United States Patent 10,329,575 (REGULATORY SEQUENCE FOR PLANTS) - sequence listing, part 8

SEQ ID NO: 8762 - DNA, 3000 bp, Unknown
  misc_feature (1)..( 3000): cDNA_ID_3043463_gDNA_ID_1971876_Annot_ID_176728 3000 nt of promoter + ATG
aaaactttagtttctcttataactatagtgaacacttttggtcaggctatcagattcgcatgtctaggcttgctgttaaatgcagagaggaggggaaagacaagtttacagtgtgcggagactagggagctttgcaagtgactcaggaattgctccagtgaactgattgtcctctaaatgtctgcctcatcccacaaaacaaaacggtaagtccaataatctaaatctcttgcacaacacttagaagtttggttgcaaaaaggcatacagagtttccaatctcgtcattggactcaaatctgggatcggtcctgtgagcttgttcttccccaaccatctgcaaatccggaagttgcagctgagtcttatttaacaaaaagaaaaaatctcagacaaaattttaggatgtgaagtccttacagatctttaagggcagtcatcttgtttatgcttggtggtagagacccagatagtccaagatttgtcaaatttctagcaagagaaccaggttcttggagatttagacttagtaattgacgacagctgcataaaaagcttcactagagtattgagttttgacttacagagaaatcactctggcgattttgtctttggagcaagttaggccagtccacgagttagcacgagggaggcatgggtcgccggaccaatccactggaggcttcatgatgctctctaacagatcttccatagcaattgctgcagaagagaatgtttttgttccagtggcttcagttattacaaaatagacaaaaacatgaagaagaaggaaacatttacagtaccatctttaatattagtggttccaccaagaggaagaatttgaaacacttctccggcgttaatgaaaggtccaaccggcgcatccttggccggagtcaatgtgatctgagtctgacccgataatggccactggccagagtaaaccataaccccattagtgctcacattgagcttccttaaaaaggaaagtccattgactgagacatcaaaagccctccagctcatggggcctggactccgattgtcctgaaaatacaaagctacatagtactttgtggccggaagaggaaaaggtggccattgaagctctagaggcttccctttacttgctgtgaaaccttccacaaaggcttcagcaggtggaatgttccagaagtttgacgggttaattctgcttcgagaagtcaccgtcagatgcttctggtccgaaaacggttgccataaacggttgtatttgtcatctggatagctaggtttccaacatgtaacataccatcaaaagtcaggcaagaaaaagtgcttttcagatcaccaaactatggaatcaaaaagggcacctgatgatctccccatctcctccaaagctgttcctggctatgaggctgagcttgtaggacccgaggtctgtggaattgtacattgtatcttcaagagattggacatctaaagacgatataaaaggagaggaagaaagggtatgtgcattcttggctagacaaacacttagtctgttcccaggaacaccaacaatgatctcgtaataagaactctgacccttggcgtaatcctctgacgtattcacgacgctccattttgtgcctccaatgatctgatcaaacacaggtgggttgtttttaccgtcaaagttaccgtagtagtaagtggttcgaataaggtacttggaggtctttgcgacagggaaattataacagtgttttcgcgatgacttgtcgggaaagtaacgtagtgtggagaggatcggaacgaggtctttttgcttaatggtcgtcgtatttcccacggaaatgaatccttcgtccggtgtgtattctatctcgttgaggtttgttgaagaagatgatccacaatttaagaagaaacctttcacatggaatgaaactcgacgttttagggtagtctataacaattgtaagcatggattcaagagtgtttttggaaattctgtaaatggattatcaagattcgatcgaaaatgtaaaaaaaaaaatcagaaaaataataaataagaatcgcaaaaacgaaatttacctcgaggaggagggagagcgtgagagatggagaagcataataagagaaagaagaacagagacattattgtgacgtattttgttgaagaaacagacaaagaagaagaagaagaagatcagattctttccattgtcgttaatggagatcatacaaagattgaaagtagagaaaatgtctgaaaaatgttaatttcttttttttgcaataaagttaagagttaatttaataagacatacaatatagaataagaaagcgcctgtagctcagtggatagagcgtctgtttcctaagcagaaggtcgtaggttcgacccctacctggcgcgtttttattttggccttatctattatttttcatgtaaccttttctctgtgtttcatactactttcaattatctcgattatcatctttttatacgtgaataatgcaaaaatatttgtattttcataggagagtttacaaccttttctctttgtattttcaaatgtatgaatttaaaaatattttaaatgtacaacctttgtaacaattaaatatataaagtgaaagattattgtgagttctaataagttttaacaatagtaaatggttttttttagaacgactctgtctgcaacagagtgactcggagtgaccaacgcgtcctaaaagcgttgcgtcatgttgaagcaaacccaactttattccgacgctaaccaacagattcacgaaaccctataaatacttagaaatccctaatcctcctctaaatccctaacttcttcccctacactctctcacacaattttctcgagaaattttccaatttcctttcgatttcgcccagaaatttcggtaactttcagattctgttcagaacgaagaaacttgttatttttggctacttctctccgattctgttcttcttgtagtagctgatcgcattcc

SEQ ID NO: 8763 - DNA, 3000 bp, Unknown
  misc_feature (1)..( 3000): cDNA_ID_1450412_gDNA_ID_1971876_Annot_ID_176732 3000 nt of promoter + ATG
tttaacgacggttttttggtctccaatcataattagcttgtattattttgtttttttttctttgaataatttcgtacacaatctaaatgagtgtgattcataagattatagaaatgttggtctaaaacatttgttttcattccgctcggatcagttgtattaaccataaacaactcaaaaatattgcattgtcaatcataatctcgtgaatcgcatataaacttgtaaacgataaaagatatttgaatctattatacattttcaattaaagctattcgatgtaggtgataacaaaggaaaaaaccttatgtagaattacggtcgtcgtattatcataatcgcgtatatttaagaaaaatggttgccgttgcgttatggaagtctccagatccgaccaactagaggaaaaaaactgaaatgtgttgttttccactaattttgtcctttgttgtgtccatacgatctcaaacccttaagaattagatcccccaaaccaaaacagtaacacgagacgaatcacctgatgtcacaaccgagcgtgcgtcccacgctctttggcaaggtttccacgtgtcagttttcctccgtacggtttcggacccatttgttccaccggaaacgacgggtggagagaggttcccgccatcttatggtaatcggaaaatgagctgtattgcataaaaatgagtcccacaaagtgtcacgtcatcacgtgaacacaatgcgccgactccaccagattatttcttcccctctccgcaaattatttccattttcgttgattttctatttctttttttagatcacccaattgacggcaactaccttcttaaccacaatttttttctggcagccatcgacttttgtttcgtatttaaaagtaaaaagatccatttcaaagtacaaataaaaatcttatcattccaacgtataatataacacaacttttaaaaacattatgcatgacaagggtctattacgtaaggcatattattgcaaatgacaaccattttggccagtttagaaaatgtaccagaaaaaacatattagaaattttatttttgttaacttgtgatatagttgtgataaacgttagcctataggtttaaatcagacggagacaattggtaagtgtaaggcaccgccaccgactttgtcctcataggtccatttcatttaccctcgtaatatttcattctaagattgtgacaaatatgcgtcagttttcatttgatcattgatatcatacatgtattcatctaaaatatttactagtcttaaaaatatcatagtttttttttcttatatataatgaaagatgttccaaacctttttgatgtatatatacttaagagttacattcattttatttcttgggcataaagatgtacatatattactatattattcactagtgtaaattacacgatgcaaagttttgatttctgacattgatatgtaatttagtggtttgtaatattattgatgtgtcactagtcgtattcgagtttgaaattatgatttatgcatatttttaaaagaaaagaaataaagcaatgtaaaatacacgactaatatatttcgtagtaactaagattatttcagtcaagatatttccgtataaaatgtattaaactcgaacaaagaagaaactactagatcaatctctaaagaatgctacacaaattgggcaacgtcaatcttaggttatgttactaaaagtggcaaatcccatctagaaagggattatgccttgtaaggaaatactttgtcacgagcaaaatgccatgttcttttctagatctcgatatgtaagcttcaaaagctattgatggctaatttgagatccattattcaatttgtactatacgtaattaagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttgtgtatgtttttgttccctattatatcttctagcttctttcttcctcttcttccttaaaaattcatcctccaaaacattctatcatcaacgaaacatttcatattaaattaaataataatcgatg

SEQ ID NO: 8764 - DNA, 3000 bp, Unknown
  misc_feature (1)..( 3000): cDNA_ID_3043469_gDNA_ID_1971876_Annot_ID_176725 3000 nt of promoter + ATG
aatttgacaaatcttggactatctgggtctctaccaccaagcataaacaagatgactgcccttaaagatctgtaaggacttcacatcctaaaattttgtctgagattttttctttttgttaaataagactcagctgcaacttccggatttgcagatggttggggaagaacaagctcacaggaccgatcccagatttgagtccaatgacgagattggaaactctgtatgcctttttgcaaccaaacttctaagtgttgtgcaagagatttagattattggacttaccgttttgttttgtgggatgaggcagacatttagaggacaatcagttcactggagcaattcctgagtcacttgcaaagctccctagtctccgcacactgtaaacttgtctttcccctcctctctgcatttaacagcaagcctagacatgcgaatctgatagcctgaccaaaagtgttcactatagttataagagaaactaaagttttgacctgtaacacgattgcaacatcatcataactagcatcatcattgttgatgttaattgttaatctgcaggtccatcaagaacaacaagcttaaaggtacaattcctagtgtactcctccagagaaagggcctaactatccagtaagaatcataaccatgttggtaccttaaaaagaaacaccatttttcataagcattttgatgtcaaaaaatatccttacttgttgtagggcgtctcctgagaacatgccaagcacaaataataccggccaatttcgggttgctaacagctgattcaagtgctcgttaatgataaatccgattctataaactacgcggtcatctttcatggcctcgaaaattgaagtgcacagatgtcatggagaaagggttcgatcaaggaagcatctgggaacgacacttctacttttgtgagtttcttctagatgaccgtattatatccttccaaatcatggaatttaagtatttatctgtttatgttatcgaaccacctttgaacccgtagagtaacttgaaccaagaggtaaagcacacaaagataattaaatggatcgtgttacagctatcttttctcttgatgtacataagtcagactgaaacagcctaaaaacacaaacaattcctgcagttcgtggtgtctcgaggtctgatacatataaaacagaaattgcctatatggggactattggtgaaagaagaagccattatctgagcaagaatcagtagtttttgtctatacctccgatcagcttgtttgggccaaacatcccaaagaagcacttatctctcttctggttatagttttgtacgtgcaacggatacacttcaataacgaacccaagcttacatgcaaaaatgggccatattcaaggtcaagatggttcattatccaaatcttccatcacttcaatgtccgtccgagatgttatcttctgcacatatcctgcaattagtttaaacttcttaagtcaattgcatgtaaaacactaaatctaaaccaaactgcaaaactcagaaagtgtggctttgtttactttttcacaaataccaatcaagaaaccaactcatagatactctagaatcttaaaactatcataggaaaaacatggaaaaagagccacactcagaaacttacctatcccttggcagggtatgcatttgcatataacctctttaccccttttcttgtaatagctgacagttccagatccttggcaacttctacactttccagtccattcataaaccacttcccggcaatcctaaaaattggtcgggttatattgtgatcagaaaaaacaatcccaaaaaggcattctaaagcaaatactgcatcaaaaagaaaatattgcctaaacacacccaaaactggggtgaagagtaactcggagcaaatctttccgaaaaaggataattcatgtcaaaatttaattcctatcttatatcgacaagagcttgcatctatatttttcatgtttttgacacacatgcttttataaaataagtccattgttgagtttcacatttcagaaacatcattcaccttccagaatctaagcttatcgctccataagaaagaccaattaaacttaatgtcattcgtcaagctacaagatcaactcatatatttgtgcatattgattggttcgaagattaaactatagagcaaatcaaacagccaatcgtcagctaaagcaattaaaatgttcatctaaattaagtgcaagtatgttgagtcttattcaatcatcaaaattagtaaatgaaagttgaagcaaagcaaaaaacctcgactacaggatcacattgcaacctccggtcaatcacatccggcgacacaggggatgtatcaggataagtcataggaagaggaagcgcgtcgccatcatctaccaagtaactctctccacttttcgaccagagcaacctcctcttcctccacttagcaccttcaccattcccaccggcggcgacggaaacatcccgagacctcgccgtgtcagaggttgaatccgcttctcgaggtaatcggattccgtcaccaaggggaatatcagcggcggcgcggcaacggagggagcgagaaggaagacgaggaaggaaaacgagaggtctgtgagaaggcagagagcaattagggtataatcggaacattgagacgagaagtttgcaggtgcggccatgaaattgggtgaagtaatcaacctcgacgaattaaaaaaattcggatatttttgtttttgtgtgtaaatacttaaaaacttggggaaaattacaaatttacaatcttcatgaaactaactgttaggaaaaattgtagcgtcccatatactctgaaggatattttagtccttttctgataaggttattttatttcaaataatttggtttttctttgtttttgtttttggttttatttcttgccgccaaaagagttttaggattggtcaaaagcggagctctgggctcgtaggtgtaacgaaaatg

SEQ ID NO: 8765 - DNA, 3000 bp, Unknown
  misc_feature (1)..( 3000): cDNA_ID_3052858_gDNA_ID_1971876_Annot_ID_176720 3000 nt of promoter + ATG
ttaatttgacttctaacaaaccttgaattcctcaaatgtcagattaggaatatcttttggatcacctccactgtcaacaccatatgtattttctggggataaggcctaataaaagtgaaaacagtagtagctgatttcatcagaaccactatatcaaggaaattcaaatatgtctcagattatctaacaaggtttttgttccaagtgtccaaacgactctttcatgatggctatatcatttagttgattaataaggtcaaaacccaagatcaggttaaaccaacaacgagaaacttctagttatagtaagcaaaacacaatacttgcctgttgagcaattcgccctaaaatattatcaggctgtgaatagacccctttcatctcattaaaaacaacacctgaaatcaaacatcaacaatgagataggatgagtgggtatctgaagtagctgataaactaaaagatatcatcgatactaagaaaagtagaggaaaagagctctaaaatggaatcctaggtaaataaaacctttgtaagatatgtcttccgagggatcattaagttcatagtgccagccctcttgctgaaaggtgtgagcgtcatccacacacttggggaagaagacagcatccaaatatacatcgacaagattgtaaaaatcctaccatagatagtgatagtgatgagttgtgatcagaaatagactcactttagataacaataacagaaagaaagaggttagcccactgaggacaacaaaagaaggacttaatgtttggctcattgtacctttgtattggtggaagcaactgggtagcaggtcctatcaggatatgtgaatgcatttagaaaagtatgcaaacttcccttgagtagttcaacaaatggctcttttaccgggtactttcttgacccacatagaacgctatgttccagtatgtgcggaatgccagtggaatccttcctgcattaacaacgaaactatgatctaaaattgcttccattattagtttttgcaagtctttcacaaggaggtgcctgtgggaccaatatctactgaaagtgcagttgctcatatcgacttttaacaaagcgttaagtaatttgacaagttgtaacctccaaaacttagaccactttacaagtaccaatatattagaagaagaaacgaaatgactaggtctaatcagaaaaaaaaagctttgatgagtagagataaacttgaccatttcaattagttaaattcaaggagtgaagctttaggtaccaatttcaattgcctaatacatactcaggtcaaatttacagagagtaaaaattattatgaagtaaacttacggaggagttctgaaaacaacaccgaagaccttgttctcatcctcatttgacacagacatcacctcgcaaccagttttcttgtgtttgaagagtatcgcctttgatttacactctgagatgaattcttccgacactttttcaaatccaagcttctcagcctcatcttgacctacatctgaatccaaacaaccaaaaataaggaaaatcacgcatcagcagaggttacacatggctccatttgattacaaagtagacacaaagcatgagatgaaaaatgcaccacacggaccacacctatctacaattcacaacctatcctaaagtaagaaccacaatttcacaagtgccacaaatcaacatgtccgaattaagagaacaaatcaattagcaattaaacttcaaacagattgaaaaaaagaagtatatgtgaaaaattccaaccaggataaagtggagcgggttgtgtggcgacggcgcgaacagagaggcgagagaactgcccattgacactgcgaactgcggcggagggaatcctcaaacctcgtcggagcaaaagacgtctaccggcgactgagggagaggaaattcggcgaagattgcgactggggacacggagagctgccgtcgacgatgtgagagacatgtaagagcgagggaactgacgaaagaagcgaaagaatagagaggacgagctgcgcgaagctaaacaagagacggttcggagcatagctaccggaaaaaaaatattcccggcggagactgctactgacggagacgaaattaaggatattgcaaagaagctaaataaacccaacggcaagaggttttatccttgtgtagttgtgtgtttttgcttgtagaggaaaaaagtaaaataaaataaaatgaaatacctcatttcttgtacaacacacaaaattattgtgaaaaatattctctattttactaaattggcattttatttttctgaatttttaagtcgggacaaaaaagaggtgctgatttgcaagaaaggaaacgtggttctcatatagccaaatgtgtttgagtgttgcaatttgctatcctccaaaaatataatgactacaaaatatcttaaatcttttttcatgatattaaacttaagtgaaagtattacaaaatctgatcaagttaaaagtttacaccagacatatactttccaggtatttgattcagaaaaaatcatattgatcagatttaaacaaattttaaattatatataagttttttcttacacacaaattaaacctttgatcagtactagactactggtagcatgcgatgagcttgcagtagtttctctcgcacattagttatgggccgagagctaggcccatgtccagggacggataaaataatcttccagatgtttctttattatccacgtggcgtgatcacgtgaccacgtctcgtctcgtctagtcctagattagcagagcctctctttcggccagcgggttaccttattatcgtcacaagacgaaactttcagaaaaaggcaaaaatcactgtcaaaactcaaaagccttgagaccaaatttccgattttttctcctctgaagaaatccaacaaattgtaccatgattccagcttcactctacttcttctagggttcgttcgttttctggagctgttgcgca

SEQ ID NO: 8766 - DNA, 3000 bp, Unknown
  misc_feature (1)..( 3000): cDNA_ID_3043507_gDNA_ID_1971877_Annot_ID_176758 3000 nt of promoter + ATG
agaatcgtgaaacagatgctgatggatctcttaacgatctgattgagtctctggagagaaagaagaaggttcagatagctcaagtagatgaacacaaggaatatagtaataagatagttgaagcatttcgcaagttattttaagcttgattcatgatctgattcagtttcttttcactattgttgtcgagtcttaacataaaaattcacagataagtaaacttgtatcgctgcacagaacattgatgattaattaagttagtcccgtttggtttacctgtgtagattttctagtcagtttcaagatgactgcattctagtgactcttagactttctccaaagctctcctttggtgttgaatcaaagcatcactctgaatcatctcctcatctttcttgaaaagatcttccatctcgattcaaatgacgaagctgcagaaactaaacaagggaagctttcatcatccataaacatatatacattcacaaggcaatgttcaattcttagagatgaagaaagatggtaccttgacttacagaatgcaagcacaaagccatggtcttcctgtacttgaagcttttgcaccacctctgatttctccatagtgctgctttaatctaaatcaacaacaagctctttacttttcaaattccttgaaaactatgaatcaaaagctcatgccttaagcagaaacctcaatgtaaccaaaaagctcatgcctttttgaagcagaaacctaaatggtaatcaaaaagctcaacaagcactttgctttttagattccttaagatctacaagtcgaaagctcgtgcctttcgaaacagaatctaccaaaatccaatttatattcataagcatgaagggagaagagacgatgacgaaccggcgagcgaaatccgacatatgttttgatgggttcggtcgtggagagaatgagataaacggaccagaccaggaattagatttggggatctcttgcgattggatgcgaagaagaagatggactcggaacttgggtttggaaagttttcaaatttttgaaacccggagctttagagttgcagcaatggggaacgtcatcacaattctctcgccatcttcatcatcttccccataatcacatacgcagaataattcgacttgcaaaaccaagttgaaccgaaccgaaccgaaccaaaccgaagctgaaaatttaattggattaccggtttggttgggttcggaattgatttggtttaagctctgctataatgaggtatgtttataccaacaaaaaaaaggaaatacaacaatatatgaccgttaaaacatgcttaaagtaaaaaacaataaggaaattagaaagaaaaaaggaaattagaaagaagaaaggaaattaggttaacgcgttacaacaaactataatcagaaaattttgcttatataaacacaacaatacactttttgtgacatctccacaattacaattttctcaacaatctctcttccttacgaatcatcatcatctttcactctgtctctgatcagttttgttcaaatatcactcgctcgacaatggaaacagaatctttcaaactcgatgttcatgtacaagctttgtctcaagatcagtcgttagggttcgtaagtacggtactaatcagtcaatacagagaagtagaggaatttctcatcaacgagaaggatgatactgtcacaagtctcggatcttacccggaggattcttctactagtcacgacccactaatctctctgaaactcccaagtttcaaaccaaacgacgtctatcaacgtctccagacccatctccacgatcatgacttgtccgaacaattatcttacaagattgtccaagcccaacaacggcaaaaaagacaaagtttttacttgccacaacaacgacctttattcatgatcgtctctgtcaaattgacacacaaggtttacaacgttgtgtcttgtgattctgctccgttggcaacagatttcgaccaagagagccaacaagaagaagaagaggaatcgaagacttgtgccatctgtttggagaatttgttgagatcggaggattactgcgagatgcctacttgttcccattattttcatgaaccatgtctcactgagtggttgactcgagataataactcatgccctctctgtcgcaaacctgttgacaaactacacagttgactacatgtttactaaattagggttttcacttttatgttttacttgttaacttgtttcacgtttatgttttgtcgaagatgcagattagggtttttcatagtttatgtatctgtttttgttggcaactatgtaatacagtaatgattttatcaatttcatttacaagtttgatactagtatgcgacacatatctcttgcaacacaaatcactgacttaaaccaaatatagtttcaggagtaaactagatctgattcagtctctggagaggaagaagaaggttcagagagctcaaatagatgaccacaagaaatctagttacaagatagttaaagcatttcgcaagttattttaagcctgattcatggtttaacaattttagcttataagtttcgactctccataagtgttctctttggatgtgaattactaatattagatgacatgaaatcccattcaaatataagtactttgctgtttcctaatatgcccttaataacaatattaacaccacaaataagaaaacaaagaaacctcttttttctctaatccaaatgaaagaaactaaaaaagggttctaaagtacctgaaattgtttcacatgaatgatcttcaatccaatccttggaggtaaaatcgcagctgtggccatcaaaagatccctgtttcaggtatagccaaagcgaacgtcgatatcattttcgaattccaacatgaatgttttaatgaaatttgctggaaagagattggctttaaaggattctgtatacaatttgtgacagatttttgtaattttatacaaaagaacaata

SEQ ID NO: 8767 - DNA, 3000 bp, Unknown
  misc_feature (1)..( 3000): cDNA_ID_3043496_gDNA_ID_1971877_Annot_ID_176765 3000 nt of promoter + ATG
gaataaattaatatcaaaaggggatgtagctcagatggtagagcgctcgcttagcatgcgagaggtacggggatcgataccccgcatctccacttttctttttcttattttatatttataccacctcaatgtttcaataattgtatagtttgaactgtttatttgttggaatactaatgttaaaagttttaaaaaaaaatcttgttagtaaaacttgaaataaaaattacgtgttctatattttgttgtactttattagttactttacatcttcgattaattaataattcttttgtaataataaaatgtatttttgtatattatttttttaaccaggcctttcccaaaatctccttcaattttaaaacaaccatattaaataagttgaactttgaaccaaaaacataagagaactaaactcttaattttatttcactagaccaatatcttattaataaaatgtatatttgttacaaaaacaataaaaattaaaaagataattgtcctaactcctaacatcacaagtttcaacatattgaaaaaaaactcaaattcatctcttttaaaataaagctctccctttttttctacaaaagtttatgtcgccacctactaagattatcggtttcaatggctttttcagccggggtttctttgttttagtctctctaattttgatttcttatgagtttgatgttatctgaatcttattttcttccaactatttcagatctaactctataaagtctaaatcctttattcttctggatttgctgtttattttgtctccttcatccttcatctgcagctttagttccgactgttccaaccataaaggcaggttttgtcgatccttcaacgcttcaaatacatatttttcactattaaagatctcgatttccttcctttcttcataagactttggggtaagaagagccttggttttattttctttagatagatctctagtctcagatatgtttttattttttaatttaattcggacttacacttatactttagttttgaaatctttagttatgagtttgagaaatttgggttcagtatcaatgttgttgtttttttatatataattttggatttttcctcctttggatctatctttattcgagagatatcgtttgctcgtcgacttagtttttggaatgattgttttttttgctgacatatgtatttcaccatttgtattccatctctctatcaatgaaactagtgaaaaaataaataaattaactcctcacatcttgttgagtataagagatagtcatttagttggtaaggttccatttccactagaaatattcatggtatcgttataacgttattcaacaacacatattctagatgttagatttgtcttatattaaaatccataaacaaaacaccttatacatgttaccatcggtccttgtacgttcgccgcatatctccgacttctctccgccgtccactggtgactctacgctcactctaaaaatctgtttactatataaaaaaaactaaacaaaagagaggattagattcattggtctaagtctagagtcaagaacaccaccaccacctgtaatcccaacaagtttagttgcctaccgtttatcgttatctaaaacaccttaatgtttccacgtgtcatcatctcacaagaatgtcacaaaaaagcttatattcttctagatgtaacattagcataactatatcccaaaaaagtctaccctttcgtcttgtttattttaacctcaattattacctttttatacatataattatgggactatatatgaactgattaatactattttcgaatcttaaaatgagttaataaagttatcaacatacactcatactcgcttaaactaagatatcttaacatttctaagatctaaagaataatttggtgaaagagaacaccaaaatatatcatcaaattttacttagattatgttacaataaaaaaaaattaaacatgtcaattgtaaaaataacattaccaattattcttatttttcatagaaaaattttatgtaccaaaataatctattttaaaccacaaacaaaatacatattaaattattattccaactcttttttaatggtaagaaattcaaatacttgtagaagacaaccttgttttgtcatgtgttataatatctatatattaattggaaattaatttctgttaattaaataatattttttaaagagctaataaataatattcttacattcaatttattgcattgaattattaacatatggtaaaaagttcttacaaataaatatataattttttcgaaaattgttataaaaaaaactttatataattggccaaagattatattgaccaaatcaatcatcattaaatttctattcttgtacgcgtattttataacaatttaagtaagattagtgtaaacattatacaagattataagttttcataaaaataagatttgtaggcgtactttatttgttgcccaagctgaccaaattacttatctctcttactcaagctgcccaatctgcccgttgctgaccactttcactctctctctctctgaagatgccctttcgtagctctctagctctcacgcacgcaaaaaaaatctccccttttgactaaaactttctccaccaatttgttttcttttgttcttccttctcttctttgtccccaattaaggagctcaaattcacttctactgaactgggttttaccatttgcttttgatctttggtttctgttcgattttggaggaaaaaaggatcaaactttatattaagagagaattgggtttcgttgatcttcatctttctattgatttcattatctgggtttgatcaaagttttgttttttggtacataaatatgtgatcagagagagtgatctactctagggttgattcgcttgactttttttggtttttgaattattggtgtttgtgtgttggctatggtgatttgatttggaattagggttc

SEQ ID NO: 8768 - DNA, 3000 bp, Unknown
  misc_feature (1)..( 3000): cDNA_ID_3043481_gDNA_ID_1971877_Annot_ID_176769 3000 nt of promoter + ATG
cctgatgtactctaaaaaggtagacattggctcagtagcttggcaaagcatatgcttgtagtcatcaacaagcttgagcgtacacttctccacaattgtagtggtatgcagaggtgatggttctgcgttacaaaacaacgattcagatgcaaaaactagaaactgagactcaaggaatcaatttgtcgtctaaacatcagatttcagatccacaaacaacattttgttaacaagactacaaaatttcacatcgaaatttcttcaattcgcagattaaattggtgatttgggagagtttgaaatgcctaaaacccagaatcgaagtcaaattatcaaaactgagtcaaaattgtgagagacaatcaggaatcatcatcataacgcaccgttttggaggtaaggaccgtatttggtggcagagagatgcatcttgatatcgtctaggttctcacactgacatagattgttgtaatcggcggtggtgagaagcccagcacggtggcctctgacgatcgcctccaagtatcccccatggatattgaacgtaagcgcctcgaatccgtacatctttctctcctgattgtaagaaatttcagatctcaaagattatcgccggagatctgatctgaattctgaagaagaagaagaaatcgaagcagagattgtgatcgcgaagaagaagataactttgaaattgactggatttgtttgcaagctttaaaccagtatccctaaaccggtctgctaaatcgaagacacgcacacccggttaaatatttctctgtccaactttaattcattaattttctctttaaagtttaaattttaatttattgaagatctcagttcccatttctcaccaatgaaaaaaataaatgaggaatcgaaaaaaagttaaaaatatgcaaaaaaatatgtttcaattgtgaactttagaacttccaaaatatcatttaaatgttgagattgttatcgactttaaaattaaacaaaagatagtgttatcggacagtacaactctacgtacctatcttttgataatatgatctaaagtatgatatctagagaaatatctttccatgtacaaacgccttgctttggtcgactcgacttctttcatctcttcatatctagcttctcattttaatgtacctgagtgatattacggtaagtttgcaagaagtatcaattaaagagtccataagaggtctaagatagaatcttacgattaaatacatttgcccatataattaggattttagctagtagagatttctaaaaatatgtgtttagaacatcaatataatgcattttcctttcatttttataaaagtattaatcttgaatcattatgttcttggtggcaacctaagttctttcatctctttacatttttgcacagtaaaactctaatgaactatttcaatttgtagaattttctatatcattatattcaataaatttttcttaaatttttccaaattctaaaataaaatatctttgatcgaatatgttacctgaaaagttcaaactacgtttaaataaacgattgagctatgaaacctcttttactatgcccctgaataaactaggggaattaagacaaatagcactaaaaactttattattccaaaaatagcatattcttttgaaacttccaaaaatagcatataaagttttaatcctctataaattaattaaataataaaagtttttttattaccatttgtatcaatcctccaaataaaaatgagagcaaatactaatctaatattaaattgaatcaaaaaacttttaaatagtagaaatatatactctaaattggaaataaaaaaacccaaatataatattacaaactaattttaaaatgaaaaatctcttttaaatggtgaaaatatataccctaaattggaaataggaaacccaaatataataccataaactaatattaaaatgaatcaaaatttcttttaaataattgaaatatattctctaaattggaaatagagaacccaaatataatattttaaatttatttctaatttattttggttgaatagattttatataaaattgtagtattattattgtccataaaacttattttagtgctacttttaggaatttctcaaataattatttaagtgctatttatgtctaaaaaactttttcatgctatttttgtccaaaaaacttaaaagtgtgctatttgtgggagtttctcaataaagtattaccgcttctttcataaaactaatcttcaactaatttattattcatttctacttaaagtaaataaaaaataatgacaaaccatttttagtttttcaacaccatcttaatacaatctacgattttctagaggtccagataaaagaaaaaatgtagataaattcacttttctatgagttgaatcacataatctatattaccggtaatctaacacaattttggtgttctctcaaaacatataaattcgaatttgcttatccaaaaaatatcccaagcattttgtgttttgtgttggatttatttcacatatttttttgctacgaataaaaatatttaaaaaatgtaaatattccatataaataaaagtttgttgtttttcacatattagttttttatttatttattaaagataccatttggatatcaagatatttgttgcatctggattttaaagtatcagaattttattaaagtactggatttctgaaattctgtctttatatttatttattatattatatcgataaaccaaaacaaatcaaagcaaaattgagagacgaaaataattttgcagcgtacattcttcggtttaacacaccggtttaaaggacacaaccgtaattaaacgtgccaacacgagtttgcaaacaaatccaatcaattcgaagctatcttcttcttcgcgttgatctctgtatcgatttcttcttcagatctccggcgacaatcattgagatctgaatatcttacgttaaggagagaaagatg

SEQ ID NO: 8769 - DNA, 3000 bp, Unknown
  misc_feature (1)..( 3000): cDNA_ID_3043477_gDNA_ID_1971877_Annot_ID_176770 3000 nt of promoter + ATG
agtagcttggcaaagcatatgcttgtagtcatcaacaagcttaagagtacacttctccacaatggtggtggtatgcagaggtgacggttctgcattagaaaacatcagattcagatacaacaaactagcaattgtgcagacctcaagcacaacaacagtagtatttatggagatacaaatacagtgactcaaggaaccaatgtatcgtctaaccatcagatttcaaatccacttaataagatgaacaacatttctaataacatgatttccaaatgcctaaaacccagaaacctaaacgcaatgaagcaaaattcaaagtcaaatcatcaaaattcgtattacaacaactgagtcaaaatttgagacaatcagggatcatcataacgcaccgttttggagataagagccgtatttggtggcagagagatgcatcttgatatcgtctaggttctcacactgacatagattattgtaatcggcggtggtgagaagcccagcacggtggcctctaacgatcgcctccaaatatccgccatggatgttgaaggtaagcgcctcgaatccgtacatctttctctccttaacgtaagatattcagatctcaatgattgtcgccggagatctgaagaagaaatcgatacagagatcaacgcgaagaagaagatagcttcgaattgattggatttgtttgcaaactcgtgttggcacgtttaattacggttgtgtcctttaaaccggtgtgttaaaccgaagaatgtacgctgcaaaattattttcgtctctcaattttgctttgatttgttttggtttatcgatataatataataaataaatataaagacagaatttcagaaatccagtactttaataaaattctgatactttaaaatccagatgcaacaaatatcttgatatccaaatggtatctttaataaataaataaaaaactaatatgtgaaaaacaacaaacttttatttatatggaatatttacattttttaaatatttttattcgtagcaaaaaaatatgtgaaataaatccaacacaaaacacaaaatgcttgggatattttttggataagcaaattcgaatttatatgttttgagagaacaccaaaattgtgttagattaccggtaatatagattatgtgattcaactcatagaaaagtgaatttatctacattttttcttttatctggacctctagaaaatcgtagattgtattaagatggtgttgaaaaactaaaaatggtttgtcattattttttatttactttaagtagaaatgaataataaattagttgaagattagttttatgaaagaagcggtaatactttattgagaaactcccacaaatagcacacttttaagttttttggacaaaaatagcatgaaaaagttttttagacataaatagcacttaaataattatttgagaaattcctaaaagtagcactaaaataagttttatggacaataataatactacaattttatataaaatctattcaaccaaaataaattagaaataaatttaaaatattatatttgggttctctatttccaatttagagaatatatttcaattatttaaaagaaattttgattcattttaatattagtttatggtattatatttgggtttcctatttccaatttagggtatatattttcaccatttaaaagagatttttcattttaaaattagtttgtaatattatatttgggtttttttatttccaatttagagtatatatttctactatttaaaagttttttgattcaatttaatattagattagtatttgctctcatttttatttggaggattgatacaaatggtaataaaaaaacttttattatttaattaatttatagaggattaaaactttatatgctatttttggaagtttcaaaagaatatgctatttttggaataataaagtttttagtgctatttgtcttaattcccctagtttattcaggggcatagtaaaagaggtttcatagctcaatcgtttatttaaacgtagtttgaacttttcaggtaacatattcgatcaaagatattttattttagaatttggaaaaatttaagaaaaatttattgaatataatgatatagaaaattctacaaattgaaatagttcattagagttttactgtgcaaaaatgtaaagagatgaaagaacttaggttgccaccaagaacataatgattcaagattaatacttttataaaaatgaaaggaaaatgcattatattgatgttctaaacacatatttttagaaatctctactagctaaaatcctaattatatgggcaaatgtatttaatcgtaagattctatcttagacctcttatggactctttaattgatacttcttgcaaacttaccgtaatatcactcaggtacattaaaatgagaagctagatatgaagagatgaaagaagtcgagtcgaccaaagcaaggcgtttgtacatggaaagatatttctctagatatcatactttagatcatattatcaaaagataggtacgtagagttgtactgtccgataacactatcttttgtttaattttaaagtcgataacaatctcaacatttaaatgatattttggaagttctaaagttcacaattgaaacatatttttttgcatatttttaactttttttcgattcctcatttatttttttcattggtgagaaatgggaactgagatcttcaataaattaaaatttaaactttaaagagaaaattaatgaattaaagttggacagagaaatatttaaccgggtgtgcgtgtcttcgatttagcagaccggtttagggatactggtttaaagcttgcaaacaaatccagtcaatttcaaagttatcttcttcttcgcgatcacaatctctgcttcgatttcttcttcttcttcagaattcagatcagatctccggcgataatctttgagatctgaaatttcttacaatcaggagagaaag

SEQ ID NO: 8770 - DNA, 3000 bp, Unknown
  misc_feature (1)..( 3000): cDNA_ID_2105868_gDNA_ID_1971878_Annot_ID_176773 3000 nt of promoter + ATG
cgagatcctctaaaactgacaaaaatgagtttttattgtaaccctctgcctattccatattgctttgtggaaatgcttcattggatttgattctctcgaataccaacatttaagtgcaattttagtggcagtggacatatatgcgcaagtgtgcacatcttctcggcagtggatgttacagtcacttttcgagagattttcagttacatggccttcctcgatcgatgttttctaatcgttattgtgtcttctcataacaattatttcgtctagtattgctttccacctacaagctggtggtttttactcatctatgatcgatttgcttcttttcaacttaacaagtggtctttttggcatgcatgtacagagttttggaataattcatccatccattcttctttacaatatacacatgaccatgaaaaactacattttctatatcgtctattctggttctggtacaagagttcattatgaaacttctacaattctttcatatttctctatgttatgatcaacaaaaaaatttgaaacgacgacattagcattggcatgcacatgtcaaatagtaaacactgtccgatcccaactattattatatcaacaacaagttttttttttttttttttctcaaaacaacttttgtatttacatttgctaaaaacatcagattatttggtagatagaaatgtgtgattcattctttaccgcaaaaggttttgaaccgtatacgaagaatccgcggccttggccgaagaaggcggtgaatgaggcagcctagcggagaagttacgtagcggaaaacggtcgatattgtcatcctcatctcctttatcaaagttaagcgcatagctcgacggatcgtaatgaaagtcagcagtatggcggcgaatatgcttcccgtgaccgccaacgccacctactccaccgcccattcgatggatcagactcttacatttttcatgtgacttggacaacgtcctagtgagtcttggagatttggtcttcattccaccaccatgtgggctttgtgtagatttctcggtggtgaccggggatgatggtaggtcgtcgggaatgttgtcgtggtggtgatgattggtcgtacgaaaacatccggcgatgcaaaaccttgatttgagtttcttttgtagagacaagttggtcattgtttcgcttcccattttttttttacaaaaccaatgtttgttggttagatcaacaaaggaatgcaaaagagaaggaagacattgaaagaaagatcaaatctgtattagaggaaagaaaaacaaaacagaaaacaagtgatcgacgagatatttggttgattttcatttattattttttcttgaaatgaactgtttaaccaaaacttcggaggagaagttgaaattctttactattttaggaatatttgaatttccaattaaaatgaggttcaattttgtttcacgttaaatattaatgagtcttttgactttgtgagcaaggggggacatatttagggtaggaaaaataatatttatagtaatttattaaattagttaagattataaagttaaaaggataatatgaaaattttggaccaattttgatttgtgaatatagtaacggcatagctaaagcctaaaaacatttaatattaaaagacctcattggattttattttctcgactgtcacatttttgttttggcagaggtcttttatccatgtaactctattcagtatccacaaacagttttggaggatcaatatgggccttagaaatgaattaagatcatacttcactagagaatgtgcactcaaagaatgtgttgcgaggtttcatcgttaaatttgcattaaaggtaaggaacttgaagatcccatagcaaaattccatctctttggtgaagtcgttgtctagttgtcaccgaagctataaaggcatacttggaaatccttcatttgaaccaaattatttgctgccaggctgccagcagtgcctgtcttgtgaaaaatgaggctcaaaataactttttttttatgggtttatagaagaattttttttttttgagaccaaatcttaaaatgttatgaaaatgaaacctatgtattcaatagaaaatagataaaaattaaaaattgagactaaatctaaaaaatttagaaaatgaggcaacaaatatttttgaggtataattttgatactaaaaaccttaaaacttttggtggctcaatacccatgtttcttagaaatatgtcatgggccgggcctgactgccagtcaatggaaggaccatgagggtgtagataatgctatatatttgagattgtaaatatagctgataaactatatttacaacgaaaaatatttaaattctgacttagttaatgtaagtttaggcataatggaaacttttgtttataaatacgataaaataagccgtgggaaaatcgttttcgcactttcgctttaaacttttactcataattggtttgaaatttaaatcaatgaaaaaactaagttaaaactttaaattgcttcaaccttagttggttttttgtaagttcttcttatttttttcttgtttatgttagatatgatttttcatcaataaaagtagacgttaaaaaaaaaaaattacaaatcatttatataaaattgttgcattttcgaaagaatttttttatagtttccatttgatttttgtttctagaagtgtaataagaaaataaatccacttttaagttttgatgaattggataaccggtttgaacgaaacctggttttgatgaaatttttcccgacactgtaacacgataattagatttgttgagttataacattacgtgtcgaattttaattggatgtcctgcgtggccgtcttattagtcacatcaccgcagctaataacactcgacgagcgacctcatcgtctacatcgccgtcgcctgttaccgtccggtgctattctccttcacaatctcacatttttcgtaccggttagaagatg

SEQ ID NO: 8771 - DNA, 3000 bp, Unknown
  misc_feature (1)..( 3000): cDNA_ID_2730189_gDNA_ID_1971889_Annot_ID_58452 3000 nt of promoter + ATG
ttctctgttcattgttgcttttagagcttaattcatgttcctgagattcaaatttgcaacctttttcccacttatgtaagaaaaaatggctttttatatattcttcattcatggctgtgttgattaggaatctctaatctctatgtctactgttagattaattgtttggtattgatactcaaattgcatatatttaggttcttgcattggttttttatagtatcttttctgcaactgagtctttgtatttaccaaaaaaagaaaaaaactcaatctttgtggggaacttaaaggtggcactgagtaatatttgaatctcattgctgcagttttgtcttgaggtttatctggaaaaaagatggaagtttgcggggatctgaaatctgataacttaaagaaccgccccttgactccgcttaggattctgaggggcttgatgatcctgctggtgtttctgtctactgcttttatgtttctgctgtactttgcaccaatagctgctctaggtctacggcttctgagtgtgcaacaatctagaaaagttgtttcgttaatctttggtctctggttagctttgtggccttacctgtttgaaacggttaacgggacaactgtggtgttctctggagacatcattccggttgagaaacgtgttttgcttattgcaaatcacaggacggaggtggattggatgtatctgtggaatattgccttgagaaaaggctgtcttggctacatcaaatacgtgctcaagagcagcttgatgaaattacctatttttggttggggctttcatgttttggaatttatcccggtggagaggaagcgggaggtcgacgaacctgttttgcttcaaatgctttcatcttttaaggatcctcaagaacccttatggcttgctctattccctgaaggaaccgatttcacgtactatatgctccctatctgatttaactgctctagatatattagctaatacattattaatctgaatcttcgaagatatctttcagtttctctttggtaggatatttaacaccatgcgcatctgtcttgcaaatatcttaaaccagtcaccctcatttacaataatttgcctgctattgcatgaatgtttgaaatgctgctcttagtatatcttctttctattactgagaccttccttatttgatatgcagtgaagagaaatgcaagagaagccaaaagtttgcagctgaagttggtcttccagcactatcaaacgtacttctaccaaaaacaaggggttttggcgtttgcttagaagttcttcataactctttggatgcaggtatggttcatgaaattttgttacaaatgttggtgtacatatagtagtatctcaagccacatgttatgcaaacacttatgtgttttgacgacattatgatggcgtgcatatcttctatttttccaatgacccatgtgggacctcatgaccacaattaactgaacaaggcatttccttttattgcaatgcagtatatgatttgactatcgcatataaacctcgctgcccatctttcatggacaatgtattcgggacggatccttcagaagtacatatccacgttcggcgagttctactaaaggagattccagcaaacgaggcagaatcttctgcttggttaatggattcatttaagttgaaggacaaactgctatccgatttcaatgctcaggggaaattccccaatcaaagaccagaagaagaactctctgttctcaagtgcattgcaacatttgcaggggtaatatctttgacagtagtgttcatatatctgaccttgtattcacatagctgtttcaaagtatatgcttgtctaagcggcacatatttaacttttgctacatattacaagttccaaccctcacctggctgttttagagaagattcttgtaaagttaaaaaccattaactttgttgtaaatacaattctttctttgtatacaaagaaataatattacaggcagaaaatatctctgggatgcctttttcattgtaagttctttgatcttcagttagttaaaattgtattccatgttgttctcttgaaagttgaaactcacatagatagtttgtgtagtctttagtcacattttggttatgtcaaattgtttgagtcttgcaagtgccactgttagcacttttcattcaaaactgtcacggagcaaacagaatttggaaggaaaagttgatatgttggaactgtagaactcttgtgtttattgagttagaaacaacaacaggtcactaaaccatcttgtcaaaaggtgttcttacttctgaatcagtcaagtaaaggaagtttccatctgagcaaaactttgtcggtgatcgacaaagcatagtagaacccactttgtcccaaaagaatgttaccttctttttgcaggtgatgaaaaagagagtaagaaggccgttgctcagcaccctttcactgatacattggatcatctttttcaggtagagcatagcatctcctgttttctttatatgcatatctataacttgtccacgtgtcatcttatctctttatatgagtaggtgcagatgagctcaggttagttttgactaaaccaactttcatgaactttctttacttttttggttgggaaagatttgagaggcacaaaacaaaacaatgtctattgatacatttctcttaggacaatacaagctcatgtagaattgtaattctatatctaaccacacaaagacacatgtacaattgtaatcgataactatgagacataatcttctttttattaacgcaagaaaaaaaaaatcatcaaggcaaataaatgttacactgacaaagaaaatgggctaacagagtaggcacagaaaattataattaattgaagttgataaccctaactttaaacctctgagtctccagcacttataaatagagaatcggtgccagagattcatcatcatccacatcacataaacacaaaatccggtttttaataatg

SEQ ID NO: 8772 - DNA, 3000 bp, Unknown
  misc_feature (1)..( 3000): cDNA_ID_4266408_gDNA_ID_1971889_Annot_ID_58457 3000 nt of promoter + ATG
agtaacgctataccacgaatccatgagacaattgttaaaaaactgaagttttaacccttcttaaaacagtatattaataatattttaaaattttataaatattgattcaaatacatccaccatataacccaattccaaaataaaacccgttctgtaatttctttacctgtcccgtgattttttttaaagtagtaatttttaaaatttaagaattatttattatatataagagttttataaattgcatcattctctaatacatttatattttatagtttaattttatatatagtaacattatacataccacataattttttggttttatataaccttttctaaattaggatgatttgatatgtttaatattagtggtcttaaaaaataataaattaaagatttaacccgtattgtgaattaattatattttacctttttattattgttgattcaaaaccccatttctccaaatctgtcttgccaaaaagccatttatttaataatattaattttatttatgatatgactctaattataatctaaatattttagctaataacataggagtgcaccatatttatttaataggagaatgtaccatatgacccgaatgcacttttaccaaaatccaccaaaaagtcttgcaaaaatactatagagataagaaacgatagtcggttttgataggtataagattaacaaatatattaattagcttaaattagttaaagagtacaaattgaaaagttatattacactttattcgaatatattatcaaaacttatataacagagagatttgataaaattgtaattgttgaatactttttttttgtgctaatttttatgtaattaagatttaattgatttcgtatataaaatattaaattgttttacgaacttatttgtttatatttggtaagagataaatatttgaatattcggtatattttgattcagtttagaaaatctttgatgacccgtctttagatccaataagccctataattaagaaatgaatattgtcgttaaatgaattttggtaaccttaataacgtcattaaaagattttgtttttgattaaatttttctaatatcattgtcatgtaattaattacaaaaattaaggttacatttcaaatgtactttccaaaataatataataggatttctttgggtacaaggtgaccaatgatcatctagaatcccgcaaccgtcaaaatcacaagttttagcgtaaacagtttatggattgtttgactttaataattggacaaatgttgtaaacaataatcactactacgtgttttaacgttaggttgggcatttttcaagtaacaatgaaactaatttatttattttggtagggataaaacaaaatttaatgcaatgttcaatatgtattagtattgtttttgatcgagtactaaaattctgtaattcgttcacttaatttaaaggtatagaatcataaaacgataattatttttggtaaacaaaactattagtcaaaagtcaaaactgacatttaatttgaattgaaaccaaggaaataaactaattttatttaaattatgttattaaatctttaaaaatcatctgataattacatgaaggaagcttggtcagccataagaagaataacaacttttttccttttttttttgttttgttaatccgttagtatataaacaacagtattcctagtttctttcaccgactcttctaatctctgcgatcgtacatcagaaacctctatctcatcgccgaggtaaatctttcagacgctgtcccttctcgtaaaaatcgaaactttgaatcaaatctacgtgaaatttttgtatttctctgcatgtttgatcaattctatatgaaaccgcgtttaagggttttagagtttttcatctcattcgttaatttcattgcatgtgtgcaggaaaaaagatcttacaatggctattaacaccatcacgaacgaagaagatgatgcatcaaacaactttggatgcaatatctgtcttgaattggcaagagaaccgatcgtgactctatgtggtcatttgttctgttggccttgtctctacaagtggctccattaccattctaaatcaaatcattgtcctgtttgtaaagctttggttaaggaagatactttggttcctttgtatggaatgggtaagccatcttctgatccgagatcgaaactcaatagtggtgttactgtccctaatcgaccagctgcgactaggactgaaacagctcgacctcgtcttgaacaaagacatcatgggtctagtttctttggtgggcattcaagttttgctgccatgccaactggtttacggttttcaaatttcttgttgtaatggaaagtatcttttgatgaatctgagtctgtttttttgacaatgtttttgaaactattattatacattgtctacgatttttgttattttgacaattaatgtttagagctacttttacattcttataaaaaatttgcatctgcttgtaatatttgattctccaatcttccgctttgtgaaaaatcgtcataagcttgttctcgtgctacatctgcagattgatcaacatgaatgctgattatagtatatgatccttaatatatgattatcgcacagatgaatttaaagcttcacatttaatcgtgtaatttggagtagatggcaaaagaacatggaaattaactaaatgacaatgatgtgatgtaaatttttgttttgaccattttgtttttgttaacatatgtaacgaatctacacagagtatttgtgttttcaagctccttgttaagcccaatgaaggtttttaatgggctctaatgggccgattcaataagttggaaagctcatgaagcgagagggaccgtgcctaatctcatcttcactctgctcgttatcttcttcctttttacctgttcaacgaaactcctgagctcagcttcactttgctcgacgttatcttcttcgttcagcgaca

SEQ ID NO: 8773 - DNA, 3000 bp, Unknown
  misc_feature (1)..( 3000): cDNA_ID_1989222_gDNA_ID_1971889_Annot_ID_58458 3000 nt of promoter + ATG
cactggacgacgtaagtgcgcaatcgctagagttgttcttcaggaaggtactgggaaggttatcatcaactatcgtgatgccaaggtaaatttatttctaatttcattatcttattggcttttacactgttgcttagtcgcttgatgtgtttgcttaggccttgaatttggagtttatacagctgagaattgactactcatatgagattaagatttgaacttgaaattggtattttaacagctaaagctatgaaagcagtccacttacccccgtttgaacatattcttggtttatatgaatatctgatacctgcaagagactgacatcatgcatagtgtgtaatcgattgaagcatttagtagtataaattgtagcagtttgtaggagagaaagtcttgacctttatgaagatattctctgttatgtagggtatactagtcttgtgatcaaactgtatctttatgtacttctttttgatagatgagttatatcagcgcgttacagattaagttgaaactggaagaactctctgaacaaatagtttatatgatgaattctaggctatttagactttagactaggataagtggctgagaaagtgatcaaactgtatcggtattagtcttgtgatcagacgttatctgtatgtagttctttgtgacctgggagctgcatcagcacgttatagattaaggtgaaactggaagaaatttctgaacaaatagttcatatgataaattctaggctgtttagacttaggataagtggctgagaaagtgttaacaaggagagattatgataaaagtttggggggttttgacaagctgttttgttgtgaatgggaaagatttgaatccatacgtatattgctgatgatgatcattgtaaacctttttcaggagtaccttcagggaaatccattgtggcttcagtatgttaaagtaccattggtgactttaggatatgagaatagctacgacatatttgtgaaagcccatggaggcggtctctcaggtcaagctcaagcaattaccttgggagtcgcacgtgcactcctgaaggtaagtgcagaccacagatcgcctttgaagaaggaaggtttgctcactagagatgcgagagtggttgaaagaaagaaggccgggctcaagaaggcgcgtaaagccccacaattctccaagcgttaagagttttacatatcattggatcaactcttcaagtagactcctctgcctccattttttttaaaaacttttcttgtctattatcggtcttttgtttcatgttaatgtttatgtgtagacgaactaatacaatctctgttttgtttgaatggaacgcaaagttgatatgcttttgtaacaaatgcacttatgaattgtgatcagacaaatgcacttctgaatcgtttatcagttagatttcaggtgaaagtgaaaactttgcttctttcaaaaggtgttcatggatagtggataagcagcaatacctgaacacacttgtatcactttgtgtatctatctaattcctttgatattgaagtagtaatgttgattttgatgggctcataccgaacgaatcagaaatcgacaagtgtgagatagtatgtatgtgtgcataaaataggctggtttagctgggaatggtgatgcgaaaatggaatgttaggtatgagagagcttacccactttgactctttccatgcatattcgcttgctcccctctttcctgcttcctctgttttcttttattccatttccatcacttaaaaacaaaacaaaaaacctgaactcttgggttggatttcaaaccaacataaaccaattctctaatacaacttggtttgatacaatattagagctacttgatgtgtgtaatgtttcgatcagtaggaaaaacaaatcacgtgtatcctatcaaacttttgattatacacaagtcaaaagagacattcattgtgtgaatttaatgaatttgaggggtctattatatttattagtcagctttaacgtatcaaatccatgacttttatcaatgttttttcttcttttctttctggatctacttcccaataccatcaccggaccggaccacttgatgatcttcctatttatgaacactactactagtaaactcatgtataaaatacgtactttatacgtgtatttctgaagattagtcacttcaaaaaatcatgagagtaataaatgttaaaaaaaaaaacagtggcgctcctttgccatatcactatcccaagtctgtaacacttcactgccacaaaaacaaaaaacaagtaatccaaaataaaataatgattttccaagtgtccttccttcgattaaaccgaggtcaccaaatctgtgtatgtaacaaaaattgtagtggaacatattgaatcagcagcgttactgtataattattttttgattatatcattacatcaacataaattatgatttcctatcattctgtgaaattactgttttcaattttgtgatttgtacttgaaaactaaacctaataaaagaaaataagttaggaatattttgttttttagttttgaaaagtggggctattttttgataaaatatcatcaactttaacaaaaatagataaaaaggttatagtatatattttttagttacaaaattgagattgagataaaaataaataaaatttaatggtcatcgataatattgagatttgaagtgtcgattggtatttgtatagtgttgtatctctctctctctctctctgtctgtttgtttcagagaaggatttttggcgtctccacgcacgatttaacgcatcgaagctctctgcacgcttcctgaaagagagagagaagagagagatcgcagatcgatttctcttaaatctctcgtgaatcccatttgccttctctctgctagattctctcttcttctcttcacccatttctcgctttctcctttgttctctcatctgggttcttctcaaagcctcttcctttttatgcc

SEQ ID NO: 8774 - DNA, 3000 bp, Unknown; identical to SEQ ID NO: 8771
  misc_feature (1)..( 3000): cDNA_ID_2730189_gDNA_ID_1971889_Annot_ID_176800 3000 nt of promoter + ATG

SEQ ID NO: 8775 - DNA, 3000 bp, Unknown
  misc_feature (1)..( 3000): cDNA_ID_4266404_gDNA_ID_1971889_Annot_ID_58460 3000 nt of promoter + ATG
agtaacaaacgattttcccaaaatggaaattgattattgaatctaagggagactgttcttacacaaggttgtgtcacaagttcattagtagtggctatctcgagcaaagtataatgaaagttagtagtggccactggccttcaattcaattattgctccatcttgagaagtgggattaaaagaaggtaactttttttaacttatttggaaaacagaatgcgtaaacaaaagagatagctactgctctaaatagtgttcatgtatgaaacttctgttttggttccacctttcttcttctacgaatctcaagttatgatcaacagacgactcgcttctttcttcaaaacagtgagtcatatacttgcttcttaacttcttaattagtgtccgcatcaaaaatgtcatgagcctaaccattgatgcaaacatttataataacaatacttatgtgtgtccgattcaacgcccaataatctctaaaatacaaaagaagaagtagtcttaaaattctagaaacagaagtcgcgacgaaaatctcagtatttaaaacaaacgtgcctaaacaaatagagataatcattcagatataatgcaaaaagacaaaagagagttgaattaaatcacgtggaaaacaaggaacacgacaaagcagaacagtctcactattcccgcgttagccactcaatacaatccgccacgtgtcccatcttcacgcgccagtcagcgttgatcttcttcctcacttgccacttccacttcttcatatataaatcccacacagccgcaaattcgaaatcaaccagatataacagaattaacctacacaactgaaactcgagttaagaaccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattattctgaagaatatccttcgaacacgatgagtttggaagattatattatccggcccaaaatcttatagttgggccttagtcattaaacatttttctcagcccattgttttaaaaattgattttcgtgataaagtagttaacttaagtgaagtacgaaggttcccttggcctaattaaaacacaagggggtttctataaatgaaatatgataaaatatcttccaagcatttcgatagtattgatgacaattacaaagttcaacatcaataagtcaagaaattaggattggaaatcaaggaagagaaacggtcttcaaagaaaatagaattgaatcgagaaaaatatcagtaatcggaaaaaaaaatgaaaaaaaattggggtggataagattcccatcattttcaaattgccacctgattttcggcttaaataagaaaaaccatcactttcaatataaaccactatttcattcgagacaaaataaaaaagaaaaaataaaaaccactagctaaactaatactaataatctaggtgctaataaatactagaaaacaatccacatttcaagtatagatgaattggtctattaatataaaatacggtgaattaaaaaataacacaattaaatttacataaaatttaaaaatatatatcaggtacatcacagaatatatttttacattagagaaagtcttggattcccaataatataaaacaaaatatcagaaaaagacatttgaattcttgatgtgggtcctcacggtcctaccacactccaatgaaatgcttaaaaaaaaagaagaaaaggaatcattacataagaaaagaaaaaataatatctgagcctgctcatatcaataattgtgtatatatagaattatatagatgatgtcgataaaagaaaccaaacaagataaataaatacaaaaataataatggtgatggtgggccgttctataaacttcaatcattaatcatagcacacaaaattccaaacttgagaaatataatcagtgggctaaactctaaagtctctctacctttctccatctccttcttcttcttctatcagattctttctttcctattacctttgccttcttcttcttcctttcctctttctctatcttcctctcaattcttttactgtttattttctttgtaatcaacaacagtttaactcttcttcttcttttctttatcaagaacagtagtttctcaattcttgattatgatactaagcaagagacctcatctaatgatccgtaaattgtctgagatg

SEQ ID NO: 8776 - DNA, 3000 bp, Unknown
  misc_feature (1)..( 3000): cDNA_ID_1394832_gDNA_ID_1971889_Annot_ID_58462 3000 nt of promoter + ATG
agtattagtttagctagtggtttttattttttcttttttattttgtctcgaatgaaatagtggtttatattgaaagtgatggtttttcttatttaagccgaaaatcaggtggcaatttgaaaatgatgggaatcttatccaccccaattttttttcatttttttttccgattactgatatttttctcgattcaattctattttctttgaagaccgtttctcttccttgatttccaatcctaatttcttgacttattgatgttgaactttgtaattgtcatcaatactatcgaaatgcttggaagatattttatcatatttcatttatagaaacccccttgtgttttaattaggccaagggaaccttcgtacttcacttaagttaactactttatcacgaaaatcaatttttaaaacaatgggctgagaaaaatgtttaatgactaaggcccaactataagattttgggccggataatataatcttccaaactcatcgtgttcgaaggatattcttcagaataatgaaatggacttttaacatttattactagaatcttatccgatttttctttacaacaaaaaaatgaaaaaatataggtgtgaatatgatccacatcaaattcggatccgaaacgaaagaaattcccgggtcattggagctccgtgttacaaaaaatctccagatttctccatgactccaaggaaaatctcacagttcgctctaaaaaaatattatgtttgggaattcaaaaatcccaaagaatcaaagattcatctaataaactctctcctccgtaatcttcgatgggtaaaatctctgtaaatcgatcaccaccggagaagccagagaagtcgtcggagaaggaatcaaacccgaaattcatcggaagcaaatccaaaaacgaaaaatcataatccaccgtcgatgtagcaacagatgcagatgtagaaggagactctggtcggatctcggatccgggtactaaacccgattcttcttctcccttgacaatgtcttggaatgtgttagcgaatctagcagcagcttcctgaatctccggaggcgtcaacgacttttctacggagatcgacggtggattattagggaaattgaaattagcatcgccgccgcggagacaaaattgagcggcgtcgaaagcacgcgccgccttctcgggagtgtcgtaagagcctaaccaaattcgttctctgctgtgtggaagtctgatctccgatacccattttccccatttcctcttcctcactcctttgtactttgactgcatcgccgtgtttctcttcttctcctcttccttcatcgcttgcttcaccattggataaaaactccggttcggttcgattcggtttggttgaattggattctgtttccggttcttaactcgagtttcagttgtgtaggttaattctgttatatctggttgatttcgaatttgcggctgtgtgggatttatatatgaagaagtggaagtggcaagtgaggaagaagatcaacgctgactggcgcgtgaagatgggacacgtggcggattgtattgagtggctaacgcgggaatagtgagactgttctgctttgtcgtgttccttgttttccacgtgatttaattcaactctcttttgtctttttgcattatatctgaatgattatctctatttgtttaggcacgtttgttttaaatactgagattttcgtcgcgacttctgtttctagaattttaagactacttcttcttttgtattttagagattattgggcgttgaatcggacacacataagtattgttattataaatgtttgcatcaatggttaggctcatgacatttttgatgcggacactaattaagaagttaagaagcaagtatatgactcactgttttgaagaaagaagcgagtcgtctgttgatcataacttgagattcgtagaagaagaaaggtggaaccaaaacagaagtttcatacatgaacactatttagagcagtagctatctcttttgtttacgcattctgttttccaaataagttaaaaaaagttaccttcttttaatcccacttctcaagatggagcaataattgaattgaaggccagtggccactactaactttcattatactttgctcgagatagccactactaatgaacttgtgacacaaccttgtgtaagaacagtctcccttagattcaataatcaatttccattttgggaaaatcgtttgttactattatttatttgttcagaacccacggaacagattgcccccaaccctccgagttaccaactttataggttttcgctgagcaacaacatcccattagaacggtgaagctcatcatcatgagcatgaaggagaagattcttgttgttgtggtcgccattatcgatcaaaagatcacaaattaagaaaatcgaagaaggaagattgaggaatataagtcgatgagttatttgagtattgatgaggaaaacaaagactatacgaactctctatttataaggtttacggaacctaatccttgccggtttaggattttactcaacgtttggaatatattacatgtttatttcctttttcaattttgattcacctcttatcttgcaaaaaaacaaaacaaaaaagtgacgtttaaagatctctaatccttttctaattaactttgtgtatgatttttagttcttctaatttctatatatttttgttcataatatgaaaatttgatctctgttttaattattttggaactaaatacacatttttaattagattagtaaaagagttataattaaaaaaagttgatctggttggtgtcagcagaacaaggaaaaaagagaggctttttcgttttgatcctcctactcttcttcattagtgaaagctacttataaagtccaaatcttgaagtgcgtgcacggtgcaccacgaatccacgatccagtgagcagcagcaactccatctccggagctctagattcagataagaaca

SEQ ID NO: 8777 - DNA, 3000 bp, Unknown
  misc_feature (1)..( 3000): cDNA_ID_2037321_gDNA_ID_1971889_Annot_ID_58463 3000 nt of promoter + ATG
catggttctaaattcagtacttgtttggagcttgctgatatttgtcgagaagttggtcttcctcctggggtcctcaatgttttgactggtttcggttcggaagctggtgctcctttggcatcacatcctggcgtggacaaggtattggtctttgagaatacagtaaacataagtcccaacaaaattaactctaaaggctatgattaaacattcagtttaacgtctgcgtttcttaaacgcttcaatgctaagttatgatttcgttgcagattgcatttactggaagtttcgccacaggaagtaaggtcatgacagccgctgctcagttggtgaaggtaattccaatttttgaactttctgctgtatattccttctcctccttttgtttcatcaccaatgtcaatgacacattactcatggcattgttgcagcctgtttctatggaacttggtgggaagagccctctcattgtgtttgatgacgttgatcttgataaaggtgaatgtcacaaaaagtagtttagtggatttggagtttttttataataacttcttcttgtgctatattcaagatagtactaatgcttttgttgctttgagacgagtagacatgacttaaatttgcttaatcttaaaattaaactctttgtatgttttgacgccggcaaatgatagctgctgaatgggctcttttcggttgcttctggacaaatggtcaaatctgcagtgcaacttcccgccttcttgttcacgtaagtcccaatcttctacttgctttaaggttttacctgatcttcccaatatgacatgcgaatatttattactggagaagtgaatgttccaagtcatacgggaagatgtttccattaaggtcaatgacaatgacatttatttcagatcaaaccttctggtggatatgccaacagggatacaattgctgactctcttgtctaaatttttttattttatatcttaggaaagcatcgcatctgagttcatagagaagcttgtaaaatggagcaagaacattaaaatttcagaccccatggaagaaggatgcaggcttggtcctgtagttagcaaaggacaggtaaaatcccagtgatcgttttttctgtcttcatattatttgtcaatttcccatcaggttgcaatacaacaaccaggactaaaaaggaaaagagaattgagttctgtagtatagtgattaacttttgtccctctaattctgaaccgtttagcttttagagcatcaatcaaatcacatctagcatatgatatttcatcacgcttatcatgttcttacttggtaggtgtgcttttcttctatgatcatataatctgattgagctgacaaatgtaaatattacagtacgagaagatattgaagtttatctcaacggccaagagtgaaggagcaacgatcttgcatggtggttcccgacctgaggtattacatctccctcccttacctatccttgatgcagtttcttccagactatgatgatgaccttttatatcatatctatatttcacagcatctggaaaagggcttcttcattgaaccaaccatcataactgatgtaaccacttcaatgcaaatatggagagaagaagttttcgggcctgttctttgcgtgaaaacatttgccagtgaggacgaggcaattgagctagcaaatgactctcagtaagttaacgtttctccagaaagtgaaatctgatcaaatcccatccgctgacactggtgtttaaatcaaatttatcatttaagatcttatgtggctgaaaattattcattgattaatgacagttacggactaggagctgcagtgatatctaatgacacagaaagatgtgaccgtataagcgaggttagtaccggtttcttgaaccattcagatttgtttttaatgcctagcaagtgaaataacaataccatcaaataacacaaacaattggtgtctactttgttaggcctttgaagctgggattgtctggattaactgctcgcagccttgctttacccaagccccatggggtggtgtcaaacgcagtgggtttggacgagaacttggagaatggtacatttctttttctatctcgaatcttgtttttaaaagactatatcttgatggcttgtactgaacaaatcttggttatggctggtttcttgcgtgcttcaggggacttgataactacttgagtgtgaagcaagtgactctctacacttcaaacgatccctggggatggtacaaatctcccaactaagtaatgaatacattgtcatggaaatggaaaccaaaccaaatgctgtctgttcaaatctttgtgcttttattatcagtctgtctagttcggtcctgaaactcttttgtaaaacctgttgaatttataatgaataaaagatgctttgctgataattattggttgttctataaaggccagtattgaggcaccattttaggctctggtgcagcagtatcaagaacatgaaccattttatgtcaccttcaagtcacatcaaagttaaaactcacatggcaatcaattccaaatcataacttttttttttactataattgcttgaaataaacattttatgagatctgaagatttgtggattttttttccattttttaaatagtaaaatgtttggcaaccaaatctgaaaaagaggtaaagacgagaggtctcgcgcttatccttaaaggactgtggtgaatggtgagtgtgacttggagggaccccatcaccgcaacaatacagcttcttagatctcgataaccacaactaacctgtcacagtttcgattagatcttctcaaaaacttcacctttttttgtttttccagtttctcagaggagatcttccttcaaagctcaaatccttttgtctgaattgtgatactgctgtccccatttttctgcaagttgggaaatttctgtcaaagttttgtgggtctgttaaaaagatctgagctttgaacatggggagctca

SEQ ID NO: 8778 - DNA, 3000 bp, Unknown
  misc_feature (1)..( 3000): cDNA_ID_1989792_gDNA_ID_1971889_Annot_ID_58466 3000 nt of promoter + ATG
tagctatggcggcggaatctgccggcggtggtttgagattggctccggcggccgaagtacatagcgatttgctaaaaagacgtttcatcgattggtttgttttattttgttttgaaaaaagtctttttaagtgacttcttgggtaatttggtgtagttgtatcacatttgtttaccgctaaataatgttttaaccgttttatggaacgtttctttctttttcagattgtacagagttagttggtttatgggtctaattgggcattctttggaaatggtctcacaagacattgtggagttcaaagaagagttcgacgattctcacaaaccaaacagcagagtcgattgctaaccaggcctttccatctaaaacatattggttataattgatgcattgcggtaggagtatagcgtatccgttgtaattgattatgaaaataataccaaagcgattaaaaagatactttcaccgcaccgttctttctatccgttactttataccacttttaattatttacatatcgttaaccgctttctctatctgcttaaatttttgtaccgttttatgttattaatcaaaccttgaatggatatgtttgtttttgtaatggtgtccaccaaagtttatttgatgagttacaaaaataattatattttaaagttttgagaaaaaaaatcatgtttgtgaactttcaattgattcacctcatgaagattttataagttctatatagattttgtgaatcttcaaaagtacaaatatatgtactctttttccaacataaatgtagtgaaaattttattttatgtgaaagaatgaaaagaaaccaagtgaaagaaattaatagacagtacatgtaattactgaatacgaaagataaaaagagaggagagtagtcattgtcagatagaaagaaagagcagacaaaaggatcgtaaaatcaaagaaaattgggtccctaaaaagattatgaccgtgaagacacaatattacgttttctgacaagacataaacacatcactcatcgcctttagattctcttccgaccctcacaagatcttaacaacaacaacaacaacatcaagatccgatcctccagattctcttctgtgtatttccttaaatctcctcctctttctctttcctatttatttatgtatctcactcaccgcttctgcctctctctctctctctctcttatttatgtaactcctcgtcttccttcttcacattgatttctgcgtcctttgacgttcaaactttaaacgtttcttcatctgttttgttgtttactttcccgagagaaaacaatggctctcagagatttatcttcttctttatcttcttcttcttcaccggagttacatgttcttgccgttgatgatagtttcgtggatcgtaaagttattgagagattgcttaagatctctgcttgtaaaggtaaaaggcaaaactgtttctctttacgttttctgcttttcttttgtttggtttctgattcgtttttttggataaatttggtgggtttctttatatagtgacgactgttgagagtgggactagggctctgcagtatcttggtttagatggagacaatggatcttctggtcttaaggtatatattcattcatttcttagaatctctctgttttctagcaaaatcaaccctagacgttgaaacttgaagtgttcttatgctggtttggctcccaagaaatctaaggtttcacaatgtggatcaaaagtttaacctttagaggatgattttattatttgtttattgatgccgtttatatgaacaattttgcaaattttgataacaggatttgaaagtgaacttgatagtgacggattattcaatgccgggactaacaggatatgaactcctcaagaagatcaaagtaaatttctattttgtgtcatttattagagcaagatttgaataagctcttctcgtgttttccttacaaaaattctgttgtatatttgccaggagtcttcagcactcagagaaatcccagtagtgataatgtcttctgagaacatacaacctcgtatagaacagtaagtcactatagctaaagatacaaaactgaatcaatggatcttaacactgtaatctgatttttttgtctatcctctcttttgttgttgttgttgttgtagatgtatgatagaaggagcagaggagtttttgctaaaaccggtgaaattagctgatgtgaagcgtttaaaagaacttataatgagaggtggtgaagctgaagaaggaaaaaccaaaaaacttagtcctaagagaatcctacaaaacgacattgattcatctccatcatcatcatcaacatcttcatcatcgtcgtctcatgatgtttcctcccttgatgacgacactccatcttccaagaggatcaaattagagtctaggggttaaatgattgagctcaatcttttctcacgttttctcttgatttccttgtgtaatatacattatttttgatatatgcaactatgtaagtctagattctaatgctcaccttattactctgttttttttttttgttaaaacaaaaggagatcaatgtgaatatgatttaaacaattttataaaattaaatactttgcctacagtatatatattgtttcctacttcacaaccagatcaattagattctataatgtaacatataatttaaaagtacacgtaaaaagattttgtatatgatcttccatgtgacatacacgatttcacttgtatgtgtttataattcataaactttcaagcatcagaaaacaaaaaaaaacgaatataatctttgttggaatacattatctattactatattcctagttgtatagcagaggaaacttgtttgcacttacgtggcatcttatgattggttcagtgatgtctgttttagaccgttgagagacttggataccattgcggtcttatcccgaaactccaagaacacataattttttttcttggtggtctctcca

SEQ ID NO: 8779 - DNA, 3000 bp, Unknown
  misc_feature (1)..( 3000): cDNA_ID_1989218_gDNA_ID_1971889_Annot_ID_58469 3000 nt of promoter + ATG
tcgctaatctccagctttctgtcattttcatgttccctcggaggagatgttttcaaggatataagagtgccgacatccttctgagaagagtttggagacactattggggcttctccatctttaacagaagatatggagtcagtagcatcagcacaaccagacatttctaagctctctacaattttacaagacgaaacttcgtgaagacatactccatcattcacatctcctacttctacagaggaagacagaaccccattggccatactgctatctactgtgtggatcatctgagctaaaccttcagtttccctgcgttttgtcagtatagatggaagagtgtagtgacattgatccttgttatctttataagaacaccggttaatactatttatgcgagtcaaagacggtacttttatcccattagccaccactgatccattttgttccactgggatgcaaaaacctacagcttctgtgttctcgtgactgcaagaaacctcaggcattacagaaactgcagcatcacggttattccaacagaggttttcctcatgattctttttaagatgtttctgaccatccgtaagtttcttgagctcatcgtgaagtactctcaactccaacctcagctctcctacaatatcttcagcttctccaagctgagcttcaagttcctcaaccttctgttgctgcttcaaggattgcatctctgtctccttaacctataaacacaaatcggttttttaaaaattagagttgaggaggaaacgcaaagccagccacaaaagaaagatatactccattagggaaagctcatcctcaagcaaacgtgatacagtctctaagatgaaaaagctatatcccccacactgaaaaacctttaacttaaaaatttcacgatgaaatgagaattgagagcataagccatgaaatatgtgtaagcctcactgccaacaatggtacaacgaatctagaacttgctgacactaagctacacttggttacgctcattagttttaggccttaggtttcatgaacaaatatcaatggaggaagagaaaagctatatctgcaaagtatcaatgtaatagtctcaagagtgtcaaaaacaatggcttgtatcaacgttcaatgaagtgaatgtagtgaaaaaacatagcaaaaatgatagtctcgaagcatatcatttgaatgatggaagattttagtcacttcaaatgtcaaagactgaataaacaaaactcagagtcacacacacacacacaacattaacaatgcttaaaaccatgaaagcaaggctgaaaaacttaatttcaaaagccatcttcatatgaagcaagaaaaaagaaatgcctctaagaccccaaaaacataatcaggcagaaaccaaataaaacaaaccaagaacccataaacaaatgaaaataagaacaaagtgatagtaccttggaatcaagcatctgtttaagcctaaccaacgtatgaagtgcttcatttctaaccgtcacaagttcttgctgatacctacgcgccttcttctcagaaaccatcacacgtgccgccgcttccttcgtcgtgttcagtatcgtatcggcgtaggctctcttcaacgccgctaaggtctgtgttaacccaaaacaaaacgaacaaaaaatcatcgcaaaccccgaaaagaaaagcaagacaaaacccacatcgtgaaacccaaaatttaaacaaaattagcgaaatcagcaacaagattctgtccgataagagaaacaaggtctagaagaaacagaacgaaactaaacgaagaaaaatccgaaatcgaaaaaaatgaactcgtgagaggaggagattgagggggtttaaggtaattgtacctctgggtctgccattagagccgataatgcgattgcagagaagcgattgttgattttccgaccaaggtcgcgaactcgccaagaagaaagaaaaagctaaaaaggtttttttttttttttttgtttctttttgtgtttccttgaagcgtctgtctgttaggaacagaaagaagtataaagacctatttacccctaaaaactcgatgttatttctcaaacgccacaccacacgtcacgtcagcttcagcatttcagactgcaaacggcggtacggtttcccgttatctccgtcactcttttcgtaatctctcttttgctttttacatttttcggtgataaatttacaatttcaaaatacactggacttttaatttttacctcatttagacaattagaccactagatttcgtagcttttaccccaaacaaaagactatattgtagctagttctaattattgaattttgtatcaactattccaatacgagacatgatataatgttccatatttggtagatacattcaaagaaaaaaaaaatggtagacagctaaaaaagaagctagctcatgggattaaaccaaaattaagatatccaaatgattttgaagtttcgattgcctagaagatggatggacaattaaaccgacttatagaacattgtctagtttacaacatatattaccaatgtaattgtattctactatttactagtgtacactaatactacttttcttgcaattttaggcgccaattttttttgatcgaaaaatatcgagttaaccaattaaaaccgggaagtaatcattaaaccgggtaatgaccgggtgattactcgagactgttatccacaataagaatccacgtgtcttcttcaagcccctccctcttcttccatttttccgccatttcacctagagagcgagcttttgggtgagaaaatctcttcttctaaactattctactgccaatcttaattcgtgcgtttctgtctagagcttggtggtgactagtaacttagccgttaatcttaaatctctgattcaattcaaatcgaattgcgattttcccgagaaaatctcgtttcacttgctggaggatttttgaatccttatgtgaactctagttacccaaa

SEQ ID NO: 8780 - DNA, 3000 bp, Unknown
  misc_feature (1)..( 3000): cDNA_ID_2995025_gDNA_ID_1971889_Annot_ID_58470 3000 nt of promoter + ATG
agtgtaatgtagcaccctagttaattttcttgcagctaacttgagtgttctggataagcagtaactttagccattgttttgtatataacatcttaagattttaagcaacacttcaaattttttttttggtttataggtgggacgatgtcaatgagttattggaggagatgctttcaaatagagtatcaaatattcatcaagttattgggcaaatgatcaagggagattatgatgatgactcaaattggcagatagtggaatacgtgttggacaaactcaattcagaaggatgtggtttgggaataaggttttacaatgcacttctggatgctttgtggtggctgggccagaaagagcgagctgcaagagtactcaatgaggcaacaaagcgtggacttttccctgagttattccggaaaaacaaacttgtgtggtctgtcgatgtacataggtagcctaagatccctacactggcttcgtttcatgtgtatgaaatggttgagtaccagtcaatctaattcttggttttcaatgttctgcaggatgtcagagggtggcatgtatacagcactatcggtttggctaaatgatataaatgatatgcttttaaagggagatcttcctcaactagctgttgttgtttcagtgtaagtattttgatactgggtacctacctcattgcaagatgccttcaagctttttatcttgccttttgccttttttaattctttctttctaacctctcagacggggacagttggagaaaagctctgctgcaagagaatctcctatcgcgaaagctgctttctccttcttgcaggatcatgtctcgtcctcattttccttcacgggatggaatggaggtcgcattatgtgccagcgatctcagctcaagcagttactgtcaacgaaagagccaacttcagaagaatccgaaaataaaaacctagtggcattagcaaactcgccaatatttgcggctggaacaagagcttcaacaagcagtgacacgaaccacagcggtaaccctacacaacgaagaaccaggacgaaaaaagaactagcagggagcacagcttaagaactagacaacgtagtttctgttgccaagtccagaaatcaaaggcctcttctgccttcctccatatagactggtgggtgaaaactgtgggcgtatttcacaagcactccatatccatgataactatgctatggtttcaagcagtagagtcaacctctgttagacagaagaagctggagaagaagataaatggtgatcttagtttatatgaagaagcgtctatatgaaaatctcaagtaagtagccaactaagtgttttgatggattgttagacccatgattttgcagccatagattttttttcgtttttttttccattcaactatgtttttgattactataaagctaaatgctaatgtaagatcaaagctctagttacaattaaaggatctattaatcaagattcctcagggaagctctagtttttgcttgtgacctcacctgatgaactctctctgtttcgaaatctaacttattacatagcaatgacccaactccacccagaataaagaaaacaatctgttgtgcaagattccttcttcggtctgattaatctttttctctctctcgtcctcagatatgtgtttgttttctgatttaggaaagtcactacaagtttgtcatccaaattggtaataaaataagaaaaagattggagaaagaaaggatcttcctatagtgcttcacacattacaactttaagattccactttgtgtgcgcataaaagtaatggtggctttgctttctaaccgatgctagtgctttgtgtgattttgctgtcttccaaaactatttaccaaattttgtaaatactttttagaatcttttccctacaaatctaaaatagataaataataatagtatgtgatcatattgcttacagtcaaatcacatcctaacattctactaaaagactaaaactatcacctttttgttttttaatgctatatagttgtgatcaagtctggacatacgatcatgctgtttatactacaattaggtccttaacagcgtcttaaaatttactcttagctagaaaacgacaaattcgactacacaatcatttttgttgttgaattagattcctgaaattgtaagtttttgtgttgaaattcaaagttataatttccaaaaaggattcacctgtctcccaagatttttttcttaataatcaactcatagatccacaagatatagtattttagaagaaaaaaaagtacaaggatggagctgtaactaaatagattattagagcagagtacagaatcatttcagaagctgactatttttctaagctcaagttgcatgcgcttaggccttagagacattgcgttgaccagtacattataacctgtagatttttatcataaaaatacatgagggtaacgttaagaaaaataaaagcgtcgatttcatttcatttttctcattctgttatttcatttttttgtatttaactttgagtttgcgaaagtcaataaatatttcttcgttatacgacctacattttttggtcgacatagcgaaatacttttttaacttcttattataggataacatttatttaactcttttttcgtcatcctataagattaattaaactactaacaaaaaacctaataaatctagtcagccaatgaataaaaaaagtctatccaaatgaaaactctgtagagagacaggcaggtaagaaaaaaatacaagaacagacgaataaaaacaaaacacgtgtcatatggtaccgtcaccaacacctacaacatgtaatagtttaaaaaggaaccacgtggcttttggcttataaaagggtccccaaagaagctcagatctaactcacaccactccattgcccattgctctgtgtactttgcttctttaggagaaagaaagcacaaggggcaaaatcggaaagattatc

SEQ ID NO: 8781 - DNA, 3000 bp, Unknown
  misc_feature (1)..( 3000): cDNA_ID_1989217_gDNA_ID_1971889_Annot_ID_58471 3000 nt of promoter + ATG
ttttgtgttgaaattcaaagttataatttccaaaaaggattcacctgtctcccaagatttttttcttaataatcaactcatagatccacaagatatagtattttagaagaaaaaaaagtacaaggatggagctgtaactaaatagattattagagcagagtacagaatcatttcagaagctgactatttttctaagctcaagttgcatgcgcttaggccttagagacattgcgttgaccagtacattataacctgtagatttttatcataaaaatacatgagggtaacgttaagaaaaataaaagcgtcgatttcatttcatttttctcattctgttatttcatttttttgtatttaactttgagtttgcgaaagtcaataaatatttcttcgttatacgacctacattttttggtcgacatagcgaaatacttttttaacttcttattataggataacatttatttaactcttttttcgtcatcctataagattaattaaactactaacaaaaaacctaataaatctagtcagccaatgaataaaaaaagtctatccaaatgaaaactctgtagagagacaggcaggtaagaaaaaaatacaagaacagacgaataaaaacaaaacacgtgtcatatggtaccgtcaccaacacctacaacatgtaatagtttaaaaaggaaccacgtggcttttggcttataaaagggtccccaaagaagctcagatctaactcacaccactccattgcccattgctctgtgtactttgcttctttaggagaaagaaagcacaaggggcaaaatcggaaagattatcatggccgacggtagtactagttcttcggagtccactaccgcctgcgctggaagcggcacaagaagagagattatgctgttcggagtcagggttgtgcttgacccgatgagaaagtgcgtgagtttgaacaatctgtctgactatgaacagacggcggagactccaaagatcgacggcgaagatagagatgaacaagatatgaacaaaaccccggccggttacgcctcggcggatgaagctcttcccatgtcttcttctaacggcaaaatcgagaggaaacgaggtattactcttcgattgaaacttttttttatcattccataaatttgatcactttaaacttagggatttgttagatatggtttgagaaatggactatgaacaactttatgttcatttggatttagaaagatggctaatttattgggtttctttctatttcttaggagttccatggactgaagaagaacacaagctgttcttgcttgggctgcagagagtcggtaaaggagattggaaaggaatatcaagaaactttgtcaagaccagaacctctacacaagttgctagtcatgctcagaaatacttcctcaggcgaagtaatcttaaccgtcgccgccgaagatctagcctttttgacatgactactgatacggtaaatctctaatcctttgtgactctagtaagttaagtggttaggtttagtttttagcttagttgtttaaaagaaactaatagagagcctttgtgaattgttggttagtgaaaacttaagtataacaaaactgattttgcttggttttgttatcaggtcatacccatggaagaagatcaccaagtgcttatacaggagaacacatctcaatcatcttctcctgtaccggaaatcaacaacttctctatacatccggttatgcaagtctttcccgagttcccggtaccaacagggaatcaatcatacggacagcttacttcatcgaatctcatcaatttggttccattaacttttcagtcaagtccagcaccgctttctctcaacctctcactagcttcatctaatcttaatgaaccatctccttcaatgcatccagcattcaacacgattggagtcgcttagagcttatcctaaaggtgaaaatctgcaacacaccctgtttgtttctttgctgtacagataggtcttgactttgttataaaaaaattcgtcaaatttatgtatttggctaaaaaaaatctgttgaaaagaagaataataaacagagtttggagataggacttaagtggggttttagggttcataatcatcctgtgtttttccttccatgtttggaagttgttgtaatactctctaagttcattcgtgtggatctatcaaaacttataaatcatattaacgttatgtttgttttattcatgatctcaatcataaacagagtcgtagtacttgcttatcatgtggctatctaaatcatgttagatgattcatggggttttagggtttttataatatatctgatttccaaggataagatattttatgtttgtagaataatgtcattatctttaatgatgccaataatgtcaaattttattggtcacttccatcatagtggagctttttcttttcccatcagatgcttttaatatattttgtgtgggatgattacatattacccctgttgcgtaagcaataatcttccaatcacagaacatgatccccattcattaatcgaccaatcaaacagcatcatttttatatgatgatgatgtatatgtgtatgtcatgtgtgtgttggcatgtcctctgtttctgtcgtgtatggttgtattcagttttagcgtcaacgacaaacttctcctcacgtctaagcggggaaaaaaaaaaaaaaaacgaatccagtttatctttgtttgttttgtatctctctgtcttttgacattgtctctaaatttatcaatttcaaatctgcgactatcctttgtttttgggtactttatctcatcaaattccagcccaatctagactctctaaacccagaaatagaaacacaaatcacaaaagattgagatagatagatcatgatctctgttctttgttgatctttgaccaaaattcgatctcctatgtatatacaattgctctgttttttcttgttcttgtttctgcttttacaagccaca

SEQ ID NO: 8782 - DNA, 228 bp, Unknown
  misc_feature (1)..( 228): cDNA_ID_1989204_gDNA_ID_1971889_Annot_ID_176839 3000 nt of promoter + ATG
ttcttctggttcctaaaaagtggctgtcaagaagagtgagacatgcatcaaactctctcttctcctgccatggcgtcaaacctccggaaaccctatttcctcaggtacttaactattcttccccaatcgatgatggtcgaaagctgaaacctttttctgcaaatcgattaaccgacaagaaaatccaacccaacccacccactttgttttgtttggatgataaaaatg

SEQ ID NO: 8783 - DNA, 3000 bp, Unknown
  misc_feature (1)..( 3000): cDNA_ID_2028729_gDNA_ID_1971889_Annot_ID_176834 3000 nt of promoter + ATG
ccaccggaagtgaggaagatgcaagtaggaagacctcccggcggagatagaattagggttacgaagagaccaccgaatggagattattcacctagggttatcaatagcaaaactggaggaggagagacgacgatggagaagaagactcatcatccttacaatcttgttgagccaatgcagtatctcttcgttcggattgtgaaggcgcgtggcttaccacctaacgagagcgcgtatgttaaggtacggacgtcgaaccatttcgtcaggtctaaaccggccgttaaccggcccggcgaatcggttgattcaccggagtggaatcaggtttttgctcttggtcataaccggtctgattccgctgtaactggtgcgactcttgagatctctgcttgggatgcttcgtcggagagttttctcggaggagtttgttttgatctctctgaggttccggttcgtgacccgccggatagtccgcttgctcctcagtggtatcggctcgaaggctccggcgcggatcagaactctgggagaatttccggtgacattcagctctctgtttggattggtactcaggtagatgaggcatttccggaggcttggagctctgatgctccgcatgtagctcacacgcgttctaaggtgtatcaatcgccgaaactttggtacttgagagtgacggttcttgaggcacaggatttacacatagctcctaatctcccgccgttgactgcgcctgagattcgtgtgaaagctcaattagggtttcagtcggcgcgtacaagaagaggctcaatgaataaccacagtggttcgtttcattggcatgaggatatgatctttgttgctggagagccgttggaagattgcttggttctgatggtggaagaccggacgactaaagaagcaacacttctaggacatgccatgatcccagtgagctccatcgagcagcgaattgatgagcgttttgtgccgtcgaaatggcacactctggaaggagaaggtggaggtggaggtggaggaggaggacctggaggtggtggtggtggtggaccttattgtggaaggattagccttagactttgtctcgaaggtgggtatcatgtgcttgaagaggcggcgcatgtatgcagcgatttccgtccgacggctaagcagctatggaaaccgccgattggaatacttgagttggggattcttggagctcgtgggttgttgccgatgaaggcgaaaaacggagggaaaggttccactgatgcttattgtgttgctaagtacgggaagaaatgggtcaggactcgaaccataacagacagttttgacccgaggtggcacgagcagtatacgtggcaggtttatgatccttgcaccgtgctaactgttggagtcttcgacaattggaggatgttctctgacgcctccgatgatagacctgacacacggattgggaagatacggatccgggtgtcgacgttagagagcaacaaagtgtacaccaattcatatcctctgttggttttgttacctagcggtatgaaaaaaatgggtgaaattgaagtggcagtccggtttgcatgcccgtctctgctgcctgatgtttgtgcagcttatggacagccgcttctgcctcggatgcactacataaggcctctaggtgtagcacaacaagatgcattaagaggggccgccacgaaaatggtagcagcttggctggctcgagcagaaccaccattgggaccagaggtagttcgatatatgttagatgcagattcgcatgcatggagcatgaggaaaagcaaagcgaattggtacagaattgttggtgttttagcttgggcagtgggtttagctaagtggttggataatatcaggcggtggaggaatccagtgacgacggtgctagtccatattctatatctggttcttgtttggtaccctgatttggtagtcccgactgcattcttgtacgtggtgatgatcggagtttggtactaccggtttagacccaagataccggctggtatggatatccgcttatcacaagctgaaaccgtcgatcctgatgagctagatgaagaattcgacaccataccaagctcaaggcgaccagaagtaatccgagctaggtacgaccgattaaggatcttagcagtgagggttcagaccattctaggagattttgcagcgcaaggagaacggattcaagcgttggttagctggagagatccgagagcgacaaagctgttcatagcaatctgtttggtaatcacaatagttctgtatgcagttcctgcgaaaatggtggcggtggctctagggttttattatcttcggcatccgatgttccgagacacaatgcctacggctagtctcaattttttccggcggttgccaagcttgtccgatcgactcatctaaggagagaaagatgtcaagatagtaaatgttaggtgtttttgagtatccaacagtttcttgggctgaggaggaaatagaataaaaagattcattatgggttaagaattttatcatattattatgattcttcattttattattcagattctgtcggaaactataatcagatggcatgagctttgagacctgtaatattttgaaggaaacgagagagatttcagatttgagaggtgaaaaaggaagcaaaacttgtcagtaaagttttttgaccacagatttgcttttggtatctctgtagttttctctgtaatctaaaatgatttactaattcctcatttaacttattttgtttacgcctaaactattacatgtaaacattgtctgattatataaattctaagtgaaaaaccggagataaagcgctaacgaaaatgattggttgaaatcacaaagacatcatctgacgtggcagtttctctgtctatcagagtttcagatagtgtgccaacggcgaaacaagacacgaaagaatctctaaagaaatcattttcatcgcttcgcttcgatttttcttcaatg

SEQ ID NO: 8784 - DNA, 3000 bp, Unknown
  misc_feature (1)..( 3000): cDNA_ID_1989208_gDNA_ID_1971889_Annot_ID_176833 3000 nt of promoter + ATG
tggtgtcgaattactatttttaaagttagtgattgaatttgggaataaaaagaatatttggatttagctgtaaaaacctttttttgaacttttcgtcttttattactttgttccccttttgagcaaacgtttcggttctgtcctcctcaagtttctctgtactactttgaatatgactgttttgtgactttcatttcctttactattttagagtttagagagagattttgtgggtatgattcgatccgaactaaatttccgtggcctctttaatttagattttagaacggctccttttctttaagatagattttataaacttttaatccaaaagaaatataaaaaatctgaaaaaatctaaaaatgtgaaagcacaacaaagttttaaataatattttgaaaaagatacttttatgccattgtatttgtgcatttatgttctcctttgcaagtgtattctctttaagctaagaaaaatatattgggctttcctatcagttatcttatgagcccatttcaaactttgtttttcaagcccaaatagctgctgtataaaagacatttgctcgttatatgatcctagtagcttcgacaaactcatactacagcttaatctgaaaccccatagaatcttaaactaaccctaaagtattcactcccaaacctcatcatttactataagtgtgcaacatatggaaaacaaacttagtcagagacatactacaatcattgaaattaatgaatttcagattccaaaatgtaaataaaacggacctgtgtcacttgatccatgccaaatcacttgctgtcattttcttgttcttcataacactaaaagttagactgaaacatgactaatctagaaacttattgagtttccttattacttgaaaagttttaaaagagatatggatggtaaacaaaccatcccgccggtatatcactattcaaagcctaaggcatggatgatggattcattcatttcttttctttttttttgaatttaagattcattcatataaaaatattaattatcccataaagtatatatagttttaggctgtagataacagttttatgcaagaaaagtgatgggacttgaataaatcgaatagttggcatgacaacgccacatacacatgcaatctcaaacattctagttgagcccatcatttcatacacaatctcatgttttttccttcatcgacgaaagtccctttttccgaataataatttttcgtattgttagtttctttttaaatcctttttgccagctaaaaagttgcacaagataaaacatggtccatcatttcctctcttttttttttaggtgtgaaaatcaatctcatccatactaatctatttgtaattgatttatctttttttatggaattttatgtcttaataatttataacatattactatatgcataaacataacaaagttcgagtaaaatataaccaagttttaaaacttggggcttatatagctagttttctctaatgtattgatttacaaagactcgctttttttattttttgcatgactttcaacgtttcacactctttttgccaattgcactaattgttggttgaaagtataaccgggaaataaataaaagaccttcttttttacctactgatatcaatttgatgagtgacataaagtgataaaacaaaaatatttatattcatatgcacaaattttatcgtttagacgatgtacatgatgatcaaaaagagtttcggtttcgaacttccaattagttgttgataggatgtgaatgtaaacccgatttatagaaagcaaacgaataagatcacgacatggcgacacacttgtcaattagtttcgaatataaaaatgagaaatatatgagagaaaacaacaagacgatcgcatttgtttgcatttttgttgactttgatcaatggaatcttcatatattagttttgattactatttttttacacaaaacaaagtccgatagtaagctgactcctttacattgataaagtctacacctaataatatctcatatcttagatacaaatttgatagcttttgaaattatcttcaccaaatcttttggtagaaactttcaaatcacacataaactactagggtttttttttgttaagaaaatccaatgccagtttttatcttgaatttgacaacccaaagttatttattttcatacgaaaaattaatgaagacattttccactcgataaatctgtaaatatacatatgtatgtatattggtaagaaaccagtttttaaatattgtatttaagaaaccaaatagcaaaaaaaaaaattgtagattcaggtagtttaggtaatgctatagacatataatataagacaagaagacaataataattactgaattgaaaacaaaacaaaatattttggtgataccaaatcaaatgaaaccaacgtcacactttttgacaatgtcaccgtatccacttctacggtcaacaacttcatcaaactctccccttccacgtaagctacatctctacccttcattttaccacctatcaacagatctaaggctataatttttttaatagttattttaattacttactcttttagttacaacaccagagactaaaacttgttctgtaataataatacaattaattaactgttaatcactgaaaatattttacaattttttataaattataggttagaaaatggctcaaaattacagtttctatgtaattaatttgtttaagtatataggggagatagatcaagtcgctttaacttattttctttttgatataaataaaaaaaattataatcattttgatcaattttacgaaaaggtcgaaactttcttcagctgaacccgtgtttcctcttctctgcaactcaccggttcgccggaaaactctacgccgtcgccggattttgcaccaacgaaaacttctttaaactactttcttcattattcttctgctgagtttcaaaaactcagcc

SEQ ID NO: 8785 - DNA, 3000 bp, Unknown
  misc_feature (1)..( 3000): cDNA_ID_2037281_gDNA_ID_1971889_Annot_ID_176829 3000 nt of promoter + ATG
aaacccaaagaacgcaacagatgccattataataaatgacagcctgaagcaatgagagccataacatgtgttcccttccccggaagcagtcttatcgtagatataaccgatcaatcttacagagaagatataggaaccaatgggactagccacggatatggtattgaagatggttcccatgtgccgaatcccgaacagctcagaggtgattgtaggcatcagagaccactgtgaaccataacaaacgccaactataacagaaccaacatagagatttccttgaaaaccagaggctatgattaggtggcctatgctcatcgttccaagtgttgcagccattagcaatggacgtggccatccctttttgtgtagcaatgcatctgaggcataaccagctccaaatctaccgagaaagttccatatactccacaaggagaccaatgaatttatctcaactgatgagtatcgaagagactcacctatttgtcggatgttgtttatcgttgaaagtccagagcccattccgcaaatcatggcaagaaataacaaccagaagcttagttttttcatagcttgcagaagattcaggttctcactcagtccagcttccactttactgtcaccttcagaactttggttaccggaggttgttgcctttggactgcttatgagaggggaataatcatgtggtactgttttttccatgccgtctcgttgtgctcttctcgcaataagtagaggcaaggcaagcatgacgagtagacatacaagtgtgacaatgttggcccacgatgacaacccaaaagtgttcttcaatatgataatgatcataagataagctgcgatgattagagatacagctgaaagaccatttaaatgctttttatcatcggctacgcttgtctcatagatcctgaccagaggcatgaccaagagtgagagcactgttggtgttactgccagtaagagaatgaagctggccggatctccagcgcacaatgtctcgtacagttgaatcagtatcgctccacttagaccaagaaaaccctgcaaagaaagaattagaggtaagcttggatgcttcactataatcaaaaattccaaagttgaaaccatgaatctcccactattaacatactttggggtttagttgaagtttctcatcttaaaagtggaggttgcatcctcatttgcaaggtttatcagaaaagaacaaatatttactacgcaatatatatcaactagaagatctagatctcgattgatccaaagttcaaagcatcaatctctttccaaatgttaccaaagcctcctcatttagactctaccaggatcatcatcatagccaaatattggtctttaggtcccaaggaaacaaactgagacgtgatccaacaatacagatccattcaatatatcgaaaagcttcatcaaaaactcaccttcataatgccaacggctgtaccaccatagtcagcgaaattctcaacggcactaacaacattagccgtattgaagaacgtttgcgactgagctgctaagaacataaacaggcacatcagcggcaccggaggctttctaataagtccggtaacagaagcccaaatgagaaagtaaccggcgaagcactgaattgccccaacagcaagcaccacccaaggtcctccagcgcctccaattcctcctccccgtccacggagacgattggacgtagcgtatgtgtataaaagcccagagaaaactccggcgtttgctccgatgtccttgaagactgagacggtatcgagggtggattgatcgtacgattgagtcgattttaggacagcggaatagattccgaaggtgtaggaagcgccgcttgcgcattgtatccatatactagctgtcatagccacccatttcgttcttagtatctccatcgccgccaattaccaccaccttcctcgccggaaaaaaagagaaagccagagctttttcccctgctcaaggacgacgaagcgacacgatcacaaaacttttttttctttttttctttattcaaacagattgattttggaaaaactatttaaaccttaatgggctggaaaaattggtatgggctcattagttatagaactcgtagtattgattttgtgagcccaattaactggaatgacacgtggagtcagatggagagcacacgacagccacaagacggcttgtggaagagagaagacggaacgaggttaattaacggattaaactaacggagtcaacgttgactggtcaaggagtattgagaaaactgtacggccggccaaggtcacgccactctctcgaccaatggttttataatcacgaggctgactcagctaatctcccgcaaatcacgagatttttcaatgttactcaattacaaaactattaacaaactcaatactacaaaatcatgtaatgtgattatttagttagtcggatcactaattaatgttttttcatgcattatactatggtcaacgacgttggagaagtaatcttgaatacttgacaacaaccaaaatattgattctttttttcctctcataaaaaaataatgtttaacaattgtaaatgatctaatatattatctccattcttgttagattaatttaatttatctctgttcatattttcacaatctaaatttcttttaaaaataatataaatgaaaacaaattagttagttaccaaagaaacagagacaaaacagatatttaaatatacatcccgccataaatatgatataagctatagttggttttcagctgcaacgtctcagtcacttctaatataataaaactcaaaatctcaaattgattaaacaaactggcttacgcagaagagtgacgactacgaaaatgtatcatgcctttaaaaaccttctctactcctttaatcggttccttcttctttcccttttctcctttcgcttcacgacgacgaaatttttgatttcagtcaccgttattgttgttgcggtgg

SEQ ID NO: 8786 - DNA, 3000 bp, Unknown
  misc_feature (1)..( 3000): cDNA_ID_1989212_gDNA_ID_1971889_Annot_ID_176828 3000 nt of promoter + ATG
ctctgtatggcaaattgctttgttacttggattataagggactcaagttcctcctgaagctgcaatagaaaattgtccgtctttgttttatcatcagcacttttgtataacaatctctgaaaattctcaagacaatcatctatgttgaactgtttggcagttgaagagcggcgagctgtcatttcttctaacactgggtgaaagaacttcttaaatgcattgctgcaacaaaacaaaacaaaacattctgtaactcactcaaagaaagaaggaaggaaagtaaacaagagactagacactataccaaagagaaaaattaagttaatccgagaaactattattacctataagaaacaaggacatcagcaaggaagtttaatctagccatcagtacatcaagatccaaaataagggtttggaattttgcttggcataatccttcttgaatatctctcaaatctttttcaattgcattttgaaaaagtctaagaccatgaattgggctccgtcctacatttggaattgaaagggactttttactccactcccaaaagcgttgaaaacatccgcttgacggatgtgactcaggtgatttcttcaaacttttagacacattaacatactggactcctttcatgatctctgtaggagtcccacaagaagattgactatcgtcaagcagccaagagcttatgaccttcagaaaattttagcttatcaaaaggaaagaagaaaaacatagcatatctcagcaaaggggatatgtatacctgttgcaatgagtcttcatttggggcaacatcttttatacaattctcaacttcaattttctcctcgtgagagagatgagagatcatccatggcaaaaagtcttcaagcaccatcactggaacactacaaatgaattgccacacaagtgatgcttgttctcggaaagaaaacttctctattaacaaaggaaacacctacatgaagcatgactcgttaggcaccactatgaaaagtgatagagtatctgtaactgaaatgttgttttccattaaaaagtattgtagttgtcaaaacagagttgaagtataacaagactatatacctgccgctcttctttaagcatatgttggcatatagatgactggatggtgcctatgcataaaataacttcacgaagtacatcgcttctacttcctatttcttcttcaagaacatgtagccagtggaaaattgaggtaaagagatcatctgtgccagcatgctcaagtgagtaattagaaactatgtttttcactcgtttatctagcgccaaaaatataacctgccagtaagaaaagcatatcaaaagccactgttacttatcatgataaggatttcaatctaagagtcagattcttgacatcaataaaagattcacaaactgaaactagagactgcaacacgaatttagacaaggtcttttaccctagtaacctagtctaaccaagaattcaaaggacaatctttatttctctagttgtaattagcttcaggaagcaagagagttctaaactcgaatttaatttgtgaacataaagaggagtaacagagattaaaacagagcaactcatttagggaaaaaaaaacttataaaggtgataaaatctaacctcatcttcagctgcgctatgatacttatatacaagcttcaagaactcaaacttccgggagagctccaccgccagatccccactaaaggaatcggcttcagcagcgtcagtagcgaaacgccggagctccaccagctgagcacggaaagccttgtggcagtaaacgaagaaaagaaccggagcatcagaaagcttggtatttccaacggtcaccgcataagatgcagaaacggaagcgttttccggcggaagggaatgaagatttccgcctcccatccaccgcaacaacaataacggtgactgaaatcaaaaatttcgtcgtcgtgaagcgaaaggagaaaagggaaagaagaaggaaccgattaaaggagtagagaaggtttttaaaggcatgatacattttcgtagtcgtcactcttctgcgtaagccagtttgtttaatcaatttgagattttgagttttattatattagaagtgactgagacgttgcagctgaaaaccaactatagcttatatcatatttatggcgggatgtatatttaaatatctgttttgtctctgtttctttggtaactaactaatttgttttcatttatattatttttaaaagaaatttagattgtgaaaatatgaacagagataaattaaattaatctaacaagaatggagataatatattagatcatttacaattgttaaacattatttttttatgagaggaaaaaaagaatcaatattttggttgttgtcaagtattcaagattacttctccaacgtcgttgaccatagtataatgcatgaaaaaacattaattagtgatccgactaactaaataatcacattacatgattttgtagtattgagtttgttaatagttttgtaattgagtaacattgaaaaatctcgtgatttgcgggagattagctgagtcagcctcgtgattataaaaccattggtcgagagagtggcgtgaccttggccggccgtacagttttctcaatactccttgaccagtcaacgttgactccgttagtttaatccgttaattaacctcgttccgtcttctctcttccacaagccgtcttgtggctgtcgtgtgctctccatctgactccacgtgtcattccagttaattgggctcacaaaatcaatactacgagttctataactaatgagcccataccaatttttccagcccattaaggtttaaatagtttttccaaaatcaatctgtttgaataaagaaaaaaagaaaaaaaagttttgtgatcgtgtcgcttcgtcgtccttgagcaggggaaaaagctctggctttctctttttttccggcgaggaaggtggtggtaattggcggcgatg

SEQ ID NO: 8787 - DNA, 3000 bp, Unknown
  misc_feature (1)..( 3000): cDNA_ID_3043556_gDNA_ID_1971889_Annot_ID_176827 3000 nt of promoter + ATG
gatggagatactaagaacgaaatgggtggctatgacagctagtatatggatacaatgcgcaagcggcgcttcctacaccttcggaatctattccgctgtcctaaaatcgactcaatcgtacgatcaatccaccctcgataccgtctcagtcttcaaggacatcggagcaaacgccggagttttctctgggcttttatacacatacgctacgtccaatcgtctccgtggacggggaggaggaattggaggcgctggaggaccttgggtggtgcttgctgttggggcaattcagtgcttcgccggttactttctcatttgggcttctgttaccggacttattagaaagcctccggtgccgctgatgtgcctgtttatgttcttagcagctcagtcgcaaacgttcttcaatacggctaatgttgttagtgccgttgagaatttcgctgactatggtggtacagccgttggcattatgaaggtgagtttttgatgaagcttttcgatatattgaatggatctgtattgttggatcacgtctcagtttgtttccttgggacctaaagaccaatatttggctatgatgatgatcctggtagagtctaaatgaggaggctttggtaacatttggaaagagattgatgctttgaactttggatcaatcgagatctagatcttctagttgatatatattgcgtagtaaatatttgttcttttctgataaaccttgcaaatgaggatgcaacctccacttttaagatgagaaacttcaactaaaccccaaagtatgttaatagtgggagattcatggtttcaactttggaatttttgattatagtgaagcatccaagcttacctctaattctttctttgcagggttttcttggtctaagtggagcgatactgattcaactgtacgagacattgtgcgctggagatccggccagcttcattctcttactggcagtaacaccaacagtgctctcactcttggtcatgcctctggtcaggatctatgagacaagcgtagccgatgataaaaagcatttaaatggtctttcagctgtatctctaatcatcgcagcttatcttatgatcattatcatattgaagaacacttttgggttgtcatcgtgggccaacattgtcacacttgtatgtctactcgtcatgcttgccttgcctctacttattgcgagaagagcacaacgagacggcatggaaaaaacagtaccacatgattattcccctctcataagcagtccaaaggcaacaacctccggtaaccaaagttctgaaggtgacagtaaagtggaagctggactgagtgagaacctgaatcttctgcaagctatgaaaaaactaagcttctggttgttatttcttgccatgatttgcggaatgggctctggactttcaacgataaacaacatccgacaaataggtgagtctcttcgatactcatcagttgagataaattcattggtctccttgtggagtatatggaactttctcggtagatttggagctggttatgcctcagatgcattgctacacaaaaagggatggccacgtccattgctaatggctgcaacacttggaacgatgagcataggccacctaatcatagcctctggttttcaaggaaatctctatgttggttctgttatagttggcgtttgttatggttcacagtggtctctgatgcctacaatcacctctgagctgttcgggattcggcacatgggaaccatcttcaataccatatccgtggctagtcccattggttcctatatcttctctgtaagattgatcggttatatctacgataagactgcttccggggaagggaacacatgttatggctctcattgcttcaggctgtcatttattataatggcatctgttgcgttctttgggtttcttgtcgccattgtactattctttcggacaaagacgctatatcgacagatccttgtaaagaggttgcatcatcgatagagttcttgtgaatactatacttttggagaaaaacgaatactgcttctcttgctacatccatggtagcttatgcttccaaaggtacacatcaatttctttacctataagtttgattgtaagttatgtttgtatcaaatgtctgtgtttagagatgggaagaaagaaagctgagatctttgtctctctttctttttgtagtttcttccaaaaatgtgagttttgtgaattgtatagacatctcaaagttcccaataatgttgaaattttttaaaattcatattgttgactactatgcatttaaatagtaataatttgcaggccatcaagtctcgttcattcattattcagattaatccacaaaccaatctccatgcaccaacactcttattcaatgcgttttcaattatacttttgatcatttccacataaattactttgttaatcaatagaaagttatggtttggaataaaaagtagttttgcagtcttaaatgggaagagaacttgaagaagacaagtccttttttcctttgttctaccaacttcaaacctacttttcgaaccccaataagttcctagaaatccaaaacccaaatgtataaagtcaactactttgactatcacatctgaggacaataatcaaaagctagcaaagcatagaaaaagacagaacctttgttcatcgtctctctctctgacacgagaaagttgaaaaattcaagttgaacatgattatattcattaattattatatgagaagggagatttctggggatatggttgttggtagtcatgggaagacagtaaacgccatcgcaattgcatttattctgtctgcagagtcaaacaaactaattttattatttgattttcagtcctatctctcttctcttgtcttgtcctgagatcagatgtataaaaaagagacttcttttcttcttctctcttgattctctcttccactgtcattatcttcaagatttgtctcttgcgagactcgatg

SEQ ID NO: 8788 - DNA, 3000 bp, Unknown; identical to SEQ ID NO: 8781
  misc_feature (1)..( 3000): cDNA_ID_1989217_gDNA_ID_1971889_Annot_ID_176821 3000 nt of promoter + ATG

SEQ ID NO: 8789 - DNA, 3000 bp, Unknown; identical to SEQ ID NO: 8780
  misc_feature (1)..( 3000): cDNA_ID_2995025_gDNA_ID_1971889_Annot_ID_176820 3000 nt of promoter + ATG

SEQ ID NO: 8790 - DNA, 3000 bp, Unknown; identical to SEQ ID NO: 8778
  misc_feature (1)..( 3000): cDNA_ID_1989792_gDNA_ID_1971889_Annot_ID_176816 3000 nt of promoter + ATG

SEQ ID NO: 8791 - DNA, 3000 bp, Unknown
  misc_feature (1)..( 3000): cDNA_ID_2037321_gDNA_ID_1971889_Annot_ID_176813 3000 nt of promoter + ATG
ttgaacacgtctcatggttctaaattcagtacttgtttggagcttgctgatatttgtcgagaagttggtcttcctcctggggtcctcaatgttttgactggtttcggttcggaagctggtgctcctttggcatcacatcctggcgtggacaaggtattggtctttgagaatacagtaaacataagtcccaacaaaattaactctaaaggctatgattaaacattcagtttaacgtctgcgtttcttaaacgcttcaatgctaagttatgatttcgttgcagattgcatttactggaagtttcgccacaggaagtaaggtcatgacagccgctgctcagttggtgaaggtaattccaatttttgaactttctgctgtatattccttctcctccttttgtttcatcaccaatgtcaatgacacattactcatggcattgttgcagcctgtttctatggaacttggtgggaagagccctctcattgtgtttgatgacgttgatcttgataaaggtgaatgtcacaaaaagtagtttagtggatttggagtttttttataataacttcttcttgtgctatattcaagatagtactaatgcttttgttgctttgagacgagtagacatgacttaaatttgcttaatcttaaaattaaactctttgtatgttttgacgccggcaaatgatagctgctgaatgggctcttttcggttgcttctggacaaatggtcaaatctgcagtgcaacttcccgccttcttgttcacgtaagtcccaatcttctacttgctttaaggttttacctgatcttcccaatatgacatgcgaatatttattactggagaagtgaatgttccaagtcatacgggaagatgtttccattaaggtcaatgacaatgacatttatttcagatcaaaccttctggtggatatgccaacagggatacaattgctgactctcttgtctaaatttttttattttatatcttaggaaagcatcgcatctgagttcatagagaagcttgtaaaatggagcaagaacattaaaatttcagaccccatggaagaaggatgcaggcttggtcctgtagttagcaaaggacaggtaaaatcccagtgatcgttttttctgtcttcatattatttgtcaatttcccatcaggttgcaatacaacaaccaggactaaaaaggaaaagagaattgagttctgtagtatagtgattaacttttgtccctctaattctgaaccgtttagcttttagagcatcaatcaaatcacatctagcatatgatatttcatcacgcttatcatgttcttacttggtaggtgtgcttttcttctatgatcatataatctgattgagctgacaaatgtaaatattacagtacgagaagatattgaagtttatctcaacggccaagagtgaaggagcaacgatcttgcatggtggttcccgacctgaggtattacatctccctcccttacctatccttgatgcagtttcttccagactatgatgatgaccttttatatcatatctatatttcacagcatctggaaaagggcttcttcattgaaccaaccatcataactgatgtaaccacttcaatgcaaatatggagagaagaagttttcgggcctgttctttgcgtgaaaacatttgccagtgaggacgaggcaattgagctagcaaatgactctcagtaagttaacgtttctccagaaagtgaaatctgatcaaatcccatccgctgacactggtgtttaaatcaaatttatcatttaagatcttatgtggctgaaaattattcattgattaatgacagttacggactaggagctgcagtgatatctaatgacacagaaagatgtgaccgtataagcgaggttagtaccggtttcttgaaccattcagatttgtttttaatgcctagcaagtgaaataacaataccatcaaataacacaaacaattggtgtctactttgttaggcctttgaagctgggattgtctggattaactgctcgcagccttgctttacccaagccccatggggtggtgtcaaacgcagtgggtttggacgagaacttggagaatggtacatttctttttctatctcgaatcttgtttttaaaagactatatcttgatggcttgtactgaacaaatcttggttatggctggtttcttgcgtgcttcaggggacttgataactacttgagtgtgaagcaagtgactctctacacttcaaacgatccctggggatggtacaaatctcccaactaagtaatgaatacattgtcatggaaatggaaaccaaaccaaatgctgtctgttcaaatctttgtgcttttattatcagtctgtctagttcggtcctgaaactcttttgtaaaacctgttgaatttataatgaataaaagatgctttgctgataattattggttgttctataaaggccagtattgaggcaccattttaggctctggtgcagcagtatcaagaacatgaaccattttatgtcaccttcaagtcacatcaaagttaaaactcacatggcaatcaattccaaatcataacttttttttttactataattgcttgaaataaacattttatgagatctgaagatttgtggattttttttccattttttaaatagtaaaatgtttggcaaccaaatctgaaaaagaggtaaagacgagaggtctcgcgcttatccttaaaggactgtggtgaatggtgagtgtgacttggagggaccccatcaccgcaacaatacagcttcttagatctcgataaccacaactaacctgtcacagtttcgattagatcttctcaaaaacttcacctttttttgtttttccagtttctcagaggagatcttccttcaaagctcaaatccttttgtctgaattgtgatactgctgtccccatttttctgcaagttgggaaatttctgtcaaagttttgtgggtctgttaaaaagatctgagctttgaac

SEQ ID NO: 8792 - DNA, 3000 bp, Unknown; identical to SEQ ID NO: 8776
  misc_feature (1)..( 3000): cDNA_ID_1394832_gDNA_ID_1971889_Annot_ID_176812 3000 nt of promoter + ATG

SEQ ID NO: 8793 - DNA, 3000 bp, Unknown
  misc_feature (1)..( 3000): cDNA_ID_4266404_gDNA_ID_1971889_Annot_ID_176810 3000 nt of promoter + ATG
ggagggttgggggcaatctgttccgtgggttctgaacaaataaataatagtaacaaacgattttcccaaaatggaaattgattattgaatctaagggagactgttcttacacaaggttgtgtcacaagttcattagtagtggctatctcgagcaaagtataatgaaagttagtagtggccactggccttcaattcaattattgctccatcttgagaagtgggattaaaagaaggtaactttttttaacttatttggaaaacagaatgcgtaaacaaaagagatagctactgctctaaatagtgttcatgtatgaaacttctgttttggttccacctttcttcttctacgaatctcaagttatgatcaacagacgactcgcttctttcttcaaaacagtgagtcatatacttgcttcttaacttcttaattagtgtccgcatcaaaaatgtcatgagcctaaccattgatgcaaacatttataataacaatacttatgtgtgtccgattcaacgcccaataatctctaaaatacaaaagaagaagtagtcttaaaattctagaaacagaagtcgcgacgaaaatctcagtatttaaaacaaacgtgcctaaacaaatagagataatcattcagatataatgcaaaaagacaaaagagagttgaattaaatcacgtggaaaacaaggaacacgacaaagcagaacagtctcactattcccgcgttagccactcaatacaatccgccacgtgtcccatcttcacgcgccagtcagcgttgatcttcttcctcacttgccacttccacttcttcatatataaatcccacacagccgcaaattcgaaatcaaccagatataacagaattaacctacacaactgaaactcgagttaagaaccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattattctgaagaatatccttcgaacacgatgagtttggaagattatattatccggcccaaaatcttatagttgggccttagtcattaaacatttttctcagcccattgttttaaaaattgattttcgtgataaagtagttaacttaagtgaagtacgaaggttcccttggcctaattaaaacacaagggggtttctataaatgaaatatgataaaatatcttccaagcatttcgatagtattgatgacaattacaaagttcaacatcaataagtcaagaaattaggattggaaatcaaggaagagaaacggtcttcaaagaaaatagaattgaatcgagaaaaatatcagtaatcggaaaaaaaaatgaaaaaaaattggggtggataagattcccatcattttcaaattgccacctgattttcggcttaaataagaaaaaccatcactttcaatataaaccactatttcattcgagacaaaataaaaaagaaaaaataaaaaccactagctaaactaatactaataatctaggtgctaataaatactagaaaacaatccacatttcaagtatagatgaattggtctattaatataaaatacggtgaattaaaaaataacacaattaaatttacataaaatttaaaaatatatatcaggtacatcacagaatatatttttacattagagaaagtcttggattcccaataatataaaacaaaatatcagaaaaagacatttgaattcttgatgtgggtcctcacggtcctaccacactccaatgaaatgcttaaaaaaaaagaagaaaaggaatcattacataagaaaagaaaaaataatatctgagcctgctcatatcaataattgtgtatatatagaattatatagatgatgtcgataaaagaaaccaaacaagataaataaatacaaaaataataatggtgatggtgggccgttctataaacttcaatcattaatcatagcacacaaaattccaaacttgagaaatataatcagtgggctaaactctaaagtctctctacctttctccatctccttcttcttcttctatcagattctttctttcctattacctttgccttcttcttcttcctttcctctttctctatcttcctctcaattcttttactgtttattttctttgtaatcaacaacagtttaactcttcttcttcttttctttatcaagaacagtagtttctcaattcttgattatg

SEQ ID NO: 8794 - DNA, 3000 bp, Unknown; identical to SEQ ID NO: 8773
  misc_feature (1)..( 3000): cDNA_ID_2730172_gDNA_ID_1971889_Annot_ID_176807 3000 nt of promoter + ATG

SEQ ID NO: 8795 - DNA, 3000 bp, Unknown; identical to SEQ ID NO: 8772
  misc_feature (1)..( 3000): cDNA_ID_4266408_gDNA_ID_1971889_Annot_ID_176805 3000 nt of promoter + ATG

SEQ ID NO: 8796 - DNA, 3000 bp, Unknown
  misc_feature (1)..( 3000): cDNA_ID_1989215_gDNA_ID_1971889_Annot_ID_58473 3000 nt of promoter + ATG
ttatactacccaaaatgaatatttaccttattcttttgttgatcgctgcgacaagcaccggcggcacaaaatataaaagaaaaaagaaggaaagatgaaggtgagatgaatgaaagagtcgcagcgatagatctgaagagataggagaaagggaatttgagacgttgaaaattccagcgtctacggaatagccgaattacagtcgctgcggcaaagatgaaagagaggaaaaataaaagtgaaagagagatgagagctttttttagatcgcaggtagctgacgtagcgatcaatcaaagaacatggtcattatctaataaaaactatttaattagccattaggaaatttgaaggctagacttgttaaaaatcttttcgtatgggcccatccgtgccttcttcaatgggcttgaagaagtagacaagacatcccattattgattattttccttagcttgatgaatgtttttggagttattacatactacattataaatttcttgttcttacagtcagtatatacacaatctgcactgaagataccttaaaaagctagaacgtacggctttgctgaggtttgtttggatagagttgttaaatccaaattcattttgaagcatttagagaattcacaagaagcccaattatgattcaattagaagcccgcaaaaccatgtaattagaaatttctagcaagtttagattcacagaaatatgttgttataacttataagcatcaatgtagctaattttggaagttgccagccactatccacaactctccttcttcatcatttcaagacatcaatctaagatttactgattaagcttagcgttctttatttccccttgcactaaataaagctcttactgagttattttattttgtatctttgctatccatcttatattcagctcctttgagcaaaaatcgatcgtgatttggattctcccacaaatcctaggggagttaattagccacgtaacaactttgaaagtcaccagtctctccccattcctcatctaaatatcaaaagtcaaacgttcaaatccccttgagtccttgacgttaattttttgttatagaaaaacgaacggaaaaagaaaagtgagattagaagatcatttatagaagagaacaaaacaacgatggttgttatacgctcacaatcaagatccccttgatcaacatgttgctaaacgcagacaaggactcgcggagacaacaatggttgttacgtattcaaaattaagaaacaagctaagaaaaaccttcatattcttaagcatacattaaaggctacataatcaatagtactgacaacgatcataacttcaaaataatgcattaatcacttgagatttaccaatagttggattttgaatctcgagttctaactccaaagctgcattttcattgtttttttaatactcatccatcgtacggcgtttattatgcgatctaccacccatgtgcatgtatttatctcacttaatggttttattattcaattcttgtaattcctttttgtttttcaaaatgagatgatctaccacccttgtgtatgtaattatctaacttaagtatttcatttacgttactcatgataacactcgatgatctaaagtttagttacattttatagaatgctatacttcacttagatatcagatgtgggttcaaaaccataaaaaaatatataaaatcatgacttatattcaacgcattcgcggagacgttgatattgtttcacaaaaataggaaattaacacacgcgtagaaatattcatgtatctatttgtgttcatacaaattaaagatgtttaaaataagatattgttaaaaaaaaagatattgttaaaaaaagaaaagaaaaaagatattgttataataagaaaaatataaatattgtcaatagtagcatgtaatatgagaaattgaatcaaacgtaaaatcgtgatcataaaaaataaaattcaaaagtaaagaaaaacatgcattgtccattttttttaatacttgaatttgtttaataattaatcctcgagttacgtacgttcactagttatttccaatcgacaaacaaattcaacggtttcgaaaattctgaacagaaataaaagatgtagtttcatacaaaataaatgttagttttttattttgtttgtgtgatgatattcagccttccaaaacatatttgttggtgaaagacaagtttttggctgtcggtagtacgaccatttaaattaaggaaaatcaactccaagattcacggatgtataaaatccaccatttgaatactgccacgtggcagtagaccaccagaagacgtgtacaagtgtgtctcctcctctccatgtataaagatgaccgttgccacttgccagtgccacatatgatcgtcggctccggtgattttcgctctctctgcggccacacttgtttgcttggtctctttgtaatactttaacatcacttagtatattgcatgtttcattctttctttctctgattttgttttcgtgagatattaaagagttcataacatataatttcgatgtcagaccgtattaaaaaagttttttttgtggattagattcacgatgcattttaatcagtggagtttaatgaaagaattagattcttaataattttgggtacatatgcaatttcagattttctttgtcataaaaggaaaatttcatttctttttgcttgttttgtgcattgcgatgtttgtctaattcagataagcacatagcgttttcctattttcagctactaaagtacccaaaaaacataaagactttgagattcttctctacatagtgggtgaaaaaaagactacatcataaaaaaaactacacgatatgaagtcatttatatgtgttatataacttcctttgtgtgtggttaggtcatataaagacctgttgcaaaggctaacatctgatcagagcgacgtggtttagaatctccgagtgatttgaggggatatg

SEQ ID NO: 8797 - DNA, 3000 bp, Unknown
  misc_feature (1)..( 3000): cDNA_ID_3043560_gDNA_ID_1971889_Annot_ID_58474 3000 nt of promoter + ATG
gagagcgaaaatcaccggagccgacgatcatatgtggcactggcaagtggcaacggtcatctttatacatggagaggaggagacacacttgtacacgtcttctggtggtctactgccacgtggcagtattcaaatggtggattttatacatccgtgaatcttggagttgattttccttaatttaaatggtcgtactaccgacagccaaaaacttgtctttcaccaacaaatatgttttggaaggctgaatatcatcacacaaacaaaataaaaaactaacatttattttgtatgaaactacatcttttatttctgttcagaattttcgaaaccgttgaatttgtttgtcgattggaaataactagtgaacgtacgtaactcgaggattaattattaaacaaattcaagtattaaaaaaaatggacaatgcatgtttttctttacttttgaattttattttttatgatcacgattttacgtttgattcaatttctcatattacatgctactattgacaatatttatatttttcttattataacaatatcttttttcttttctttttttaacaatatctttttttttaacaatatcttattttaaacatctttaatttgtatgaacacaaatagatacatgaatatttctacgcgtgtgttaatttcctatttttgtgaaacaatatcaacgtctccgcgaatgcgttgaatataagtcatgattttatatatttttttatggttttgaacccacatctgatatctaagtgaagtatagcattctataaaatgtaactaaactttagatcatcgagtgttatcatgagtaacgtaaatgaaatacttaagttagataattacatacacaagggtggtagatcatctcattttgaaaaacaaaaaggaattacaagaattgaataataaaaccattaagtgagataaatacatgcacatgggtggtagatcgcataataaacgccgtacgatggatgagtattaaaaaaacaatgaaaatgcagctttggagttagaactcgagattcaaaatccaactattggtaaatctcaagtgattaatgcattattttgaagttatgatcgttgtcagtactattgattatgtagcctttaatgtatgcttaagaatatgaaggtttttcttagcttgtttcttaattttgaatacgtaacaaccattgttgtctccgcgagtccttgtctgcgtttagcaacatgttgatcaaggggatcttgattgtgagcgtataacaaccatcgttgttttgttctcttctataaatgatcttctaatctcacttttctttttccgttcgtttttctataacaaaaaattaacgtcaaggactcaaggggatttgaacgtttgacttttgatatttagatgaggaatggggagagactggtgactttcaaagttgttacgtggctaattaactcccctaggatttgtgggagaatccaaatcacgatcgatttttgctcaaaggagctgaatataagatggatagcaaagatacaaaataaaataactcagtaagagctttatttagtgcaaggggaaataaagaacgctaagcttaatcagtaaatcttagattgatgtcttgaaatgatgaagaaggagagttgtggatagtggctggcaacttccaaaattagctacattgatgcttataagttataacaacatatttctgtgaatctaaacttgctagaaatttctaattacatggttttgcgggcttctaattgaatcataattgggcttcttgtgaattctctaaatgcttcaaaatgaatttggatttaacaactctatccaaacaaacctcagcaaagccgtacgttctagctttttaaggtatcttcagtgcagattgtgtatatactgactgtaagaacaagaaatttataatgtagtatgtaataactccaaaaacattcatcaagctaaggaaaataatcaataatgggatgtcttgtctacttcttcaagcccattgaagaaggcacggatgggcccatacgaaaagatttttaacaagtctagccttcaaatttcctaatggctaattaaatagtttttattagataatgaccatgttctttgattgatcgctacgtcagctacctgcgatctaaaaaaagctctcatctctctttcacttttatttttcctctctttcatctttgccgcagcgactgtaattcggctattccgtagacgctggaattttcaacgtctcaaattccctttctcctatctcttcagatctatcgctgcgactctttcattcatctcaccttcatctttccttcttttttcttttatattttgtgccgccggtgcttgtcgcagcgatcaacaaaagaataaggtaaatattcattttgggtagtataatatacagtagtgagacatgggcttatgtcacatacactcacatgtgtcacacatacacctatttttgattattttagtcttgtttgtgtccattggaccttgagagaatcataattcattatctgtatcatgaagatttcaattcaagaatttatattcttacaggtccattactcaaaaacaaaaaagtaaagaaaaagagagcgagataaaatgatttcaatgaaaaataatttgaaaaagaaataattaataataaatatattgtactaacatacgcccaaaaattccactatagcgtatctcaagattcaagatctccttcttcttcagctctcgtcatcatcattctctgcttcttttcatttgctcctgttaacaaatttgccaactttcttccattttcgaatccctcttaacgcaaagttaggttttttgttaattcatttcattgcttggatcctaaggaaaaaaaaaacagaaatgaaaaaacccaaattgtcgaaagtggaaaaaatcgacaagattgatctgttctcttcactatggaagcagagatcggttcgtgtaata

SEQ ID NO: 8798 - DNA, 3000 bp, Unknown
  misc_feature (1)..( 3000): cDNA_ID_1989213_gDNA_ID_1971889_Annot_ID_58475 3000 nt of promoter + ATG
gctggaggaccttgggtggtgcttgctgttggggcaattcagtgcttcgccggttactttctcatttgggcttctgttaccggacttattagaaagcctccggtgccgctgatgtgcctgtttatgttcttagcagctcagtcgcaaacgttcttcaatacggctaatgttgttagtgccgttgagaatttcgctgactatggtggtacagccgttggcattatgaaggtgagtttttgatgaagcttttcgatatattgaatggatctgtattgttggatcacgtctcagtttgtttccttgggacctaaagaccaatatttggctatgatgatgatcctggtagagtctaaatgaggaggctttggtaacatttggaaagagattgatgctttgaactttggatcaatcgagatctagatcttctagttgatatatattgcgtagtaaatatttgttcttttctgataaaccttgcaaatgaggatgcaacctccacttttaagatgagaaacttcaactaaaccccaaagtatgttaatagtgggagattcatggtttcaactttggaatttttgattatagtgaagcatccaagcttacctctaattctttctttgcagggttttcttggtctaagtggagcgatactgattcaactgtacgagacattgtgcgctggagatccggccagcttcattctcttactggcagtaacaccaacagtgctctcactcttggtcatgcctctggtcaggatctatgagacaagcgtagccgatgataaaaagcatttaaatggtctttcagctgtatctctaatcatcgcagcttatcttatgatcattatcatattgaagaacacttttgggttgtcatcgtgggccaacattgtcacacttgtatgtctactcgtcatgcttgccttgcctctacttattgcgagaagagcacaacgagacggcatggaaaaaacagtaccacatgattattcccctctcataagcagtccaaaggcaacaacctccggtaaccaaagttctgaaggtgacagtaaagtggaagctggactgagtgagaacctgaatcttctgcaagctatgaaaaaactaagcttctggttgttatttcttgccatgatttgcggaatgggctctggactttcaacgataaacaacatccgacaaataggtgagtctcttcgatactcatcagttgagataaattcattggtctccttgtggagtatatggaactttctcggtagatttggagctggttatgcctcagatgcattgctacacaaaaagggatggccacgtccattgctaatggctgcaacacttggaacgatgagcataggccacctaatcatagcctctggttttcaaggaaatctctatgttggttctgttatagttggcgtttgttatggttcacagtggtctctgatgcctacaatcacctctgagctgttcgggattcggcacatgggaaccatcttcaataccatatccgtggctagtcccattggttcctatatcttctctgtaagattgatcggttatatctacgataagactgcttccggggaagggaacacatgttatggctctcattgcttcaggctgtcatttattataatggcatctgttgcgttctttgggtttcttgtcgccattgtactattctttcggacaaagacgctatatcgacagatccttgtaaagaggttgcatcatcgatagagttcttgtgaatactatacttttggagaaaaacgaatactgcttctcttgctacatccatggtagcttatgcttccaaaggtacacatcaatttctttacctataagtttgattgtaagttatgtttgtatcaaatgtctgtgtttagagatgggaagaaagaaagctgagatctttgtctctctttctttttgtagtttcttccaaaaatgtgagttttgtgaattgtatagacatctcaaagttcccaataatgttgaaattttttaaaattcatattgttgactactatgcatttaaatagtaataatttgcaggccatcaagtctcgttcattcattattcagattaatccacaaaccaatctccatgcaccaacactcttattcaatgcgttttcaattatacttttgatcatttccacataaattactttgttaatcaatagaaagttatggtttggaataaaaagtagttttgcagtcttaaatgggaagagaacttgaagaagacaagtccttttttcctttgttctaccaacttcaaacctacttttcgaaccccaataagttcctagaaatccaaaacccaaatgtataaagtcaactactttgactatcacatctgaggacaataatcaaaagctagcaaagcatagaaaaagacagaacctttgttcatcgtctctctctctgacacgagaaagttgaaaaattcaagttgaacatgattatattcattaattattatatgagaagggagatttctggggatatggttgttggtagtcatgggaagacagtaaacgccatcgcaattgcatttattctgtctgcagagtcaaacaaactaattttattatttgattttcagtcctatctctcttctcttgtcttgtcctgagatcagatgtataaaaaagagacttcttttcttcttctctcttgattctctcttccactgtcattatcttcaagatttgtctcttgcgagactcgatgaagcttcatcaatttcttgtgttccttttcttgttcctctcatgttttgctctttcttcatgggctcttcctctctgttccgattcaagtgagtgatttttttttgttatcctattgatttgatattagttctgctattgtagattgatgcaacattttgttttttgatggtttttcaggagctccctcggaggtgaattcgacattgagcttttgtccttacaaaggaaaaacatgctgcaatacaatg

SEQ ID NO: 8799 - DNA, 3000 bp, Unknown; identical to SEQ ID NO: 8786
  misc_feature (1)..( 3000): cDNA_ID_1989212_gDNA_ID_1971889_Annot_ID_58476 3000 nt of promoter + ATG

SEQ ID NO: 8800 - DNA, 3000 bp, Unknown
  misc_feature (1)..( 3000): cDNA_ID_1989210_gDNA_ID_1971889_Annot_ID_58478 3000 nt of promoter + ATG
catttcagttacagatactctatcacttttcatagtggtgcctaacgagtcatgcttcatgtaggtgtttcctttgttaatagagaagttttctttccgagaacaagcatcacttgtgtggcaattcatttgtagtgttccagtgatggtgcttgaagactttttgccatggatgatctctcatctctctcacgaggagaaaattgaagttgagaattgtataaaagatgttgccccaaatgaagactcattgcaacaggtatacatatcccctttgctgagatatgctatgtttttcttctttccttttgataagctaaaattttctgaaggtcataagctcttggctgcttgacgatagtcaatcttcttgtgggactcctacagagatcatgaaaggagtccagtatgttaatgtgtctaaaagtttgaagaaatcacctgagtcacatccgtcaagcggatgttttcaacgcttttgggagtggagtaaaaagtccctttcaattccaaatgtaggacggagcccaattcatggtcttagactttttcaaaatgcaattgaaaaagatttgagagatattcaagaaggattatgccaagcaaaattccaaacccttattttggatcttgatgtactgatggctagattaaacttccttgctgatgtccttgtttcttataggtaataatagtttctcggattaacttaatttttctctttggtatagtgtctagtctcttgtttactttccttccttctttctttgagtgagttacagaatgttttgttttgttttgttgcagcaatgcatttaagaagttctttcacccagtgttagaagaaatgacagctcgccgctcttcaactgccaaacagttcaacatagatgattgtcttgagaattttcagagattgttatacaaaagtgctgatgataaaacaaagacggacaattttctattgcagcttcaggaggaacttgagtcccttataatccaagtaacaaagcaatttgccatacagagaacagaggtaaactcttatgatacttactcgtttctataacataatggaagtttttcacggattcattttgaagatgttacattgtgtgtatattatattcaattgtctcattgttgtccaggtattcccaatcatcagcaagaattgcaaccatgaaatgcagaagcagctcctatacacaagcattcatgtcttacctcttggattactaaagtgtgtcatactttggttttctgctcatttatcagaagaagaatctcaatccattcttcatttcttaagtttggaagattcttctcccaagaaatcatttccacgcctcttgctacagtggcttcgttttggctattcaggcaaaacctctgttgaaagattttggaaacagttggatgttatgttcaaagtaagatgttcctgccaaaaggagcacactgaagaagcatcaggatcattttccaaccaaacacagctgcaactatgtaaagtatctaaagatgtttatcctagaaagaaagataagtcttcaacctgcttcatgtcaatggatctagctgttggagacatgtatgagacaccttactcaagtcgaatgaatcaacaaatgactttctcaggaaagcttaagcctcctctccatctcccagatttttttggtgagaagaatatggatgatcctatgattatggatgttaaaccaattgacctccttttcttcttccacaaggcaatgaagatggatttggactaccttgtttgtggatcaacaagattggcagccgactttcgtttcctcgcggagtttcagcaacggttccatatgataaagtttttgtatcagatacattctgatgcagaagatgagattgcatttccagcattggaagccaagggacagctaaaaaacattagtcactcgtttagcattgatcatgagctagaaactaaacacttcgacaaagtttcgttcattttgaatgagatgtcagagctgaacatgttggtttctaccatcaataccactgcagctgaccacgaccgaaaaatgaagtatgagcggttatgtctcagtctccgagagatttgcaaatcaatgcacaagctattgtctgagcatatccaacatgaagaaactgagctttggggtctattcaggaactgcttctctattgaagaacaagagaaaatcataggatgcatgctcgggagaataagtggggaaatattgcaggatatgattccttggttaatggaatctttaacctctgatgaacagcttgccgcgatgtccttgtggcgccaagcaacaaggaaaacaatgtttgtcgaatggctaacagaatggtataacggtcatgttttacaagaggaagcaggagaagcaaacaacgatccatttggggattcagatccactagagattgtctggaagtatctctttgaagcatctgctgatggggaaaaagggagcatgcgcagcagccttctcaaactcccgaagacgaattttacaggtattatgaatcagcctcctcctaattacaaggttgaagttggcaaaaaagaggaaaaagatctagaacggtcagaaagtaaaaagatatgcagaggatctaaccaagagggggacaaagaacaaactgacaaaatgtctcagaaggttagccagtttggtccatccaagaaatatgaacaactgttaacaatgagtgaagaagaacttgtggttgtgattaagaaaatatcatgcgactcttccctggatcctcagaagaaagactatatcaagcagaacttgttaatgaggtaagctctactaactctcttttggtgtcctgttccaacatatttagataagcaggaaatctatttagtcttgtattgagactaaactaatgtcaggttcttctttcagtcggtggaatatctcacaacgtacatataatttggaaccatcctctctctcgagcaac

SEQ ID NO: 8801 - DNA, 3000 bp, Unknown; identical to SEQ ID NO: 8784
  misc_feature (1)..( 3000): cDNA_ID_1989208_gDNA_ID_1971889_Annot_ID_58480 3000 nt of promoter + ATG

SEQ ID NO: 8802 - DNA, 3000 bp, Unknown
  misc_feature (1)..( 3000): cDNA_ID_2028729_gDNA_ID_1971889_Annot_ID_58481 3000 nt of promoter + ATG
gaatcatgttcctaccaaaggagcttatttccctgctgtagagaaggctttagagatgattaaccagaaaagttcaccccttaacaaggtagtttagactttagagattgtgttcgtatctattcttaaaacaagtttataggtttcgttttaactgatgtttttggctcgtggaattaggttgttcttgctcgtaacagcaggataattacggataccgacattgatcccattgcttggctagcacagttacaggtgtgtttttatctctggatattatatagtagtcagttttcaatgtttagatttatatctcactaatttttttgtgtgacagcgtgaagggcatgatgcatatcagttctgtcttcaaccacctggtgcaccagcttttatcggaaacacggtaggtctttttatatgtagtctgtgataataagttctgttgataaagatatgtgcacatttgttatttatttctaagaaatatgtttgtgacatacatctttgtgaaacagcctgagagactattccaaaggactcaattaggtgtctgcagtgaagctttggctgcaactaggcctagagctgcttctagtgctcgtgatatggagatagagcgtgacttactaaccaggtcaatttttacttcaagtgctttgaacaattacagaatccagttctccattatcattttactgaatttttgctaaactgttgcagtccgaaagacgacctcgagttctctatcgtacgagagaatataagagaaaagttaaacgtaagttcaatcttgatgctctgcagcttcaatgcttcatttcttggataatagtttggtatattttttcttattatgctttcttctgctttgcagggtatatgtgacagagttgttgtcaagcctcaaaaaactgtgaggaagcttgcaagagtgcaacatctatattctcaattggcagggagacttacgaaggaagatgatgaggtgagataatagtattggaatagtttttacatttccaagctcttcatttcttcgaattagctttaaccctttttctttctatctgtctatagtataaaatattggctgctctgcatccaactccagctgtttgtgggcttccagcagaagaagcaaggcttttgattaaggagataggtaaaatatctaccttggttcaactatcttctagtaactatagatgtagagattaagaattatgctgactcaaacattttgcttcttctagaatcattcgatagaggaatgtatgcgggacctattggattttttggtggcgaggagagtgaatttgcagtcgggatcagatcagctctagtcgaaaaggtgagcttatttgatctctttctccctttaaaaaacacactttaacactaattgttatagcaaaatcgatcattacggtttttgctacaacttgtaaaaaaatgctgaactgtattttgatttacagggtcttggggcattgatctatgcggggacagggatagtagctggaagtgacccatcttcagagtggaatgagcttgatcttaagatatctcaggtacgagcttttgtccagaaaatgtttagtgacatcatggttctctgttaccaaaatcctaatttttattctctcttttgttgttgtttttgcagttcaccaagtcaattgaatatgaagcaacaacatctctacaggcgattaattgaagaaagagtaacatttgtatttgattgttttgtttgtatgggggataaggggttctcacaataagaaagcaatgttgtctctcttgtaaattaaaaaagaaatgctttaatttgttaatgggccgagccttttcgggttgtaactagggcaggcctatcatgaatgttcataggcctagctgttatgattgttaatgagcttctatagtgtttttcttcaaagacagatatattcaatatggatctaaaactgaactgaatttaactgacatgacaatcgaatcaaattgaatttattttttcaattttcatttagcaagaagtgacccatcttcagagtgaagtaatctatgcttattatctcgattaagcaaaaatccgtagaatgcttgggcctttcaacgatgatgtagccgtgtaggacaggtttacggaatctgcttttatgcaaatggtaaatattaatattcctttataagttagcgtttcagatcatcttctttcgttagattaagaaactactttgttattatataactataaataccatccaacaaccttactcgccatatcttttcatgtgtggtggtttataggaacattgaaaagtaccatattataaaatgaagaatcaacacgtcaacaaaaacacaaataaaatgagatagtacaattaaaaaaatggagcgcatgtaaaaagtgaagaatcaaacgaaggcttggcgatagagaatggaatcagatttcccattatccccactctaacaccatatattcctttccctttttaccctccacctcaattaggtttattaatcatatttaacactctaattaaccaacccatttcatctcttttattttactaatcacaatgctttggcctcattacgttttacctagatttactttgtcacaaactacacaaatatgaacctaattatctacactcgtgtcagaaacagttttagctaatatttagtaagttttaattaaaactaatgaaatgaataaatagtgtatagtacataggatttgtttttagtttattaatggaaattaagatttcattagtactaaaaacatgtaaataaaataaagctttaaagaggaatatattcaaataaaaaaagcaagacctcgaaaaaaaaactttctattatctctcttccgcgattaccgtaatctctgtcacaaacaacaaaaccttctctctctcactatcttaatgagagaagaagacattctcgagaaatgagaagactaccactacgatg

SEQ ID NO: 8803 - DNA, 3000 bp, Unknown
  misc_feature (1)..( 3000): cDNA_ID_1989206_gDNA_ID_1971889_Annot_ID_58483 3000 nt of promoter + ATG
gttggatagagctctcaactacaggattatgtaccttcctcaagctacgtttaaccttttcaagttcaatctgaggatcttcgacagcgggtggctctatcgactggcttgaaactttccggaaactgcgtttgggtttctcaaactcaaaagatgtctgtactgaggaactttcaaagtttgaagcaggaactttacggacactcttcttgggtttagcagactcagcctcgactaaaagcctgttctgaggttttctgcttatcgttttcttcggttgaggaactggtttccagaagcatgaggctgaccagttctctaaccagatcaagtttgagtttggattggatgtatcatatgcgtgtacaggtagcacttttggtgatgaagcgagaagctgtaaacaaaattatccatcaagatctttaaataaaattagagactccatagtataaaagagatattggatacagtgaacatcattataataaataactctaccaacaagcgtaccttctgagcaaaagcattggctgttagtttcttgattccaaggtaagcatctgtaggatttgcaagcttgttcccctgataaaaaaagccagttctaacaattatttccccaccaacccaaactagaatatcttcctcgactaagtttgtatttaagtgtaagtttgaacttacaaagaaatgaaagtatcattacctgaagtagctgcaatctgcatttcctataaacttgaactccaatgtcggacttcctgatctctcttcctcgagcaaatgcttgcaacctgacaattcccatgacagagaaaagagttgcaacagcttgtctcctaacaaggtgaccacggataagcgcttgtagccttattatgcctttgagtgcccaaaaagcacgccgagccttcacacaaagagctcatgttaggatatacaaaaagacaacacaccagaagcagcaatcaagagagagagagagacaagcctaataaaatcgaaacagctggaattattaccaagtaacctctaaacgcagcctgcacagacgttgctgcaatctctcgttggattctctctgcatcagataatgaatgatcttgaacaggtgcaacattctgagaatctgttgattttccttcaggaagctcaatttcatcatctgagatctcttcaggtcctacattttgagtctctaacataccaccacttctatcaacggtattggtctctgcaacttcaaaagatggaagatctgataccacatctgattcttccacctttgaagtaaccagtacctcttttccactcacaactctctgcgcattattataactataattagaacaaaaaaaaaaaaaaaaaaagacaatcataagcaaattggtagcctaaaaccatcactgttttctcaattatgatccaaattctccacatacagtatttaatcatcacatacataatatagaattctcttacaaaagcgttacctctttgtctttggaaccactagatttagaagtttttttcccaagcaatacattcttcaaccattttgtagacttccccataatgtatagaactaaaacaaacctgcattgcccaagaaacaacacaagccaatattagtatgtgaatatggcaactactagtctaccacaatagtcaaaatgaagaagtcttttaattcattaattagttatggcaaaaaaggagagtaacacattatcttgttctaatcaactctaataataagcttataaagataaacctaatgataactaaatgtaagaatcaagaaagaacaaaaaaaaaaaacaatgattaccatataaatttatgaagtgaaattaccagatctggaactcagactgaaaaagaagaaccctaaatgactcaaaatccactttccaaaatgaaaaacaacaacaaacaaacaaaaaacaccgacagagtcaaacaacaaatcccaaacagagagatccttctaaaacccaacactactcgaacaatgtcttaaaataaagtcggtttaaagttggagtaaccgtcggatctccgttctaaatccaagtccgattcagaccaaacaaaaacaataacaaagaaggagataatataccgtaaattagaaatttagagttgtgttagttcaatgcttccatagcgtctctctctctcttcctcggagctttgatgctctctaaagaactgtttttctctttggtggtggtttcagagactttcagtgaccagacggaaagagaaaataaatattttgcgcaaaataatatttctaattttaaccaaaaagtaagcgagcatctccataactccaatcttacgcagttgatttctagccgttggatcttctctgaaatttagtatttttgtcaaacatttttagtttaactaaaattaatttttacagaaaaattcagaactcgaaagagggaaaattaaagaagagttaagagagcaatctataaagaaaaaaagctgaaaatcattaaatgcgataattaaaatagaagaaaaagggtaatttagtctaaaaatttggttatgtcatcagtagtctagattttaaaatacaacagtaacagatatttaattgaaattgctcagattttgttatagtcgtcgagattacttcgaaaacaagtgtaagaataccgcgacgttctaatgaagcattcgaagtaaatttacaatcatacccttgcactgtcgttgaatacgaaagaccaacttttgcaccagaggcacgtgggaaatttattaaccagtgcctagtggttcccgctccagtgaagtagtctcgttaaccgttatgggcctaagcccaatccataaaattattaaaaaaaaaaaaaatgatcatggaagaaaaaagcttgtgattgtgagacatttcatcgaacacttggtgatcaatatttgaaaacgaagagcacagccaaaattcgataaaccctaaggaacagtgagatg

SEQ ID NO: 8804 - DNA, 3000 bp, Unknown
  misc_feature (1)..( 3000): cDNA_ID_3043560_gDNA_ID_1971889_Annot_ID_176826 3000 nt of promoter + ATG
aaaatcagagaaagaaagaatgaaacatgcaatatactaagtgatgttaaagtattacaaagagaccaagcaaacaagtgtggccgcagagagagcgaaaatcaccggagccgacgatcatatgtggcactggcaagtggcaacggtcatctttatacatggagaggaggagacacacttgtacacgtcttctggtggtctactgccacgtggcagtattcaaatggtggattttatacatccgtgaatcttggagttgattttccttaatttaaatggtcgtactaccgacagccaaaaacttgtctttcaccaacaaatatgttttggaaggctgaatatcatcacacaaacaaaataaaaaactaacatttattttgtatgaaactacatcttttatttctgttcagaattttcgaaaccgttgaatttgtttgtcgattggaaataactagtgaacgtacgtaactcgaggattaattattaaacaaattcaagtattaaaaaaaatggacaatgcatgtttttctttacttttgaattttattttttatgatcacgattttacgtttgattcaatttctcatattacatgctactattgacaatatttatatttttcttattataacaatatcttttttcttttctttttttaacaatatctttttttttaacaatatcttattttaaacatctttaatttgtatgaacacaaatagatacatgaatatttctacgcgtgtgttaatttcctatttttgtgaaacaatatcaacgtctccgcgaatgcgttgaatataagtcatgattttatatatttttttatggttttgaacccacatctgatatctaagtgaagtatagcattctataaaatgtaactaaactttagatcatcgagtgttatcatgagtaacgtaaatgaaatacttaagttagataattacatacacaagggtggtagatcatctcattttgaaaaacaaaaaggaattacaagaattgaataataaaaccattaagtgagataaatacatgcacatgggtggtagatcgcataataaacgccgtacgatggatgagtattaaaaaaacaatgaaaatgcagctttggagttagaactcgagattcaaaatccaactattggtaaatctcaagtgattaatgcattattttgaagttatgatcgttgtcagtactattgattatgtagcctttaatgtatgcttaagaatatgaaggtttttcttagcttgtttcttaattttgaatacgtaacaaccattgttgtctccgcgagtccttgtctgcgtttagcaacatgttgatcaaggggatcttgattgtgagcgtataacaaccatcgttgttttgttctcttctataaatgatcttctaatctcacttttctttttccgttcgtttttctataacaaaaaattaacgtcaaggactcaaggggatttgaacgtttgacttttgatatttagatgaggaatggggagagactggtgactttcaaagttgttacgtggctaattaactcccctaggatttgtgggagaatccaaatcacgatcgatttttgctcaaaggagctgaatataagatggatagcaaagatacaaaataaaataactcagtaagagctttatttagtgcaaggggaaataaagaacgctaagcttaatcagtaaatcttagattgatgtcttgaaatgatgaagaaggagagttgtggatagtggctggcaacttccaaaattagctacattgatgcttataagttataacaacatatttctgtgaatctaaacttgctagaaatttctaattacatggttttgcgggcttctaattgaatcataattgggcttcttgtgaattctctaaatgcttcaaaatgaatttggatttaacaactctatccaaacaaacctcagcaaagccgtacgttctagctttttaaggtatcttcagtgcagattgtgtatatactgactgtaagaacaagaaatttataatgtagtatgtaataactccaaaaacattcatcaagctaaggaaaataatcaataatgggatgtcttgtctacttcttcaagcccattgaagaaggcacggatgggcccatacgaaaagatttttaacaagtctagccttcaaatttcctaatggctaattaaatagtttttattagataatgaccatgttctttgattgatcgctacgtcagctacctgcgatctaaaaaaagctctcatctctctttcacttttatttttcctctctttcatctttgccgcagcgactgtaattcggctattccgtagacgctggaattttcaacgtctcaaattccctttctcctatctcttcagatctatcgctgcgactctttcattcatctcaccttcatctttccttcttttttcttttatattttgtgccgccggtgcttgtcgcagcgatcaacaaaagaataaggtaaatattcattttgggtagtataatatacagtagtgagacatgggcttatgtcacatacactcacatgtgtcacacatacacctatttttgattattttagtcttgtttgtgtccattggaccttgagagaatcataattcattatctgtatcatgaagatttcaattcaagaatttatattcttacaggtccattactcaaaaacaaaaaagtaaagaaaaagagagcgagataaaatgatttcaatgaaaaataatttgaaaaagaaataattaataataaatatattgtactaacatacgcccaaaaattccactatagcgtatctcaagattcaagatctccttcttcttcagctctcgtcatcatcattctctgcttcttttcatttgctcctgttaacaaatttgccaactttcttccattttcgaatccctcttaacgcaaagttaggttttttgttaattcatttcattgcttggatcctaaggaaaaaaaaaacagaa

SEQ ID NO: 8805 - DNA, 3000 bp, Unknown
  misc_feature (1)..( 3000): cDNA_ID_1989205_gDNA_ID_1971889_Annot_ID_58484 3000 nt of promoter + ATG
atatcatatgcgacaaaaagtaatacgtatgagtttacaaagcaaatttgcttctttttttttaataacttctggttgcaaggtgatatgaaaaccccaagtccgttctggctaaatctaattattaaaatatgattttgtttgtaaaactataacgaatatcattcttctgcagaaatcaattttctttatttttctaacaatataatatcctgtattcatgattaatttcttttaataaaataaaagaaaattgatctctgcagtcaataatttacatagcaatcttgggagatggtcttgttacacagaaaattgattttcaaaaccaatgatttacataacaatcttgttgcagggaaataataagatttgggatcccatgagatttcctctgaatttatctgatattggtgtgctcgtctgtattctctacttccacacttcattctttatcgagatagaagaaatcttaaaattaacaacagaatacaatgtttacatgtggaatacaaaaacaaaagtatgtaaaacctataagagtgttataatgtttagaatccttgtgttagtgcaaacacacgtccctctaaaggtggaggcaatgcagaaaccgcatcttcgatttcctgtgaaaactcgcaaagattaattaccactacaaggtaagagagtaactgatttcctactgcttcataaccaggttggataaagaagacacaccttcactgtataccgagccgaaaagtggattagcaggattgctttgttttcaaacttttcagcatgatttactatctgcagtttaaggatatatgaaatcttctatgaccatcaagagacagaaagtaacaagaggtgtcaaagaaaggaggatcctgacctcagatatatggatatgtccataatctctcgcatgctctaccgataccgaatcatcaagaaatgtgctctgcacaagaggaaatagagacagcttcccttttaatacaaagccatgaaacttggaccgggaagaactatatcattataaatcacgcacattgtccaaattcatatcagtagcagatattcacctccatgacgagaacctttgccttgagagcatcagcattagtttcatcaactacaaaatccgacgttgtatctcccgtaaaagcaacttcaggagttattatgctgtctgtaatctacaatccacaatccaaacttattaaacaggcttatatactttggaaagaccattgcaaaactattgactttgtgatagacaaacataagaaaaaattgacaagcaatattaagcaaatcaaagacaaacctcaacacctgaaaccttcaagttcttaatttcatttccagataggccaatatattccttcttgagtttatatttagttgaatacactacataaccctgcaaaatatcaaacgaaagcatgaattcaacgaagacacataacgctaagatatcgaaaatctcatgcgagtttactaaaataaacctggctttggatgacatggaatgtcttaaaggctttgactttgagatctttccttataataaactcctcccctgcatgaagaagtgtccaaggtttaacaaaaaagccaaatcttggctgcaatgaatgctagaggttgagttaccacctatgtccaagccaacaagattgtgctttagctctgaagaatctaactttctgtgaacttcgaataaactctcaacagtttctttaatggatgcgggtactataatcgttggaggcttcattttgtacaagcctctagtagcaacatacattggtaatccaccctaacataacaatacgaatagtttagctcacaatttgagaatgtaacacccaaacagtaacagagcaataggctaatataacataacaatttagctgacaattagagaatgtaacaccaacacagcaacagagcaatatgctaatgataataaacacatggtggctctcaacaagggtttatcaaaacagtaacagagcaataagctaatgataataaacacatggtggcagtctcaacaaaggcttatcaaaattgttcttaaaacaaaaagtcaaaagaaggatctttgcaaaatataatccgaaatttcaagtctttttatagaagattcaagatacttacgatatgatccatgtgagagtgagagatgaagaggaagtcttgagaaattgcgcgatgtgggcaacgaccaatgtcgaaagctatccgaagagatggaaatatgatgcacgtctcgtgcccaccaatcgacaatccctcgatcgggtaaccttcaatttgcattgctttcttcttctccatctcactgttccttagggtttatcgaattttggctgtgctcttcgttttcaaatattgatcaccaagtgttcgatgaaatgtctcacaatcacaagcttttttcttccatgatcattttttttttttttaataattttatggattgggcttaggcccataacggttaacgagactacttcactggagcgggaaccactaggcactggttaataaatttcccacgtgcctctggtgcaaaagttggtctttcgtattcaacgacagtgcaagggtatgattgtaaatttacttcgaatgcttcattagaacgtcgcggtattcttacacttgttttcgaagtaatctcgacgactataacaaaatctgagcaatttcaattaaatatctgttactgttgtattttaaaatctagactactgatgacataaccaaatttttagactaaattaccctttttcttctattttaattatcgcatttaatgattttcagctttttttctttatagattgctctcttaactcttctttaattttccctctttcgagttctgaatttttctgtaaaaattaattttagttaaactaaaaatgtttgacaaaaatactaaatttcagagaagatccaacggctagaaatcaactgcgtaagattggagtt

SEQ ID NO: 8806 - DNA, 228 bp, Unknown; identical to SEQ ID NO: 8782
  misc_feature (1)..( 228): cDNA_ID_1989204_gDNA_ID_1971889_Annot_ID_58485 3000 nt of promoter + ATG

SEQ ID NO: 8807 - DNA, 3000 bp, Unknown
  misc_feature (1)..( 3000): cDNA_ID_3043625_gDNA_ID_1971893_Annot_ID_176859 3000 nt of promoter + ATG
ccggagactgagattattattacgaagacgcagatggtgaatctcaagtgtgctgcttgtgggtttatctctgaggtcgacatgagggataagttgactaatttcattctcaagaacccacctgagcagaagaaggtgtcaaaggataagaaagcaatgaggaaagctgagaaggagaggcttaaagaaggcgagctagctgatgaggagcagagaaagctgaaagctaagaagaaagcattgtctaacggcaaggattctaagacgtctaagaaccattcttctgatgaggatataagcccgaagcatgatgagaatgctctagaggtggatgaggatgaagatgatgatgatggtgtcgagtggcaaactgatacttcccgagaagctgctgagaaaagaatgatggaacagttgagtgctaaaactgccgaaatggtgatgctctctgcaatggaagtagaagagaaaaaggcgcccaaaagcaaatctaacgggaacgttgtgaaaactgagaatcctcctccgcaagagaagaatctcgtgcaggatatgaaagagtatctgaagaaagggtcaccaataagcgcgctcaaaagtttcatctcgtctctctctgaacctcctcaagacatcatggacgcactcttcaatgctctctttgatggtgtgggaaagggattcgccaaagaagtgactaagaagaagaattacttagcggctgctgcaacaatgcaagaggatggatcacagatgcatctgctcaattcgattgggacattctgtggaaagaatggaaacgaagaagctttgaaagaggtggctctggttcttaaagcattgtacgaccaagacatcattgaggaagaggtagtgttggattggtacgaaaagggtctcaccggagctgacaaaagctcgccggtttggaagaatgttaagccttttgtggagtggcttcagagcgctgagtctgagtccgaagaggaggattgagtcacttttttcttccctcctaacttttctttgcggcatttcttataatacttcgtcagttttcagaattcttaaatctttttgctgtgttcttataaagaaacatcatctattaaagttgtcttcgtttggatttggttttgacgactttgggaaatatttatgtttaagaaggtttcattggtcattgacttttatatattatatcgtaaccatgatgtgatagtgggccttagatcaacaaacatgcgaaaaacagaagcagaggcccgtttcaacggagcataataaattgcattctctgtcttttgtttttaggttttttttttaactgatagatgtgccgtcgaaaataatattgatatttaaaaattcacaacaaacattcttaactgacccacccatctatctgctattcccacgcgccaaggaaaataataataatagcgaaattgatttttacatttatttattgatagataatttgtgtattgttaagattaacagattttaagggattaaagtggaaaaggtaaaccgaagacaacttgccatttactgatttacaacaatccaaatttaaaaacaaatggtcccagtttttagggttgtcacttaaatttatcgaaatatttacactttaattgggtaaaacataatggacagaaaaacaaatattgtgacaaacaaaaaaacatgttttcaccaagaaaaacaaaaacaaaaaagatgtaaagcttttcttacatctgtacaaaataaaagcagacgaaattgtactttattttccttattaaattgtcggtatgttttatatgttgtgaaaagtagaatggataaccaaataaaaattactgacatcttaataaagttggttcaaccggtttaaaatgtatttttttagtgttaacaacttaaagcttttttcgattatcgaattgcaacaaacaaatatattaacagaaaaaaggaatcatgtatctatttcaatatcctgttttttttcttccatttggatatttagatctttttctgaatttatcttgttcttaaattaaaacagaaaaaaagattaaaagtaagacagcttgctaatggcaaccgcaacaaacaagataattttgaaacggatccacttggattttctttgattttgtagaaaaattgacaaattgcttttgtataaaaacaaaaaatgtaccgtaaaaacacacacataaaaaataaaaagtgataatgacaaacaaataaagtggtatttttcttttatctactaatgtgattataaaaaaatcgacattgaaaatttcaacacatctttttcgccaaaacctgaaaatggtcttattataacataaattagtttttttgtctttctattatatattcaataactcatcccaacttgaacaaacctatttcaaatttttttgtcttgaataatgataagttccgtagtgttcttttctgttgtgacaaaaaatactagctaacgagggataagcacaaaaacatgattaatgtttctctaatcattctaaaaatctacaggaatattcccttttcagttttttctttcttaaatgcatttcttagttcttcataattcagtgagttttaataacaataataaaaaaaagagcatcattaattgaacctaaaaataatgagaagaaaaaccaaaaagatagagagtaagatgcacgcgctaaagatcgaacggttaatagaatcaggttagtgaagagagatattaaaagtttgttgtcgtgtggcaaaaactataatttccttctcacaaacaaaaaaaataaaatcaaacacaaaatcccgtagcatcgtaacagtaattcgctattatctcctcaccctccgctttcgcttcccttctctgcccgtttcaattccttctaagacatcacggtctctctctataaaaacagtacctacctcttcttcttcttcttcattcgctgacttcgtttacactgaaaacaaatacct

SEQ ID NO: 8808 - DNA, 3000 bp, Unknown
  misc_feature (1)..( 3000): cDNA_ID_2039641_gDNA_ID_1971893_Annot_ID_176867 3000 nt of promoter + ATG
atatggagctttattatttaaatctttgataccttcttctgtaattatgaaacacagataattatgtaaattagcaggcaatggagtaaatatggtgacattatgagtcactgatctgcctaatggagtttgatgatacaacaatgaaggaaggtcatgtgcacttgtgtgacgtgagaatatcctccggcttgtttggtctttaaaaggaaaggacaccacaataacaattatcaattagaaaacaaaaaatactccttttattcttagtcaccaaacaaataaaatcagctccttttttcataccacacaatgggaacaaaagcaatgataaaagaagcccatcaccttcctttgcttttaaattattcataatttatgaaagaaacaaaaaaaattattatttttatttttgcttctcttccggtaagtcaaaggagataatattaagagtttagatattaatctcttaaattctgtgttcattttaagattttgtagcaaaagtttattattactaatcatgtggttgtactgcatgtttaaccaacatgaaagaatatgtattcattttttcggaatgcgaaataagagaatcaatctcagttcagttcaagttcgaatctttgaacgacatgcggtttatataaaaggaactatagtatataaatatatatttatatatatgcctcctttaatagattttcttatattccttctttgttttgtaatttatggagaatatttactatgtattcttcatgaagcaattttacaaatattcgaattttaatttttccttttttgaacgtctgatgatcgatcattcgcgtgcacaagaatctcatcagggcatgatagattcgaaattttgatttgctcagttacgatatatctttgattattcttcctacggcggtttaaacctaaaaacaagttttcatgttttattcacctagattggtttcaagtgtattttctaaccactatttttttcaagaaaacgggaaacaaacagaaactatttctggtgcaaaatatagtctgaaaatagtagaatgcaatccatatcaatcttgaaagatatatttttttaaagtgtacttgagaagaatgtaagaaataagagattaaaaaaggtacggagaagataacgagaaaagcaataaaatgcataacttttgtagtcataacgaaaaaaaggagaaagaagataatgaaaatagtggaagatcggtgtcttcgtgatgaattaaagtagaattgtgtgtacgtaacttttgtaatcatactttctttttcttcatcaactataagacgtaacaatgatatctataatgcatgcatatagttttaaaattatctaggttcttgaccaaggcttagttagctcggtaagtttctaagaacttcgatttaccaataaatcaagccaaactatatatgatctttcgcgatgccaattgatattctgacaggatcatacaatattgttgcttttcttgtatttatttatttgcgtatcaccgcaccgattcatatttattatagtatatagattggaaaaacaatatagagggactctttattaaagtaaaaccaagagaggaaataaaactgaataagaaaataaacaaacatgcttgtctttgtcgaacacacagatttttattacacaagtggttccgaactaattaagattcctaattttaaaataataaagagatttaaaaatgttatcttttgtgtttggtaggccattaaagctccaattatttgtcactaagtcagggaaggagactaagcataaagacgccactgcataaaccttatggtcccctcaaaataaacctaaagttgtaaaagaaagaaaataaaaacataacgttgataaaataaaatttgaagaaagaaaatcctacatctttgtaccacctatatgaacctaacttatagggaaaaagacattgattcttttgcagacccatcagcgtgcatgtccaaaaagatgtgaaaatggtttcgaaaattatggattggtcatgatcagttagacgataattcgggctatgattatgaatatatatttatatttaaaaggatgaatcttttcaactttagatattctaattatagtataaatcatgatcattttatcatttacgacatgtttaaatcgccgtaacatacatagaaacatatgaaacgattttacatatatgacaattcaatttatatatatactacaaaacgtacggttctatatacactacatttatgataaacttcgaacttgtctatagtttaagaaaatctgttgctgctgtcaaaagcactaaatctttgatcaaccaataaatcaaaagtttcccacgataccaaaatttaaagaaacgggggaaaagtatatttgttctgttaaaactatttattatttgaaccctaaaacataagactctttccaattctggaatgcaaataaattatacaccaccggaataatcgactgaacttggtacgtgtcgacatcggaaggtatttcagctcttggtagatgacatcacgtcgtgcgtacctcagaaattaaagcgcacgataaggtcaccttctcggctttgccaaagatgcatctctctcttgcgttttgtttgtcgttaaacgtttcgttcctttaaattgattgtgattatttcttaataaacttgattactattattaattctttaacttaaatattactctaatggtgatgccgtgatggtcacaaataaatgaaatagaaaaagaccaaaacaaaaaaaaaaaatccttttttcctctcttttacatgatgggaactcttgacctttaagttttttttttttgtgacaggaagtgttcaaaggaacgaaatacacttcttcttccatttgatgtctgtggtccgaatgaaaaatatctctgtattaaccagaaacgtgtttcataagcatctttaactcttcagctctcaaattcttc

SEQ ID NO: 8809 - DNA, 3000 bp, Unknown
  misc_feature (1)..( 3000): cDNA_ID_2039866_gDNA_ID_1971893_Annot_ID_176870 3000 nt of promoter + ATG
cacaatgtctattgctcataaaattttgagagactcgaatacaaagacgggtaaaaagtctgggaaaaataaaatctgaaaattgtatcactggtcaccaggaattgacttgataatgtcagaatcacctgaaacaagtcgaaagacaaaatcattagtagatctatcaatgaagaaccagcagcaatatataagcaagtagctagctcttttaccaggatcaacaatgctcagacaagaaacacggaagtactttccgcaagctgttcccaaatcaacgttatctgaaagccattaacaaggagagaagaaaaacacagttaagccaaagtggtagatacaagaggaataaccgatgaatgagcgttgaaacatgaaactatgttcaatagaataaacattcatctactttctttgatgaaatcatcaagataatgtattaaaacgctccttcgagtattatcatcgagcaagatcaagttttgtctaagagtcaaaatctaacaatgcgaaatcatagaccaacagagcaatctttggtattatgaaccatgtcaatatttgcaataaccacatacagagacaccaacagcagttcaaaccgatcgtgaacttgcgaaagatcaagacttcacgtcaatatacattacagtttcttcgacttgagatcatacttccatcatcagtttaatggtctatagaagcagattttaacactttcatctacttaagattatacattctcagttattatacacaatgaaaaccttcacaaaaacaagagaacaatgaatctttaaaaactggacgagctaaagaagaaaggaacttacttccattgtaatggtggacaccaactttagcgagcattgcgtagtactcaatctctgatcttctcaacggtgggcaattggtggagattagaatcagtttccctgtgaacataagcaaaaaccagaatcaataacaaactacaaaaagctaaaacatttaggtatgcagaccaagtgttcgacgcaattacctttggagccacggagggatttgagaacagacttgtaaccaagagtgtatttaccactcttcataacaagagccaacctactgttgataccctcatgagacttcttctgcaattaagcaataaacccagaaacatattagtacattgagatcgtaaacgatatctagatgatgaggaaaagggataaaactttgatgggagagaataaggcgcaccgttttcttttccgtcaccattttcgccggcgatggagtgtaatcaaaatgtcttggatctgtgcggtggaggagaagaggagcacgatgaccaaaccgaaaaagcgccgcttcgtcacctttttatagtccgtgtcaattttctagggtttttgctcttcaatttattggaaatttcaattatgcccttaatgtttctatagttttgtaatttgtcaattaaaaaagtaattactcgatttattcgtttcagtgaattgacagtgattaaattagcataaaccacttgtacattcaacattttgtcgacatgaaacgtatttgaattactttttaatttacaaaatatgcagaaataaattggataattggtaaacatatattttttatatttttttttatacttttattagattattcaatgtttcaagtttcaacaagttttgtttgtggatgaaaaaaaattcaaattacttttctattttctttctatcggattcaacgtataagttgaattctatagaaatggaacgaactgatcaatctcagttatgactagtgtgacaaaagacaaagtttaacaatatttatttaattaagataaattgctaattttaagtgttagattttggtagacaaatattaatagataaattataattaattatcttggaaattaagaaacaagtaatcaaaagtggtttaatttttattatgatttgaagaattaatagaataagtcgaaagatgtaaaaatatttatatacacagagcaaacttcacattgaagatctctctcttttttccccctctatgttaatatcattccccttgtcggcacgtaacaacaacgaccgagacaacacaaacaaacaaatcccccacgtgtcgtaaactgagaccaggtggtcgtcatgtacaatatttctataaaatatatggtaacatcaagaattattccatagagccctaacctaatttgcttccttttgaagctccttcatcgagaggcaccttcgttataagcttcaacttcactcgctatatgtatacccatcatgtctctcttacaccatctaatatctcatacacaccattataatgtgtaatggattgtgcttgttttgttgggttaccaataaattcaaacacatgtacatgttattgacaaaaagagaaaacacataaggtttgagtctttaatttcacagaagagaaaacacacagtgtatatacaatgtacaaatcacactagctagaacaagctatatataaaaattagaggcagactaggaaatatatatgtgtttgatgtatttactatatatattatccatacgcatacgcacccacgtatatatgagcctttaggcaagtgccaagaaacctataatgttaaatatgaacattgaataaaatacatcttttttttgggttaaagttttaagtaacaacacttggttatataataagagtaaactacatttttacaaatattatataaaatgagtataaatgtaagggatgtacctagccatatggcagattcgtctaaattaagatcaaaaattctatccgctcaccatttgtaactctctctctctctctctctctctctctctctctctctcttaacacaaacctaaaaactctcctttcgtcgactcatttacttaaatatacaattttgcattcgatcaatttctctcgtgccaactaataatagattgtgttttgattattttgcagtgaccatcggat

SEQ ID NO: 8810 - DNA, 3000 bp, Unknown
  misc_feature (1)..( 3000): cDNA_ID_2037390_gDNA_ID_1971893_Annot_ID_176873 3000 nt of promoter + ATG
tgtacgtatgagtatgttagcttggttggttagaactctcgtctataaagatttttttatttattaaatagtttatcgttttgtaccgatgaataaagtttataaaaattattttgattggttgttcgacatcaagtaccaagtaatgtaacatttgcatgtaaaatatcaaaacatatactacatcataagtttgccatcgcaaacgctgacaaaaagtagtttcttattttatttttaaatttttgttaagggacaaaaagaagttttaatttaaagtattttatagaggtaaaataatgtgaagtggtctttatgactaaatttaaacgcagcaaccaaaattcttagaaatgttatgttttgttcggatctaaaccaactttattcacatgtttttagtatttgttaactcatgattctatagaataatctataactatattttataaataaagttctgaaggcacagttgatggacgcggccacacgtagaatttgccttttagataaaggtcatcatgcataatgcgttatctcagtgaatagattcgttcggtgcactgaacaattggtttggtacagattaattcttcagatatcgtgaactacaggaacaccagtgtggccaaaagcactatataacgttcacgtacgtcaaaataattaaccgatgaagtttggtatgttaataacttaatataatgagatatattatagtctattttccgggtgctttcccctttataatctgaaaacagaaaaaatattacacatatattttagagtttaagcaaattttctcactttggctgacttcattcacacaaattggtctttttttttttactaacactaatggttctaatttttttcgtgaacacacaatgcatccaaaacatggcgccttccattattttcaaaattttaaccattattattgacgggcacataacacgaatttgttgagttgcgttagaccaaagaatcctacgtaccataggactatggcattaaagtagctagtttggaggattctggtgggtgaaaaaaagtaaataagtgaataagaattggttcatagtggaaagaacaacctatatgactcatgcgtagtggaaagatagagaacaacttatatgactcatgcgtagaccatgatcgtacgatgaatagattccattggttatgattataagtaagcaaaattccaaaacggaaaaagaaaatgtggaccgaacatgcccagtgaccacatcacatccgttcaattccatattcttccatataaaaagataaggaaaaagagacccaaaaagaaaagaacaaccttatatgcataatcaaactttcatttgcatttctttttcatcttcgttttccttcgaaatcaattatatagtatagtgccttctttctccatcaaaccattcttgttttgtttggcaacgctgacatctccacttaaaatattcgttttggatcaaagctcatatatgttcttgtgttgatgatattttggatatcgatttgtttgttaatttttgagcattttattaagtatatactagttattaaatattaaaaagtacacgaaattttctgatcatctaacattgttggtatgctacaatcgcacattttaatatatgttgcgatcaaagtttgaaaagttgaatagaaatttcttaaagaaacgatgtgataattcttgtggtcaggcactcacttttttacctccagaggttaagatgattttatgaaggattaaaataaaatctcaaagacaaatgcagtttttccccttgatcttatacgaatgatccatataaaatctctaaaagtatttcttgattcagtcagcaatgtgtccgagatcaccaaacaaaatagtcacaagatagtacttatcttcacctgcctaatattcttcatattatgaccgtgacatattacgacaaagctatcattccctcttgttgtattcatttttttctaagttaaacaaagaatatgtacaatcggataaaaacaattgatttactggcatgttctactataccaggtaagtatacgctaaaaaaaaagaaaaagaacaaaaaaaaactattttcagtatattaactaaaaccaaatcgaaaaaaactatgcactttttatagaattctgaactagaccatgattatgcaccaacaaataattacaaacaaaacaacacatagggaagaaaaaaaagatatacaacaatttattggctttacaaaaagaaaaaagaaaccagaattttattaataattatttatgttttttcacataagcattcacttggaaacttgttatttatatcgtagtctaatgaggaaataagaaggttatatcataaatcataataattaaattatatagtcaaattacatgcagtaacaaaatctcaagcatgagtgataatttcaactatagtttggctaaaaacataattacaaattcagtatcctataattccctatgtctcggattataaaattttctagataaaagcacacagtttaagaaaccataaatgttttatgttatttttataatagaaaaaagattgtagaaatgattataacattctaataaacataaattatgtatgtatatttgcgaaaatctgactaaataagaaaaagtctaaaatatctaatataatgggacataattaggagtatcatttttgaaatctaatggtaatttctaaagtcaatataaaaaaaaaatagagtaatattttattttttctacatacagtaaagtaacagctttcaattattgcatataaattatattcaaaatttagggccaaagtttggaattatacttactttctttctaattttaagtataagttatggatatatatgaccaaaaaagttaatatatatctagagagagagctgaatgcaacttagttccctatcacacacttcaataacccacaaagataaaaaaaaaaaaatg

SEQ ID NO: 8811 - DNA, 3000 bp, Unknown
  misc_feature (1)..( 3000): cDNA_ID_1388793_gDNA_ID_1971893_Annot_ID_176878 3000 nt of promoter + ATG
atgtctgccgaaccgaaccaaaccgagaaccgaactccaattataattttgccgatcggtttagccttcccttcatagtcggtaatcggaaccgaaaaaatcggtttgttcggttcggtttgttcggtttaatccgaaatcccaggcctaatgagctctatcaaactcatatcttcctcaacttaagagtccgagtgattacgctaccgttttgtaagtgggccgttattgggctttgagatttaatgtgatttgagttcaactagatttaggatttgcgtttactcgatctctacgtttctctaataatatccacagccatgaacggagaaaagtcaccaccgattacgatgacgtttctaaatgataatggtttctcacattgttttttttttcgatttgtgttacatattttcattatcccaaaccaccttttgtattcgattgtatctttgttgcatgtttcaagagctcatctcgataatggtgtctttgttgcagattgtatcagtcaccaaacgacgcagcgcccaaagctgatagaagacaagtgattggtgtgaaagagtgtggtgaaacttatgttctggcagagtataagcctatatatgttcatcagctcgtccttgtccttgcaactgctatacagctgggattgtgtatgacattgaaggatgttgaatatgaaggaagattagatggaatctttgtgatgttttgaatcttgtttgtagcttcatataaaattatgattatgtaaagtcttatgtgtaatcaaatgtttaactttttcctttattcaacaaaggatttgtatcgataatattttactagttacagaagctgaagaagaaagtattgtaacaagttagggtgtctgaaaccataaaggttgtgtcttgctagttaatttatatataacaaaggctgaaacatgaactttttaagatgattccactctcgtttgcagcattaggagacatagttgataagaagcttgatgaggattatgtaaaggaagaagttgaaatgatgatacaagtatctctgctatccacacaagcagcaccgggagaacgaccaacgatgtcggaagttgaaatttttagaaactcctgcttgtgctacataaactggttttgcaacatcatctccataatatattctaacagtttgcttttgaggattgattcaggatcatcatctatatctgttgtcttcttagtttttactctgtctcgggttatccaaacagcagacttgtgtgagtacacaaacacagaacaacagaaccaaaatctctaaacaagaccggctctctaacaagagacataaccaccaagtagactcttgtctcccttgcactgcattaattagtaatcaccaaaagtctattcctgttttgcttcttctcttataatcatcaaacacacaaaaaccaaaaacgttgtagtagaccatcagctactggaatcagaagcaacgatagagtttgagggtaaccaaaatgtgtttgggagtaagcagagattaaatatctccatcatgtcactatgttgatgggaagaattcgattgattaaaaaaggaatctctgtacaaaagcccatccaaagaaaaggaaattaagatcaagacaaatatctgcttatgtcaaagtcattaaccgactccaacggctatattgaacaaacggttatcattattgatgaagacctaattaacactttgcttataaataaagactcatacacgcagcctcttctaattcttcgttgagagaaaaaatcaaaactctctgattcacattcacgcatcttcttcttcttctttaattttcttcttgagagaatctctttatacagagactctgtgtgaattccgatgatccaattagtagtcattgatcagaagtgaaaagcggatgatgatgatgatctcctctgcaacatgatgatccgtaagagttgatttcacttttttccgatgagtcgcagatggagcaacgacggatgttaacggcggctagaccacgtttgtcctcgacgatccgtacgattacgtctcacgtggcgttctcagcaagccgtctcttgaaaccttatgttgcatatcggcttggattggaggtatgagtttcgctagcacgattgctttgggagataggacgcgaatcagaggaaaacagagaacgaatccaccggtggagataaagaaatcgccagtgattagggtttcacaacctcgaggtataccacttggagagatactagtggtttgtgctgaatagaggaatagtactataaactttcaaaataacctaaaaaaaaattactcatatacaaacaaactacaaaagtttagggaaaatggatcattttgaatgcatactactagtaggttacagatactgaatcactgatccaacacataaggcttagttagagcagaaaatgtttttaccataataggcccaaatcttatatgtgcccgataagagatccaaagaaacccaattatcactgatccaacacattcaatattttactaatctcaaataattatcgttgttttggccttttcttacatttctactacattataatccctataaaaaagacatttaattttgatgctttttttcttgacatgtgatcaccgacagagagagtaactacaagtctaccattatccagctgcaatcacgcaaacgcaccgcctttttctctctttgccaactcgtttatttccaatcataaaatgccacgttaacacactcttgcagttaattgacggaaatacccctcttcacatactacaattacgatattaatgtgttaaaaattaacggtgtgggctaatctcacgcgctttcatcatcttcttcctagattcgctcctccactgtcttaaatttcactatcttcttcttcattttccttccttctcacttcaaatccataatcgctctacttctctctctctctctagattcgaaaaa

SEQ ID NO: 8812 - DNA, 3000 bp, Unknown
  misc_feature (1)..( 3000): cDNA_ID_3043609_gDNA_ID_1971893_Annot_ID_176874 3000 nt of promoter + ATG
tgacccaaaattgtatatcgtttaatgcaataaacgtaattaagctctcgtatacttcaaatgcccaaatatcatttcaagtcagcctaaaactataccaaattttgaagttcgaccctaaacgtatatatttaaaaactcaatttcaatttttcacatcgtagaaagtttgtgtagctagagaaacatgttaatatatatagtttcgaattcatcggatatatatttaagtgtagttggtcctacatcccaatatcccatgatgtttttttggtagttcggtttctcaagttggttggtacttggttcggtttctcaacttggcccatgatatgaagcatataatatgcatacatacatctacattttcttttttaaagtgttacattcacaaatttacaaatcgaaacttgttataatatgcatacatatgcaaaacataatgtgttaccgacttcaatcgtgggtacgtatttttgagattgatgataacgtataatacatatctaaacagattataacagctgtttaggacattcagtttaatacccaaaaaaaaaaaaaagaaacaacgacaaaatagttgacgaatatacatttaaaaaaaaaaaattatagtaagatagtgtgtggctggccgtgaaccaacatggagaacaaatagctcgtagccaccaaagcactatctagcgcgtagcgaacacgtagtcaatggctaattgtaccaaagacgaacctagccacattatagtccacgttcaaacgaggcccaccagtttctataaaagtcaacttcaccccccaaaaaaaacgctcctaacttttgaccttttcgcttttcttgatttggagccagtggcattgtcgtaaaatcatttgatctaaccgctttgatgttcttgcttagtttccattacttctgtcattatcacctttatatttttttctcctaaaaaagccaaatattcgtaatcacgatctttatctcttataatttaatgtttattccaatttaaaacattaaatttataaaagctcagatctatatttctttttcccctcacttttgttaaataattttttttatctcttgtttatctttcttgaatttttttccagtttgaagcaaaatctattttctctgtaaattttgtacttttctcacaaaatactagggttttcgttttgtattttgatgagagagtgattcagtgaaccgggacatgattcaggtttactgattttactgttttaaaactttagaaaagaatagtgaacatgaacaatctggtgttctaaaatctaaaaaggggaggcttttaactaatatctctcgtgtactttttctctaattcttaaatcgttctctcttttctgtttctactttttaagatcccttttcgctttaataaattaaaataaatcacgtaaaaggtctaatttggaggaaaaaggctaaaaagcgagatcgaattcttcttcttctttttccaggtaagtgggtgtttcaccttccaactatcaatggctatgcataacaccaattaatttattttgaaacctctcatttatagaatacacgtgcatataatgtttaatcatcttcttcttttttggtgaaaatagtataatactagttgattcctttttcaattgtgtttttgtctatgtgtatagatatcagattaatcacccaattttataactggcaattatacaataatgaatagaactaggaaaatgttgaagaggtatcgtctggtgtaggagtttacgattacagcgtctcttcgatcggtagaatattaattaactcactatcaatcatgcatacttgtctacattacaaagtcaacacatgtggtgctcactttggctccagcaaaaactgattacaatatttgtgttttaaagtatataaaaattagtcagaaaagagaatcgtattattttttatagctttttgtgatcgaaattggcttatgtgacagaaaaacgccggttaattccttagaaaaacttaggttgaaaatgaattgcggctagtttttataataatcatgtcattgtccatcaacttgcacaagttaaagcttttgtctaaaaaatgggtgatttaaaatgttggtttaatgcattctaatgaacaagtcaatatgctggtattgacagaacatctacatagagtttggacaagagatcaagtcccaattagaaccaccaaaaaagaacatatgaattaggttttatataatagccttttaggtattctttccaaatttctgttcagttaggtttgttttctaagttttcttaagtccttttctaaagtttatgtccaacccaaaacgatgataaaaaaatccagaaatcaaatgttaattaataaggttctcttcgtctactcttagctaaaattaaattattttataaaaaaaaaaacgaaaggatatgattaacgttagttcttcctcgtttattgagggataactgttgcatttttaaaaaatctcactatgtgccacgtggctattctggtcaactatctctccttatagcaaaaaagtaaacgagatcattgaattgagattgttttcagtattgcacacaaagtttgccacagaaaccattgacttaatttgtttaaactttaatgtcgatcaacgccaattaaaaattgcatcttttctagttagacttttttcaatgttcttaatgtacttggtctcttagtaatccagattcatcaaattgtatatgaccaccactctcttatcattaaattaaaacaaaactatcctaaactttcgttataaataagcttcatcaatgttgctccaaaattcacacttaaaagtcatctttcaacccaattatctctatcctttctcctggttcgataccattactccatccacacaatttatataatctcaaaaacttgcaaagtaaagtactaatctaagtagtctcctgttctgtttgcagagttacatagct

SEQ ID NO: 8813 - DNA, 3000 bp, Unknown
  misc_feature (1)..( 3000): cDNA_ID_3043598_gDNA_ID_1971893_Annot_ID_176881 3000 nt of promoter + ATG
aaagagtatatcctacctattttactaccaaaacaagtttagttccaaaattaacacaattaatccaaaaaataccataaactaggtttaacagtttagcaaatattagataaattttaacaacttttaataacactaccatgacatttgttaaaaaaaagcatcgaaatttgaacaatacttgtgacagtttaagacagattattaaataaattaatcaaacacgagaaaaaacagagtgagagtgaaagaaagaaacgaacttgagcaatgcggaaccattcataggagtcgaatgaagcagcggtcaagatgacttgaggaaagctggtagcagctttaaccgttccgttaaaccggattcctggaccggcgtaggctacgccgtgtaaagcttctgaccaccattcgtacgccggaactccaagacgcggtatccctggagctgtattcaccagctgcgagatcttctcgtctatggttagcctcgagacgagatcacgcgctcgcttgccaattgggaggtcagtgcggcagaactggtagagtttcgtggttggatttgaagggtcacaggagtgcggcggaggagctgattcaacgccgtggacgatgaagagaaggagaagaagaagcagttgtttagccatggcttcgaaatgcggaaaagagatgagaaagtgatgagtgtaagagagtgacagagtctctgttcttcttattcgttccccaattatgtctgtaataaattgacttaaataaccttcttgattcaacagggtaacctaaaaatttattatattgttgtttttcaataactctttttttttgcaattaatggacatcttaaattttttattcaatagttgaataagtataatgaagttgttaaattttggtgttgtgaagtttttgtgtctttttctgatttgctattttcattattattttcagatttttatctaatcctatatccttgagatcaattagtttatagaaaatgttttaaaaacagttatatcaaaactcatcattttttaactatataaatagagatttggttcctttaatttggacacatagaaaatcgtattagattgcatattatctcaaataaaataaacaaaaagtatttgatttttatctatttctgtttaatttaatttgctaataaactatttaattcttaatcatttaatttaataaaaatcaggatagactgttgaattttattaaataaaataattgtagaatagaaaaaaatagtatatatatatatatgtttaattattagatggaaaagataacaaaaataatgtgaaaaagaaggaaaaaaaatgttgaattatattataccattataaatggtcttacgggccaaagcccaataatattttttccaaatagcttttaaggtctttgcgttaagtcatttagcatatatttttttcccagtgtacagcccaataagtctttcaaaacgttttggtatcaaaacatgtaatagcgtttttatatatcaagaattgtttaagaaatgtactgaaccgtccaaccaaccatataagtgataatggatagcaatattattataaccttatcaggtcaggccatatgtcacaatcaacctaattgtgatctataaaagttcacctggtcacgtatctaggtttgactggataaaaattgtcggtttcaaacaattaatacaacaatattactagtagataatttgtttctgtctcagctaaatgtttggtggaaggagctttgtagagaaattcatttgaagtaaaaaaatctaacacaaattcaacatgttcagaataataattcacagctgggtaaattttaatttacaattattgagtttttttttttttttgtttatgtcaaactcaaaactagtgccacgtggaggaagctaagcctataaacgattatgaccgacagttgtcactctagaagtagcggtccttgtgacggcataagctggtcataaccgcttagtggtgatgatttgacgaaattgcccattaagcgactgtgagatgtcggtagactacgatggccacgttccacagagagtgacactaacaaccaaaacctattttattactattttttcttttgtcattagtattttattactaattgtttgaatatttcctcgtggtctattattattaaacactctagtcctcttattgttcattaaaattgtctgacgcttgtctcttcctttcgttttctactagaaaattcagctattttcttaatgttttatatctcgtaaactcttaagttgtaacagtgtttcaatataatttgaacacatattgaagtttagtccaaaattcttcttctccagaatatatccaaatcgagtcacaatggaaaacaaattctcctttgtaggtaaatagaaacaaacaataattgtggcattaaagtgttttaaaacgagatcccaataatttacatcagtaagatttcaaaagtgtgtaattagaataaacaataaacctccacaatttggaagatattttgtttccatatttgtcgcgtataatttattatattgtcaattctcgagaatttttaacgttttgttttgaccaggtaacgactgttccggtaaatatgtaggtccaaaaacttcccgcggacttaactcgttttgaaatccgctgtttggttttctttttttattaccggctctaaccggtcctacccaaaaccttgtcatgtcctctcattcctccaccgtttataagtaggcccttaactccaattcccaccgtttcttcgctaaccacacaaagcttgttcttctccttccttctccaatttcgtaagctcaaagatttcgatttcgattttgattattgccaaaggtacaaacttttgaacacaggtttgtttattttgtttcactctgttcgattttatggggttttatttatattttgttcttgatcgattttaccaggtttaaag

SEQ ID NO: 8814 - DNA, 3000 bp, Unknown
  misc_feature (1)..( 3000): cDNA_ID_2037366_gDNA_ID_1971893_Annot_ID_176880 3000 nt of promoter + ATG
tattccaaacatagcaaacatagttggtcaagttctctacctgaaaatgcgctattgtggacttgacaagccttgtattgaactgaaagtcataaaagttctttcctttctctacttgcaagcattcctgacaacaaaaaatacaagaaatcataagaaagatgcacaccaaaactcaagatttcaaatcatccatcatcataagctataaaaactttgattggctaagacgaaccttatcaagctcttctctggatcgaaacagactctcaaagtttttatagtgcagcaatctattctcacggtatctatccctcgtgtaattcaagctctcccatggaatcccttgaatatcttttccattcctagcttctaacgctgatgtttcattgttcgtcttactctcactctaaaacaacaacataacaagtttgctattaatttcatcacatccattaaatttcaagcctttcctaaacttgaagcagagtaaagtatcataccagctcgaaatcaaaatcggagtccatgaaatcggaatcagactcactggtgacatcaacctctccaaagggctcatcatcatcgaaatcagcgtgaaattcatcaacaaggtattcaagatcagagttgtcgaaaatatccatctttaaacctggtaaaatcgatcaagaacaaaatataaataaaaccccataaaatcgaacagagtgaaacaaaataaacaaacctgtgttcaaaagtttgtacctttggcaataatcaaaatcgaaatcgaaatctttgagcttacgaaattggagaaggaaggagaagaacaagctttgtgtggttagcgaagaaacggtgggaattggagttaagggcctacttataaacggtggaggaatgagaggacatgacaaggttttgggtaggaccggttagagccggtaataaaaaaagaaaaccaaacagcggatttcaaaacgagttaagtccgcgggaagtttttggacctacatatttaccggaacagtcgttacctggtcaaaacaaaacgttaaaaattctcgagaattgacaatataataaattatacgcgacaaatatggaaacaaaatatcttccaaattgtggaggtttattgtttattctaattacacacttttgaaatcttactgatgtaaattattgggatctcgttttaaaacactttaatgccacaattattgtttgtttctatttacctacaaaggagaatttgttttccattgtgactcgatttggatatattctggagaagaagaattttggactaaacttcaatatgtgttcaaattatattgaaacactgttacaacttaagagtttacgagatataaaacattaagaaaatagctgaattttctagtagaaaacgaaaggaagagacaagcgtcagacaattttaatgaacaataagaggactagagtgtttaataataatagaccacgaggaaatattcaaacaattagtaataaaatactaatgacaaaagaaaaaatagtaataaaataggttttggttgttagtgtcactctctgtggaacgtggccatcgtagtctaccgacatctcacagtcgcttaatgggcaatttcgtcaaatcatcaccactaagcggttatgaccagcttatgccgtcacaaggaccgctacttctagagtgacaactgtcggtcataatcgtttataggcttagcttcctccacgtggcactagttttgagtttgacataaacaaaaaaaaaaaaaaactcaataattgtaaattaaaatttacccagctgtgaattattattctgaacatgttgaatttgtgttagatttttttacttcaaatgaatttctctacaaagctccttccaccaaacatttagctgagacagaaacaaattatctactagtaatattgttgtattaattgtttgaaaccgacaatttttatccagtcaaacctagatacgtgaccaggtgaacttttatagatcacaattaggttgattgtgacatatggcctgacctgataaggttataataatattgctatccattatcacttatatggttggttggacggttcagtacatttcttaaacaattcttgatatataaaaacgctattacatgttttgataccaaaacgttttgaaagacttattgggctgtacactgggaaaaaaatatatgctaaatgacttaacgcaaagaccttaaaagctatttggaaaaaatattattgggctttggcccgtaagaccatttataatggtataatataattcaacattttttttccttctttttcacattatttttgttatcttttccatctaataattaaacatatatatatatatactatttttttctattctacaattattttatttaataaaattcaacagtctatcctgatttttattaaattaaatgattaagaattaaatagtttattagcaaattaaattaaacagaaatagataaaaatcaaatactttttgtttattttatttgagataatatgcaatctaatacgattttctatgtgtccaaattaaaggaaccaaatctctatttatatagttaaaaaatgatgagttttgatataactgtttttaaaacattttctataaactaattgatctcaaggatataggattagataaaaatctgaaaataataatgaaaatagcaaatcagaaaaagacacaaaaacttcacaacaccaaaatttaacaacttcattatacttattcaactattgaataaaaaatttaagatgtccattaattgcaaaaaaaaagagttattgaaaaacaacaatataataaatttttaggttaccctgttgaatcaagaaggttatttaagtcaatttattacagacataattggggaacgaataagaagaacagagactctgtcactctcttacactcatcactttctcatctcttttccgcatttcgaagccatg

SEQ ID NO: 8815 - DNA, 3000 bp, Unknown
  misc_feature (1)..( 3000): cDNA_ID_3043613_gDNA_ID_1971893_Annot_ID_176872 3000 nt of promoter + ATG
aatacaagtatataattttaaacactaaacaatataaataatatcaacaaaacatatacaactcgcagtttactatacatttaaaatcaaataaaataatatcatatatttataatcaactttacaataaaagtttttagtttaactaaaatataagcctacctgctgtataatgcaagttaaaattataaataagcagattaccatcacgatggatgtaccttctcacatacacacctatcaaaaacttaaaacctttcaaaacctcttggtatattcaaattaggattcttcattcatggaatcattattccaagggttttgggatgtcttatgaaatgattttggcaaaagaggatgtaaatttttttgaataaaaagtagtcagcaaaacatatgttttattgggattttttagataattaaatcagagaatagggctgggcatatgagtaacacattcgagttcgggtagaacccgttcgggtttgggattaatgggtatatgatttactacctaatagaataattctaaatattcggttcgggtcggtccagttgggtttgagtcagtttggataaaaagtttcaggccctaaaaatactcaaaaaaatagaaacgggtattttgtatgtagatagtgcgtctccaaacaaaaaaaacttttaaatttattaagttttaataaatttaattatatttgaatatattttactaaattttgacaaatataacaaataattttgacaaacataacaaacataacaaaatatacaatttaatttatacaaaatattaatagcacgggttatgatctagtttattaactatataattgaaactattgtttttactcaagattgattgatgccctgaggaagtcaacaaaactctttatattcaatcatgtgaattattcctatagacaacaaaagcgtcgatatctcatatattttctaaccaataaaactgctatataaaaatgctactaggccgaccaaattcgctgtgcatagacagaccctgtacgacaaaacaatcaataatgtatactgtttcattcaagtggcaaataagtacacaaaaaatcaaatacatatgtttaaagtacctttgaaaaactggctgtgagaatggatacttgtgatcgatctttatccttttgatcagcttaatcagttgtgatcttacactgtgaattttgatggataagactatgtatataacagagttatttgtatatatgtaggtggggatatcgtttgcaagaataatgttgagttcgataagaccaagcattgaggccttagggaggttatcaaaaacagatatcttcggtgacataaatcagtatccaatggcaaataagactgcaggattattgactcttcgaatcagttctcctttgctatgctttgctaatgccaattttataagagacaggtcattaatcaatatttatcttcttcttttttttttttttttgttcaaacatcattagttactcttgtgaaactcttatcagtttgacaaaaaaaataaatattttttcttctttcagaatattgaattcagttcaagaaatagaaggagaggagaatgaacaagaagttctaaaagaaaatggtcttcaagtagtaattctcgacatgtcttgtaagcacatcccacattctatcatgatatactaatttatagaaaatgttttattgtatatatagtagaggtactgaatcttacatgtaacaaaatattggtgaaggcgtgatgggcgtagatacatcaggagtatttgcacttgaagaactacatcaagagctagcttctaatgacatccgggtacatctttatttctcaatcaaatgttattcattcactatagttacatatgtgggttcattggattttcaaattaccaatatttgttttatgtttgtgggctgcagttagtcatcgctagtcccagatggagggtacttcacaaattgaagcgagcaaaattggacgagaaaataaagacagaaaatatatatatgacagtaggagaagccgtagatatttatgtaagagcaagatctacgtcccacgagttgtgttgatatatatatgtaagaaacagtacaactcaaacatataacctagtgataattttattgttttctcatatagcctatagtttttatttaatgtacacctgactaaaaagtacaaatttcaatgcataaggctacaaaatattcttcttcttttttttctttttttctttttattttcttttacatcttttggtttggcttacaatttttttttacatcttttggtttggtttacattcctaagtgtttttttaagaaaaataaataaaataatacaaggatatatatagcagtgaattggaatcagaacttacattggtgtcttggtgagtgaataatcatatgaatcttccactttgaacatcatcacgaacaattcacaatgtttaagcaaaaacaccttgagatagtgtttaacggtcggaaaatatagccgttgaaggaaagtcaaatatttgaccattaagtagatattgccgaagcctctccatatgctgagagagtagccattgcgaggtaaagaggactagttgacttttatgttttgtttttacaattaattattgacaaaataaacgatatatgctggttaatctgaacgttattaattgatcccaatactcctatatgaattttctgtggcaaaaaataacatcatattcttaattcgttcaaagaacaaaacccttttaatctctcttaatctcttccatacatttctaaccaaatctctcttatacctaacctctccttctttcatggttctcttttctctcgtccgtacatctctcatatatatataggcacttttgcctccaatgatcagattttcgcattccctaaaccaaaataaagaagagtctttgagtttgttggttgcattgatcggatataagagacatg

SEQ ID NO: 8816 - DNA, 3000 bp, Unknown
  misc_feature (1)..( 3000): cDNA_ID_2024857_gDNA_ID_1971893_Annot_ID_176869 3000 nt of promoter + ATG
atcgtgcatgtgtttatttacatatattttcatagatgttatgtatcgttgaagaagacagagaacaaaccaagtcttatagagaaaacggtgggagcaacccggtgaatgaaggaaagaagaagctatgtataagtagaatcggttggttttcttattttacaattaatgaagaaattgtttttcaacttttaatttctaaaaaaccatataatgataagttttatttgatgggcctcacactgagtcattgcatgtaccgatgtcactgaaacacgacgtgtttcgttttggagtgccacatatagtacgaacttgatcgactagagagcagagcatggccatgtcggaataacaaataatatactattgtaatagcaaatggtgaaaatttatcaaaaaatccttcaaaatgtttaacaagtggaaattttatatgttaaatcgactggaaagctaatataacacttgattttgtggtgttttctaatgatttttttttgtttattttgtaacaaattgacaacaaaaattaaagattgtttgcggactgtttctttattttttaagttccggggctatttacaaagtatttcggaactttctctatttaccgaaaacatccgatacctttactatttactaaataaccccgaactctgttgttatttatagaaaagcgcagcagcgattttttctatttacataagaaatcctgaaactcttactatttttgaaatgttctgcaacttttatatactaaaatcttcagtaatatgtaaaaacgtgtcaaccctcagttgcacctctaatactgaataacaaagcagtgggggaaaaaatcaaaattactacgtagtacaaaaaatacagatccactattcggtggcttccaccaacaattttttttttgataaaaagaatatatggcttgtccgttttgtcttttaatcaaatgatatggacagtacatgtatatgcaaaacatggttacactttaattaagatgaaaaagcctaaggagaagattctagaagagcatggaacgttctagaagaagaaatggacataccttgtttgaccggaaaagagacatagtcgatcagagggagagaacatgaggagggcaagatcgatgtcacaaagtgttgacaattcataagccttttttattaaaccttttttacgttttgagaacgtaatttgtcggttcgtgctcttctctatacgctttaactccaatttaacccgacccatatccgatggtcactgcaaaataatcaaaacacaatctattattagttggcacgagagaaattgatcgaatgcaaaattgtatatttaagtaaatgagtcgacgaaaggagagtttttaggtttgtgttaagagagagagagagagagagagagagagagagagagagagttacaaatggtgagcggatagaatttttgatcttaatttagacgaatctgccatatggctaggtacatcccttacatttatactcattttatataatatttgtaaaaatgtagtttactcttattatataaccaagtgttgttacttaaaactttaacccaaaaaaaagatgtattttattcaatgttcatatttaacattataggtttcttggcacttgcctaaaggctcatatatacgtgggtgcgtatgcgtatggataatatatatagtaaatacatcaaacacatatatatttcctagtctgcctctaatttttatatatagcttgttctagctagtgtgatttgtacattgtatatacactgtgtgttttctcttctgtgaaattaaagactcaaaccttatgtgttttctctttttgtcaataacatgtacatgtgtttgaatttattggtaacccaacaaaacaagcacaatccattacacattataatggtgtgtatgagatattagatggtgtaagagagacatgatgggtatacatatagcgagtgaagttgaagcttataacgaaggtgcctctcgatgaaggagcttcaaaaggaagcaaattaggttagggctctatggaataattcttgatgttaccatatattttatagaaatattgtacatgacgaccacctggtctcagtttacgacacgtgggggatttgtttgtttgtgttgtctcggtcgttgttgttacgtgccgacaaggggaatgatattaacatagagggggaaaaaagagagagatcttcaatgtgaagtttgctctgtgtatataaatatttttacatctttcgacttattctattaattcttcaaatcataataaaaattaaaccacttttgattacttgtttcttaatttccaagataattaattataatttatctattaatatttgtctaccaaaatctaacacttaaaattagcaatttatcttaattaaataaatattgttaaactttgtcttttgtcacactagtcataactgagattgatcagttcgttccatttctatagaattcaacttatacgttgaatccgatagaaagaaaatagaaaagtaatttgaattttttttcatccacaaacaaaacttgttgaaacttgaaacattgaataatctaataaaagtataaaaaaaaatataaaaaatatatgtttaccaattatccaatttatttctgcatattttgtaaattaaaaagtaattcaaatacgtttcatgtcgacaaaatgttgaatgtacaagtggtttatgctaatttaatcactgtcaattcactgaaacgaataaatcgagtaattacttttttaattgacaaattacaaaactatagaaacattaagggcataattgaaatttccaataaattgaagagcaaaaaccctagaaaattgacacggactataaaaaggtgacgaagcggcgctttttcggtttggtcatcgtgctcctcttctcctccaccgcacagatccaagacattttgattacactccatcgccggcgaaaatg

SEQ ID NO: 8817 - DNA, 3000 bp, Unknown
  misc_feature (1)..( 3000): cDNA_ID_1989254_gDNA_ID_1971898_Annot_ID_58487 3000 nt of promoter + ATG
ttagaatacggataaagtttaaacttcacagtgaaattcagttgagataataaagtcaacccgttatatttactcatgttcttcaaatcgactaacctttgtaccaaaaggactttcagggtggtcgatgtcaagcagcctccttccctatacaaggagaacacaaaaaaaaagtcaaaactaagtttctgatctccgaaagcaacatcgaagtacactatactctttgtcaagacgaatcatctacagtagatatcaaacaatatcaatatcaatttctcttctcatctcatactctccgtcgacgatcggcgcattactttatttactctgtttttcttatgtttttacgttgtttagtttaagagataagtcccgagcttatcactcacctttgtgggagaattgttcaatttcgatttgacttggcacgtgtgagacactcgcacatgcgaatctaaggttcagtaactggatgaaatttactgaactctaggaattttttaaaatcataactataggaagaaacaaaaaatgtggtcttaactacaagaattatcacattttttaacgataaattatacaagcaaagaaaaatctatcttgatatttttttagaaataagtatataaagaaccaataaaatccaactgctattttgtttaagtttctaattaatattcacaagctttgttgggcaatattgaagattaaaccaaaaaaataaaacgattttgtccataatcattctcgaccgaccactgtcaccattctaaaatatcattgttttgtatgcaaattgcataaatcaaatggctctttcacgtttaaaataattgtatttcggagaaagtgcatatcaagacattgcaatctgacaaagaaaaaaaagcgtgtagacttatctatctccctaggttaacaatccaatgcatgcgtgtccacctttaaatctccctacacaagcaaaattcagtaaaaagcttgtacgttgattacatatccaacgaaccatatccactttcaatttgttaatcatataaatttgaccctaaaatctatctcattctctcatcaatcttcttcctttaaatccctaaatcttcacgttacttttctatctacattttcactttcaatggctttgattatcacctgctccgctctacccacgatccgagcatcttccggatccggatcccttaacccggatcaaaaccgtaagaaatctgctgcttggtgggctcctctcttcggtttaccctccgatccagattacctcaacatcgaaagctcatgctccaccgtgaatccggataaaaccgatatttccgggtcgggtcaaaagtttcgtcgcggttgttttacggaggagaaagctaagcagttgaggaggaaaaccgcagaagcttccacgttccatgacgtaatgtatcactccgccattgcttctcgacttgcgtctgatatcaccggccgagtcgaggattgaaacggattcgggtcagatctggagacgaatcaattaatgaataattaatcttttttttcttaattcagtgttcttgtaggatgcagaccatcttctatcggtgctcctttttcatttgaaccgttggcttgtgtttggtctttgtgtgttgtaaactctagttccctttctgtttcttctgtaatcaaccgttggatttccacttgttatttttagacatgtgttccctagttagctcttttatcttatctcaaatttaagacattgtgttctctaaatctacatcagaacttgactttggtctgaaaatgtctaaatataacattttctcaacggttatctacttcagaacttgaattcggacagcttttctacttcacaacttgaattcggtcttgttttacaaattccacatagacgaactataatattttgtgacatttctcactgaaaagccaacactaattaaaaccactccagatcttattcttaacgatgatcgtgaatttggttgtgtcgaatcttttaatatagtcgtctcgttgtttcaatgtagtggtgatacatctttcctctctattaagatctttttataatgttcaatgaagaaccacaaaatgtaaagtgtctgtgatctattattcattcttgtaagtttttctctccacaattcacattttctagaatcaaacctcaaattagatgttaaaacattaaacctccaaactggttctctgcctccggtagtcaccagtatcagatgcgctcctccggtgacggcaatgcctttccgattttcctttagtaaaagccctgggccaatttgggatttggccaattattgaatataacattataaactttaaaaaacaaaacattaaaccaccaaacgaaattttaatttatttatttaagaatcatactttgttttactttattttcaaaatcatgctgacaaaaaaaaaacgtacagtaaaatacactactgatttacgatttttttttctaaataaattatttacaaatggtattgtgaattgttttgtcaattacgaaaatatagggtcgcttattgcaacatatgaaacgtataggaactaaattaaaaaatacaaataaaggtcttctccttcccgtctagatgtagaaatccctaaaacttgctactgttttgcatacggggcttgtacaaataaaaaccacccaattcctacgctttcctctacaaattgtccccttttttttttaacttttatactttcaattcatctttggttctgtagaattcccaggaatcagcattccactgtaagctactggtttctctaattaactgtagatcgatcgaacttttatagattcgggattgtttctcccaatatttctgtagaaattactacaaaaaaaattagattttcagctactctgagtctaccttgaatcgtttgaaatcgaaaaccctttcctttaatttcaaagagtcgcttaattagggtttaggatagatg

SEQ ID NO: 8818 - DNA, 3000 bp, Unknown
  misc_feature (1)..( 3000): cDNA_ID_1989250_gDNA_ID_1971898_Annot_ID_58492 3000 nt of promoter + ATG
tggggtggaattgcaaccactgcttgtaagatatagttggctttaaacacttttttttgttaaagaacagactattaatattgtcttctaaaattattaattatatatatatttttaaattattaattattaacatttgtatttaaaatcattttgatgaattagggtgcgatgtcacaggaatttctgagaacatggaagatgatttggtttccataaactcaataactgcatttgtatttagccttttgcttgacgaaccacaaaatggtaacccgtaatgattaattatatatacgtcacatccatagtttatagtatgcatcaaatttctctatcaaatttgttaatcctattggcttgatagtcatgataggaataggaggtatcggcttgggtgcagcagtagctctctactgtgcgactatttatatctctggtaaaaaaatcagaaacctaagttttattgtagggatcaacggctggcttcctgcttggaggtaggctcttgaaaccctaatgtcatttattagctattactatttcagtatttcttaaggaaacttaaattgcaaacctttaaaacatggaaacctaactaaatcttgcagaaacttacttcacaatctctcatatgattatggggtcccaagtcttgctccatcagtatcaatcttacttacacatggaacttgtatgtgtatacattatctactttacgatttagatatcaattgcgagatgatgctgattcttgtcttttattttgtgtgtcacagctgatgatatagttcccttcccattcggacgcaaaagttcggacattcttcgcagggctggatttcaagtcacgttcataccaaaccaagggtctaaacatgaattagcttcactttgttttccgttaattaccaatagattttattgttctgaatctatatttggggtattccttgtgcaggtatcatcttccaatcgttccccaagtaatcaatgaggttcgcttatggatcacatcaaaactccaaccctaaagtcaatgctcgacactgcatagagaaaggaattggggagcaaaactatcatataatatatattttaaaatatttttgtcttattatctctttttctagttcataatcaattatataggcgatgtctctttgttaggagtctgaaaaatgtatatatttcttcggttaatgttataataaataaaagatttacttagatcttaacagattttttttttgtgaaaagtttttttttattaatatttattatacatttgaacttgaattatggcacagcgatgacattaacacaaaccattagattacaaattttcatgatatttaatgttttgaaagattaacagtatataacttgcttaatcaaactgaaaatacttttcttaaaagaaatagattcttgaagaaagtaaatctcatgagaagtttagatacattttacactcacaaaaaaatagaaattgatctaagtttcccaattggtctattcataaaaatgcaatcttcctaagctaagataataaaaaatatcgacaataatcctataattgaatatcgacgacggtttgtgattttccataggtctctcgaatgatcaaatggtctcttcctagctccttctttcgaacatttttggcttgaacaaagcttataacgcttgaaaacatcctaatcccgcataaggatctaaaacatgtacataatttaagacacgatagtaaagaatcaaagatggattccaacacgacaaatgactaaaaacaaatactacacaagggaaaaagataccaaaaaaaaaacacaaaatctgaagaatataaattgcctaaaagtaattaaaaaaaactaattaattttagatggaaagttgaaaccatacattatctaatttaaaacatttcttactcctaaatcatcaaaataaaataaaatagcaggagtatttaataaaagattttaccaattatagtttacaattattggtttagttagttgtagttgatgattttttatgtaaaaaagtaactttagtgatatttttttaagtatgtgtacagaaaccttaaatgtaataaatggagtataaaataacatatattgttttcatagaaaatcaaatcataaatcacaaaatcaaaataaaattaaaaagctgatgagaccttaatgtgatttaagttctgtcatgtgtcaaacatatagttattaattttaaataaatttaggttagtatttattaaaaacaaaatccagtgacttggtgggtttattatgtttatacgtgtattaattaaggttttcgacaaacaaaaacaaatactataaaatgacaaattctgattttgttttaatagatttttatatcatcttttgttaacattatctgaattagttaaggtgctatttaatttagggaaaagtttaaaattagataagaaatattatattgtaccaactacatttaaacaaaactaattaatcatccaaagatacaagttataaaacctttaataacaattttgatgaagtgtcaattatcctatagaggggggggggggggggggggggggttcccccttcgagtatgatctatagattattagattatgttacacccaaatctgttttctgttgttgtggttgcgcttttcattttgtaagccaattagacaattactaaatcaacaaaatattagtaattttaaaaaatagattatgcctccattaattaaattgtatttcacccaattagtatatgatttttgccatccacccaactttttaaggatgagattttgtcaacttttaatactaagatattttatgtcataaggctcctttggtgctttaacaaaaaagaaagaaaggaaacactcatttctattataaatacacaataccttcccttgctttctcttatatctttcatctctagtgcaagttaaaaactagttcttctcaccaaagc

SEQ ID NO: 8819 - DNA, 3000 bp, Unknown
  misc_feature (1)..( 3000): cDNA_ID_1989242_gDNA_ID_1971898_Annot_ID_58505 3000 nt of promoter + ATG
ccttgattacatctttgtacatcatctccattgttcttttctgccaatctaatatagcttggactgatccactctcaggaatcccttcaggccacattggaacaacaacatagaccttaaacttctctcctgctttgattttgctaacaatcttcaaagatagctccttcggaatcagatgcagagcattgatttcctctggtttgattccatccgcgctccaagcaaaagagcttccaaggaagtactggttttcgatatagatgaagtctttagctcgtctaatcgcgtgaatgtaagcatcttgaatactcctatcaattatattatcttttccactcacaagacctgcttccgctgcagcttcaggggagtcaggaaatccagcagctgctccaccatcaatggatctaaacaactgaacattccacacgtcatgatcctctgagaacagaacgggagaaggcgggatgataatatctccgagttctctcattttaaccaaaatatctttaccgccttgtctactccatctctgctcaaaattatacaagacatcccaagcaataggtccttcaagacgacaatgaatatcatgccatggctctctaggaccacctttggttatcgcagcgccagtgaaattcggttgatggaagtcatcgtgatgggcagtgtccaacgttctaaacaaggagtgaaacggagtgtcatatcttccatcacaaagatcaagaccaccaacaaaactcactattcttctggatcttgatcctccactcggcatttcactgtctacaacaacaatcttttggtgatgagtgaacatagttgagatttgcaagttttggacaatgcttccaccatcatcagggttacgaggacacaaaatacagttcacgtcggttcctctgaaaaaattctcagtttcctcatcatgagtagccataagtccatcttttttcagcaaatcaactgatgttctgtcatcccaaacaagcaaaataaccttaacaccttcactagctttcttcttgagtagctcaccaacagtcacatctcctccttgttttggcctcctcgagtccctcactaaagaaatctcagtgtaaacagaccaaccagtaatgtaaatcaagtgtttagcattagtaattgcatcgaaaatatcctcccaacatcgatgtggctcgtagtttttccctcccgcaagagggattttcgggacaaagtttccagggatatgagcatcttgatacaaagaaactttgcagcctctcctctgagagaagaatgtgtaaggaactcctggaaacttagcacttttgataccacgattccagtttttatccttttcaacaccgaaatattggagtttcacatggatctttgatcctccagcaattgggtttttctcattatctaagatatcaacccatctatcaacttcttctccatgcaaaatatcttccacaggaatataacctcttccgatcaacgtcgcgccaatcggattagcatccttaacagtgaaaataacatgtttagccatgtgaccacagtaaatatgaaaagactcaaaccactttgggttttttggctcctttgttattttcctcgttcttccaactcttgctttctcaagatcgattgtagcgtaaagctgagtttctcctttgccaacaccgattgtttcttctacatttgctagtatctggaaagattaaaaacagaacattaaagacagattgaaggaaaccttttgttgttgtatctctaaacaacttataaatgagagagagacaaaagacaataccgatcctaagaaacctgatctacctccttcagcatggagatgatcaacttcgtagattgtcgcgtgcaatcttccatgtaacaaacactcttccattttttcttcccgcctgtaacatcataacaatattagtaaaactcatacattagattaccaaaatacgtaaattcacattttacagatcctgtaaacaatatttttcgtttaaaaatgtaaagtaaatttatgtgcagggagagacgaatctacaagctaaagtcattaaccgtaatcagtgtccgaggaaacagaagaaactctaaatctcaagtaactgatctccatcaaaacaaaatcgaatcacagaaacagtttgagaggcaagcaaaacactgagaaattacatactgcaatcatataacgaatgtttaaactttaaccaaagtatttatgagtttcataaacattttatacacccacttgcttcacaacaagaataccagaaaccagacgatatgtgatctccaagataaacgttttaaaaaggaaaaagatctgcagagaagaggaagaagagagaaaacgaaactacctgcaaaatttctcagagattgagagagaagcttgtttggaagaattcaggtttgatccgagaaggaagctactttgtgtgtgtagctgctgaatgtttttgtgatattaatagaagatgaagcaaaaaaaaacaaaaaactggctttgagtttaagactattgctacgtgtccaaatgaccgagattactgattaacgatgatactaaaatcgctctcaaaaattccttaatgattgtaaatcggtcacagaaaaaaataactaaaaatagattaatgttggcaagcattttaattattgcagacaacatacacatgagaattacatttccaggtatatcaatggtttttttttttttaatttccaacctggttttgataggaatctgtttggtaccaaacagatttaccgaacataactgcctaatgtaattaaaaaaagagagagagcgagggagagagagaaagtaaaagctcttactttggccacaagatagtccggatctctctctcagcttcacaattttccccaagtttatcggtccaatctaatcctcaaacctcaaccaaaaagctaacgagcaaacgcgcgtgatactcttttccagaaatg

SEQ ID NO: 8820 - DNA, 3000 bp, Unknown
  misc_feature (1)..( 3000): cDNA_ID_1989241_gDNA_ID_1971898_Annot_ID_58506 3000 nt of promoter + ATG
ttttgatatgtaactgtaaaaatctttgcagggcatcaattgagtgatatattttgttttttcaggtcttacataaagtcagaagcagttttgaagatcatgaaatacattgacttaccatttccacagcttgcgttcttcttgcagtttgctcctctgtaagttctcgcttaaggtttaaatagcagaaggaaacgccgcgatgtgattgatcttaataagcatttttcttttgacatgttgcaggtttgtgagagactttttgtatgaaaatgttgcaaacaatcgatatgcaatgtttggtcgatctgattcatgtgagctctaagaatacatatgtgatcctactttgccacaaaaaaaaaaactagatatgtaatcctacagattaatataagcttttatacagatgtatagtttacaacagccattaaacaatagatacatatgtactacttttcgaatcatgtactcgtcaaatgtataacctttccgacgttgatatttgtgttatatatatggaaaaaaacttgggattgtgtgaaattgtcttttttcagagaatgtctcactggtctgctggctacaagctgctaattgaaatctctgaatggcatgctctgtatggtatgttctctaagaagcttagtgtatcccgcaatgaatctgcagaaatttcaaggaaaatttcaattatttacaggtaagggatgaaacttttcacaacactgagggttttgtttatgtgttgatggagaattcggctacttttgaacaatggttcattaaatctctttcgttaacttaccccgcaagaaggatagctagagatgtaaatctgaagatgtgttgataacacttgtgttttgatttcttgtgtttcatgtcataaccaggaggaatgtattttgggttcacgtatccgtactgcggacggagaagaaggacgaacccgaggaagaaaccagctaggaatcctccaaaatgagcagaattgtccacacgtggtaagaatccgacgcttagattcagtacaatgatcaggattaatgtcataagtgcggtgcactacaaaaaagtttgagatcagctttcaataatgcaccatattgaaaatgaataatctttttaccttattttcatagattgtccagtttgtgatgagctctgagagcattgcaccgagtaatccgaacaaagcaccagatgctccgactgatacccgttctccttgggaatctgttaagcaagacaccaggcttcctccaagcccggagatcacatacaaagctccgattctcactgtaacaccaaactcttaaatcagatcacagaaaattcaggagacggaaaatagaggggtttaaagggtcttactgaatccaaattcttgttcaaggcgcattccgatacacatgaggctgatcatgttagccatcaagtgaaggaaaccaccatgaagccatatgcaagagatgagacgccatctctcaccttcctccacaagtctcctttcgagagctccgagttttctcagcctgaatcaacaacaaagatgcattctgtaagtattgaaccagtttttaatagattccttgttctaaccggagagaaaaaaaccattatggaatcaagaaatccttccttacgtgggaatagaaggaccgagtagcatattctccttaatcggttgaaacgaaagccttccaaggacatcaaataagagacactcatctgatcttgcagggcaatcgttcacatacatggtggtagcgaatgtgacgaagttggctgctaaaatgagaggcacaagccacgcaacccatggcacgggaatgggcgggcgaaaatgtggtcgcgctggtggtggtggtccgttttcgatatctggtggaatcggcggtctcttccccatttctggaaaagagtatcacgcgcgtttgctcgttagctttttggttgaggtttgaggattagattggaccgataaacttggggaaaattgtgaagctgagagagagatccggactatcttgtggccaaagtaagagcttttactttctctctctccctcgctctctctctttttttaattacattaggcagttatgttcggtaaatctgtttggtaccaaacagattcctatcaaaaccaggttggaaattaaaaaaaaaaaaaccattgatatacctggaaatgtaattctcatgtgtatgttgtctgcaataattaaaatgcttgccaacattaatctatttttagttatttttttctgtgaccgatttacaatcattaaggaatttttgagagcgattttagtatcatcgttaatcagtaatctcggtcatttggacacgtagcaatagtcttaaactcaaagccagttttttgtttttttttgcttcatcttctattaatatcacaaaaacattcagcagctacacacacaaagtagcttccttctcggatcaaacctgaattcttccaaacaagcttctctctcaatctctgagaaattttgcaggtagtttcgttttctctcttcttcctcttctctgcagatctttttcctttttaaaacgtttatcttggagatcacatatcgtctggtttctggtattcttgttgtgaagcaagtgggtgtataaaatgtttatgaaactcataaatactttggttaaagtttaaacattcgttatatgattgcagtatgtaatttctcagtgttttgcttgcctctcaaactgtttctgtgattcgattttgttttgatggagatcagttacttgagatttagagtttcttctgtttcctcggacactgattacggttaatgactttagcttgtagattcgtctctccctgcacataaatttactttacatttttaaacgaaaaatattgtttacaggatctgtaaaatgtgaatttacgtattttggtaatctaatgtatgagttttactaatattgttatgatgttacaggcgggaagaaaaa

SEQ ID NO: 8821 - DNA, 3000 bp, Unknown
  misc_feature (1)..( 3000): cDNA_ID_1989239_gDNA_ID_1971898_Annot_ID_58509 3000 nt of promoter + ATG
gttattcagcatagttaattttcgcaaaagaaagaagccaaaattaattaaaagaagcagcaaatgttgtgtcccttttatgttttctatgcgaatggctcaatggagtaaattgctaattcacgtcatgaacacaaaaatgttgatatattaaacaagaagtccatttttgtacctcatatcaaaattttatttgtaaattttgtattaataattgtggatttgctatactatactatgaaatatttttctttatagacaagttatgttatacattaaattatttatttattaataagtacagtattttagtgtattgtcagagttcagtttctttaaagaaaacacaatattttttttttttgtcgtcaagaaaacacaatatttatgttaaacaaaaatgcatgatatttcaatagtttgtggaaaattatagaaaatatttcattttccttcttttagtttggtattaagaaggaaaaaaccaaaaacatttttttgataatgtatacataaattaaaattaaaataatgagaaaacaaaacaaggtccaaaataccttgtgaagaaaatggcgacggcgtttgccaacacgacttcaagctccaacctttacctccatcgctgccgtaaaaaccatcctcttccatctccgtcgttcttttcaccgttccggtcgtctccacttccttctcagacccttttcctcgtccccactccaaaacctgtacgacgcatcgcggtcgctcctctcggccctccaacgccgcctagtcccgacccacctccgcctaaaaacacgactgagctcacaagttcgtctttcccttcttacccttaaaacttcaatgtttcaactctgagttctgattttgtttactgccaattctatttttcaatctttcctaattcgatgaaattgcattacggaattcgaattaggagaatgaaggtggtttaactgctattgattcgtagataaagatgttaatcttagtcctcaagatcgattactgttcattgctaaagttttgatctttgtgacaatttatagacttttactcttgttaagcattaaggatttataaatctcctccttttacaacttgtgaatgtcttccaaaagttccaccattttcttttccctacaggtttagtcattggttgcaatacgagagcaatcttcttaacaatttggattcatagttgttgtttggtatcacattttgtgtaggtcttgtgggagtagcgtcgatgattcaagaccgtgtaaagatctttctttcagtactaatttggatctctctcttcttttgggcttcggctttacaaggaagaggcagcaaaggtaatggtaaagggaagaagggttcacgcttcaaatagtattagttagattggtgtggtgatgatgatgatgattgatgaaaactcctctacacgtttgtgtatatatacagaggaaatattcttccaagtaaagcaaatttcttgtcagactacagttttatactagaaactagattgttctcttcttacgatatctctagcttagagctatagagattactctactgtgatgaaactaaagtagtttgcatttaagtcaaaatgccaaatcaatatcattgtttattgaaagctgtttcagattgtaaatgactagatgtgtttggtgtgtgcttgattcagccaaacggtaaaccgcaccgtttctttgatttgaatgtttgttgtataaaatgggcctttagatatgttatataacttgtttgggcttcaacatactcttttattgggcctctctatataatataatatttccaaagttgtatttaattattatttgatttatatttaaaacagtggttgtttattcatgatatgaaaaaagaaataactggatttaggtaaaccttattcaatactgggacaatgaattaaccagctcatgattagttggacctgttttggttaaaggctggtagtaagtttagaaacagaaatttatgataagagcctaacattttgttctgaccacactgagtaatttaacaatctatctaaattaagattttatgctatgtttaatttatatttgttctgattatagcaaataaatttccatatctagagatcttcttcatacacaataaaaaaaactagtatttgaacttttgtatgtattaaaaattgcaagattttgtaagtacagattcaccaaggtgaggtgtgtgattaggaaactttgattagttgtcatgtgtcatcaacaggccatgaaaaggaaatctttgaaattcaaaaaacaataccttttgatgaaattattactatataaatactatatgtgactatgtgtggatatgcacaatcattcccactaatagtttaataaagtgtataatttttttcaaattaaaacagctaaacacacacaaccacattcaaaaaggggttaagcattgaagaatattctaagaaaatttgtttctcttcttacagaagtaaaagcgactctctctctcattaagcatcaaaggagtttcgtttttcttgctttgctgttacattcttcaggaaaaaggcgttacctttactctctctgcatcaacgaggaagcgtgtagagctaaaggagctgaatttgagagatttttttgttttgtttctgggtttgttcaaagatgcaaatttttagttgtttctgctgtggaaaaggatttgatcggtatgtatggagttttaatcttgattttcaacttgatttgctggtttatgggttttatctagtttctccattgttttgttcttcagaaatttgttcttgctttgatccgttttgctattcttctttattagggttttgagatttatatcatttctcgagcctattcatgttcaaaatttatttcttggtgtaaagtttggaactttcgaacaataatctactgtttgataagcttaagttgcagatttgataaacccaagaagaaagta

SEQ ID NO: 8822 - DNA, 595 bp, Unknown
  misc_feature (1)..( 595): cDNA_ID_1989226_gDNA_ID_1971898_Annot_ID_176940 3000 nt of
ttcgcgtcaatttagctgcgctttctcgatcttttgtacttcggaagctgcaacgttgtagaatcggcggatccaagtcggtaattactcagcttctggtaagtgttcactgaccgatcgatgtgattttgaattttttgtaaccagaagatatatttctggcttcagtcttcaaatttatccaacgcaattttctagttctaatgcttgttttgtggctctggaattgaaaatcctttgtaatctgagaaagttctggagtgttcttcagatttagtttaaaatagttgcgattaattcctaaatgcaggtcgtaagactagtttagatctgaattctaaacagttatagttcatctagtatcagatttttgttaaattagagtttgatgtactggaattagaagggatcattgcatgctaatctttgatatgtgttgtagactgattgaatgattttatctgtcttaggttgtgatgttaatgtgagctgcccaattttgtgatggtggattgaagcggttgaatttttctacttcagattgcttttgtgtttgatatgttactcataatgagattatagccttgaaattatg

SEQ ID NO: 8823 - DNA, 3000 bp, Unknown
  misc_feature (1)..( 3000): cDNA_ID_1989227_gDNA_ID_1971898_Annot_ID_176939 3000 nt of promoter + ATG
gatgttgaatatctaagagaaaatatacatcacaaaagcaacgagaaaagaagacaatatacaccaacgagaaaacaataaactaacataacatggaaaatcaagaaggaaacaagacataccagaagccgccatgtttttatgagaagaacttgaaaatagtcttttttctatactcagccgatttttgttctatattttgagaggagttttggaaaagcagtgatggtgaaaatatgtgacgaacaatgtgtatttatacacccaaaaaagcaaacacatgatatatttttctgtttcactaaatcaaaatgtcaaaaatattggttggtcactcattaatgaaggaaacctaattaattagatgtttcattatcaatatgtgcaaccagacctaggttttaatgtttaatttctttctaattctatatgaaatgataacaaggaaattgaacttatgatatctacagtgtactacagctggaaagtggaaaccaataatatatttcatattatttgttttagttttgtttaatcaattgataaaaccaactatacatatttggaaaatgttaatatgtatgaatctctgaactagtagagattttcgttttttacacgttgactattaatgatggatcttaaaaaacaataatatatatacttcattttctaaattactatttcgtagggcatgcacctacacacgtatatatgaatttttactaaatcgttttattttagttggtatacacattttggcaaaactgtaatagttatgtaacccgcaaatattatagatataaattgaggaaacaaaaaagaattaaaaaactatgagtcgtttcaaatgactaagtgagtcataggaaaacttagtcgcatcaaatttctaattggggcatgagtgtgatcaaagaatacatacacataaaagcaaattactaacaactatgaatcccataactagtatagaattaaattaaggaaacgacaaagaaaaagaatcttgactatgagtacaacaacttcaaatatttataggtaagaataaggaatttcagatgactaagtgagtcacgggtgctttccaaacaaaaagaaatttccatcctcattgtggaacacgtaaactttaatatttccttcttttttgttttaagtcccacaactaccttaaacctgaatatcaatttggttagcacttggtattcttccgtcgcacgttttggtggtttctaagaaaagtataataaaattccggtttgttatagaacaaaaaaagaaggtcatatagagttgatcttttcgtttcaaataccattgacagaaaagcttggaggaacaatttgcgaatataatgttgagtttggtgtttctcgaagctgaacaaacccaagcaacaatatgcacaaggctagaaggtggagagtattatttcaaaaggtcaaaatgttcgttggtctcattatcaaattagtgtagtaattaacgttccatctttggcttcctagattactcttatgtttgaaaaaactgacttgacaaaagctaaatgcttgttttctttttcctgtattgaaaagaggttaccatgtacaacttgataacaccaacagaaaaaaagtgaagaatcaagaaggaaaaacaataaaaagtcattgcaaaaaaaaaaaatcgattaatcttcaaccatatatacctaacagattacaaatcccttctaatatgtaatagagatcagagaaatgttttgatgtgtaattaaattaagtaaaatatcacaaagaaagacaaatgtcattacttgcacgaccttgtggtacaacaattaccaaattcgatgtggtatacattttattttacttgttaatttccgcttagtgttttggttcaacaagttatttaatttcaatttcttagtcttatgatatatatatatgtatatttttttttggtgtaaaatcaccagccccaaaacaaaatctagcagtactagcttaggaattcaaatactaaacatggaaagacaaatgaagaagaagaagatctaacgagaggaatctgagtctctagtcttatgatattatattattatttgttaacattgaccaaaatggcagaatagatgagttaacgttctaataaaaataaaaatatgatcatatgaatccgtgagctagtcccaaaaagagatatggaccaatcacatttaacatgttatcattctactgtgactaaatcagttttaaatttaaataagaaacaaatgtttttaattgaaaataagaaaaattaaatgattttttaatctatgtgggaaaattttaaacatcaaataaattgaaagagaggaagtaatatattttttagaaatttgaacttaattaatataagtttccgttttaatataaaaaaaaacaattgatactccaacaatgtgtaagcaaccaattattttaaaatcaaataatttttaaaatgtgcatagaatctttttttatatataaaaaggcgtaacagctggaaggaggagattggttagtgatgaaaaatgaaaagtttctaattacaaaagacgaagatttgcaaaagcttttaattgtttatgtcccaaagctacttgatttggtgaacctctgttctttgatcatttcaagtctgattttcgttcatccccgacatgaataccattctatattcaaatatcttaagcaaaattcgaagattcccagaaattctgggttttcgaagtagtggagtgctatggatgttgcacacaaggtgttcgacgaaatttcccaatgctatttttttatatatcattcttgtgtcacgtgactctcacgttataaaagccttgtgtcacgtgactcacacgttataaaacccagcttcttcttcgatgcaattctgttattttcgttgcttctttttttcccgcttcacaaatttctctctgaagcaagaaagcttaaagaatcttgagaatcgtctaca

SEQ ID NO: 8824 - DNA, 3000 bp, Unknown
  misc_feature (1)..( 3000): cDNA_ID_1989229_gDNA_ID_1971898_Annot_ID_176937 3000 nt of promoter + ATG
gtgacgaataatgtgtatttatacacccaaaaaagcacacacatgatgtgagagagagaatattccatttatttttccatttcactaaatcaaaatgtcaaaactattggttggtcactaattaatgaaggaaacctgatttattagatgtttcattatcattatgtgcaaccacacctaggttttaatattttctttctaattctatatgaaatgataacaaggaaattgaacttatgatatctacagtatactgtatactacagctgattaccaataatatatttcatattatttgttttagttttcatataattaattgctaaacaactatacatatttggagatttaattacgtataaatctcataactagtagagattttcgtattttacacgttgactatcaatgatggatcttaagaaccaatatacttcattttctaaaatactatttcgtaaggaatgcacctacacatgtatatatgaatttttactaaatagttttactttagtcggtatacagattttggcaaaactataatagttatgtaacccgcaaatattatagatttaaattgaggaaacaaaaacggattaaaaaactatatgagtcgtttcaaatgactaagtgagtcataggaaacttattagtcgcttcaaatttctaatctgtgtaatcaaagaatacatacacataaaagcaacttactaacaactatgaatcccataactagtatagagttaaattaaggaaacgacgaagaaaaagaatcttgactatgagtacaacgtaacaacttcaaatatttataggaaagaataaagtaatttcagatgactaagtgagtcacgagtgctttacgaacaaaaagaaagttacatccacattgtggaacacgtaaactttaatatttcattttttttcaagtcgtcccacaactataccttcaaatctctagacgtgagatatcaaagctaccttaaaacctgattatgaatttggttatagtacttggtattcttccttttcacattttggtggtttctaagaaaaataaatttcggtttgttatagaacaaaaatagaaggtcatgtagagttattttcatatattcatatctactattgacagaaaagcttgaggaataacttgcgaatataatgttgagtttggtgtttctcgaagctgaacaaacccaagcaacaatatgcacaaggctagagactggagagtattatttcaaaaggtcaaaatgtttgttggtctcattatcaaattggtgtaataattaacgttccatctttgggttcctaagttactcatatgtttgaaaaactggcttgacaaaaccgaaatacttatttttttctttttgctatcttgaaaaggggttaccatgtacaacttgataacaccgacaagaaaagtgaagaatcaacaagataaaacaataaaaatgaattgcaagaaaaatagattaattaataaccatatacctaatagattataaatcccttctaatctgtaatagagatcagagaaaaattgctgtgtaattaaattaagtaaaatatcacagagaaaaacaaatgtcatcataacgtgcgtacatttgatgtggtatacatttcattttacttgttaacttccgcttagtgttttggttcaacaagcaatttagtttcacttgcatagtcttttgatattattagttaaattgatcaaaatggcaaatagatgagttctatgttcaaaataaaaatatgatcatatgaatccgtgagctagtcccaaaaacagatatggaccaaccacatttaacatgttatatttctactgtgactaaagtcagttttaattctatgacataactacgtaacacattgatactatatatccgctcattcactctacaatgactctcatctcaatcgagtcaatcgccacaatttgtttgccaactaattacaaactcactagatatataacattcgaagtcaaaagataaaaaaaaatgtcgcttatatgatcttacgcatttgacaagaatgtcgctatatatcttgtatacatatctagcttcatgggcacgtttctatgtccttcactccccacttgtctttagttgataagaaattaatgttatacaacatcaaatgaattgaaagaaagcaagtagtatattttttcggaaacttgaaattaatttactctatcctttttgaaatgtaaggatgtttcaactaaaagcacaaaaattataaagtataattttttttttccaaaaacatcattactatttaattaagattcaaccaattatatataaaaaatattgcataataaaattgttgcaaagtactccttatgtcagttaatttgttgcaacaatatgcaaactttaaaattatttgatactccaacaatttgcaatcaaccaattattttaaaatcaaataattttaaaattttgcatagaaactaaccaaaaaaaaaaggtaacagctggaaggttgagattggttacaaagacgaattatttattatattaagccccaaagctacttgatttgtcgaacaacctctggtctctctgatcatttcaagtctgaattttgttcatccccaacatgaataccattatatatccaagtctcttaagcaaaacccgaagattcagacaaatcctgggttttcttttgtttatctattcctgaaaattcacaactaaatcgaaacagtgtagtgtagtgtactacagatgttgcacacaaggtgttcgacgaaattccccaatactaaaaattgttttttctttttctttaaaccaaagccttatgtcacgtgacactcacgttataaaagccagatttttcttcgatacaattatgttattttctcgttgctcttttttcccgcttcacaatttctctctgaagcaagaaaagccctcgagagacacaagaaagcttaaagaatcttgagaatcgtcttca

SEQ ID NO: 8825 - DNA, 3000 bp, Unknown
  misc_feature (1)..( 3000): cDNA_ID_3043669_gDNA_ID_1971898_Annot_ID_176931 3000 nt of promoter + ATG
cttctataaacactagtcttgtttttcttctacactatgaactttatccaaagactcttgaagaacttgcattgcgactttataatgatccaaagataccgctccttcttcaactacctgaagagagtttttatacaactggtcaaaccattgaacccggtccgtaccatcgacaaaaccagtcaagccgttatcagcgaagtggaggcgtttgtagtcttttctccaccgaggtagaatataccgtaaagggatttcttcaacgccgttgaaattgagaacacatagagcatgtctgcataagtatccgtagaagttgaagcagctacaaatgcaacgtacttcgccaactgatctgttgtacagaacttcgaaatcgcggatttctcttctgctggattcgcctcggacccgttctttcacaaggaagatcacgaaaggtccatcgacatggacctgcgttgtgctgaaacatgagtacatttcttctacctctatttggaatttcttgaacatgtctctcgtgtagattctcgagagctgtgtctcgaaagaacactttgttttaagctccgcggtgttcaaggtttgagactctatgtcgctgagagtttcttccctgtgcttcttctgaagagctagctcgtacttatcgagaaactctttcaatggtgtttgcttgtgaacatacctctcgaaaaatggtttcagggtttctccaggatgagcagcggcgattcctgcaaaaaaagtgtctttgagataaaccggagcccatttagctctctcttcatacaaggaacggagccattcattctcgataaccccaaaattgtgaaccatgaacccccaagctgcttcaaactcaacaacttttaaggtttcgtaaactgctttcgtaaatgccttcctcacggcatcataattatgcagcccccctaatttctctggaattttcctcattatatgtgtcagactgaatctctgatgagatcttgggaacacttgagagatggcagcctctaaaggcttgcatctgtctgtgacaatagtttgaggagaacgcttcatgacactgagccatactttaagcaaccaatggtaagactccattgtctctccagcaagaaaaccacaactaagcaatgtagttttcccatggtgattcactccggtaaatgtcaccagtggaatctcgaattttcctgatatataagaactgtcgatgaagatgacatcgccaaagtaactgcaggaaactttagagaaagcatctgcccagaatacattccgtagttgaccttcatcattcacatccatcaagtaaaaaaagtttggatttgtcaattgcatacggcaaaagtagttgtaaatggctgcagaatctcctctcttaaggttcagcaaatcaggtgacccagtagaattctgaaacttcttgttaagagtcgagtttgggttcacattgctcccattatccaccacacaagctcggtacagcttaatcgtcttagcgtctgagactggactagatacacacttcctcttccttttaaccgatttatataacttacaaccgagtaaatggttatgatcaagtgtaacttcaactacccgccacctcttagaatcaacctgtctcattcttatcatagcaggacaaccagttcgagtttcctttctaacacgattcacatcgttaatcctcttaaaaccttgactactacaacaaagcaccgcaccatacttctctttactacgccgcttaaaccacgaattcttcactcttacacgaaacccaacttcactagcataacagttataatagttataagcatcatcatacgactcaaactccattccaaccgcaggtgcatcgaattcttttctctcatcaacaagtaaaccactctgttcatcaaaccctcccattgtttcttcttcactctttctttcttcgttttgacaaaatccaacatcaatctcatgctcactactacaaactagagcttcttctcctatccgtaaagtatctgacattggatcatctctttcacgaacctcgtcgttctctaaatatgcagatgcttggacctgtaataacaaaaagctataaactttgattctagcaaaccctatttactcaattgaggcatcaaacttgtgaaggagctgaacaaaaatgataatcaacccaatgaaatcaaatgtaacatcatcacaacccttgtgcgaatcgattcataatcttcacaaaatccagaattgaaaagaggagttttagagttaaacacatacatcttcatcaacggactcacttctctccattggaggtttggttcctcttccttcttcaattcgcgggtaaattttgatgaaagcacttgactttattcgattgaaggagaacactcgtgaaattgatcggtccgggatagatccggacgggtcttacacggaaagatccgacccgagagtgatcttgcgcgggtattgacctttgaaagcggttaggtagtttaacttcttcttctgacggtgaggtggtcttttggggctcgactggtgactctagcattttcaccaacatagagacaccttaggcttagggttttcacacacaggttcaaagcacgtgctgcaaacgtcgtcgttcgcacttaaacatatcatttttgtttttccttcacttaagacacttaaacgacaattacactgaaacggagggaatgctatgaaatgaaatccaaaattgcattacatagattccctgaaatgaaatctatgagtctatgacattagtaaaacgcacaaacttgtgaatgtgatatttatgagcttataaaacagcatatataaaaaaaaaatatatcaatttctagattttacccacaatcttaatttatgtcatcattaaccactaatttttcaatattttctctctctttcgaggcgcatatataaatacaggaaatacgcttttttacttaccaatcaaaa

SEQ ID NO: 8826 - DNA, 3000 bp, Unknown
  misc_feature (1)..( 3000): cDNA_ID_2038996_gDNA_ID_1971898_Annot_ID_176930 3000 nt of promoter + ATG
tgtgggatgcctacaaggctatgtgatattctactattattagttatttaggctgttacaaggctttgtgattacctctgtccttttttgttgtatttggaagtcagaaaaatgctcggagggcagcaactactttctctggcctgtatacaaagttcaaaattcagagagtcttataagaatcaaagcagaccagaacagtatgtgtattctcataccagtcttcttgaggcaaatgcccagcaccttcgatgagtcgaagcttaacattttgggggttctgtttctcaaattcctctgctatagactgaggcagatatttatcagctattccccaagccagaagcgtaggtttatcccagctgtgaaggatcaaaacctcagcaaagtaaaagacctatctgtagccgtgtgaatttgtaaaaagttgaaatgcacttacctgcctgatgaaaacccatttgcaatttgactcaatgtgtctccaaagttgatcttcttcgcagtctcgagcaaggctaattcatcagaatctcaggatgagaagtctcttagataatagattaaaccatcataagaatcaagagtaaggtgtgtatcatgctccattcattgaatttggtttagagacgtaccaaagccaggccctccgcttgacaaatatggtagacgatacacatcagctttctcattcttcaggacgtagctatcaaaacagatatagagtaagacaattgtcagtagaagcctctatcaacatcaccaaacacatgcattttgaggctgagctaggagaatagccagtatataatgtctcatctctataatgaagatgatggttaatttgatacatacgggctacctccttcaatgaaccgctcggccaagatagcattttggcaggtgaattcaccaaacaggggaatcctgcatcagaaaaaaaatgaggaaagccaagagatacaaatagattggtgctttcacagagtattgcaagcatttagagtggtcaaaatggcaaaagagttgaacctcagctgcttaaataatccgggaactggggatgaaacggtcagcggactattaaggatcgcgagtttctcaaccttgcttggatttttcaaagcccaagttaaaccatatgaacctacaagaaatcccttgggagaccacaacaaatgcagaaataagatatatattcagtcttgatgaattattaacatattatacacaaatgggataagaacacacatccgaacctgaacaacaagaaagaaaggagatttgacctctagcacttcaagcagtttatcaaacgcctcatggtactctttttctgagaagatttaaaacttattagaacaaagaaccatgtacactgattttgcagttcacaaactattaaatgtaccatcaacgaacctgtgtaattaaaaccgtatccaggctgcggtttgtcactgaatccgaatcctatccagtcaggtgcaaagcaatgaaatccagcatctgacaactattacattgttgggaacacacaaaagatccactcaagcttcatatacatacacatgattcattggaaatcataagagtctttcattagaaacaattgtttcccatatagacacatgattcaagattcagtgtagcacctcagacatgacagttctgtagctaaaagactgagtaggagctccatgaacaaatacaatggttcctcgacgactctcctttgatcctaccggaaaataggaaaatgcttaatcagtgatcaaaaactcttcttgaatccaaaaaacaaacacaaaacttaagtctttaccagtctctctcacaaaccatctaagcttcccagatttgatagttgagccatactctttacctttatcttcagtcctctaaacccacaacataacaatcaacaaaaatataacactatgataaaaaatggaatttgaaatcaatagaagcaaatatgaaccatgcatcttttcaatttcaatcacagttcaaaattgaactgagtaaatatgtgaaatttacgtagagcatttggccgacattgccgtcttccgccggagactctggtaactgaattgcactccggctagacgggttgtctgtaacgaaaccaaatgggttaaaagatggatcctcatcacgatcgtttttactaccaccgctgtttccattctccgacgtggcgtttatgacagagaagcggattttcgacggcgtggcagtgattctagaggcggtggattttgtggcgacggtggaggagaatgagtggagcagaggaagaggagagagcaaagacatttttgattggtaagtaaaaaagcgtatttcctgtatttatatatgcgcctcgaaagagagagaaaatattgaaaaattagtggttaatgatgacataaattaagattgtgggtaaaatctagaaattgatatattttttttttatatatgctgttttataagctcataaatatcacattcacaagtttgtgcgttttactaatgtcatagactcatagatttcatttcagggaatctatgtaatgcaattttggatttcatttcatagcattccctccgtttcagtgtaattgtcgtttaagtgtcttaagtgaaggaaaaacaaaaatgatatgtttaagtgcgaacgacgacgtttgcagcacgtgctttgaacctgtgtgtgaaaaccctaagcctaaggtgtctctatgttggtgaaaatgctagagtcaccagtcgagccccaaaagaccacctcaccgtcagaagaagaagttaaactacctaaccgctttcaaaggtcaatacccgcgcaagatcactctcgggtcggatctttccgtgtaagacccgtccggatctatcccggaccgatcaatttcacgagtgttctccttcaatcgaataaagtcaagtgctttcatcaaaatttacccgcgaattgaagaaggaagaggaaccaaacctccaatg

SEQ ID NO: 8827 - DNA, 3000 bp, Unknown; identical to SEQ ID NO: 8821
  misc_feature (1)..( 3000): cDNA_ID_1989239_gDNA_ID_1971898_Annot_ID_176928 3000 nt of promoter + ATG

SEQ ID NO: 8828 - DNA, 3000 bp, Unknown; identical to SEQ ID NO: 8819
  misc_feature (1)..( 3000): cDNA_ID_1989242_gDNA_ID_1971898_Annot_ID_176921 3000 nt of promoter + ATG

SEQ ID NO: 8829 - DNA, 3000 bp, Unknown
  misc_feature (1)..( 3000): cDNA_ID_3043677_gDNA_ID_1971898_Annot_ID_176917 3000 nt of promoter + ATG
cttcagtattttgttttaaaatcctggctccaatcatattaagcttaggttggtttgttgtaattagctaaagaaaagtaatgacaatatcgagttaataaacaaaataaaaatagggtggcataattctagtgaaaaaattgcagtataacgtttttttccacttgatgcattgaatcacaatcggagccgaagtgtttgtgaaattatctaaacgaggtaatgtcacactattatgatgggagtcccgtcaaatgacctcattatctattgggccatatgaaaaggttttcttatttcatacgatacagtatcgatcgtttccttatatacaagagaagacattagtcttacgacttaacctaattccaacatatggactaagttaatcgaggcccatatggcccaatattatcttcagtgggcccaccctgcttttagaagaaagaaacgaaaatgctcgtcgtttcaccctctatcaatcacgccggaaagcagttcgccggtgagtagagtaccggagttaaaaagttactatctttgtagataaacactaatttgttttcaaaattcgaaaatgttttgaagttccgaaataaaaacaaaaaaattccagtcgtaagaaaagttgtgactggttagtagtactcttgggcaatgccagattgccagctaagggagggagcaacggctcgaacatataccacaatctctctaaaaagcacatttgcagtcatctttcactcatttgcattcgtccaaaacaccgcaaaaaaaaaatattcactcatcggcaacaaagagagaaaagatgcctcctcggtctgtcccacaagccaagatgcaaaggtatttcgaaatcatgttcttcttcttcttcttctctggtttgaactctctctttcgttacttttccaaaaatcggtgttttttttctaatttcttagcatcctctgatttagtctctctgtttactgtgtgtttctctaactttactctttttgtttagttttttcaaaatgatatagtattccagtttctcttcactcatttttgcaatcatgttcgttttctacttttttctacatgttcatgtttgtttctgatacagctttattcttcctctgatttcgttagttcttccaaaaacctgcttttttctagattcttagcatcctctgatttagtagtcttctccgtttgttttcaggatccagaacgtctacttgcactacatgttctcttaatcaacgccattgtcatttcgttggtgttcacggcaatagctgccggtagggatgacaacgaaacaatttccgagtccaactccaacaactcaacaaccgctgctcctcctcctcacagaaacatgcccgaccggatatcggtttgttcctcttcgggatacttttcgtagtatatctcatggtgaaatcctaccaactttctcttgatgacatctggtttcctttcaagaagttcttagatgaaatttcattgtggcttggagttgtgtcccttgttgttctcctgctccttaccactacagtgtttacaatctacattgcagtcccttcagtcatattggcgatagtgggaaggttcatttttgggagaccctgctttctagaattcggctacatcaccttcctacagatatcaaaatggatttgttatctctggcttctaatcgttttgggatgtgcaaagcttagaaggaatttgtttacagggacttcagaggaatccagaatgttactaacagatagggttactaaatcggggaatgcaaaggattcttccctcgtgaagtggaacaagaggattgccgctgcgagagctcgcgcaaccgctgaatctgacagagtggccaaagagaaagccgatattgaagccgatgaggacgctgccgagacagccgaagtcgagctcggcttgatggtggctccggtcaatgcccaataaggcccactttagttttccctcgttctcttttttatgtcgcttgagttttaaataaggcccagtttagccaaaccataagacccaatctagttttttttccttcgtaatatcgttttgtgggcttgttttcttttttagttttggataaatggacttgagcttgtttcttcttgcattacatttatttacacatctgtttagtttagttatgcaaattccacctttgtttcatttgaaaataatcatagaaaattaaaacaatgttaccttaaagtgagattatagttgatctgaaaatgaatataaaggaatctggtttgttcgcttcggtgtccttttaagaatgaaattaaaaaagtcttatttactttacaaacttgagattatagattgccaaaccttctcaagtcttaccaccatattatagtttgaaatggatatcgtgatcatcaagcagaatcactaaatctccaaattcatttttttttttttgtattcaaccacacgtacgtacctatgagccactcttgaagaaaattgggtagggggttataatgtaaaaaaacagattttttgttataattaattggtaaaacatttttgggaaaaaagctaaaaaaactctcaactaattttaattttgaactttaatatccaattgttttagattggaaaataaaaatctaaagtaataaatcgatatatgaaaaaatataatttttttttgagtagttgaataaaacatgcgggttaacagacgttaattttgctaacaaaaactttaaaccgaggttaatggttaaccaaacgtggttaatttggctttgcgaaagactaaaatgtcctcgttcgttttccccaaaatcgattcgttttcaccaaatttcatttgggatcgcgaaagagaaatcccaatttctctctattctgatttcactctatcgttttgtctcctttgatagagtgagaggtgatgattgttagcgtttgatcgggtgaatctatgtttgagtctgttcgtaatctatcgaaaag

SEQ ID NO: 8830 - DNA, 3000 bp, Unknown
  misc_feature (1)..( 3000): cDNA_ID_3043681_gDNA_ID_1971898_Annot_ID_176916 3000 nt of promoter + ATG
atcaaaatgttatatgttgctacatcaggcttgcagtcattagctattatccatcctatactctcagcaggatcaaccttataaccgtgcctatacttagcatcaatgatattattaaggaaccaaacactaacccttaaacccctttctttcacttcactcaaaagtcgatcactcgccacaaaatccccttccttgcagaacccgttaatcattgtaccaaaagtttccaaagtaggcataaatcccttcaacttcaactccttgaaaactaaatacgcattttcgatatcgcccagcttgcagtatccaccaatgattgtgttgtagaacacaatattcggaatacaacctttaccccatcgaccttcaatcagctttctacctacttctacctttccttcattacacatacccttgaccaatatacaagtactgtaattatcaacactatcacctctatcacacatttcgtcatacaccttccgtgcatctccaagtctcctacttttcaccaataaactcaacaacgagttacaagcaataacatcaggcacagaatcatataactcaacaacataatcataaatctccactgctttacttaaacttccagattcagcataagcgtgaagaacatgactcaatgcttcatgtgtaagcttcacattttcgtttctgagattacccaacacatcttcaatctcattgaagatcctatacctcgctaagagcttcagaaacgaagaacaagcgaacccattagaaaagaactcatctttcttctcactcgatagccaatcaaaaagcttaacgccgatttcaacatcctggattcgatcgaatacgaaaggtgaaatgtcgacaaagcggacttcttcatcagcgaagcaatcgtcgagaatttgagaccagttttgttgggttttgaggatggatacagtgtcgctgactagtttcttgatacggggagtaatcggaagatgagatcggaaggaattagatgcatgaggattggagagaggtttgatgcgagagagaagggttttagacattacagacgacggtgagtggtttcgtcgtcaacggcgtttgattcagaagtagagaggaatcagttaggggtggggaagaagagagagaaccggaataaaccaaaccaaaccaaaccgaaatcgaaccaactctgtttatgaaacactctcattacgttttcttttgaattataccgaatcgacttttaaagaaaagctaactaaatagcaccaaatggagttataaattgttttgttctataagttgataagaccgatggttggttattagttatcatcaattgattacgctgaatatctgaattttgtctgtgtatcatcaatcaattgattgcttggtcaggatctatcgtcgtagagccggtgagtcggagagtcgagttttctgggaggtttgtggcgggtttggtgagtcgacggtgaggtgcatcgtcggaaattggtttcttccgatggtggttttcaatccttcttctatgcctcaaagtcgtggaccttgaaaccaccggatctagtgcgaatggttctctgccactgggaatcaacaagttccgagcttccgttctattttctggtgacattttccgatctcttttttgtatctgtttccaagtttgtatggcccaaggcccagtccattgagatttaaaaaaaaaaaaaaaaaaaaaaactttttggatctattgaagatacatggcccggttaacattggttatcctgatctttgtttgatgttctaattaatcatgtatataagtaactacatatgtataagcttagagaaccaactctgtttatgaaccactctcaatttatggattcttcgcccattccacacacttgccttgcctaattctttttttaattaaatattaccatatttgaattccaatacataaactattatattaaaatatttttactaacgtaataggtcaattttttattttattttttgtgcaccacgtaataggtcaattaaactgtgaatcaccatgaccgtcaaataatcatatctattttactttgattacgtaaaatatctgaattttatttcttcacatcgtgtgtaaattctttttggatcagcaagattgttttgtcttttgtccatatgtgccacgtggaccaacgcgtctgtcaccgttagtcactgaatcttttgagccttacaaatcaaattatatgttgttatatagtccaataatttttttcataatttgaaaacttctcttaaaggatttgttttcactagtatctacaagtattgaaatttaagtgaacaaaacttcagtattttgttttaaaatcctggctccaatcatattaagcttaggttggtttgttgtaattagctaaagaaaagtaatgacaatatcgagttaataaacaaaataaaaatagggtggcataattctagtgaaaaaattgcagtataacgtttttttccacttgatgcattgaatcacaatcggagccgaagtgtttgtgaaattatctaaacgaggtaatgtcacactattatgatgggagtcccgtcaaatgacctcattatctattgggccatatgaaaaggttttcttatttcatacgatacagtatcgatcgtttccttatatacaagagaagacattagtcttacgacttaacctaattccaacatatggactaagttaatcgaggcccatatggcccaatattatcttcagtgggcccaccctgcttttagaagaaagaaacgaaaatgctcgtcgtttcaccctctatcaatcacgccggaaagcagttcgccggtgagtagagtaccggagttaaaaagttactatctttgtagataaacactaatttgttttcaaaattcgaaaatgttttgaagttccgaaataaaaacaaaaaaattccagtcgtaagaaaagttgtgactggttagtagtactcttgggca

SEQ ID NO: 8831 - DNA, 3000 bp, Unknown; identical to SEQ ID NO: 8826
  misc_feature (1)..( 3000): cDNA_ID_1989237_gDNA_ID_1971898_Annot_ID_58511 3000 nt of promoter + ATG

SEQ ID NO: 8832 - DNA, 3000 bp, Unknown; identical to SEQ ID NO: 8825
  misc_feature (1)..( 3000): cDNA_ID_1989236_gDNA_ID_1971898_Annot_ID_58512 3000 nt of promoter + ATG

SEQ ID NO: 8833 - DNA, 3000 bp, Unknown
  misc_feature (1)..( 3000): cDNA_ID_1989235_gDNA_ID_1971898_Annot_ID_58513 3000 nt of promoter + ATG
gtgacggccgagtttaggactttagggttttgttcttaaaagaaagaaaaagtaagttactcttagggaaaattaaagaatcccaaaaccacaagtaatctcaggagtctctttgttaaaaaccgaaataattaacgattacatatataacaagaacagagtaaaagaacttccaagagaactccctcggtctaacaccatagaaaactcctcctaatccctttggaagaaggaaataatttcttaaatactctacataaatttgaaacaattagagaaatattcccaaaaccacaagtaatctcaacagtttccgaccaaaaaaaaagacatcgtgccgttttacaattcttaacaacttctcgtttgtatcagaaaatacaagactagccatgtgttggtaacttggtatagataaagatactttaaagatataaagattgacgcatccccaacatcaacaatttttccacttgatagttgatagtttaaatatggcccaaattgaacatcagcaaagtaattaatgaaatctcagtcctcggaaaaatcaagtttaggtgtcaatctttttaccatttaatagaacactatagacataaaaatcaaataagacattaggtgtttggtagtagatattgaaatatctttttagttcttaattgggtcgttatttcaaatatatactacacagacagactatccaagtctcaccattttcatcaatatttacgaggaaatactcaaattaacaccattaagagagacactatatattttacataaagacctggcgctataatgaatcatcatcattgcatttatgacttaatcatattcaacgtatacaatatatatatttgatttactccatagtaactttttcctgatcagataactataacctagctgtttaacaaagaaaaaataaaaaataaaggaacgatttgtattaaaaggtttaaaataatacaaataagtcttacaaccacattgtattctcgacaaaatcatgaatggcaaatacgcgaataatatctctaggttgttttcttgtctttagcctagtactttcgatttcaactcttctatagcttttttgcttcacgttataataatgaacacacaatggcatattataaaaaggataacacatactaaatatctcaccagcaggagtgatacctgagaaagttctgaaatcacctccagggtattcaagcaagccaaaagtaatgttggaccattcttgcttctcagcattctccataatccacatacttatattgttttcgttgctacttatgcatcctaacttcccttggtggttaaaaagacctcgctcagtacacttgggactccacaatgtttcaggagtgcggacatgataaaatctttccgactttacgtcgaaactcatcatgaaaagttcaccataattctcattatcttttcttctaactgctacgtagtaaatagttccgtcaatgcatacccccgcccggctgactgaaatgagttcgtaatcaatattgcctcggatttttctccattgaggacaatctctacccaatgtgaaaacatgaaaagtttgcgtcaactcttgcgagtcattaaccatggccaacactttgtattcattcatgacatggtcgtatccaaagtaacagtgtttgtgtctctttggtgagagtaccattgattcgatcttgggtaaaggaagacattgcctcgtggtagggttgtatatggtaaccaaatcatatactgatgaagaacaacatataaagcctcgaacgtattgatacctgaacgcattatagtggtttcgtccaggcattattgatactttgggttttgtgctttgagagaatgtagacgacacggtgaagaaagttccaggatcacattggtggaagatgaagaccggaagcttatgaggcggctgtctcaaagaccgagccatgatcgactcaacgaagtctctacgtttgcttataatgaatgaccatggctttgagacacatcggaacctcatcaaagattttgtcgggagttttttgagtatctccacaattaggtcaaggggtagatgaacatcttttaattttgataaaagtagttgaaactcttccaatcttttttcttcctcttttaatgatctctgcttgttcaaatatctgataactttaggaacggagaaaaagaaaagaaagacagagaaggcttgcgttcttttattgacactaaacatgtagccggtgcgtggtctacgaaaacttaaactgacactcaaaagaataatcagaaaactgatctgtgaaatattggacaaagataaaagcgtgaagaatgagagtggaggagatgggaagatatcgtaacggcgaagaaaaggattgaatatattgtgttcgataaatagggttttggttaccaaagaagaaaacaattagggtttaatgtgctattattgctaaaccaattctcctaccaaacaaaaagacattgtgccgttttacactaaagacttcgaagtccgaaccacgtcttgttttgtattagaaaaatacaaatacaaatacaaaccatgctgatatatatgaatatatgataaattatttcataaataaattatcaacatggttagcgaaaattatatattcagaaatttacagaaataaaaattcacagtttaaagagatatttttttttttgaaatattttgttacttattatatttgatattttttttttttgaaattatgtttacgtttcttcattcaatgatattttcgtttaaattttttttggatacaattattttacaaaaattgtgtctattaattttcaaaagaagatttatgcttggattaaaataaaataaaatttagagagagtacaactaaagcggaacaactaaacgaagcaataaaaggcgcgaatcgaaggggaaccggagagaccaaaaccctaatttcgccgacgagaaaaaccatg

SEQ ID NO: 8834 - DNA, 3000 bp, Unknown; identical to SEQ ID NO: 8833
  misc_feature (1)..( 3000): cDNA_ID_1989234_gDNA_ID_1971898_Annot_ID_58514 3000 nt of promoter + ATG

SEQ ID NO: 8835 - DNA, 3000 bp, Unknown
  misc_feature (1)..( 3000): cDNA_ID_1989232_gDNA_ID_1971898_Annot_ID_58516 3000 nt of promoter + ATG
ctctctctaaattttattttattttaatccaagcataaatcttcttttgaaaattaatagacacaatttttgtaaaataattgtatccaaaaaaaatttaaacgaaaatatcattgaatgaagaaacgtaaacataatttcaaaaaaaaaaaatatcaaatataataagtaacaaaatatttcaaaaaaaaaaatatctctttaaactgtgaatttttatttctgtaaatttctgaatatataattttcgctaaccatgttgataatttatttatgaaataatttatcatatattcatatatatcagcatggtttgtatttgtatttgtatttttctaatacaaaacaagacgtggttcggacttcgaagtctttagtgtaaaacggcacaatgtctttttgtttggtaggagaattggtttagcaataatagcacattaaaccctaattgttttcttctttggtaaccaaaaccctatttatcgaacacaatatattcaatccttttcttcgccgttacgatatcttcccatctcctccactctcattcttcacgcttttatctttgtccaatatttcacagatcagttttctgattattcttttgagtgtcagtttaagttttcgtagaccacgcaccggctacatgtttagtgtcaataaaagaacgcaagccttctctgtctttcttttctttttctccgttcctaaagttatcagatatttgaacaagcagagatcattaaaagaggaagaaaaaagattggaagagtttcaactacttttatcaaaattaaaagatgttcatctaccccttgacctaattgtggagatactcaaaaaactcccgacaaaatctttgatgaggttccgatgtgtctcaaagccatggtcattcattataagcaaacgtagagacttcgttgagtcgatcatggctcggtctttgagacagccgcctcataagcttccggtcttcatcttccaccaatgtgatcctggaactttcttcaccgtgtcgtctacattctctcaaagcacaaaacccaaagtatcaataatgcctggacgaaaccactataatgcgttcaggtatcaatacgttcgaggctttatatgttgttcttcatcagtatatgatttggttaccatatacaaccctaccacgaggcaatgtcttcctttacccaagatcgaatcaatggtactctcaccaaagagacacaaacactgttactttggatacgaccatgtcatgaatgaatacaaagtgttggccatggttaatgactcgcaagagttgacgcaaacttttcatgttttcacattgggtagagattgtcctcaatggagaaaaatccgaggcaatattgattacgaactcatttcagtcagccgggcgggggtatgcattgacggaactatttactacgtagcagttagaagaaaagataatgagaattatggtgaacttttcatgatgagtttcgacgtaaagtcggaaagattttatcatgtccgcactcctgaaacattgtggagtcccaagtgtactgagcgaggtctttttaaccaccaagggaagttaggatgcataagtagcaacgaaaacaatataagtatgtggattatggagaatgctgagaagcaagaatggtccaacattacttttggcttgcttgaataccctggaggtgatttcagaactttctcaggtatcactcctgctggtgagatatttagtatgtgttatcctttttataatatgccattgtgtgttcattattataacgtgaagcaaaaaagctatagaagagttgaaatcgaaagtactaggctaaagacaagaaaacaacctagagatattattcgcgtatttgccattcatgattttgtcgagaatacaatgtggttgtaagacttatttgtattattttaaaccttttaatacaaatcgttcctttattttttattttttctttgttaaacagctaggttatagttatctgatcaggaaaaagttactatggagtaaatcaaatatatatattgtatacgttgaatatgattaagtcataaatgcaatgatgatgattcattatagcgccaggtctttatgtaaaatatatagtgtctctcttaatggtgttaatttgagtatttcctcgtaaatattgatgaaaatggtgagacttggatagtctgtctgtgtagtatatatttgaaataacgacccaattaagaactaaaaagatatttcaatatctactaccaaacacctaatgtcttatttgatttttatgtctatagtgttctattaaatggtaaaaagattgacacctaaacttgatttttccgaggactgagatttcattaattactttgctgatgttcaatttgggccatatttaaactatcaactatcaagtggaaaaattgttgatgttggggatgcgtcaatctttatatctttaaagtatctttatctataccaagttaccaacacatggctagtcttgtattttctgatacaaacgagaagttgttaagaattgtaaaacggcacgatgtctttttttttggtcggaaactgttgagattacttgtggttttgggaatatttctctaattgtttcaaatttatgtagagtatttaagaaattatttccttcttccaaagggattaggaggagttttctatggtgttagaccgagggagttctcttggaagttcttttactctgttcttgttatatatgtaatcgttaattatttcggtttttaacaaagagactcctgagattacttgtggttttgggattctttaattttccctaagagtaacttactttttctttcttttaagaacaaaaccctaaagtcctaaactcggccgtcacgatatctacatctttcacaattcttgtgagtttccagttatgtttcctagattaccgtcacgttttatttgtttacaaaagaaggagaaaaacagaggtc

SEQ ID NO: 8836 - DNA, 3000 bp, Unknown
  misc_feature (1)..( 3000): cDNA_ID_1989231_gDNA_ID_1971898_Annot_ID_58517 3000 nt of promoter + ATG
cggatgaaccagaaaatggtaatgcagaatgacctaatatcgacctatgcataattattagagaatataacaaaaattaaaaaagtgctcttttatatatatttataagtgctcactaaaacttttttatatatatagtcataaaaggagtgggaggttttggcatgggtgcagcagtagctctccactttgcaacaagttgtgctcttaaccattatactataaatccccgagttgttgttggaatcagcgggtggctttctaaggcgaagtatactcaaataatttctttaaactaagtaaggttacgtttcacatcccattgaatgatgaaagactaattactcaacattgcaggagcctaaaacgaagtatagaatttgcttcatatgaggctccacctcgtgctgcatcgcagtcaatcttacttacacatggacaaagtaattcatgtatctattttcctctttagacagagggaatgctaattaaatctttatatatgataatatgtttcgcaggagatcatgttcctcacctatgtggctgtggagaagaagctgcttttatacttagagaggctggatttagagacgtcaggttcttaccatttgcaaggtatagaaacatcaaatattttactttttagccctgctagctctatatagcatttttggtttgacatttttttgtctaataagtttattgggttatgaatatgtgacataggtttggaccgatcgctcatgagatcaatcgcaacgtaatggtcaaaagctggttagaagagaagctcccgctcgatgttgtgcttgcaaaagaatgtctaccataaagactttcatctatctagctagtgactagtagtttactatcgtcgtttgtttaatttgtcctgaataaattagcgtgactcatgttatgacttatgactaagttattggttttttcagactttacggtagtttgttttttccccgttggtgctatcaagttgtcgcaaccttttttaacaattaaataattattaattaactatgttgcaatcttcttataagtatacatgagtaatatatatttgaattaagccaagatataacgtaaattgataaacctatacgtatttggtaatgaaagtatgtgattagatgatagatatacatccatacaatttagtttttgaaagtgtcaatttcctttctctatacaaactacttcaatcattcaccatatgttaattaatataaactcgaactagccattatcatttatcaagttgcattagaaacagataagacattaggtatatggttgcagattaattttttctgtttctttcaattaattttattgttttccttcctaattcttcagttttttcggttggcgattattaactggtaacctttttcgaaatagcaacaagaagaaagagatggtaataattgaagtattatttttttcaaacgtaatgagtaatttagtaacccaaagatgttgttaattagaacaccaaattgataatgtgaccaacgaacatcttgaccttctgatatatcactctccaccttctagccttgtgcatgttgttgcttgggtagcttctagaaacaccatattcaacatcatatttgcaagttattcctccaagcttctgtctataagatttggaaggaaaataactctatatgacgttcttttgttttattctaacaaacccgaattttattatatatattttttagaaaccaccaaaattgataatcaggttttaagatagcttcgacatctcacgtctagagatttgaaggtatagtttgtgtgacttaaaaaaaaaattgaaatattaaagtttacgtgctccacaatgagaatgtaatattaaagtttacgtgttgggattgaaaattctttttgtttggaacgcactcgtgactcacttagtcatctggaattacttatttcctataaatatttgaagttgttgtactcatagtcaagattattttcctgtgtggtttccttaatttaactctatactagttatgggattcatagttgttacttgttagtaatttgcatttatgtgtacgtattctttaagtttggaccacacttatgccccaattagaaatttgaagcgactaagattttctaaatacctaattttattttattttattttacagctcctaaataccttaattagttatacttttgctttaagtttggaccactaatgactgaattcgtcatttgaaacgactcatcccatatcaaatatcttgccaaaatgtgtaccaactaaagtaaaactatttagtaaaaaaattcatagatgcatgccctgtagagtgtagtatttataaaatgaattatggtattggtttttaagatttaacattagtctacgtgtaaaattctaaaacctctactaattatgagatttatagatatcgtaaattttccaaatatgtatatagctgtataccaattaatcaaagtaagactaagacaaataatatgaaatacataattggttccagctaaagtacacagaagatatcaatgtcataggttcaatttcgatgatacttattacttatgatttcgatgatatcataagttcaatttccttttatatcttttcatagaactagaaagaagaaaaaattagtccctaggtgtggttccaaaaattgataatgaaacatctgattatgtttccttcattaattagtgaccaaccaatatatttgacattttgatttagtgagatagaaaaaaagaaatggaatattctctctcccatcaggtttgtgctttttgggtgtataaatacacatcgttcctcacatatttccaccatcactggcttccgaaactcctctcaaaaatatagaaaagaaaatcctttaacaaaaaacagatatagaaaaatctgctaagtaaaaaaataaaaataaaagaactagtcaagttttttctcatcaaaacatg

SEQ ID NO: 8837 - DNA, 3000 bp, Unknown; identical to SEQ ID NO: 8824
  misc_feature (1)..( 3000): cDNA_ID_1989229_gDNA_ID_1971898_Annot_ID_58519 3000 nt of promoter + ATG

SEQ ID NO: 8838 - DNA, 3000 bp, Unknown; identical to SEQ ID NO: 8823
  misc_feature (1)..( 3000): cDNA_ID_1989227_gDNA_ID_1971898_Annot_ID_58521 3000 nt of promoter + ATG

SEQ ID NO: 8839 - DNA, 3000 bp, Unknown; identical to SEQ ID NO: 8817
  misc_feature (1)..( 3000): cDNA_ID_1989254_gDNA_ID_1971898_Annot_ID_176899 3000 nt of promoter + ATG

SEQ ID NO: 8840 - DNA, 595 bp, Unknown; identical to SEQ ID NO: 8822
  misc_feature (1)..( 595): cDNA_ID_1989226_gDNA_ID_1971898_Annot_ID_58522 3000 nt of promoter + ATG

SEQ ID NO: 8841 - DNA, 3000 bp, Unknown
  misc_feature (1)..( 3000): cDNA_ID_1989262_gDNA_ID_1971905_Annot_ID_58524 3000 nt of promoter + ATG
tatgtattaaaaataattcgttccattcatggggtggttttcttattaatgtttggttgaaggagaaaagcaagcagtaattaaaatatatagaaattaatattgctgtaatttgttgatttactagatgtatgttattccaaacactaatttttgaaagataatattttaataattgttattagtcatattgaacgtttacaaaagatgtagaagaaaccaacgtgtagcttgggttcaaaacctagttctattaatactaaagtttgctaatcatgtttaaagtaaaattagatgaattttattaatccaatctctatgaatttaatatctttttatataatttcgtatgttccattgtttattatttcatattatcactcttctaattgaaatatgttattcttatcatcatttgaaaattgtttttattctctggactttcccatatataaccgctccattgttttacctttttagaaccctaatttgttctttccaggtcatttactatgtggtttttagatgtggacaataatatataagttatgaaattatctgaatctatactttttggatatgtgaaactcggataaacatcaaaatatccgtatcagaatccgtaaaatgttagtagaaaatatttgaaggtataaagagttgggcaacatgtgttagcggcaatgattttgaatgtgatgagaagtaatatctaggaacaagtggttagatacacaattatgtgaatagatgatataatagatacaacaaaaatgattgatgagaaggagatagaaaaagggaactttgttccattgaccaatgtgtttgcgatcactttttcaaattttgaagtaattgactacattgtacaatttatgtgtaatcatgcctatagtttctacatcgattcatcatacaatcatgagttttcatatatctagatcctaattactatcaaatataggtttgtgagaggttgtatgtgacttggaataaaacacaacatcctccatcatatctcttttgaggatttaagataattttgaagatttctttagttgaaaacacataaatctaaataacatgatttaaatggaatttgggaagattttcaaacaaatcataataactactctaaattcacttaagatcaacaaaatcataaaaactcaaatcatttaaaacaaagggttggatacactttgaaacttgcaacttatattttgattggtttttttttttatagtcgattgttcttaacaaaaaccctctatacttgatacatatattaataaaataaaaaaactatagactaacttttttgctgtgaaagtgtgttaattatatcttcaacatgagagaatgcatcattggtggtgtgagataaaaccattgtgtctttctaacccacatctaacaaatattttatctaattgggcattaaaataataataagtgaaggctcaataacacctaaaaatgcagcgaatattctagcttccatgcgtcataagcaagcaaaaaaaatggagactatatataagttcttctgtataattagagttacaaatttgtggagactatatataacttcttttgcctcccatgcgtcataagcaagcaaaaaaaaaaaatggagcaaactttcatcacgtggaaaacttgtctttcttttttttaatacatatttgaaggtttaaaagagttagacaggatgtgttagcgacaatgttttcgaatgtaatgaaaaataatctttaagaacaagtggttatgtacaaatttatgcgaatagatgataaagtagatacaacaaaaatgattgagtagcaagagatggagaaagagaactttgctatattaaaaaatgtgtttgagatcattttatcaatttttgaagtaattggctacatcgaataatttatgtacttatatatagtttctatatcaattcatatacttgatacatatattataaaaaataaaatccttaaaactacaatttttgtttagaaaatgtgttgtgtatatcttcaacatgagagaatgcatcagagtggtgtgatcaaactcttctaacccaaatctaacaaatattttagggttttgtgccaacaaccctcaaaaatattgttcttgcaacataacctttcatataaaatacatgtaggtcaatactctgatatcaaaagtcacccgcaatataaccacgtgcataaattttatataatccttgggcgtgtatagattttgcaaaccgtataagtatgtatataagttattaaactacgtcgtttgagcatttttcggaaaataatatattactagagtggattggaaccaataaggccccgatccagatttgaaaccagaaattggaattttcaaacttagggtttgattttggggatttataagtggggatcttttgtttatgtcacaacgtcgtcgtatctggtcaataacagagactctttcacaaccgacgtcgtatctggtcaataacggagaccctttatctctgtattttgagataactcagtcgtgaagcagtcataactaagctgtgtgactattataactcggtcaaaccctgaaagtgctttccttaagccatcagttggtacaatcaagtaattaacatatcataatcacattccaactagtggaatcatgaaactatctcatattctatatactttatccaacatcatacccaacaacatcattcctagaagtttggtcaacatagtttgtcaatcgacacttaccgaaaacccaatttattttttgttttcatattatagatcttgaaactaatagaaccaacaatttggtggctagtttgaaatctcataataacatctggtttcttataactcggtcaaaccacaaaatcttctggcataactcagtcgtaacgtattggtattgtgaggcccaagcccaagagggtcccaaccaacccaagtaacacacaaaaccctaagcgtgtgt

SEQ ID NO: 8842 - DNA, 3000 bp, Unknown
  misc_feature (1)..( 3000): cDNA_ID_1031665_gDNA_ID_1971905_Annot_ID_58531 3000 nt of promoter + ATG
tggtatgttaatacttggattaccggctaatatcataagtttatggtgatttgagatagtttcacttttgttatgaattagagttagcacctaatacaaatgttacattaacttttatcttttggactgtgttttaataagggaaagaagggatacaactttccatttagaaagagaaatgacgatgacgactggtttccctaaaaatcaataaataaatagcaaaaaagaaaaaagactacatgcaaagaataataataatctgacacaatatattcatacagtataaaaagattttcctaggggtacatacgcaatttccacatgtacaatattagtcaaacagtgatttttttggacacttaaataacaactcttccaagtatagattgtgcaattttcctaaacaaaaagcagtctaaaccgttgatagatttgtccgtcctaaccgcgtaaccatttgaactcttagctttttttaatgttaagttgttgccaataaaccgaccgtaaatgaatcgagatacttgatttgaaaagtcgatccaaaatcaaatcaaacaaagaaaaatggtttaaaaccgaaatttctttaaaaattaaggatattgtagataaacattcaataccgaaccaaaataaaaccatactaaaccatccataatttggataccagtactaagaaaccaaatttttaaaaaccgaataattcaaataaaaaccgaaccgaaatcacatggttttgtaagagatcatttgaaaaaaataaaaaatattcgctcaacaattttgtttctctataatcaatcaccaatcagcaaaattctagggtttcaattatcttctctgcgatttgaatgaacaaatccaacttcattcacaaatttcatcactctgcaaaaccacatacaatggaagataacgaagaagaagaagaatcaccgacggagttaaacacgatcaccggtttaagcggttttgtagttatctctcccgataagctatctctcaaatacactggcgtttctcaacacggtcacgatgtcggcgttgttcaagctaataaacctgctccgtgtaaacgtttcgcttattacttcgagatttatgttaaagatgctggtgttaaaggacgtgtctccattggtttcactactaatagtttcagaatcgcgagacatcctgggtatgatattgagttttgtttagatttgattaggttcttaaagatctcttatttttgtttagttgttttaagtttgattaggttcaggatttggttcaattgtgtgagttttatttatgtttggttaggatcagaacatacgaaagtgttggattttgtttctatatcattgttgctgagcattcaaattgatagttttgtgatatttcttatgtaatggttagatgggaactcaacacttgtggttatcatggtgaagatgggcttatatatctaggaaaacgtcaaggtgaagcttttggtccgacttatacaactggtgatactgttggtggtggtataaactatgattcgcaggaattctttttcacgtgagtatctaagagttcaagagtcaattcattttcatgttacagttctgacatatctttgttatgagatgccagtgtaaatggaactctggtagggacagtctccaagtacatcaagggtcctctattccctactgtagctgtacatagccaaaacgaagagtatgctctctttgtttcttaatatgatgtcagcgtgaactatttttcaagtgcttgaatatgttctttgtttgatgttctgaatcttggtagggttacagtcaacttcgggcaggagaagtttgcctttgattttaaggtaagatccttgaatatttttggtatactagtggagtttctagctcttagcttgtgtaatttatcgatgggatagtccgaagtataactatcgtatagtaaagaaacatatgcatctttttgatatggtacaaacatataatgtggcagatgattcactgtaaaaaaatacagtgattaaacatcttctcttagactctacgattaagaattgtatgtgtaatatgtgtagaaagttgaggtagagagtaatatgtgtttacttgtgcttctctttctgccttaggtttgtttgaggttaaggttacaggagtgattacgtatgatttagctgttcctctttttttctgttgtgttagggatatgaatcatcggagaggaataagcaacaaatagcaatcgaaaagatatccataccatcgaacatgagtcttgggtgagtacactcttgttctgtagttactgaggtgaagttttttcttctattcttttattgcattggtaataaaatttctgcgtagctaagaagcttctggttttttttgatcatcaggcttgtaaagaactatttgcttcattatgggtatgaagagactcatcatgctttagacttggctactaacagtacacttcctcctatcaatggagctcaagaaaatggtattgatgatacatcatatgcattgcatgagagaaaaattcttagacaggtattgaattagactgctatcttgctcgttactactactacatctctttcgttaagtattgaactgatccatacgtcggttggtaaagcttatacggaagggtgagatcgatgctgctcttgcgaaactccgagatagctatccccaacttgtacaggtggattgaggaactaatcatatcagttgattcatattgttacattgaaaatatgaactcttacctcaattgtataatctgcagaacgataaatcagaagtatgcttcctccttcactgtcaaaagttcattgaattagtacgggtatgctcttcattccttatatattaatcagatccactgcggttagactgacctctctctaagtaaataaatactaaaatgtgacatacttagattggagcactagaagaggctgtgaaatatggacgaatg

SEQ ID NO: 8843 - DNA, 3000 bp, Unknown
  misc_feature (1)..( 3000): cDNA_ID_1989256_gDNA_ID_1971905_Annot_ID_176972 3000 nt of promoter + ATG
attttttttgaaaaaataattttggcgggaaattttttttccgaaaacttttggcggaaaatgtttttgacgggaaaattttggcggaaaatttgttttggaatattttaggcgaaaaaatattaagattccattttgttaacctaaaataatttccaaataagggtaaaatggtcattaaaaatttaaagagggtagaaatgaaaatggataaaataaaaggatagagttgaaaaagggcatcatgaaaaaaaaaagaatctttcttcaattaaacatataattacaaaataattttaaaaggaaatcttgcaaaatctgccatattccactctatttctttcaatccctgccatattctgtaactccttccaactcatgccacattttgctgcacgtggaattcagtggacgaaattatccttaaggtgggtcagcgctctgacgaagatggtgacataacagcttttggctgatgtaatgatacaagacgaaaaatcatgctggaagaataaagaattaggggacaaaatagtggagaacaactggcttctactgttgttattgggtatttaaaaatgacttatttaaacaaattggttatccaaaattctgcgggggacaacgtaatatataatacattaggagacatgattacctgatagcgggggacaacgtaatatataatgcgttaggagacatgattacctattagcggagaacaattggagcaagacttttgttttagtcttcagatcttgtcctcgaatagaaattctcttttgcatctacgttttgtcctcgatttcaccatcttgctctattattatgaatcctacatcttatatgcaattgttctcatttaataattttgaattttatttaaatttttgcgatctattttgatccacagattagttgagcgttattgtcttcacctacacgttaacatattttaataatatgttatatcgggacaagttcatatcgaatgagtaatagaattggatcggggacaaagtcagatcgaatgatagacaagataatatgtaataactgaatatttttgttgttttacaatagaagaaaaaaaaatcgtgtcggtgaaaacaataatgctcaactaatctgtggaccaaaatagatggtaaaaaatgatgaaatcaaggacaagatctagatacaacagaaatattgtgatgaataaaattgagagacaaatttaattgaaagttacatgtaaagaatctgtgcaggttgtcaaagaaagtgagagagtgacaaaagcgcttcatcttcgggaagataataatatatggttaaagcgcacagatttcaaggaaggagagataaaatagagaagaaatggagagggacaaaatcgatatttcagtatgaaatatgacatgagttgtaaggcccagcaaattatggcagattgcataaggattggaaaaaatatggcatatgttgtaattttttcctttttaaaaataatctaaataattctataatcaatatgtgaacgatattatactttacagatctttttgtaacttcaccttaattatgatagaccttgcaaacaaataaatgcaacaaaaaatagacactaaaaaatctcaacaacaatctttaaattataaaaaatcacataaatatcttcgggattcaaattttaataattatttaaacggattttctaatttatatcaaaaccaaatatattgaatataaaatatacaaataggaaatacattaatttaaaagatacaaaatatttaacaagaaattgtgttattttttgttcaaagaattcgatataaaatcttcgaaacgatccgatattgattcttattagattgaaattgttaaaatttcaatatattatacaatttttctttttaaattgaaattgtaaaccgactcgaagtatattaaataaaaatattattaaaaagaaaaagaacaatttgatttttagttatcacgggacggatttatatggcgggacgggtttacaggagacgagtttacatggtaggacgggtttggatgagacgagattatatggtgctatgagtttagatgggaaaaatttggataccacgggtgtactcctagaattaacaatcaaattacaactatacaatagtaaacaaaacaaacaataataacataacaaatacaattttaatttcaaatttttagttacaaaaaaataaataaaatcaacattttagtataagtgttaatcttctttgacacctctaaatgttattcttctttgatacatttaaatgtgtaattttaatataaagttactaaactacatatgttccatggattaaatttgaaaacaccaaaagtttatattaaataatttttttataacaaattatgaataaaataaaatattatcccgtggtatggtctatcacaagtcaaatcctaaaagataaaataacatatattagacttattaatatcataattgtgactcaataaaaaacatacacaaccttatcgataattattaatcatcacaaacaacaacaaacaacaaattatattttgtgataaagaaaaataaataaataaatttaatttacggtatatcgcgggtcatatcctaattatgatacaattgtctatttttaccctatatatattacaaacgcacacatttgttgcataacatatttagacatcgcttccaaagaaagaaatcatttatctctacattatttcttcctctcattgcccctctcttctcaacgttttgtctcttatatctttacgtttcatactttttttttgttgacatttaattatttaaattttttgttcctatggacactagataggacaacaaaagatataaagaaaatctacaccacacatatcatgaggttctggaacaagtttctgcggtaagagaaaccaaaaacatgaagggcagaaaaaaaaagaacaaaccatcttcaacacagagccatg

SEQ ID NO: 8844 - DNA, 3000 bp, Unknown
  misc_feature (1)..( 3000): cDNA_ID_2138868_gDNA_ID_1971905_Annot_ID_176952 3000 nt of promoter + ATG
tataaagtactatgcatacttaaagaacgaaacaagattggaattcttacattgggagctcaagaatcatggagaatattatctaaaggtttccttagtcattacaaagtgacaggttatgcaaaatgcattgatggagtcatctactatgaaggttcttttggtgatggtttaagacaagagcttgccataatgagttttgatttaagatctgaaaagttcagtttgattaaacatccgaagaaaagtagcatagctacatgttggtcatcttatgagggaagattagctttggtaagttccattgcttctggagttagcttatggattttggaggatgctgataatcacaaacaatggatatataaacattttccttcacatcgagaattcatcaaagagagatggaagttgaagggtgttactcgtactggtgaatttatttacacatcttacagagcttatgtacttaatgttgaaggaagggttttatatcaatggttccgtattttgtatgttgatcccaagagaaacagtatgagggtagttatgcatggaggaattgcagttgacgatattaggcgacttgatgaagttggatatgatcttatgaaagacttgactgtcataccaaatcacattcagatttgaagctgatcttaccatgtcgttgtaagagttttcttcatttttcttttcttaagttctgcaaattttgtgatgatttttgaatcattgaatcccattgaggggtttttgtcttgatttaagaaattccttataaaatcgtggtagtgaagtaacacctgactctaacgcaagaacatcactgaaatgtgtagcttagtcttctatattggttacatatatagtcatctaatgttcttgaataaaaatacctcatgagcagaactccaggtcatatttttcttaatcaagagaaatacattttgttatgatttgataagttccttaatcccaacatgtttttattgtgtttggaagacagtttgattacctaagtttgtaggaggtctaggcctgaaatatcactttcatgtaataaactagaacaaactattttatcaagatggaactaatatgcactttaatattaatacataatacttttaaaaatggtgaaaaataatgagcttatctaccaaaaaacagaaccagttgtttatgatggccaaaagtgtcataattacagtccctagttgctctcatgtgtctttcagatttccagctcttgaaactttgtcaatgtaccaagtgagatgatgatgatgttatgttttgtgaattgtcaacaggtcctgaattggagcgcttgttgaaggagctgatttggactcagaatcaactggatgaaaaaacagtctatgtgtatccacgcatgaatgatttttccactggccagctcatataccgaccagaatgattcttcttccctttcagcaactaacggctctgcaaaagggaacatatatagtgatatataactgatctgtcgcaagaacatgatgaccatttcttcctagtgagtattttgagtgaggggggagtttttagccttgctcttatgatttagggattttcttattcatgacaatattggacccctaggtagtactaataacaagagagggtttttgttttcaaatgttggtttactggttaggcttttattctccaccatggtatggttcctataaagctacataagaattcattttgaagtttgtttggtgtgtgaccgaagaaccaaaaaaaaaaaaacagttgctcattctttgtctacttatctcactattcggcaatgcatatacgtcctaatctttgttttgcttatcttagttattctatctctctcccttacctaaaaagctggcttcaaaggacttgacggatcgtttataaaacagactagtcataaacatagatttatattcgagatggcttcaaatacgaatcttaaactgtttatagtatatatagtatctaatagctgcgggtgttgtgaaagggaacttagtgttgaccatggtcatggagtttaaccaagaagtttgttgaaccaaggattcacacaatagatttgtttagagagggaaaacaaatctagtaatttctcttcattaggtattctatccaagactcgattataagaggggttctaatctcttatgaaatacattagggttttgctcaagaacagaaaaagaattagagttttaaaaaggtatagctgcatccatgatggattgcctacgtaccctgtgaagggatcaagccattcgtagttttcaataggtataaagttctatgtttcttgtgaatatcccaagatctccccctttttgtgaagtccctaaggcactttatataggatccttaaaccgcctccctagcgatattcttcggaagattcttatttatccttaggtcggttctagaggataatcgtcctaaggatattctccttattcttcggaggttttggggagatttcctgatttcgacattatcttcaaagattctcctttatcatttctgaaagtcccataaaagatcccattttaccggaaatgatccttggagaatgaatggtttttacaagtctttgcctcgcgtgttcttcacggctcggtggtcgtttgagaggtggcttcggggcaaacggtatgtaccggctcggggcgcgcttgatgactgtccattaagctcagttggctgtctcccgagccgatatagatgtttcccgcagcgttctcacgattggttcgggctgtgttcatatgattaacacccgagccattttacaaactctcttcgggacggtcgatcgaataaggtcccgaggtgctttgttctaggctaggggccaatcatatgtttaaccatgaggtgattgttattcttagactgtttggctcggtcttgcttgtgggggaatccgaccccaacaaagttgtaccttgacggaagagagcacga

SEQ ID NO: 8845 - DNA, 3000 bp, Unknown; identical to SEQ ID NO: 8843
  misc_feature (1)..( 3000): cDNA_ID_1989256_gDNA_ID_1971905_Annot_ID_58533 3000 nt of promoter + ATG

SEQ ID NO: 8846 - DNA, 3000 bp, Unknown
  misc_feature (1)..( 3000): cDNA_ID_3043759_gDNA_ID_1971906_Annot_ID_176981 3000 nt of promoter + ATG
caattccttaatgtatgtgagtacaatgctccaaaacttcaagtatttgttttatgatataatttgaactaaattaaattacctctcattgaaatcttagagatactagatccatttattcttccattttcaaactaaagttaacaacttcaggcttgatggatagatattttcacattgtagattagctcagatgaatttatgaaaggattggtgggacagacttctggcttccttccccgggacttgcaagctcttgtagctgatgctggtgccaacttatacatcagtcaagagtccgagaccaagaaaattaactctctgtcagatgatcttcatggagttgatatacaccaggcaagccaaatagataacagcactgagaaattaacagctaaggaagactttaccaaagctttggatcgatcaaagaagagaaatgcatcagcccttggtgctcctaaggtaacattcacagttttcttgctgtggtgttttctcgtttgtttgtctatttatgagacaagtttgcatatttttttgttactggagatgcacataacttaaaggtttatttgtattcgtaggttccaaatgtgaaatgggatgatgttggtgggcttgaggatgtgaagacatcgatattggacacagttcaactacctctcctgcataaagatttattttcgtccggattgcgtaaacgttctggtgtacttctctatggccctccaggaacagggaaagtaagtaagccattttttctttcacttttagcatctcttaatagtctgttttttggcagttatatttttgagtttttgaattaaatttacagactttactggcaaaagctgtggcgacagagtgctccttaaatttcctcagtgtaaagggtccagaattaatcaacatgtatattggagagtcagagaaaaatgttcgagatatatttgaaaaggtaagttatatttcttcttccctaggagaagcatattgagtctttggttctgattcttaaactagtgtgttttcttcaattgcaggcaaggtcagcgcgaccttgtgtgatcttctttgatgagcttgattctcttgctccagctcgaggtgcttctggtgattctggaggagtcatggatcgagtggtatctcagatgcttgcagagatcgatggactcagcgactcttcccaggatctgtttattataggagcaagcaacagacctgacttgattgatccagctcttttacggcctggcagattcgacaaacttctatatgttggagtcaacgctgatgcgtcttacagggaaaggttaggcatttaaacaatcaaaagcatgtccaaagacaaaaaaaattagaagcttcctgattcttgtttttgacagggtacttaaagcactgactcggaaatttaagttaagcgaagatgtatctctttattcagtagcaaagaagtgtccctctacattcaccggcgctgatatgtacgccttgtgtgctgatgcttggtttcaggcagctaagcgaaaggtgagagggatagggttgaaatttaagactatataagtctctgtaaaagcttttattgaaatcgctttgtatctgcatacttggcaaatgcaggtgtcaaaatcggattcaggggatatgcctacagaagaagatgatcccgattcagtcgttgtagagtatgtggattttataaaggttaaaactcttttccttcatctactcatcaaaaagagttgccattttcatggttgagtagaaatgttaatttgttatggttcggttttatcagtcgagagttataatagtttcccactttgtcttctttgtaggcaatggatcagctctcgccatcactctccataactgagcttaagaagtatgagatgcttcgagatcaatttcaaggccgttcgagctaaacccctctcagtacataaaaattagcttataatgaagacatttcatatttttttcccagactattttctctgaacagttctgttgatttggttagtcaattgatagtaaaattaaagaatcaataatgtaaaataattttcttggtttgaattacctttgattggttacgcacaagtgattcttcgcttccatagttccatgtaataatataacacacaagtgaagcagattattcaatggtaaaaggttttcttaaaaaaatttccacaacggttcataaaagaattctgtttttggtttgggtaggaaataaaatcatcagtttgttatattaggtttgtgttttatattatctgtttgattatggtgttgttagtaatttcagaatattttctccaaacaattatttcaattggcattccaaaaatagcgtttttgttttccacacgtgactaaattccattaattacgtgaagcatagaatccatatggcgaaagttttttaaattacagtaaaaatttttatgattaaggagattttacttgcaaaaaaaagacaaatctttgaagactgaaatgacgaacttgaccactatgacatcacttgtcacgtgggatttgctttgtttgggcgagctggtccgaaatcaatttttttttttaggaaattatttttgttgagttaattttttttcctctttttcgtttgttcgagaaaacagagaatgaggaatcaaaaaacggaattttgaatttgcaacgtgaggaacctcctctgtcgtttcgatcttcaagtttttttttaaagctttctctcttcaaagctcttcacgtgagctctcccaaatctgggcgttattcgctttctggattctgaatcgcattatccaacgaattcagctgattgattttatcgggctgctttgttcaagtctctctatgtaaatgggtatttaagagttttgcttattctctcgatcgatctaagtttttttctgaggaaatttggaagattttagcttcttcgattgatatgatatatataggtttgggttttag

SEQ ID NO: 8847 - DNA, 3000 bp, Unknown
  misc_feature (1)..( 3000): cDNA_ID_2178997_gDNA_ID_1971906_Annot_ID_177010 3000 nt of promoter + ATG
gaattcttcatatggtgatttactgatttgtttgccaagtctcagttttttgataatgtaaaaaagtctttgactcttgtatctcttctatacaatgatagttgggacgaatggataaggctggactgtctgttgaaacattcagatgagaatattgagaaacagaaagaacagggtttgaaacagcaagggattaagagtgctatggcttggaaagtgtcaaagatgaaacctagaagccctaatggtcagtcagcttcttcttttgtttgttttgcatattcttgtctcgatggatatcttgctgcttttgtggatattcagagtctctatcagggactctcatttggtcttgcttgctttattctatgtcgactaagtagaagttgttgagattaaagtatacatacacatctttcgttgttagttgagatattgtgtcagttgagatattgtgtcagctgagattttgttcaatattttcttaatttttgcagttgctagaggaagaaagcggaagcaagattctgttgatacggtaatcgctcctttagtggatgtatttgcttaatctttcagcttccaaatatccagggatttttttaatcaggggagtcttactcatgtcttgttgtttgctgaatacaggagaagaatgtgcttccctctgacaaccttttaagtttcaatattccaccagcattaaggaagcaacttcttgacgattttgaatttgttactcagatgcagaaggtatttctatcagcctgttatttcttctctcaattctcaaacggtcttttctgtgtgttttgacgcagttgaccatagtcttttgattcatttagtcagagaaaaaatattcttgtagtcgcatgaatatatttgttgtgaatgtcatatttaggtgcatatgttaaggaatttattttaagtcatttttgggaattgtctgagcagcttgtgcaacttccgcgttctccaaatgtggatggcatcttgaagaagtacattgacagccaaatgaagaaacatggcaggtaagctctttgtggattatagtttctttctgctgtcagtttccaacagttacacttgttaatctcttttgttgctattctcatatacttaaagagagtataaatcatttgtatatgctccatggataatttggttgacagataaagcgtattccaagcttctgatatatctagtactttctttggtgaatctatatagggtaacagattcattagaggaaattctgaaaggcttgcgttgctactttgacaaagctttaccggtgatgttgctttacaacaatgaacggaagcagtacgaggaatccgtatcagggggtgtttctccttcaactgtgtacggagcagagcatttgttgcgactctttggtaaggccagtttttgtaatctgcaaatctgcctttatcatgtggtttagttgtcaagataagactatataaatattgagttttgcagtgaaattaccggagttgctagtacatgtgaatatggcagaagagacattgaaggaattgcaggacaactttgttgatattctcaggtttcttcttcttgttctcctacttaactctttttacaagtatttaaagacaaataacaaaaacaaaatgataaagcaggttcttgaggaagaatcagagtgtgctttttgtatcgacatacaaagcagtggaagaaatggagaagaaagaaggttaggaaattgtgcctaatgacgtgttcttgtaagtatgtgcagcgaatcttctctttgtagtattttgtaacgagacctaagaccatcctgaccatccttattgatggtctcttaacataactcttatgttaagagatatgtcttataattaacaaaagtgacttaaagtctcttatataagaaattttgttagttataaaacatgtctcttagcataagaattgttttaagagatcatcaataatgatgatctaagaactattatactatgttccgtctcgattttgaaagtacttaaacgtcgttatcgtgtttgtctcggcgttttaaattccactgtattagtaagaatttatttttaaaataactttagtcatttttaattatctcttctcccttttcaattattaatgatcatagtaacttctcttgatttgtaaatatgctacatagttgatcttttgaatatacgaatgaaaacatattataatagtatgtgttcaaaatcttttgagttttatgagtacagaactatatgtttaatgggcagattagtatataaaattaccagtgcatcagaaggaataatgatctactcgagtagtatatcaaaataatactattcaaatgtataccaacgacaatgagttcaaaatcatcaaaccccatgggatgatgagcaaataatatttttatcagctactctatacatcatttgatgataatatgcaaaaattgtataccaatgagttcaaaattatcaaaccacatgggatgagaaaaaagcatattactatttttaaacagcttctccaatataaatttatttgaccgttacggaaagggagagagatacacacactctttctcttttattattttccgtttatttgacttttcttctttatagatcgacctggtcccacgtaatcttttcaaacttaccgtttggattcgataatcaccgtccgatctcacatgaagcaacgtgaataaaatgaacggtttagatctatcgaccgtttatagcaatacctttctcctttataatctctatatctctctctctctgaatttcgaaaattataatgctcttctgcttcgtactagctgcttcagcttcttcttcttcttccttagattcaaaatctctcttcttctgagtttctgattttcaagtttgagaactactcttttccttctaaatctttgatttttttctctcgtgatttttgtggttcactgctaattgtgaaccaaag

SEQ ID NO: 8848 - DNA, 3000 bp, Unknown
  misc_feature (1)..( 3000): cDNA_ID_2178993_gDNA_ID_1971906_Annot_ID_177009 3000 nt of promoter + ATG
tacattttcaaatatggatgctgttattttgtggatttttaagtgtctaatatattatcgaatatgcagtgttttgtggattttgaagtgtctaatatttattgaatacagtaagttaatatatatatatattatatagacaaattgacatatatttttggccaaagtatctcccttggattttgatcatactctgcgaatgtgattcctttcggttttgatcatactcgccaaagtgcatgaagaaggttttttgaatgtgtttcgtggaataacatttattttcgccaagaacataactttatgctttccgatttttagtttacagtgtgttacatactctgcgaatgggcccctatttactctgtttatgaagtcaatttttgaaatgttggatgctctcgaattggatttgcagttacgaacagagaacacttatacggacaaaattctgaggttcgttatataaagcagtgggaagttaaacaacgttgtagtaactgggttcgttagcgtgttaaaacagcatgctttcaaaaagttgcatcgcccaccgtggggctcgaacccacgaccacaaggttaagagccttgcgctctaccaactgagctagacgggcttgttgactatattcacactattgttatactcatataaaaaaaacacatcccaattttaactagatgcaggaaagaaatttgcaaggacggtgctctgcgacaaaagattcttgtgaagaaacaaactgaaaactcatcagcttatattataaggctaaagctagtgttatgtctgtaaaaaagatgcatatatataaatagagctgaataaaattacaacaatgacaatcacctgcctttcccattggcgacttcacatctttattttactcagaagagtcacattcatcatcaaacatggctgatgacaacagtccctgtacaaactcacacttctttgccttctccaatttatcactatccgataaaggacacgacgatgtaccctcttttgctgctgacgaatccttaatcggattcttgtcttctacacttgaatcaggcagcacaagcttggtctgatttggtaatgcagaattgttgatgaacgataaaaattgatcggaaacatgtttagagggatgctgatgatgattcatagatggtggcaactcatcaagatgaggttgaagatatttatcagataaatatggatcttccctgtaagacatttccttctgctcactgtaaaattatcggtcaaggaatttcaaataaatcacattcattatagcgacggaaatttgacttgaaaggttttgaaaagaaacaaaaaaggatatcttcaagacatctctatgatgtgatgttatatgatccaccatatgcatcttcacccttttgctacatacaggacatatctacaaaaaccacaaaacaaccaaaacgaattgtaagatgatgctaccacatgacaattcacggaaccagattaataatgttccatcatactacttatatattcatttctttagctcgtaaaaccaatctatgcttcaaaacagagagctcaagtcacctactctctatagcaagtatgtaaagccaaaaaaagtgtcaaaagtattaatatcctaaaaccttaaactgatcaatggagagttatgtaaaacccaaagagtaacttaagataagagtggcatgtttctctattaaaactatttgcaatagcaatcagattctcaaacgcatcaatctaaaacaaatcctaatcaaaattatagattgaagttatgtttcccacaatccgaataactaagctgtgtaaaactgcttcatgtgaagcttgagtgtgaaatgaaaagagcaggagagataggaagtgaattcacaaaccccattgttagcttcatgacgatgttcttcgtcgatatggtgacacaattcaactaaatcataatcacttgcgcaaaacgggcatggatactccactgctatatcgtcgtcaacttcttcaaactcttccaaatcttgataaggccctgaaatattcaccactaattaactcgagagcaaaagagaaaaaaaaagtcttctctcatctaaaaagcaaaacgtaaagctacaatttttaacttaaacgaccaactacaaaaagtcatcaaaacagaactcaactcaatcgaaacccaattaagaccaatcttcaatcataaaccctaaaaatgaagtttgaaagaaaaattgaggggatttggataataaacctgattgatacttagcagcagtttccgatcgatagcttctagaagaaccagatgagctaacgcaccacatatcgtcttccatctgctttgtcggagcctttcttatgtaaaaatctcagataattgatgagagaccttcttcgtcgtgtcagctaaatacccaattgtgtaagagatagcagaaagaaaatgtcaagaaactactccacggaaaggccaaacctttttttaatccgccgagtcttaatggacaagaatacttcgggtggtaagagtgaactactattatacccttacattgcactgagcctttttctcagctaactcaggggtgtttttgtccttttcttgtaaggatgttactgttattgcattgctccccaagttaattatcagtaaaggcctgacttgaaattatataaatgggcttaaagtcaagattttgaaatgatataaatgggcttgaagtcaagattttgaaattatttaaatgggcttgtaggcctaataataaaagcccatgttaaaatctgagaatttttagattctgatagacggaaaatcccaattttcccggaaattttcagacaaaatcgcgttgagattcaacaactttgagtgagtttttttttttgtcatttacctttgtcgcttcgacgtgagacgagccgtggaagaagacgaaagggctcttaagctctctttactcttttcttctcctcctctttttgag

SEQ ID NO: 8849 - DNA, 3000 bp, Unknown
  misc_feature (1)..( 3000): cDNA_ID_2178989_gDNA_ID_1971906_Annot_ID_177008 3000 nt of promoter + ATG
ctacaaagagaagattcgctgcacatacttacaagaacacgtcattaggcacaatttcctaaccttctttcttctccatttcttccactgctttgtatgtcgatacaaaaagcacactctgattcttcctcaagaacctgctttatcattttgtttttgttatttgtctttaaatacttgtaaaaagagttaagtaggagaacaagaagaagaaacctgagaatatcaacaaagttgtcctgcaattccttcaatgtctcttctgccatattcacatgtactagcaactccggtaatttcactgcaaaactcaatatttatatagtcttatcttgacaactaaaccacatgataaaggcagatttgcagattacaaaaactggccttaccaaagagtcgcaacaaatgctctgctccgtacacagttgaaggagaaacaccccctgatacggattcctcgtactgcttccgttcattgttgtaaagcaacatcaccggtaaagctttgtcaaagtagcaacgcaagcctttcagaatttcctctaatgaatctgttaccctatatagattcaccaaagaaagtactagatatatcagaagcttggaatacgctttatctgtcaaccaaattatccatggagcatatacaaatgatttatactctctttaagtatatgagaatagcaacaaaagagattaacaagtgtaactgttggaaactgacagcagaaagaaactataatccacaaagagcttacctgccatgtttcttcatttggctgtcaatgtacttcttcaagatgccatccacatttggagaacgcggaagttgcacaagctgctcagacaattcccaaaaatgacttaaaataaattccttaacatatgcacctaaatatgacattcacaacaaatatattcatgcgactacaagaatattttttctctgactaaatgaatcaaaagactatggtcaactgcgtcaaaacacacagaaaagaccgtttgagaattgagagaagaaataacaggctgatagaaataccttctgcatctgagtaacaaattcaaaatcgtcaagaagttgcttccttaatgctggtggaatattgaaacttaaaaggttgtcagagggaagcacattcttctcctgtattcagcaaacaacaagacatgagtaagactcccctgattaaaaaaatccctggatatttggaagctgaaagattaagcaaatacatccactaaaggagcgattaccgtatcaacagaatcttgcttccgctttcttcctctagcaactgcaaaaattaagaaaatattgaacaaaatctcagctgacacaatatctcaactgacacaatatctcaactaacaacgaaagatgtgtatgtatactttaatctcaacaacttctacttagtcgacatagaataaagcaagcaagaccaaatgagagtccctgatagagactctgaatatccacaaaagcagcaagatatccatcgagacaagaatatgcaaaacaaacaaaagaagaagctgactgaccattagggcttctaggtttcatctttgacactttccaagccatagcactcttaatcccttgctgtttcaaaccctgttctttctgtttctcaatattctcatctgaatgtttcaacagacagtccagccttatccattcgtcccaactatcattgtatagaagagatacaagagtcaaagacttttttacattatcaaaaaactgagacttggcaaacaaatcagtaaatcaccatatgaagaattctcttatttataaatagtttcaaatgatttcaaaccgattagaagccagtaactatattggatgaagctctaaccttttgttccaaccctgccaaaagaaatcatttacatcttcaaaactaaagatagaagcaaaatagctcaaaagaatgattttaaacatatacagtatctacttacaatgtaatgcacaaaatatttccattcattgtctttaaattcaactttaagaacctgagaatattattataaaaaaaaaaaaggaaacgatcagagacataaagcataagcagagaagaacactctaattcaagaatacagagagtgtatttcactaaccttggcttcgtagaagcaatcactgtgtttggctaaaactctctctccttcttcgaagtggccgggaggagcaggtagcagaagaagaggcaaatcttctccgtcacaatcggtgttggtctctgtatcagaaccagagtcccgtcgtgtgtctccgatgaaatcatcggttgttagatccgtctcggcggcggcgttagggcttcccatctcaaaaagaggaggagaagaaaagagtaaagagagcttaagagccctttcgtcttcttccacggctcgtctcacgtcgaagcgacaaaggtaaatgacaaaaaaaaaaactcactcaaagttgttgaatctcaacgcgattttgtctgaaaatttccgggaaaattgggattttccgtctatcagaatctaaaaattctcagattttaacatgggcttttattattaggcctacaagcccatttaaataatttcaaaatcttgacttcaagcccatttatatcatttcaaaatcttgactttaagcccatttatataatttcaagtcaggcctttactgataattaacttggggagcaatgcaataacagtaacatccttacaagaaaaggacaaaaacacccctgagttagctgagaaaaaggctcagtgcaatgtaagggtataatagtagttcactcttaccacccgaagtattcttgtccattaagactcggcggattaaaaaaaggtttggcctttccgtggagtagtttcttgacattttctttctgctatctcttacacaattgggtatttagctgacacgacgaagaaggtctctcatcaattatctgagatttttacataagaaaggctccgacaaagcagatg

SEQ ID NO: 8850 - DNA, 3000 bp, Unknown
  misc_feature (1)..( 3000): cDNA_ID_2178985_gDNA_ID_1971906_Annot_ID_177007 3000 nt of promoter + ATG
aacctcaatttataaatttggtgtagcttttcaaccttgatgaaattattacatagaatcattcgttaaaagacttataattgggtttagaaaagcccattttaaatttaaagcccaatatactgctcgaaaaggaggaaaccctagaaacattgtggtatataaattcttttcgtctcgttcgctaatcagttctccgccacaccaatctccagaaaaggggagaagcaaaaatggtttctctgaagctccagaagcggctcgccgcatcagtgatgaagtgcgggaagggcaaagtttggctcgatcccaacgaaagctccgacatctccatggccaattcccgtatgttgttgcttttttcttcatccttttacttttattgttgtcctgtgtttgtctgcgacggtggtagacggtcttaggtgttgaatcactgtgtttgtttccgatctgaaaatttagagcttgtaggtgttgttacggtttcatttctctagttataggccttgtagaactgtgatttgtctcgtgaatcaaagctagaggatttgatttctgatattgcttcttaatagactgaggatttgaatgatgttccatttcgagtattgttgttatatatttgaagatctttgtagcttcaaatattaagaatgtgatgattggtgttgaacttattgtaggccaaaacatcaggaagcttgtgaaggatggtttcatcatcaggaagccaaccaagattcactctcgttccagagctcgcaaaatgaagattgccaagatgaagggtcgtcactctggatacggtatatacttcacaactctgaaaatccctctatttaatcgtgattttgaagaatgattagcgttgtttactcttgccttttttcctgtgtttatgattaaataggtaagaggaagggtacccgtgaagctaggttgccaacaaaggtactgtggatgcgtaggatgcgtgttcttaggcgtctgttgaagaaatacagagagacgaagaagattgacaagcacatgtaccatgacatgtacatgcgtgttaagggtaatgtgttcaagaacaagcgtgtcttgatggagagtatccacaagtcaaaggctgagaaggctagggagaagactctgtctgatcagtttgaggctaagagggcgaagaacaaggctagccgagaaaggaagcatgctaggagagaggagcgtttagctaaggtcagagcttaacttcttacaaactttataaagtttttttttaattttgatcagagattcttatgtgttgtggattgtttgcttgtagggtcccggtggagatgttgcgcctgtagctgctccagcacctgctgctacacctgctccaactgcagcgtaagtgttatttcaattttgttgtgaattgaatttgtttcaaattggttaacatctatctaaatcgtgtatgtgtgtttttttgcttgtgcagtgtaccgaagaagaagtctaagaagtgaagaggatatatagtgtgaagctatatcgatcatcagttcacggattagactctgaagaaggttttgaatgttttatcgaatgcgtttgtggaataacttttattttcgcaaagaacataacttatgtcagttaatctttatgctttcagatttttagcttacagtgtttcaacagacctactttgcaagttgttctttttttggtttcttattgtttttcgttcgtcatacgcaattacaaaataaccatccattaatccatccataaattgttaaattttagaattaatatatgcaataacaaccatcatctatttcgaagtgttgtttattttcttttgactttcgttttgttgattcttcactctactcctccagatgatccaacaagtggtccacctcttctgtctgctgagagcttttagtagaagcgttatttgataataactgtaatacatcaacccaaacgatactgatatgttttcatttcaatcctttacattaatcaaacactaataacaaattcacagtaacatatgaaaaacatcactgtcattaaatatcagtggaggtattacgtaccaacctgtaagcgccaattcataaaacactactaaccaacacccactcccatgtttttttctagcttttactatacatggtatactttcattttcttttagataacagctaaagctttttacaactcgtatgcgagtctatgttctccttgttgtcttattactataacgagcaaatatgtgtttgacaagagaataagacaaagaaaaaggtctcacattgacacgacttctatacacacaccaataaaccaatgtgtgtgattttggatatgcgttggagatattaacgtatacatttatttacatgtaggaaatacatagctgtatcaccaatatctccaacacattttatcacgtttaatccaaaaactacaattatctttctttttttttaattattatcataagaaaatgtaaaactataaacacatgtcaaaatcaataatgttacatatatcaaaatccaataaaaatattatgattgaatatgcgtggtgaattgattgacatgtgtcacaaaaagaaattacaaactttgaaaagtctagcttatacaataagatgatatattttaataaataatatatgtgattcttttctttttagtattataaatctattatattatcttatttcaattgatataatttaatacactttttcaaaaaacagtgattgtaatacttttattattatactatctgtaatttattagataattttccttttatttatataataaatgttctttttaaacttgtattttgggttgacaaggcccaacaaaagcccataaatgaatttcggatggatatatagaagagaaaggacatttcgcctgcatgggtaaaaaactcaacaaatcctgaaaacaacaaattcccgaatcacacagcgaggaggaagagaat

SEQ ID NO: 8851 - DNA, 3000 bp, Unknown
  misc_feature (1)..( 3000): cDNA_ID_3043733_gDNA_ID_1971906_Annot_ID_177006 3000 nt of promoter + ATG
cactgtaataccaatacttttctataaggaatcaaatctataaatagcatactaactagcactataaaaacattatgaatcctcctatgagcaaatcacttttaaatttgttaacactcttttaaaagaacaaaaaaagcaaaaaaaaaataaagatattatcaccatggctaacgcaagaagtttggtcgccaaggcaaacaatattaacgtaggttcattgattctaatggccttggtgtttggttcttgcgtggctaatggtgaatatctcggcggccgccgtggtctcgctgctaattccggtaaccccacggtctatgatattactaagtttggagccgtaggagatggttccaccaatacttttaaggtaaagtttagtttcattttcgatccataacctttttgagtattttatagtaaaatgcatgtgacattctaacgattgatccaataacattcatgcaggcgtttttgaacacatggatacaagtgtgtgacagtccagtaccagcaacgctactagttcctaagggaacatttttggctggtccagtcattttcgccggtccatgcaagagcaaagtgaccgtcaatgttataggcacaatcatcgctacgaccagcgggtacgcaactcccgagtggttcttgttcgagcgtgttgacaatctcgtcctcaccggaaccggcacattccacgggaaaggtgaagctgtctggaaagcagatggttgtggtaaaaaggtccaatgcaatcttcctccaacggtaagaccaaataactatatattatttcaaatcatgtatatatagatacttgcaataactaatcacacatttgtacgcatacatgcagtctctcaaattcaggaacatgaaaaatgttgaaatcaatggcataagctcggtgaacgcaaaggccttccacatgttcttagtcaaaactgagaatgttaacatccaaaacattaagcttaccgcaccagctgaaagccccaacaccgatggtatccatttgagcaatgcagacaacgttagcatcctcgacagtaccatagcgactggagacgattgtgtttcagtcggtcgtggctccaacaacgtaaccgtcgaacgtgtgatttgtggtccaggacacggtctaagtgtcggtagtcttggtaagtacaagaacgaggaagacgttagcggaatccacgttaacaactgcacgatgattgagaccgacaatggtcttaggatcaagacatggggtgggtcagacccaagcaaggctgtggacattaagtttgaaaacatcatcatgcagagtgtcaagaacccaatcatcattgatcaaaactacggttcaagaggcggagtaagtatatacatcactgaaaatgtctcaaaccaactattcttttgaatatatgcgttaacaattccttttttttggcatgttttgtaggattcacaagttgctataagtgatattttgttcaagaacattagaggaacaacaattacaaaagatgttgttcagattatgtgtagcaaatcggtgccgtgccaaggagtaaacgttgttgacgtgaacttggactatgtaggcaagacaggaggagagaagaagtcgtcatcaggcggtttggtcggagctctttgcgataacgccaatgttatcttcggtggaaaacttagtttccctatgtgtcccaaataagctttttggtataaataatttaatattaaaaaaaaaaatcaaaagtttcacaaacattgttttgtttgtgagttagtttgggaatttatcaacaagaaataatcagtggaatatttgacttttgataatgttttttttcccgattttttttgattttttttttggttttatgtataaataaacagatccttcagctggttgcttaatagtttctggttagaaaatttggtctgtgggtattagtgtgtacaatcattttattgctctatctaaagtcatcgatttctttctttctaagtggcaaaatatctctttcataaaaaaaaaaggaaagaataataaataaaaatatctctttcattctaacttggcattaaaatttagcaaaaactatttgtggaacttgaaaaaaatattactagctcagacttaaacttaaatagtaacaagcatattaaaagtcatgctaactgagatattgatttcctcatctcaagaaactatcttatgaatctgtttccgattattttagtttcccatcaatcatctttaatttctaggaagtttgattttttgaaaatttctccacctgcttaaatttcattacaatttttaatcttagataaacaactgtaatttatgcaaaatgaactgattatataagtcgttatgaatatttatattttttaaaaacatttcagcaaaactgatatactttttttttttttttttttgcaagcaaataaacaaacttccttgaataaaacgtgaaaaataataagagtctttaaagataaacgttgttcatatacattacgtcatataatatatataacaattaagacaatacaaacatatatacaattctcattgggttgaaacattataaagataagataaacatctgtatatatacattggtatacaatatttttcataaatttttttttctctaatcgacagttatatatatacagaaccataatttttaaagcatgctttccaatgcgttttttttttttttttttttttttgtaaaccaaagccgtgtttctaaacctcaatttataaatttggtgtagcttttcaaccttgatgaaattattacatagaatcattcgttaaaagacttataattgggtttagaaaagcccattttaaatttaaagcccaatatactgctcgaaaaggaggaaaccctagaaacattgtggtatataaattcttttcgtctcgttcgctaatcagttctccgccacaccaatctccagaaaaggggagaagcaaaa

SEQ ID NO: 8852 - DNA, 3000 bp, Unknown
  misc_feature (1)..( 3000): cDNA_ID_2105271_gDNA_ID_1971906_Annot_ID_177005 3000 nt of promoter + ATG
gggaaacagagtggtttaacgttagcgtgttcataggttggtgatcctaacatggaccatgcttgttgggagagaccagaagacatggacacaccaagaagtgtgtttaaagtcgacaagaacaatcctggttctgatatcgccggtgaaatcgccgccgctcttgccgctgcttcaattgttttcagaaaatgtgatccttcttactccaatcacctcctccaacgagccattacggtactgtaaatgtgtcatttttcacaattaatattcttcatttagtaaacctatatttttcaagttttataattaggtgaaatattcttcatttaataatcatttggctattaattttttttttttaaatctatatgagcattaattaaaaagttgcatttgtgggtttttaaggtttttacatttgcggacaaatacagaggaccctacagtgcaggtctggccccagaagtttgtccattctactgttcttactctggatatcaggttcaacattttaaacttttgaagttggatctatattaatttaaagtgtaactgtaatctcggaaaaaaaaactgaaattgaagtcatgtttttggttttggtttgttcaggatgaattgttatggggagctgcttggttacaaaaagcaacaaataacccaacatatctcaattacatcaaagctaatggacaaatccttggagctgatgagtttgataacatgtttagttgggataataagcacgttggtgctagaatccttctctccaaggttatacaaatctttgaaactaatcaaagattccaaatttagaccattggttcttgaattcttatgaaacattttttgtgtgactttgttttgttttttcaaggagtttctgattcagaaagtgaagtcacttgaagaatacaaagagcatgctgatagtttcatttgctctgttctacctggagcatcctcttcccaatatacaccaggtttttgcatatataccactcatcttctcattgaaatttaaaaatcaaggaatttatgatatatgtgtatacatatttataggtgggctattgttcaagatgggtgagagcaacatgcaatacgtgacgtctacatcgttcttgctcttgacctacgccaaatacttaacctctgctcgcaccgtcgcttattgcggtggctccgtcgtcacccctgcccgcctccgctccatcgcaaagaaacaggtttgtttcaaaaccaatgtatattgactctggtatactttggatgtcaaaatcaaacttgactatcaagtaaattttcagttaatgcacataataaatgtgacaccatctgcaagactacagcataccaataaaagaattaagaatctatactttattataatgataattagcaaaaatgaaataaattttgtattttgctaaagcatgaattaattaatatcccaatataaaatggaaagagtagtatttgcttaattaattgattcatgtgatatatgcttcaggtggattatctacttggaggcaacccgttgaagatgtcatacatggttggttatggtctgaaatatccacgtcggattcaccaccgtggctcatctctcccctccgttgcagtccacccgaccaggatccagtgccacgacggcttctccttgtttacctctcaatctcctaatcctaacgacctagtcggtgcagtagtcggtggtccggaccagaacgatcaattccctgacgaacggtccgactacggacggtcagagccagcaacttacattaacgctccacttgttggagctttggcttatcttgctcgatcctaaggccaactttaactaagcttaaaccgcatttaattgttggtttacaatgttaattagtagtaatgattttataaatgaatggccaagattgtccgatccggctgaatgaatgttttagatgatgtggtatttgattttaattttctaataaaaaaaaaagtagcatttagaagtgggaatgggtctatgaaatgagattacgtcaatatgagtgaaattgataaattatccaatcccataaacgagatggtgaacaaatataaatttacatttactgctagtaaatacaactacaattactttttaccacgcaaaaggagagaggagagattttttttttttttttacttcgtaaggataatatgtacttagaaaataatatacagtgacgaaggatgatgaatgctttcatgggaaacgagcaattgaccaggttgagagagatatgggccgattaaagctgtcactgtctctgttatgacagaactaagttcacgtttacgtgatttaaatttttattgatagaggagatgattgtgtttacaatcactgaattgttactgattttactgtgaattgcatatcaattggtaaacctgtaaaattgtcttatcattttgtggattaccaatcatatttatgagaaatctcaattccatttacataaatatttaaaagacaattacagaataatttagctatgacgctccgacataatcaacaaacaaaacaatattttgcatctgtatatatatatatacaaaattttgttacacatacacataattttgaggaagaaacaaaaattattatttggttgcaattttagactgttttataattaaccgagtaatattgatcattctcaaccacttaatcaattgattcttttttttttttttttttgcttgatataaaaaaagttacggtaaaattggaaatcgttactacctaagattggggtcaacaatccgtaaaagaagatggaatcacacactgtaataccaatacttttctataaggaatcaaatctataaatagcatactaactagcactataaaaacattatgaatcctcctatgagcaaatcacttttaaatttgttaacactcttttaaaagaacaaaaaaagcaaaaaaaaaataaagatattatcacc

SEQ ID NO: 8853 - DNA, 3000 bp, Unknown
  misc_feature (1)..( 3000): cDNA_ID_2178973_gDNA_ID_1971906_Annot_ID_177002 3000 nt of promoter + ATG
atggtatcaggatgtgaagtggctttgaggagaaagtcagtagcccaacgaatagcgtcttttgcgtttggtaactcagatttcatgagaccaccaaactcaattaaactccatgagagcattgtggttgtgaatgccattgggaatccaaacttcatattgtcccctgcatcgtagtatcctcccaccaaatccacctacaaaattaaaccaattcacacaaattaggctttccaagaaaatatgtaacttagtttctctgttttaacctaaaaagcataataacaaaattagggtttcaattcctctgttctaagcaagagtcccattaagtttgaatttttttatgattttgatagagaaatttaacctaaaaaccataataaacaaatttagggtttcgattcctctgttttatgcaacaaccccataaagtttgaaccttttttgatgatatatgttaagttttaacctagattgctagcattcatgttaatcgagaacagacccatttcacattttccataaaagcaacaacaaagcaagagaaagtagtgtcatttacgttgagagcagagccatcagagagaccagagttgcttctccaagtcattctctggtttggaggaagctttccggatctttgaccttcgaagaagagaatggacttggagagagcgtctttgtaattgtggttgtccaggtggtgacgatggtggatgctagggcgagaggaagaggacgagaagccattggagagaagcaagatgaaagagagaaaggtgatgagtcgtgaagaagagagatagagagccatttctctagtctctagagataggaaaagaaaagagagagctctgattaaccaatcaatgaccagtatgcagaagaagaagcttgctgctaggtgagcagaggagatttagctatttatatagagcaaagatttggttttctctttcctagctaaaccggttagttagtcacatgaaccaaacaaacagaatcattaatatttggaaattacgaaaaaactaaacacacctttatacttgttaaataacatgataagtttagtttgttttttttgtgtgattgattttttttaagttgtttacgtagctttgtaaaaaaagttaagtttgaagggatcttgtaaatattgcttgctcattgttaacacaatctcgaaatcgtaaaagttttgtaatcaatcactccataccgaattcagtggaaacattttaagtgtccatcaaatatggtaaaaaatgaaaaataaaataaataaaaatccaatgaaacgtccagtcaattttacgtggtaatgaccaaaataataataatgagatatgcatatgctttgtcagaccaaaaaagaagaagaaagagatggagcttggagagcgaaagaacaaatgtgagagttgtgggcattgtgtccaaactaataacaaatcaaggtgaaaatcgtaaaagtaagaataaattaagggtcttttcgtaatatttggtaaagttgctattgtccatacgcatgattcatctccttgaaaatgggctaaactttgagggcccaacttacaaagtcgataagccttgcaccttcatttattcctttcagttcaatatagtagttgggctattataatcgcaacacctggcccataggccatatgtcttcttcttttttttcttctaggccatatgtctacgattgaccaaaagtaaaataaagtaaatgttgtttacggattagattggtgtgaaggagctgtgagcctatggcatatgtaccacgttaagatttaagaaaatctggaataaaaaatgcaactagatattatgttatacaaatctaggccagagtcggttgttttcggaccgttctgccgtgaaactgtgttccttaacattttgatttaacgtttccatatttctgacattccaataaattattgataactagtaattaattaaaacggtttactctgaactctgaagtgtgtgaggtcatcaaatgtcaacggctacaatttcattagttacgtgcgtgactgcgtgttgacatattaagcagacaaaattataattacgttagatcattagcaattagatacagtcacgaatgcattgaatgtaagttgattataaaactttaaagcggactaattgtatttaaaaagagagctatagttagattggaacttggaaccatcgatatgattttatccgttaaataatttgagaaaatgtttaatgctgacaaataattgaacaatttgtcaacatattgcaagtttgcaacaacgaaaaacgataaattaacacctaataagtcagttgtacaaatatacctacaccaaacatgcatttacatatttgttcaaatatttttctttgaaaggagtgttgcaccccccataaaataaaacgtcaatattctttcctgttttgtttctttcggtaattagagaaactgattgtgaattctttaccaacaaacaaacaaatttacctagcaaagttttaatacttcaacaagcttacatgatattaaatcatttgtctcgaaattccgtgttatgatgcactaatgtcaatcaaactattaataaaaacaaatatcataacaggtaacggctactattaataactcaattatcatcgagatacgcatatagatagacacataatcaaatactaatattttctctataaacgtatgaatataatgttctgcaataacagataggcatctttgaataagcagacagagtttccgatgattagtaaattactttctgcaaacaaacctacgcgtttttatgactcccaaacgagttgactcaggattatgatcgcattacaatatcatagttatcatacacatattaaaaaattaaaatggacctacctcatcctcattaatcatcaccacacttatataaaccacttaacctaaagtttgtattcacataaaactttccagtaccaatg

SEQ ID NO: 8854 - DNA, 3000 bp, Unknown
  misc_feature (1)..( 3000): cDNA_ID_1026880_gDNA_ID_1971906_Annot_ID_176997 3000 nt of promoter + ATG
tttttaataaatttattgcttgttgttcaagagaatagctcgtagctcagccgggtcaatctcctcagaaacggtttccggtctgtaataaccggttttaggatctggaacccatggtgccttctcgcttgaagcttccccagctctcttcttcatctccgcggtcgaaacgcttccatctaacgccgttttggctgcggcggcaaaccctcgtctgaagagaatccaaaatccaaaacgtcagcgttttgttaaagcgacgagaaaacagagcaatacataacgtttttgtttcagaaacagatgttacctgaaaacggcgttcgagagcttttcggagccgaagacggattggatcttagcgttagcgagagaacgagccattgtggtttataggttttacgagttttggagaagaagaaaaacagcgcaaaagagaagtttctcaggttcttgatctgatgactgctgttacctttttgcggcaacgagatcgaacaaacttggtcgtcctatctctcttgacagatttcaaaatgctttgcaggatagatgagaaggaagagagatgagaggagggtttatatagaggaagcagagcagataggctgcgtcaatttaggctttcacccaaagttattgttttctgtttcttttgatttttttttttgggtttagggttttaaagttagttgtaacttataattaaaattgttttcaaagtcgttttgtatgtaattaacaacttgttttacttatctggatttaaaattaattaactcatctaatatacaagtatactatagtttgaccaaaaccaatttttatcttcttttttttgtagtcaaccgaaaatataaatgttcatatatgaaattaccatatgtacgtattcataatgctcaaaagaaattaatgatatatttagatatttttttatctcctaaataattgtgattgcatatatttagatattttttgatctcctaaactaaattgagtcggaaccactcaattctgccgaaccaacacggcctcaaaaagagtcggccatttagtcactctttctttcagaattttgaaatgaacttagtcctcatccttgtgtcaattttaaccaccaaaatcatacgacagcaaaaacttggacaattaataaagatccgtcctaagcaggaaaaatatagaccaagtgtaattaaaaatgaatgaagaaggtcgagcttaatcttcctcgtaactagctacttcatcgtcaatcctgaagtagcgtacctcgtagacatttttgtctttgttagatgcaatcactcgtagccaatcacggagattgtacttcttcaaatatttctttgtcagatacttcaagtacctgaattcaaaaccagatttttgcaatttaagagcaagttagggtttctaaagacgtgtgagagaagaaaagaagtttaccgtttggagaaattggaattggcgttgacattgatctttccattatatcgggtgatggagacggagttaccaagagcaccggctttacctctgaccttgattcgttcctgaagaaacttctcaagcgtggctatctccaagatcgtatcatcaactggtttagagcagtcgatcacaaaagaaactcctttcttcttagcaccagctccactcgacttggcccctactcgagccatcttcctacagagattgaattgaatgaaactctcttgcttagattagacgttggctcgaaaagatgaaaatcttcccgcggcgaggttagggatggactatataaatgacccacaagagtccctagggttttgtttagtgttagcccaatgggcttcttaggcccaatacttgggctaagagcttgtctaatttctgtttgatccgaaatgatatcaaatattgaaccggcctcggttcaattaatctttgttcaacatcaagagatatttgatcacataaaacctgtaccgtatttcatttcctagagtagttatctcagcatttaaaagatgtggaggaaactatatcaaacactggtttattctcttacaattgtacaattatgaataaaacatctatacaacttctcaaggctttgcgatttcgcattgcgactcggaagcagtttttcatcttagtggatgaaagtcagtcacctgaagaaataacagtgctttgatcgaatctataagtaaaagaatgttatgagtcatggaatcaatagctttgtaatcattccttctgcctcgacgacatctatagtgagattttttgtctgacaactctttctcctcagcacaaatctccttgcttgattctgtatctgcttaacaaatcaaaaacttcaaaatcagatttctctaagagcaacaaagacatatctcaaggcaaaagacttttaactacaaaccaattcaacaaggttcttacgcctataatgaaagaacaatgtcaaattttggagagaaccaaccctagttagtgatcaaacatgttttgccatatttgtcttcctaaaactaaccttacaatttctatgtttgtagctggctataattaagacgactgacggagaatgacattactcgaacaatatagtcttagaagcatctccataaagttggaatggtcacaggcaaatgaacctatctaacaacaagccagtttcggagacatgtaatttttttgtttgtgagaattttttaagttgctttctttgtaatgttttaagattttgattaaagcagataattgaaacgtttcttcgccacactatagtatataaaaggctcacgtgactcacgtgacgctcccttattaacctatatcgttcgccaacttcgaaaccctaaattcccaaattgcggaggctgagagatctcaaatcgacgaccaacaggtgaattttcgcttcctctgcttcagacattcttgataaagtttgaatcttgactttggacttgtgtttttggatttgataaaggaagaatg

SEQ ID NO: 8855 - DNA, 3000 bp, Unknown
  misc_feature (1)..( 3000): cDNA_ID_2106710_gDNA_ID_1971906_Annot_ID_176996 3000 nt of promoter + ATG
gatggtggtagtcgtgggccatctaggagatcagagtttcgtggtatgtagtcatataatttgcattattctgtccaaagttgtaggaattgttcctaattttacttgtttttcttttgtccaccacagttctagtcacaggcttgccttcatctgcttcttggcaagatctcaaggtgacttcacactggtcaacaaaactccttacttccccttgtatctttaaagtttctgaattctaacatgaatcacttttacattaggatcacatgcgtaaaggaggcgatgtctgtttctcgcaagtgtaccgtgatgctagaggtaataagtgtgcccatataatcttgtccatcgaaaaccaagttgaatggttttaatcttggacaatcttactgtagggacaactggagttgttgattacacctgctatgaggacatgaagtatgcggtaagctattttccctgtttctcttctgtggttgagagtttgttctactcatccttaatcactgattagctctcactcttgaatttccccagctgaaaaagctcgacgacacagagtttcgaaatgcgttttcgaatggatatgtccgggttagttgaagctgactttcctgtgaattgtgatcttttcattgttgtgtttaatattttgtttcatatctctttaggttagagaatatgattcaaggaaggattctaggagtcctagccggggaagatcctattctaagagccgcagccgcagccgtggacgaagcgtgagccgaagcaggagcagaagcaggagcaggagcagaagtcccaaggcaaagtcttcacgtaggtcccctgcaaaatctacatcaagatctcctggcccccgctcgaagtcaaggtcaccgtctccaagaaggtaatgatttgattccttttcagaatgcaccaggcaacattacttagtcggtagattttcctgtgaagtttatgaaaatctgattagaaaagtcattgttgatgctcaaagttcttgttgattgagcatatactggttttttgttgacacctgctgtttgctcgtcattattgtcccttcttactccatccttatatttagatgcttagcccttttctggttaagatttgcgagattggccttacatttttagcatttttaaatatgctcttttctttcctgagaagaaaatggttttgtttcatagatatggatttacatacgactagaaaatggaaattaatatctggatggaaattgattgttgacaagtgtttcgtctaagaggtatgggaaactttggaatagagactttgcttttcgtggcttcctgatatagtattcactaatttacattgctgctagatggataacagtggagacattggatcacttggatcacaatattatatcgggatttctgtaaaactatattggctcgatggattgacaatatggaatctgggttctcttgggacgtccgtggctcatttggcaacacaagtttttttggccacatggcttataaaacctctgtcctatcacctatgttttaactaagtagcagaatagtttggtttatgtttctttttttttatttgttgcaacttcttaatctctgtgagatagaaggagaggctccaggaccttgctgaacagtataaaacacaacatgtttggatttttgaatctgagtttcttttcttggacttttgcagatcgcgttcaagatcaagatctcctctaccttctgtgagtaacaagatccaacttgtgacccctcttttattttgacataatcttctgttttacattgttcgttatcttaatagcttttctgtatcacaggttcagaaggaaggaagcaagagccctagcaagccaagtccagccaagagtcctatccacactaggagtccatcgaggtacataatctttcttagaaatgaaacattgcaatctgattttgtttgataatgcgtaaatctgaatctgagctcttgtttgcaggtaaaatgggagatatccaggtgaaaagagaagagagaagcatcttcttgctactcaaaacaaattctactttcttgaagtggattatatctgaacgcttattgactgtagaagatgcgacaagtttgatttgcactatcattttgtaatattcttgccattcttcgtcttctggatccctttacttttgagaatgatgtttttttttgaagatatcgtttcttttccctccttctgattcatccttttcttaattaactaaagctctcacttaaacaacgtcgtgtttagacctgatccggaatctgactgtatagcctgaactgtacgattccagtaaccggtgaatcttgtctggagacgtctgctttgaacttggtttttgtggtgaactcagtcctttgttcgtttccctaatttctcatgctcttttgcaatcatatcatgttcgattccatctttatagttctatatccttggtatagtagtgcctgatttggattctctgtcctctttagcttagagagctatataagcctgaagacaaaacttgattttattggatgatatagaacatgcaacaaaaggcaatcaacaatctctttgaaaagtattcgctgctcattgagagataatgaaagtgtctttacttagagagtgtggtactatggtgttgatcactcaatatgttaacatgtgggtccaaacaaaaaaatactaaagctaaggaaacaaacaaaaagccttttgaaagctaatgctgctccctattttctatatcgttggacgatttgctctttacttcttcatcaaacttgtcaaaacaagtggacccactcctagaagcagacgaatgcagttccgtgtttcaaccaaacttgtacttgcttgttaaagtacttaaataatctatcacaaggggttcaccgttcgtatttgttcttgcttgctaaagtttttttgctctgtacggtgacaagaccagagagatg

SEQ ID NO: 8856 - DNA, 3000 bp, Unknown
  misc_feature (1)..( 3000): cDNA_ID_3043737_gDNA_ID_1971906_Annot_ID_176995 3000 nt of promoter + ATG
gtgatcacctacaagagacaagactgatgtttgatgatttgcttctttcagtatgcaaatacaccatggagtctgcaacagatacttttgtatgtcaaagaaacttatggaaaccctcctgtctatatcctagagaatggtctctctttatctctctctgcctctctcagactttagtttgcttcttcatgtgtcttaaactctctctctctgtcgggtgattgattcttcatttacaggacaaatgactcctcacagctcatcacttgtggacacaacaagggtgaagtatctgagctcgtacattaaagcagtgcttcattcactcaggtaacagtaaaagttgttcaagttatcattcaatggatgtgtcagtcagattctaagcataaaatttgacacagcaggaaaggatcggacgtaaaagggtattttcagtggtcgttgatggatgtgtttgagctatttggtgggtacgagaggagctttggattattgtacgtggacttcaaggatccttctcttaagaggagccctaaactctctgctcactggtactcttccttcctcaagggaacactgcaccatccatcatatgcttcgtcttgatcatttgatttcaatggttataatgcttagttgtcggaaatgcaaaccattactatgttttatttttgctaaataaaatcattactatgtttttttctttatcatctttacaataaatcaagatataaacattgtatgttagaaaaagccaaataggtattagtctgttattacaatttctctttgatagataaaggtgattatgtattcttcaaaactatgtttatcttatggattagcataagagctggatatagcgtgtttgacctatatatataatattgcgtataaagcaagacatacgctttcgtataaaaagccgtacttaatacctataattccttgagtgtcttttgcattttagttacgcaagagacgactgatttcttgtcaaatcttaaaggcatcaatttatttacttgtttaatacgttacacatcgtacattgttgtattgttaattagaatgtataagaaaatgattgtatgctaagttagtaaccgtgtaattcgaaaatatttgactaatgcgtattttctgttttccttttgaaaacatcaaatcccactggccactaggccttaaaatgatcataaccagtcgaattgtataaaacaaatgaccacttgagcagacaaatgaatggtgtgccactttatttttggaacttttgtcgattcatttggaactttaaattgatattttggagcttttcaaaaagtaaatagtgaattgaaacgttcaaacctagaacactagcaagatgaaacattatatgttatcacattacctcattatgtagtaagaaatagtacaattcatatagctttctattaaacatttaaaatgcaagggtttaatgcatcactattacaccattcaaataaagctaaaagaaattaaagtttcaaagttaaattttctttgccactagagcatatacctctaatttgttttgttttttttgtaagatgaaaaaaaaatgtaagcaaagaaaaaaggacagtggtgggtgactctggatgaaaaatgttagtgcaaaatcatgatacacatagtaataattaagggggtcgtaaagttaaaataaacaaaatgcgcggcttgaaaataatataaagcagagttttagtggcgaaatccaatccaagtcaattataagagcatctccatgagtagtctctcacatagtttttcattaactaaaaaatataaaataataataaagtaggagagagatatgagagagattgagaatagtttctctgcagagaaactttagaataatgattgagagactatgtgtatatatgtgtgtttattattggacataaactaaatcatagtaaaatattattatattttttttttgagagactatgtgtatatatgtgtgtttattattggacataaactaaatcatagtaaaatattttttttttttttttgagaaacttttaaagtatcttaccaatggaaatggcctaaacttcctaaaaaaatatattatattcttaaaactatttccaagtttctaatttgaccccacaaaggagaaaaaccaacaaaagggccctttctggtggcatctttatcccaaattacacagtggttttcatattttatatattatctttacatcagagttttttttttcccatcaacatgtatacgtaaaagaaaacaacaaaaattatagcaaaataacccttcttgaatggtaaaatatctcgcagattttatatcataattttatatagtttacgataataaagaaatgtgagactaaataaattcaacgaataggatatacacagaatccagactttggcatccacgcggcataaagaaatagatcgagtgtgatatacaacaaatcacaaatgtgctctcattaattttaaaaaacccaaatctttaatgtattcgtaacgagtctgtcactacattaataataagtcattgaaattgaaatccaccaatagttgcacagaagaattaatatatatttccataactctcataacacaaacttcaccttttaacgaagaagaagatatgttcccaaaacaaacgttttgactttttttttgttttctcatattcttttatttcacaacttgttatttccgccgacttcaccagtcaccaccaccttcatttattcataaatacgtctctgttctgtttttgtttctgtttcattttcatacataattaagccaacacgagacgcaagagagagatagggaaagagataagagcgactctgttttgttgatcaaaatcctttttttttgtttgagggctgaatttgtttgttgatggtcatctaaatttgtaacctttatctgttttattgagttgtgaaattcagagaaaaaataaatg

SEQ ID NO: 8857 - DNA, 3000 bp, Unknown
  misc_feature (1)..( 3000): cDNA_ID_1010567_gDNA_ID_1971906_Annot_ID_176994 3000 nt of promoter + ATG
gaagatcggaaaaaattctgagagtttcgtctaagggtttcgaatggacttttcgagcggaagatcagaaaaaattctgacgagagaagacaactacaagagaacggtggacccacattaggctttcgaatggactttgctttttgggccctttttgcttcccaagcccaacaaggtattttactttcctcctttcttatttttgtttttctcccttttttattttcttactaaaactataagtttttcttttataagtgttaaattttaaaattttgtgtaaactaattgttaaatttttataagtgttaaaatttttgtgtaaatttttataaatgttaaaattttaaatttttgtgtaaatttttataagtgttaaatttttaaattttataagtttttcttttataagtgttaacgtccatacccctaagaggcgtcatcggttcaatatgatttacacttaatttaattttttaacatttatttttattttattcaaaaatatttttaaaactatattttatattactactagtaaaactataaggtttttaaactataaagttttttcttatatgtgttaaacttttaaattttgtgtaaactaattggacacaatgtccaaacccctaagcggcgtcatcggttcaatatggtttacatttaatttaacttttaacacttatttttattttattcaaaaatgtttttaaaactatattttgtattactactattaaaactatattttgtattattactattaaaactataaggtttttaaactataaatttttttcttatatgtgtaaattttttaaattttgtgtaaactaattggacacaacgtccaaacccctaagcggcgtcatcgttttaatatagtttacacttaatttaactttttaacacttatttttattttattcaaaaatgtttttaaaactatattttgtattactactattaaaactataaggttttttcttatgtgttaaacttttaaattttgtgtaaactaattggacacaacgtccaaatccctaagcggcgtcatcggtttaatatggtttacacttaatttaactttttaacacttatttttattttattcaaaaatgtttttaaacctatattttgtattactactattcaaactataaggtttttaaactataaagtttttcttatatgtgttaaatttttaaattttgtgtaaactaattggacacaacgtccaaacccctaagcggcgtcatcggttcaatatggtttacactaaatttaactttttaacacttatttttattttattcaaaaatgtttttaaaactatattttatattactactattaaaactttataaagttttttattatatgtgttaaaattttaaattttgtgtaaactaattggacacaacgtccaaacccctaagacgcgtcatcggttcaatatatagtttacaattaatttaactttttaacacttatttttatttcattcaaaaatgtttttaaaactatattttgtattactactattaaaactttataaagttttttattatatgtgttaaaattttaaattttgtgtaaactaattggacacaacgtccaaacccctaagacgcgtcatcggttcaatatatagtttacaattaatttaactttttaacacttatttttatttcattcaaaaatgtttttaaaactatattttgtattactactagtctactattaaaactataaggtttttaaactataaataatttcttatatgtgttaaatttttaaattttatgtaaactaattggacacaacgtccaaacccctaagaggcgtcatcggttcaatatggtttatacttaatttaactttttaacacttatttttattttatttaaaaatgtttttaaaactatattttatattactactattaaaactataaggtttttaaactatcaagttttttcttataagtgttaaatttttaaattttgtgttatctaattggacacaacatccaaactcctaagaagtgtcattggttcatacctaatttaaatttttaacacttatttttatttatttaaaaatgtttttaaaactatatttttatattattactattaaaactataaagtttttaaactataaggttttttcttataagtgttaaatttttaaattttgtataaactggatacaacatccatatttaaaaatgattttaacactatatttttatattaataaaacttcttataaatgttaaattattaaattttgtgtaaactaattggatataacatcaaaacctcgaaggaggtgttttaagttcaatatagtttacatctaattttaatttttaatttttaatacttatctttattttattttaaaaaaattttataatatttattgtatttttgtgtaatttacacaaaattttgaatccttaggattgttgagttcacatttggtttttgtataacactcacatcgattgtagacttgtagtgagtttgtgagatgctctatgttctccctaacttttttttctgtctctaggcacgatttcacgaaaccggaatctgtggaccaaaagttacctagagagtgattatttttgagaaaatagtcttcttacgagtatgttaaatctaaaattataaatgaatgtgatttttatccacacataaccttgagtactaaatacgaattttgtaaaaatgaatcttttctttggaataagtttacttcaaaatttacagtgaaaaaattataaaagatccactgaaccaatcaaatattgtatctattaccgtatatcatcgaccggtttaaaataatttgtaataggtaaataacagaacgacgtcgttttagagaaccgtgtaaaccctttgtagttaaaccctttccgccgcgaacttcatctctctgctttttcttctccatcgcgaaaataaaaaatcagtgagagag

SEQ ID NO: 8858 - DNA, 3000 bp, Unknown
  misc_feature (1)..( 3000): cDNA_ID_2178924_gDNA_ID_1971906_Annot_ID_176982 3000 nt of promoter + ATG
aattagcaaattccttaatttcacatttttgtacaaatactgctcttcaataatataaggagagttatttcataattttttgattttttgaccaataaaaagaaaacttgttaaattaatcacaataaacactaattctaaatcgtaatttggaaatacattaaaaacattatatatttcttaaaaggttaaagatataaatacatacacattgattttttaggactcggaatccaaggaaccaatgaagtattattcatttgagtcacgggcttgttcatatgtctttagcatactttttgaatcaatcaatctatgatagtcaggtgataatgtgaatagttggctggttgagtctccagtcgggtgcactacgaccactttaaatccattctctatgagatctaaaatcacatccgcaaaccctccatcacccgtcatcatcgctataacactttttccgattttctcttcatatcatatcctctttatgttagaatatataaaaaaacaagtataaggttcgctgtccgaataattttgagtctcaagaaggttgacaataagaataacttgtttatcaatatttcttttagtttaattttttttaacttttaaaaccaataaaagaattaaaaaattataaatactttaatttaattttctaaaattgatgtatctatccataataacaagtaaaaatttgtattatgtataaaatgattaaaattatactataaaacagaaaataatttaactttaaataaatattaaaattttaattttaattttagtattatttattaaattacatgacacgccttccagaagatccactgcacctctactttatctgtaacaaaatattactatcctttcatctaacggttaaataggaaatccaccgtagtcattgatacagctgattattcccaagctcgaaacgagaaaagactagagcgcgcaaattttgaatatatttatttattgtctttactttccatcaaattttgaagaacgaaagaacactgttggctaagaggaaaaccctaggaaccatcaaccgagaagaacgaagaagattcgaaagatggaagggacattggagcgacactattctgcttcaattcggtcaattttcgaagctttcttttgagaatcgtccatcgtcgaatgttgcttcatcggagtttcagggtcttctcgattcggactcgtcggagctccggaatcagttgggctccgctgattcaggtgccaattgcggagataaggactttattcttagccaagacttcttctggtaaatcttcggcatttcctgtaacacaattctggtaaatcttcggcatcaaatcagtacttgtaagtatctgtaacacaattctggtttagttattctgatatcttccgtagctaaaaaggaaatttctctcatcaccatttgattccaatattcctcagaacaagaagctgcgcaaaagaatttgaaaacgaaaacgactcacagttgcttccaccgttacatcaccgggatccctagcataatttagcgcaccacaacctgaaaacaacacataagctccttatgaaaacactttccttaatcagttaatctatgaactgcaagaaggtacgggaaacctgactgaagttaagatagtcatagaaaaggcttgatcgcaaaatatatacctatgagtttttcgagctttgtttgaagtattaatcctccctacaatattcaagccaactatggtcaaaccacaatcaaattcaccctatagctcctcaaaactagtcaagccaacaacaatcaggaattgggcaaaatcaaaagttcccatgttctttctcaaagacaaattctcaggagttcccagagagctttatgcaagctcaagttgagattaaacattacctcttcttcctttgcattctcgcttggccacatatcattttctcccaaactaacattgatgatctcttcctcctcctctaaaagaccaaacaacagcttgcgaatcacttgttagacaatgagcgacctaaacactaagatctaaaatcgaaatttcagatgataaaagcaatcatcagttctcaccagagatgctctgatcggaatctggattcccctgaaaatccaacaagaacaaaagcaaaactcaaaatcaaattaatccaacaataaaagaaatcgcaaaagcaaacaattctcagagatgtagaacagtcaccggaaggtttcttcgccgtcacattcgccgtcaccgttcaaatcgatctcgccggcgtgcacctttataccgtccttgccgttagtatgcttggatatgggcccttctctgagtttactttcttttagtattagtaattgggctttaataggcccaattcccatgttttatatcccacattttagaattaatcaaacattaatctggcaattccttaatttcacattctagtacaaattactggtctttagttataaggattaaggagagttaattcatgtttggaaaaaaaaaaatgagaaactttttagttgtttgaccaataaaaatacaaattgttaaattaattaacaaaaaatactaattcaaaattttaattagtgaatcgtaacaaaaaatattatatttcttaagaaagttgaatatttaaattagtgaatcgtaacaaaaaaaatgctagtgctattatagaaaaaaatattatttattaaagacccatcaaagcgtacatgatacgctctacagaagatccgctgcacctttactttatctgtagcaaaatatttcaatcctgaagattgaacggtccagaattgattatataggaagtgcaccgtagtcagtcatgcagatgactattcccaaattttagctcgaaactctaaaagacgagagcgcgcaaattttgaatttattaatttatttcaattatttttccttagttgaatcaccacccaaagtaataatattcatcgtcatg

SEQ ID NO: 8859 - DNA, 3000 bp, Unknown
  misc_feature (1)..( 3000): cDNA_ID_3043752_gDNA_ID_1971906_Annot_ID_176985 3000 nt of promoter + ATG
ctcctgagaagttgtctttgagaaagaacttggcaacttctgatttgccgaattgattgttgttggcttgagtagttttttttgaggagctatagggaatttgattgtggtttgaccatagttggcttcaatattgtagagaggattactacttcaaacaaagctcgaaaaactcataggtacatataatatatccattttgcggtcaagccttttctacgactatttaacttcagtcaagtttcacaaagagcttctgtgttgtttccaggttgtggtgagctaaattatgctagggaaaccggtgatgtaactctggaagcaactgtgagtctttttcgttgcaaattcttttgtgcagcttcttttttggaggaatattggaatcaaatggtgatgagagaaatttcctttttagctacggaagatatcatcctctcttgaagatgtggtcgaagttcctgactcccccgaggagagttatatttcttcttccagaagaactggattagcatgcatatctgctcaggaaaatgggtcagatgatgaggttaccttctaatcttggagtccatttcactcatgcatcttgataagttcttcaaattggtgacagtatcctctacttatgttttgaatggtgattgttgttgccttcagattacacatgatgaacaagtggcaacttggtctgctataagtaaagaaaccaagtcactaatccatttgaatggtgttgcttcagtcgcatcatcccatctatctggcttcagagccaagaaaagtagtaatggtactgttttatccaaaactcttcttggtatttttttaccgtacaagttaaagaacgttgcaccacgtatgaaaactcaaagaaacagatcatgtatgcacgattttctgaaatctctgagttgggtttctaatgtatatgcaggtctcaaagatcatgggaggccaaaattttcatttaactcacatactcatggagaaacgtcatccaagataagtgacatggctgaaatctttgagcctgatgtggaggatcaggctatagaagaggatccaattattgaatgccccaacagttttgatgaaagatcagaaaacaggcagggtgtttctgttgctgagtcgagagaagttttgcacgagtgcactaaagatgcggtacccaagcttcaagaaattcctctagataaaattagactgataaaaagaagctctgaactggtattattgattatacagtggattagcatttgatttgctgctttgctctcagacatctgtttcattcgtttggcctcctttctgctccaggacagcagacatgaagcaaaaagtcggaaatttactcataagggaaattcatctaacttccaagatagtgatactgatgatgaacttcctggacctatggatagtggatcatcaagcgatgatgaggttttattcttttcctttcttgtgatttgggtaatctccttctcctcagtttacagtcaaattcaaattatattgttctgtgacatagcctagttatcaaagctcagtgccaaacatttccaaccagaagaaacaatttgttggggaccggtttgatgaagcaataaaagcttcctctttgagcaaagaaggtctcttgttcggttcacctaaattatctgggtaatcaaactctcaacatcttttatgcaccacactcttaaaatcacacatcagttaacatgaaaacccatttttggttgcatcaatttgcagtggctctagcctgtatggcaagctgcaacagatcatgaaacaagaaaaagagacggaaatggaaatcatgaggaaattgcaaagcggaatcggagaagcaggtaactctttttgtaactcccatataaacaaaatctagttcatacctctgttactcgttccaatttcccaactcagattcatcgggctatgttgatgttaaagtcatgtcaagacacttggagggaaagcttgtcgtctgcaaatgctctgtcattgacctctctggggtttatctctccatctctttgacgcatctgataaacctgctcctttaattagacccttaagcaattgatttagtcacattcgattttgtaggactccctattactcaagaacacacaagctcttgcggcaaaagaaacagaaacaacaattatttttagtccgaaagtttgtgcggatgttgatatcgaaatagggaactttatccgagtatatgcgccatggtcagttttgattccactctttagactcttatcccatgtcactaaactcttttgtgatatttagcttttcaattttcaacaggaaggagttggaagtgcagaaaaccaatgatgtgattattttgtcttcatatttctcaagtttgtaatataactcacacaaatgtcaagatgtggaaaaaacttgcaaatgattttatcagtgtgtataaaaacgataattaaagctctctgattgataacaatcatactgatcagagcttaaagtgttttttgatttatcgtgttttcttctttgggtttactactgattaaaggcgttaatcagttctcacaaatgattcaactcgttttagttatttatacatgaactgtttgttggtttgattcctgtcgtgtgctttggtaaacctcaaagtaaagcataatcatagtattcgtcttgtttattaattagcacttaaaataatggaacaaaaaggataataaaagaaccagaaaggataaataatgaaataaaacggtagatccctagtttacattgtatcattggaacaattcatctctcaatacacaagaaaggtggactctttacgtggatgtcaaggaaaaacaaaatgttcctcagcttttgtattgcaaagaaaaagcatataactaagttggtatatataatagggtttatggaggatacatgcagaaattaaacaagtgtatctatatcgtatatatggactgcttacag

SEQ ID NO: 8860 - DNA, 3000 bp, Unknown
  misc_feature (1)..( 3000): cDNA_ID_2109499_gDNA_ID_1971906_Annot_ID_176987 3000 nt of promoter + ATG
tggttaatatatgtttcatgtaaataaataaagaacaaaaaaagcattatttaaactaattagataaattcagataagattctacgattatgaaaatgcgaaaagcagatataaataattcgatgccaattttgaatttatagatcactacactcatgcattcttgttatgttaagttgcattactccaaaactaccaatatcttctggagtaaccaaatagaaggagggaattttaaaacaagctatattcacacagcctcggatgtggtgcctgaacatattggattggttttgataatatttcaattattttcaattcaaataataataataaaactgaaaataataaaatccagtttcattgaatatttgggtattcctagtactaaattagttaaatcaataaaaatatatttgaaaattttaaatccgaaaatttaaaaggtaaaaaaattattttatttacttaaaaaccttgcaaacgaaaatattttgtatataaaaaaaatagtttacataataaaaatatttgcaaaaaacaatataatttagtcttagtgttaaatttacttgagtgaaaaacagttaaactttatatacctcaattagataagctattaaatctatacctcaatttttttattttattttttggttcaacgctatatcctacctaattagattggctaaattgtataagctagtgcaaaaagttcatataagaacaaaaaactgtaaaaggaaagaaatctacaatttcatgtaaaaaatccaacttattaattaacaaattttgaaaaggaaataaagtaaataataatggttatggattcaccttatctaattataaatacatctttatatgctctatcctctatgagtgtactatagagagtagagagagtagaaaaaatgggttcctccatattattggttttgtttactctcatggttatgctgtccatttcttatgaaccactcaaatgtaattatcttgaattttttttgtttgcttttcttcttgtgctatggttttgaatattcataattgcgttgtagggatgggcataaacgcgagccatgtaccggaaacttgctaccatcattgtaaccagacgttcgagagtagtcgccaatgctttaaatggtgtcaagaattagctcgtaaagatggtaatcatactcatttatatactaattaatgggatggaataaagaagttttgatgggtttcttaattctcctccttcttcatcgtattacatgatgaaatatgtaaaattgcagagtacaagatttatgggtacccttactcaaccaacacaaggcgtgtcctcgccgttcttcatgagaaaggtctctcttacgatcccatcaccgtcaacttgatagccggtgaccagaagaagccgagttttctcgctatcaatgtacttttcacatctaaatatctaactctgcttcatgattaatggttaggtcttaactagggtttccattttattggtctcttcttattgatgcagccatttggtcaagtcccagttttcctagacgggggtcttaagttgactggtgagtttaaaactacattttcaactaattaatgatctaatgaattttgatataatttgttttcgtcagaatctcgagctatatctgaatacatagcgactgtccataaatcaagaggcacacaacttctgaattacaaaagctacaaaacaatgggaacacaaagaatgtggatggctatcgaatcttttgagtttgatccactcacatcaacactgacctgggaacaatccatcaagcctatgtacggtctaaagacggactataaggttgtgaatgaaaccgaggcgaagctagagaaggttctagatatatacgaagaacgactcaaaaattctagcttcttggctagtaacagcttcacaatggctgatctttatcaccttcctaatatacaataccttatggacacacatacaaagagaatgtttgtaaaccggccaagcgtgcgccggtgggtggctgagatcacagctagaccggcttggaagagggcatgtgatgtgaaggcttggtaccataagaagaagaattaatcttataatcttgtgatgtactttcggtgatttctttaagtttgatgttatgaataaaaggcaaagcttttgcaaaaatcactcttttttttgccataatgatttcaaaattccaaagaataatatatacttcaatatacatgtcacaagattaaatgtcaaagttgtttataatgagcatttttgtggatgtggaaaatgtgaaaattactctgttcctttgaatgtttctatacgaaattatagttaggatttagtaatgtatttctccataattatgctaaatttagttagttacttcaatatgattaaatactttattgaccccaaatttgtaattgtaccagattgtcaaaagtgtgaaaccaaattttcttttcttttgatattgttttgtttcttattatctctcgttctatcgaatgatctaactcgagcatccaacgatctaactcgagcatctaacgatccacgtggacccaacaacgtcggtcagagtttgactagtagatgaaggactattcttgtggtcgttgtcacgcggtggctgatattttctcttatttttattttattttaactattttttacgttatatttaagtcttgaaccaatagaaacgacgaatcatacattactcagcttgactttgaaataatcctataacaaaagagcattccaagaattttatccaaaaaacaaaataaaaaagagtattcaagcttggtggcgccgtttgtttttggtttattcactaaagttactctgttttagttgtataaatacacactcccatttgtgtatttcttttcatcaatcacaaagatctctctacttcaataaatctccaccttactttaagaacaagaaaaacacagtattaacaa

SEQ ID NO: 8861 - DNA, 3000 bp, Unknown
  misc_feature (1)..( 3000): cDNA_ID_3043748_gDNA_ID_1971906_Annot_ID_176991 3000 nt of promoter + ATG
cactcccaacaattctccaattaataataattaactaatttgcataatcattttttttcatttcactgtcaagtggcatttctgttaataccgaaataacacaagtaaaatttcgaaactataatgtaagttcaaaaaattctattgtaactacagaaatcaaaaattctaaacagaagctcgttaaattttcaaaattttaatataacaaagagaaaatgttactagtattcgaatcaacaagttattgtcatgctatgtctcatattcttctaaataaatactgaaacttttaataaaaacacaaaatagaatttgaaaaacaaaacaaaaaaagagaaaaaaaaatcttcaacaactacaaaattaaaaaatcgagtccacgcactcaccatgtatatataaacattaacttaagcaataataaccaaacaaaagaacccaaagaaaggcaagaaaatggacaagtcctttactctgttcttaactcttacgattctcgtcgtcttcatcatctcttcacctccggtccaagccggcttcgccaacgacctcggtggtgtagcatgggctacgactggagacaatggttcaggctgccacggttcaatagcagagtgtatcggggcggaggaagaagaaatggactcagagatcaatagaagaatattggcgaccacaaaatacataagctatcagtctttgaaacggaacagtgtgccttgttcaagaagaggtgcgtcttattacaattgtcagaacggagctcaggctaatccttatagtcgtggttgcagcaaaattgctcgttgcaggagttagacctacaaacaagaaagctatcttcttgatcttgacttatgttttctttgatccatcaagcgttttcattttaattaaatctttaaatattcatcatgtctctgcacaatagtaaagacctatgttttgatcaaattgggttgatttgtaatattttatgtgaataatcatggtcttaatgatccatgaagttgtttggtttttaattattacaaagagacgagtattcaaagagttattacctacgtttgatcaaaccgggtttggtttgtacctcagccgctttcacagtcggattgaataaccggtctcaagttgcaacacacaagtgaccaactctcaacctaacccttaccaactctcggcgcgtttacgggaattagtttgttttgaaaattaatattttatatatattggtcgatttgaaccaaaccggatcgtaagaaattggttttatccatgataccactttttctcttcgaagggtttgagaaactgaaacatgggcttggaaacatagaaggaaattcactacaaaacaaaacatacttgaattagtaacaaaaagcgtgaaacatgcagacattattataacaaactaacatttttggttcttgtctaatcaattaggggttgtctcaataaaacatgtcgcccatcagcttgacaacatggttctaacacggtttcttttaggttaaattggccaagttgctaatcaggagaacactatcttaataattaaatcaagtagttgaaccatccgtaacaacatcaattttataaatcattttcatgtaatttgcaaaattttatagttaaaacttaaaaacgttccatcgttgaaagaaaatagaggtactacaaataacaataatataggtagaagatccatgataatggatttttgattttttttggtttgttaaaaggtattcattaatcatggcaaaaattcgcaacatgtttgcttgcatacgctagaaaagaaagaacatgatgagttacaattttttttaatcttctccctagctatcccaaatatccgaaaataaagaagaagataatattcaggattgagtttctctttttataaacaatagaaaacatcttcttctttggttgatccttatcccaaaaaatgattggccacaaaattttgaaatattttcttatacattttccattccaccattaaatgtctcgtctttctctttttccctctttcaataagtgatggatttgaaccaaccgacttaaaatgggccggtcttaaagccgcaccacactaatgggcctttacctatttacaatttttctgtctattgaacagtagacttactgctcatataattggcgggatcaatacacgtgcttaatactagaacattcggttcgttcctaactgcaaacgagtttggtaatttagttaccccataattatcaccacagttgaccttagttttaagtttgaaattcatctaaaacaccatatatttgaatacattacaaatacaatgaaacatatgacacacttgtgtgatggtttagataaaatacgtattgaaatagctgtaagaatgttacttgaaatgcaataaaacgcatgtcaagttgtcaacatgtaaacccaacaaattaaacgattaaaaaaatcagccacaaaaacaggtagagcatgcagcaaaatattccaatgcttgggtctctatgttaagttctgtaattcgtctttattatatatatatttggcaaaatttaaatattgaccgttggatgtttttggttttaaatctgtaccaataagcgaatgagagaatctacttcttcaatataattccctcaaaatctacttgtgatcattttataatgctttggtcaaaagtgctgattttgtaattaattaatttttgtcgtttctaatacgagggtgaaatttgtttcttaaagtaaaaaaatggaaacttgttaaatgttttagaaatatgacaaagaaaaaggaaaaaaaaaaaaaaaaaagagtggagatacgaacttttatataagaagaagagaaagttgcagcacttgtctgaatattattatttaagataaaaccgacttttgcagtgaaaatctcttctttgaatcaagcggcggagacggcggcggtgaagaagaagaattagagagagagat

SEQ ID NO: 8862 - DNA, 3000 bp, Unknown
  misc_feature (1)..( 3000): cDNA_ID_2178947_gDNA_ID_1971906_Annot_ID_176989 3000 nt of promoter + ATG
aagtcttgaacgttgacttccaaattaggtcgctctgctactcatcaatcactaatcttcttcctttccctaatcgattccaaaccttctgtggtgatggcaagcttcaaagtcaacaatgttattcatatttgtttgagcgtaactgtcaccaaaaaaggttcctagatcaaaaaagttgaaagttaattagtttccgaaataaaacagaggaacaaaaggaagcgtgtttaagataaaattagggttttcttaggaaagcatataaataaattgcatagctgtcgcaaaacctctgtttactcgagtgcgaagaaacgacggaaatggttattaccaggagacggagacccttttcaattctcgccggaattaggattctcatttcctaggtagattacttgtattcacggaatgtaagtcttaactagggtttccatttaactggtcttttctgctcgaacgatcgtcttttaatctctaaactctttactgaagtagacctattttgaactatttttgtttactaatttagcgattagtcatcgacgacctagtaaacttgttataacgagggtatattattacgtaacgatcagttgcttatatttgttatatcttattagggtttttagcctcttgaccttactcatgcaactattgatctgataaacatttttgagtttgatttcgggaaaattttgatatgtctagtcttgctcagagtctcgagctatatctgaatacatctcgtctgtccatagatcaaaaggctcataacttgtgaattacgaaagctacaaaacaatgggaacacaaacattgtgaatggatattgaaacttatgagttcgatccactcgcatcaatacttacatgggtataatccattaaatctaaagacggactataaggttgtgaatgcaagcaaggcgaagctagagaaggttctagatagatttattacgaagaacgattcaaaaagaatagcttcttgactaataataacttcacattgcctcatctccttgattcaatgatccaatttgaacatccaacgatccatatgttttcaacaacgtcggtcaactttgactagtatacattaaaagactattcttgttgtcttatccagccatggttgatattttctccgattatattgttttataagttatatgaacagtatatgaaaatcttgaaccaatagaaacgacgaatcatacgttactcagcttgactatgaaataacaaagagtattcaagcttggtggcgccgtttgttttttgtttattcactaagttactctaatttagttgtataaatacactctcccatttgtgtatttcttttcatcaaccacaaagatctctctacttcaataaatctccaccttgctttaagaacaaagtcttaacaaatggcaggaatcaaagttttcggtcacccagcttccacagccactagaagagttctcatcgctcttcacgagaagaatctcgactttgaattcgttcatatcgagctcaaagatggtgaacacaagaaagagcctttcatcttccgcaacgtgagtaatatttgtcaaaacaaaatattgtttcatttagatactgaacctttagtctgaaaaatcttgaatgttgttttgcagccttttggtaaagttccagcctttgaagatggagacttcaagcttttcggtaagcagcaaaacacttaaatttagacctaatctcaaattctgtttttgacaattgcaattaaagaaagcagaaacactcaacttttttaatgttttgttggcagaatcaagagcaatcactcaatacatagctcatttttactcagacaaaggaaaccaacttgtctcccttggctccaaggacattgcgggcatagccatgggcattgaaattgaatcgcatgagtttgacccagttggttcaaagcttgtttgggagcaagtcttaaagcctttgtatggtatgaccacagacaaaaccgttgttgaagaagaagaggctaagctagccaaggtcctcgatgtttacgaacacaggcttggtgagtccaagtatttggcttctgataaattcactttggtcgatcttcacactatccctgtgattcagtacttgcttggtacaccaactaagaaactctttgacgagcgtccacatgtcagtgcttgggttgctgacatcacttctaggccttctgctaagaaggttctttaagtgactcacaaactgttaatcagaagattgaataaagtggcgatgacctcattgccctaattctcataaacaataaaagtggcgatgacctaattgccaaattctcatacactctgtgatttttttgtgtgtgtctcctctgttttttttttttggtttgaatgtaatcttcaataataatgagtcttgatatataataaaaatatatttggtagcctaaagtttagctactaataagtagtgttgatctcttatgaccaaaaaaaagaaaagaaaattagtgttgatctcattcttgaaagttgacttaattattctaatttttgaaagctgacttgagacttcatttttgccattgtaaggaagaaattgactgttgacttttaatgctttgcaatttaattagaatattaaacttcatagttagacagaatcacattcagttattaaaatatcacaacactaactccaagttaggtctgctactcatcaatcactaatcttaacaccaactccagcttagttatgctactcatcaaatcactaatcttcttcgttttcctaatcgattccaaaccttgtgtcattgtgtgacaaagtcaacaatgtttttttctttgggtctaattcgtaccaaatataagtttctagataatattcaaagaagttggaagttaaatattatttccgaaataaaacagaggaaataaaaagcggataaaagttttgttttttttccgtaagcgtagaagaaaattga

SEQ ID NO: 8863 - DNA, 3000 bp, Unknown
  misc_feature (1)..( 3000): cDNA_ID_4362174_gDNA_ID_1971909_Annot_ID_177025 3000 nt of promoter + ATG
acgaagatttgaagacggatattcaacgtatatccaacggtgatcgttctccgatcttgtcttctcatcccatcaccgagtttctcacaaggtatgttacttaagtcaaccaactatatcaatgattaatatcgtttcttttgtttttacaactttatcaaggagtaccaatccccttgtactaggtcaccatccttttagtaatgactaaaacgttgttataaaaaaattcaatgacgggattttgatcaccataatacaaattgttaaaaaatattttatagaatactatacagtttttttaccgtaattaatttgtaatgttttgtgtgtattgcagctctggaacatctgctggcgagaggaaattaatgccgacaattgaagaagacataaaccgacgtcagcttttaggcaatcttctcatgcctgtgatgaatctgttagtatattacttttaacattattaaacaaaattgtaacgatttataaaattaaccaaaaatgtttaacaactacagctacgtgccgggattagacaaaggcaaaggtttatacttcttatttgtgaagtcggagtctacgacatcaggtgggttaccggctcgtccagctctcactagttactacaaaagcgactacttcaggacgtcggattcagacagcgtctacactagtcctaaggaagccatcctctgctgtgactcgtctcaaagcatgtatacgcaaatgctatgtggtctcttaatgcgccatgaagttaaccgactcggtgcggtgtttccttctggtctcctccgtgccataagcttcctccagaacaattggaaggaactttctcaggatatctcaaccgggaccctaagttctaaaatctttgatcatgcgattaaaactcgaatgtcgaatattttgaacaaacctgatcaagaactggctgagtttttgataggggtttgttcgcaagagaattgggaaggaataatcacaaagatatggcctaacacaaagtaccttgatgtgattgttactggtgcaatggctgagtatatcccaatgttggagtactatagcggtgggttaccaatggcaagcatgatttatgcttcatccgaaagttacttcgggattaacctaaatccgatgtgtaaaccctcggaggtttcttacacaatcttccccaacatggcctacttcgaattcctcccacataatcacgatggagatggaggagtagaagcaacctcacttgtggagctagctgatgttgaggttggaaaggagtatgaacttgtgatcacgacctacgcggggctctaccgttacagagttggcgacattcttcgtgtcacggggtttcataattccgctccacagttcaaattcatacggagagagaatgttttgctaagcattgaatctgataaaacagacgaggctgatttacaaaaggcagtggagaatgcgtcgaggttgcttgcagagcaaggaacacgtgtgatcgagtatacgagctacgcagatacgaagactatacctggtcattacgtaatctactgggagctacttagtagagaccaaagcaatgctcttcctagtgacgaagtcatggctaagtgctgtttggagatggaggaatcgctgaacgcggtttatagacaaagtcgggtttcagataaatctatcggtccgttggagatacgtgtggtgcagaacggcacgtttgaggagctcatggacttttccatctcgagaggttcatcgattaatcagtataaggtcccgaggtgcgtaagcctcacaccgatcatgaaactgcttgactctagagttgtgtctgctcatttcagcccttcgttgccgcattggtcgccagaacgacgtcattaggtaaaactttatgatagatatcaaaccgatgctagctgtgcggttttagaatatgaagctctgtttctgattctaagtctccctattagatttcttattatgatgttgtgtacttgtgtttagggttttgctagcattgcctgctcagtcttctatatactatggatcttcttgtttttatattttgcttgttacacaatctctgcttatattatgtagatggtcttgtttaaaaaactagtttaataattcataatataatttagttgtgtggtttaaaaatggatctgccaatacttgatgccttgatggatttgtgttttccatcaaaatcccatatccaaacaataaagtttagaatttgaatagtttggatatgtagaaaataagaaatcatgactaatgatactttttttttttttttttgatattcaaaaggttgatgacaaactccaaaaagtaaaaagtaataatgtcattgttaatattttgaaaagaaaaggggtacatcatatttgaggataaatacaatttaatgaataaaggaaataactatttttttcattaatattaaaagttaaaaccaataaacatatttcaaataaaattatacaaaacttttttttttttttttttttgccgtctaaatttattatttattacaaattatgagaactgttacatagacgacggacaattcctttcgatccttattagatccacgacagacgatacctcttctcattttctatgctcttgatggacatcttcaatatcttctcttgcatagaatcctgacgaacagctataattgtacaaaaaatttaaagaaatttaatttagtaatcatgttaattatataataaaatctcctcattaatatattcttcacagttgtttcagatcgaacccgtcaccaagaactcagaatctctttctctcacaaccgtcctctgatcccgccctcatctcccaactcccacttgtataaatccaatttccaaaactcctccgacgagtattttgattttcccagtgacctgagaaatcgactaactaattccctatcggtaaaaaaattcggttgacctaaccctaactagagagatg

SEQ ID NO: 8864 - DNA, 3000 bp, Unknown
  misc_feature (1)..( 3000): cDNA_ID_3043803_gDNA_ID_1971909_Annot_ID_177043 3000 nt of promoter + ATG
agcttcctgttgttactaccaccccgactaagctcccatcaatccttgttgtaaatgttcaggtatattgtctagttccatggttaaactgttcctcttttgcatcgtctttggtgtttcggtttaatgatgatgttgctatcggaatcatagattccattgtatccagctgcaatttttcatggtgaaactgatggagaaggaatgaatttcgttttatactttaaactttcggataactatttaaaggagcttccaccacattttcaagaaagcattcaggtagtttaatcttccacgtcgtgattctgtttttttgtgctgtactcttgtgttgaaaacgcatttttgaatcgctttgtctttggatatatgcagagattactagatgatgaggttgagaaagttagaggctacactactgacacgaatgtaccctttagagaacggttaaagatattgggtcgtgttgcgaatgtagacgatcttcagttgaatggtgcagagaaaaaactcatgaatgcttataacgaaaaacctgtgctttcacgtccacagcacgagttctactcggtatgtcacaattatcataacaaatgcaaatcctattgaaacttgcaatataatgctgaactaacttaactttgaaatttgatcttgtagggtgaaaattactttgagattgatattgatatgcatagattcagttatatatcgcggaaaggatttgaagcatttttagacaggctaaagaactgtgttcttgatgttggactcacaattcaggtaatgtgtttcaatttgttacttctttgatgaatttttgggtctaattgctgtggttatttaactgtataatctcattttcaggggaataaaccggaggagttaccggagcagattttgtgttgcatccggttaaatgggattgattacatgaattatcatcagttagctcttagtcaagaagtcctatgatactaaacaaaagatatgacctttttttttgttgttgttctttatcttcttttcttttgttcctcaagaacacaaaatctaagagatacatcgttttgaagaagaagtcaataatggaagcatgagtatatacatgatacatcattccgaaacctgatcatttctcggagattgcctacgactctgtacagtggccaatattgctcatcataaatatcataattcaatgagaaatcaccaacaacagtaggatttaatgatgtcttcggaaaaccgttttctgatattataatgatgtatccgtaagaatatacatattttctctaaccaaatcatatcaaagctggtacgactataagtttcagtttgcttttactggttataaggggatggttttgacttttgagcaatgatcttgacccggggttttgagagaggagcaaggcaaagggctttcatatgtttcctctctagtctctacatgatgaacaaggcatttgggtttagacttcgtttaacctagtgtcgtcactaagtttctgttgtctctttataagttttagcttcttggttttggttttggcttttctatttgtgacttttgtccctctaactagttttggattcggtctctttcttttgggattagttttccaaagattttaccatattccgcatatcttttataattctcgtaacttagaaccaaattcacatcaaaaagaaccaaagattttgtctctctacctagttttggactagtctatattaaccgcgaacggaaatataatgtctaaaccaacctcactaaacccataaagtagcaggttgacaaatgtgcttaaaatttttcttctacaaataattgaaaaattaatcttcaaatattattatactaacaatttttaggtttaaaataactttagtatcactctttttgtaaatattataattcttctacattacattttttttaacacattaaatatccttatcaaatttgtaccttttgttttaacattaaatttttatttactcattttagaaaaagaaaaaaaatgttgtatttaatagaagaggataaaaattggaaaaaaagaagtaaaaaacagtaacaataaagaaacagaacagtgtttaaaaaaaaaaaagaacaaaaacaaattcacgtgggcgaaccgggaggaaatgaaccataattcgagtcggtccaatcaatcccatttcacaaaccgagctttggaaagacgctagattgacttattaaatacaacgcgagtcggtcgaaccgaataatcaatcctggttaacaaaccgagcgtcggagagacgctacactgacttgaatacaacgcagaaactcactgtttatatataaactcagcctcctcctccacttttcattctacgtacaaaaatactcttttaggctttttgattccggcgaggtctctgcttctttctcctccttctccgtcgtctccatatcgtgatacttcaggttacattcctcaaatcctcttttttgattctacgacgaacgacatcgctttccttaacagtttcggcgggtttatcacgcctgaatcctaatttttccaacatctgacgaacgagtacagaaatttctggttatttatcttgtgtgacattcgtgagacgtagtttagtttagttagattgatttccatcggattcatcataggtaatatttgttgaagtttatgtcatcgatttggttttgattttttgtactctgttttctaatttgatgattcctggttatgaaatacacaacttgtgatgttgccttgttcaatgtcgatcctatatacgactaattgtgttgttaattggtgtaaattggttcgttttggggttcttggtgtatatgattcatgatttggaacttgaaaagttccattacagtgtttgctaatgtacatgtttttttgttgttgtaccaggctagaagaaacaattcctttggctgagccgagagacgtgaatatatagacgaag

SEQ ID NO: 8865 - DNA, 3000 bp, Unknown
  misc_feature (1)..( 3000): cDNA_ID_2053753_gDNA_ID_1971909_Annot_ID_177047 3000 nt of promoter + ATG
tatttggggcaaatcagatggattcgagccagaaaacaattcggctaatctaacatgtttagtctgggatacaacaacagtaatcgtaaccacaaaatcatgaagtttcttatgtttatgacaaaacagcatgtccacaatactcagaaatctatgattttaactccagttcatggaggctggttgagatcaatcccgtctggtttttacatagcgaccgcgtgtctttgaagggaaatacttacttttttgctcaagatttactaaaggatgcaaagattgagaattatttactctgttttgattttacagcagaaagatttggaccgcatcttcctctgccggttcactcttatgatgacgtgactctatcttgtgtcagacaagagcagcttgctttgttatatgggaacaacgagacagatgattcattagagatttggattacaaatcagattgatcccaatgcagtgtcgtggagcatatttttgaaagtggatatcaaaccgcttattggttttccaaaagacttcgatcctgggagcttcttcattgacgaagagaagaaagtcgttgtggtttacgatttggacggacatttatatagtaccaagaagaactgtgcctaccaaaggctttacatcattggagaagatggatacttcacatctgtaaaaatcaaatgctctgactcacctgaattctctgcttatgctccaagtttagtgacatacaaaccaaccaactacgcaaaatgaaaagaaaaaggaagaataaaagaagaaagatgcagattacttcttagttccatttgcaatactttttttgttacgtatttttttgcatcgtctcctgttttcattcattgtctttcatttccttttgaacatttattaatttgttttttgctatttatcatctaactaagtatttagatttatcatgatattttaggctttttttcaattgttagtatcaaatttttcaatataaaacaaattatatctaccacaatgcagattcgtcttgatgttctttgtgattgtcttggcattctctatatgtttttgtggaagcatcggagttttagattagatatgattaacgtaggagttcatgtagaagtagagagatgtgttgtaatttataaaagaggcttcatgataagatagcttttgttgtttgtcttcacttccatggttcattgtcttccttttccattgatgtgctggtgaatcacaaagatactcatgcatttttcaatcctaattttggcatatgtaagtttttttcaattttgtttgctttttaatccaggcattggatgaaaacagagagaattcagggctaaagaaagcctttgatttttttttttttgtgtgtgtgtcaaaacagataataaccttttgtttttgggtcgtttaattgctatatgatgcatcaaatcttgtaaacaagagtgattccaagaaggtggaagtatttccgcatgattacggttgttgcttcacaaaataggagacggcttgtttcctctgccgaaccattgacatgtaaaggtaaatgttcatgttttgagtgattgattgattcaagccttaattagcatgtttatattctcttttccatatcatcaactaacattcataccagttgtttctaagagatttagtcgctggcatgaactaatatatatgcaatagtatagaggcacacaaataaaagatttgatcggataaagatcataagaaaaatcagagacataaagaacatgcatcatataaaataaatgtaattgaaagggataacaaagaaaacatttgataagcattgacctatgaaggcgctacttcacaaaaacacgagactcttgatgtgatttgggtaaaccttcatgttgtacatatagtctttaacaaatccatagcggcttctaaattcatcacccacaattccttcaaccgagacttctctaatactgtttctcctcggatcaaaatatagtagataaaacgattcaaacaatatcgatggtgcaaaaacaatctcaccagcatcactaacaccataaaagcttggcttttctttccgtattaggtccatttcagaaagagtcaaaaacgcgattatgcgtccattcgtgtctatctccattcgtcaaaatccatatatcaatagacgggaatttaaaagtcttaactagggctaaccttcccacataaggtaccatataacaacttttcctataataaccctctggaagtttgatctggttgaacttttcagatctaacgtctaagctcattagtttgcgttccacttcaataccatcaccaacataaacagttgctccatagtacatgactccattaattagtatatgcatcccccacaacgtatagtagatcgatgcctagggacaccgttggttattattctccatgatcttagtccttaagctcccagtgtacgaatgcaaatcttcgagtctctctagtaacatgtagtagtacaatgattcaagttttcaatcaatctgatcatatttacgctaccattcttgattagatgcttatcctgctcaaaaatgtattcagatatatattaacaattacttttgaatggtatcaaatatttattaactaattctttttaataatttaatccaattaaattttaactttttaatggattcaaatatatactcattctttatttagtgttaaaaaaaaaaaagtagctcaactggaaatgtatgtaaattatatattaaaagctgacccgggtctagaggatgtatggaaagccaatagcatcgtttcgaacattgcaataatattgtgtggtgacaagcaacacatgatatgtccgtttagaaacagacaaaataagaagaagaagaaagagtcgtggaggattcttcattcttcctcatcctcttcttcaccgattcattagaaaccaaattacaaaaaaaaacgtctatacacaaaaaaacaa

SEQ ID NO: 8866 - DNA, 3000 bp, Unknown
  misc_feature (1)..( 3000): cDNA_ID_3043774_gDNA_ID_1971909_Annot_ID_177044 3000 nt of promoter + ATG
ggacagaataccaatcctgcacttgtacagagcaacactttcagtacaccttccactggctttgggaacacgttttcaagctcttcatccttaactacaagcatctccccctttggtcaaataacggttagtttttctgtaactaatttaaatgccagttcacttcagagttgatgtctctttcacttccgtttgagttatgtagggatttctaatatgagtttatttttgcagcctgctgttacgccctttcaatcagctcagccaactcaaccattaggtgcttttggtttcaacaactttggtcaaacccaaataggtatgtgaatcagtcaaaggcaccctgaatattatcatcttgaatactcgaagccaagtcttgtatgtttatgtttctgaagctaatacaactgacattgcaggtgcaatgggaacttttagccaaggaaactttaagcaacagtatggtctctctgacctcagtgtttccgactcttatttccgactagataccactagtttaattgtactttggaagttgcgtctctggagcttaattcttttctttttgttttgttttgttgacaggcctgcattgggtaactctgctgttatgcaaccaactcctgttacaaacccatttggaacacttcctgctttgcctcagatttcaattgctcaaggtggaaattcaccttcgattcagtatggtatctccagcatgcctgtaagtttttctgcctttttcaacacccacacacaccaccctttttcttcataacttctttccaaatttgaagcaaataaaatatagatattctcaaagatacaatgttacagaaacaaatgactactccatgttattaccctgaatattttcctttcttctcaggtcgttgataagcctgctcctgttagagtatcaccactcctaacttctcgacaccttttacaaaggcgggtcaggctaccaacaagaaagtaccgtcctagtgatgatggtccaaaggtatgtttttctattttctgaattttggctttgtcttgaatatttcagtctttagtgatgtttactgaaggtctttctacctgtttgtttcaccaatgtttgtccaggttccattcttcagcgatgaagaggagaattccagtacaccaaaggctgatgcgtttttcattccaagggagaaccctagagctttatttatacgcccagttgaaagggtaaaatcagaacatccaaaggatagcccgaccccactgcaggagaacggtaagcttcccttttttttttcattcattggcttatttattgcaagatttagagctttgtttcaattgcaaaaagaagcttttcattgtcccaatagctcggaagatgatctgcttgcatattaatatagtggctgaatttgatcatatctgaccccttattacatttgaaattcaggtaagaggtcgaatggggttactaatggagccaaccatgagagtgagtattttaaatatgcatttgtaacaaaattgtgattaaagtttgtgcattggtgaggccattcactgactctactgttaatatgtgcagctaaggataacggtgcaattcgtgaagctcccccggtaaaagtcaatcagaaacagaacgggacacatgaaaatcacggaggcgacaaaaacggttcacacagttcaccaagtggagcagatattgagtcattaatgccgaagttgcatcactctgaatatttcacagagcctcggatccaagaactggctgcaaaagaaagggttgaacagggttattgcaagcgggtaaaggactttgttgttgggagacacggttacgggagcataaagtttctaggagagacggatgtgtgtagactcgacctggaaatggtggttcagttcaaaaaccgggaagtgaatgtgtacatggacgagagcaaaaaaccgccggtgggtcaaggattgaataagcctgcggtggtaactttgctgaacataaaatgtatggacaagaagaccggcacgcaagtgatggaaggcgagagattggacaagtacaaggaaatgctcaagaggaaagctggggaacaaggagctcagtttgtgtcttatgatcctgtgaatggcgagtggactttcaaggtcgaacatttcagttcctacaagcttggagatgaatatgatgtgtagaaaaggaccaaagtcgttgtcatatgtagactagtgtctcgattattttttattttttttaccttgtggggttttgtctattggtcttttgcaatataatgtcaaaatgatacgtcttttacctcattggctcaacctggaaaaattcaatattcattttgttgttttcgccaattaatataataatatctcactaagaagcagaaaaaaaaaatagagtcgtggaggacacaaaactggtctcaccagttgtttcgtggtttcttctaaagatattattagttcctaatttataaaaaattttgatgactttaatcacatcctaaaaagtaaataaaagaaagattataaactatttagagaattttttataattttattgattagcttttataattttgtaaaatttctcaaataatttttctattttaataatatttttcatgactttctatgactttattttgtgaaaaaaatgtagaaagttatgaaccaataacataataattcaaatcattaacaatcagaaattattatattttaattgaataacacaaaacttttactgattttataagagtatgaatctaataactccaaatttatgaagattttagattactttttacaaatcttatttgaataacataaactttaacatatttttaaaaagtcttgattgaatatcaacagattctacataacactttaaatcactaactttttttttgaaatcatatataaaccaataacaccccctaattgtatacctaaactaaaaataatttagacaaaacaaag

SEQ ID NO: 8867 - DNA, 3000 bp, Unknown; identical to SEQ ID NO: 5682
  misc_feature (1)..( 3000): cDNA_ID_2993959_gDNA_ID_1971909_Annot_ID_177048 3000 nt of promoter + ATG

SEQ ID NO: 8868 - DNA, 3000 bp, Unknown
  misc_feature (1)..( 3000): cDNA_ID_2178872_gDNA_ID_1971909_Annot_ID_177037 3000 nt of promoter + ATG
gaaactagttttgcatacaatctagctccgaattcagaagaagcattcaataaaaccatttctgctaatgataaaacctcatatgctatttaagaagcttacgcaacagtgaaaactactaacttaccatctccaaattttctcaaaatatttgtgtaaataaaacctgatagtggtctttgcaacataaagaataccttttccattgagcgaccacaaaaagccttcatggcattcacgaaatcattgtacttctcgaactgaaccacaatcttacaatggagacctgatatgaggtctccactatcctcatctgcgtccttacctagatcatcgtcctcagcaacattaagattcctatagaggattagttaatgcagcggaacatggaatttatgtaaactatcggaattatattaacatcagattcattggtaaacagaataaatgatccgaagaatactgagaacacatggtaagcaagttcaatacaatgattgtaattagtcttcagataagatttccatacaaaatgtcatttcttttgaactacatggacaaatactgtatactatgatcaaatgtagatgcatcaaatctatccaaagcagcacaaaactacttaattttccaataagcaagccatagatcactctcaactcacatagtgtcacattcttgaagcagatttatgaatgttctcttcactccgattgaaaaaaaaacaatcctaatcaagctggacatgaaagatgacaaaatcttacctaattttcccaaagctagagaagattgtatgtgtaaccaacatagaaggcttcgatgaaactcgtggctcagcaaaccatcttgatggcacacctctaagtataatcgtatcagcctctctccttccttcccttgaatgtcctgcaaatcacaatcacatcaattaccacgaaaaaatcgtaaaatcaaaatccaaaattgaagaaccaagattaccaaaagcgtaaaactcctcccaatccttcttcaacttctcgaaatcatctgaaatcggaagtaccacactaagcttatacttaactccttccaaattaagctcaataccattcatcttctccaccaaactcttcctccaatccaaaaacttcttctccaattccttcacatctctctctccatcattctccttcttcttcttcttcccatcgagaaaccctaaatcgcgtataaacaacgatccatgagcaactggctcctcacgcttccgtttcttcaagtccttgtgacgacgaactacgatgtcttcctccggaactgtgacggaggttacgacagagtttttgaggtaatctattaaggatcgcttgagttgccattcgtcgatggatttggatacggatgggactactgggtggattgtgagattgagcttgacgcgtgagacgagagcgagaccgttctcttcgatatctagagtttctatcggagatagctcttctaacgatcgcatttttcgccgtcgatgcaaaattcaaaatcgcgattggctctctctctcagagtgtcgtcggctattgagtacagagaacaggaggatactgaaaacagtggtaaaccagaattccaaatcggttatttccggttctcttggtttccaatattttgggaataaattgcataaacggtccaaaatagagataaattccaatgtaaattttttgaacattgactgaaaccattaataaatgttgaacgtttcatccaatgcctaaatatatatggtaaggattcttatcttagttatgagttttggcatactaggactgaagcattgcatcctactgtgagttttggtggtttgtgctcttctgttgaccttagcaatgcgtccatataaattgagtatggttggattactgttcatacctctagcgaaacattgcaattcgctaggtctctattgtggggttagatggcatgaaccattagttgcacaaatgaactctaatgcatatcatagaggcttgtttttggatatagtttacgaaatattgagatgatatctttcatacaaaaacaaaaaatgcatatgatgatgacactcttacatacacttttggtactatctatccgcgtatgattttaagataatttttttgagcttttactttaattagaatttagtgatatacttgtatgcacaaatttatacaagcaatttatgaatacggtatacacaaatttatatacaaacagttagaccaataccaaaatttggtgatatacttgcaaacctagcatgctaacgaatttgataacttacatgccttatcccatctagcgaaacaaattagagagattaaactgttggagataaatttagaactcggttgatcacaactcaacatttcgcactcaaacattacaaaaatactagtctcctacatcaggattacaaagtggtcttccgcatttgttcatttggaaaaatatacaaccaaacaagcgcattcgatgatacaaattcttgtaccacattgaaattcacttacaatattttaattcgaacaaatttagctgagaatgtctttattgatagcaaaaagttgtgttaatttatattttacgcatccacatttgtgtgttttatgctttcacatttgtaaagaatttctttgaacagttgtgaaaattttcaacatttatgaaagaaaagaaaaaaccacttaataattttcaacatttatgaaatttgaaaaatgtgttaattactacgtgtttatgtaaagttatatgacccgtcttgcccattctctccccgacgaagacacacacagacaaacaaatcctagcttagcaccgtcgcgaccgaattcgaaattccggtaacccaatcgccgggaaaatccaccgctcgtggctaccgatattgattctaatcggatctagcggctccctttcttcgtccagatctcgtacttcattcgacctcgattcgctgtgcaagttacg

SEQ ID NO: 8869 - DNA, 3000 bp, Unknown
  misc_feature (1)..( 3000): cDNA_ID_2178852_gDNA_ID_1971909_Annot_ID_177030 3000 nt of promoter + ATG
tttgattaaaaaaaaaaaagtttctacttaagaaaattaaaccaaaccgaaatcatcaggtcacctacattgtcttgtcctcgttcaaatggtttttgtctctttatttattattgattcatttcttatatgcactgttcacattgtgtttgggtgaaaaagttatatttccctaatgctgtcatatctatggtggttccatgaccttccaccactaatgtttaaattgggataaaacaaaaactattttaaggttttgactaaagactgacctcacctcataaactaattcaataagagagtatttataaatgagaagaaaccacaagatattttacttaaacaaaaaaaaaagctcaaggtttttcattttagcaaaataaaaaaaaatcagctatacatcacgagaatcatcatcataaatccctgcatgcgtgctacacattcgacaaactttaacctagttatagtagtgacggatccataaagtttttgtatcgaggtcaaacataacggaatagagatatggaaatgcaaaccttgaaatttaacggtggcataacagtttttcttttgctaaatgctaagatcaagatagatgtctcactgtctcagtctcacgatggtcgacccaacattttttgatacataaaacctaataaaatttcatagaaaattttaaattcgtgattttctattattaaatgagacaccaattactaaactacaagatttttacacgaatttgatattgcttgaacctaaaatattggatgctttctaaaaagtttgttagactttaggacttgacaagccatatgtcgcacgattctcttgagaatataacagttataggaagaaccatgcaaactccacacaaacaatgacttgatggacttttcaacatcatcctattgagtatgatataaacactcgtttccatcttgattcactcgttatctttgcattgatcataaaatttagtttcttagggcattttttcggtgatatctttaaacaaaaactatctacaacattgtggactgccctttcgttccgtcttagtgtttttagtcacctttttaccatcttttcctatttagttttctttccaactaaatcttgtgatttagtagatgaatagataaggcccgcctaaatagattggtataacatataaatgttaattttaatcgatagtatttgggttctgaatagtaaaatagtaatctacaaattttagatatttaagttaatatttttatttaaatataatttcagtcttatgtattctattttatttatgcacactcaatcttatcgatgatatttgaatttaaatagtagtccacacacttttgttatatgtaatttagtattaagtatgataatgatatttgaatttaaatagtaatccacacactttatcatcttacacattcaatttcgcaatacaatttaagtatttatttcatcatattaaactcgattttaattatacatactaagtgataacaattttatatcaaaataatatttatatcagatcaaatttatatcttagttaatattaaaaataattaacacttaacaaaacataattaatataaaaaatccacaaaatattttgaaaactaacatggtttaaaggcgcaattgcaaaaaagctctttttagtgccctttttcaagaataattcatcttatggattaaggcgtagagtctagggatattttaaggaaatagataaattgtagatctagctatgattaggattgttaacacaccgttctaaaactcaaatcactaatgtaaagtcaactaactctcgttgtatcaactagctatgcctaataaataaggattctaactctcattgcaaatacttaattgctaaacatgcattaatatcaagtttgattagttcacctaagtatctaaacgagacatattcatatctagatagttaagctcatctatgatagtttaaggtaataagcgccctcttagatcttacctattatcctaagatcaagttctaggtgatcaatataaaactagcattaagaacaattaagatgaaaaaacctaaagatatttcgtaacaggttatcgatctacaaattcatttaaatctctaatgagagaaaccctaaacccaacaacgtgattactaagacatgattaaaagaacacaaatcatattctaaaaaaattgcattgaattaaaataagagaatagagttaaaggagtttagaatctctcttcgagaagttttgattcttctttccttgaatataaaatctctcacacaaaaggttaagtctaaacaatgacctcaaaaatctatatctaagttaacaaaaacgtggagagactatctttcaaataagggaaacttatgaaacttctgcaattcttgataacttgattaaaacgtggagaattcctttggtcccgatacaagtgtggtgtcgatcgacaccatcgcatcaaaaacgtctatgttgcttttccttgctagaaagcttccaaatttcctattttgctctatagctctcaaaagtggatatgcacctgtaaagacttgaaaacatacgaaaagaactaaaaagactcttaaaaccattctaatatcatgtttgaaatgagtaaaaaccattatatatcaatatccaaacgcaattcgaaccgaaatctgaatgtttatatctagatagcggtatgtctttttggcctagttaatgcattttcatgtttcaaacggcttgtcaacgtttaattcatatataaaatgcttacatatgaatttgatgtataaaacggtaacaatttgaaaaatttgggtattaaatgatatttttccaatttgattggtcaaacaaaaagaaaagggtattactgtaaatttaagttacattcaaatgcttaaaggctccccctctagggtgggattctgagattcaaatttcaaacggcactttcagatcgagacgaag

SEQ ID NO: 8870 - DNA, 3000 bp, Unknown
  misc_feature (1)..( 3000): cDNA_ID_2178863_gDNA_ID_1971909_Annot_ID_177034 3000 nt of promoter + ATG
cttttaacaatcaaaatagtattggtcaaacaatatttctgcattaattagttttttcatatttagcaaaaaagaattaattaaaaaattcatccctattcgacttcactttctctctctgcctgaaaattttgatcggtttctggtttctcggcgaaagaagtaaagtggccgacaaatagtgatctcgtgaaggaatcagtgtgtacagtggaagaagatgatacatttggctggatttacatgttgcttaggcggcgtcgctctttatcttcttaccaggagcacaggcaggttaggttttttttcttgtctttactatttacgaattacgataactagggtttactgttattcggtggtaatgttcttctttcgtgggacagagatatcaaatcaatcactagggtttaccaactcaaggatttgggtaatgttcctgcattgttctgcatttcaattttaggtggatgggttttggttatgtgtttgatatcattcgtttttattcagaacaattagtagaagtagagagcaaggtggtacctttgatcatcgcagtatcaggagatgttggctctgagactcctattaagtgtgagcatagttatgttctcggtgtatttctcaagagaacggtatgtatgaattggattagataatctagtttttcgtttctgtgattttggatatgttaaaaagaaacgatttttttcaggcagaacaacaggttttgagacgtaattggagattttcatgggttcgaaatagtacattgatgcagccgatgactaaggaagtcccctggtatctggtatgtctgttggactttgattggagtgtattactttctaaagtcatttacaaaatatgatattggttgcctataggacgacgggacaggtcgtgtgaatgtagatgtatctcaaggtgaattaggcttggcgttgacggttggtagtgatgtatttgaaaaggcagagccggtatcgcttgttcaaggagcgttgggttatcttaaaggctttaaggtcttttcttttcctttcctaccacttttcattgatttgcttttgttttgacaatgcttatacattgtggcaccattgttgtctatagatacttggagtaagacacgttgagcgtgttgtcccaattggtacaccgcttacagttgttggtgaggtatgtcttttatctgttagcggtccaaaatacgttttatatctctctttgttatgttgcttaccatgttaacaggctgttagggatggcatggggaatgtcaggattcaaaaacctgagcaaggacctttctacgtcacttatataccgctagatcagctcatctctaaattgggagatttgtcaaggttgtttcttttctctgtttttgcctattcttttcttcgaaaactatgattgaaaaaaattctaaaagatctctttcttttggcaggaggttcaagtatgcctccatgggtttaactgttcttggtgtgattcttatttcaaagcctgtgattgaatatattctaaagagaattgaagatactctagaaagaaggcggcgacaattcgcactgaaaaggtatgacgcaccctaaccacagccacgtatgaagtattcattgcgagttgcgagttgcgagttaagtgttgggtaacttgttgcagagttgttgatgcagctgctaggagagccaaaccagtaactggaggtagtaatagtatctatccattagagtttgtactttgtagtagtaacatgtgaatcctttttctgcatacacttggaattgctctgcttacaaaaacgtcttaccaggtggtacaagcagagatggtgatacacctgatctctgtgtggtttgccttgaccagaagtataacaccgcttttgttgagtaagtataagaccgcttttcttctaaaagctcttgaaaaccctctcactgatcaaacatggcatcttttgattcctctttttgtttggtttggacttgtaggtgtggtcatatgtgctgctgcacaccatgctccttgcaactaaggacctgtcctctttgccgggaacgaatacaacaagttttgaaaatttaccgccattgaaggacaaaactcagaacgatttttacaagcgaacaattactagtcttgtacatatagtaaagcctttgtatcatgagtttttgactagaaatttttttgcattgatagattgtgattgaacaaatgctaatataaatttcaagcttagatttacatttactaatgaagttatataatcacgtttcgatgttaaaataagaagtgaaaaaacgtgaacggcaggattcgaacctgcgcgggcaaagcccacatgatttctagtcatgcccgataaccactccggcacgtccactttttgttaattcctcactatcttaaatatctaattaccgttaattattacaaatcaggttgggcttaattaagcccaaagttaaagacagattagtgaaggagacagagaaagaaacagctctaaaatggtaatgaacgagaaactagagagtcaacggtcatagcgttgaccaaatctctcactctcaccagccaaatctctccaacttcctctttctctccacccaaatctcgccggcgatcgtcactgacgaatctgattcgtccccaacactcaacgggtaagctctctctgcaaaattcagatcgttctagctcaatctcaacatcggatcaagattcaacttttgttcttttctcttaaacaaagcttttgatcattagtgaaatctaaaatattaacctttgaatctgtaaacttaagcttagagaaccctaagatcaaaactaaaaatttgatctttcattgtcacttgttggaagcaattcaaaattctgtgttgtgtatattttcaaatttgtggattgttccaatttcgataaagttttgatttttattccttttgttgtgtgtttttataaggaggtagaaga

SEQ ID NO: 8871 - DNA, 3000 bp, Unknown
  misc_feature (1)..( 3000): cDNA_ID_2178869_gDNA_ID_1971909_Annot_ID_177036 3000 nt of promoter + ATG
caaatcaatcaatttcagtggtggagctgcaattaaaagggaaaaatatgttatgatgattacagaaaccagtacaaaacaaacgatatgtgataattcatgttccaaagagaacatttaagttagatcttcatttagatatatagtccaattttcacaacttagcttcagattctacccaaaagaagttgaagcgctaatgtgcgttagatttagaggtaaaaactcattacagctgaactgttcacttaagtaggggacattatccgacttaggcttgggtaatatggatgttgcattaaatagggattcccatttatgattgtgcaagtagaaaggaattacctgtgctggtacgaagttttaggtatatttcatcacgaccccttcctgaagctcctttgctaagcctatcttgtagtgaatgccttagtgcacctgtaatacacacattcgaaaaaaacggaaatattagtcaaatattaatctaatgcattgcatcttacatgcagaaatagcttcacaaatcattgctaaattgcatatgtgcacatagggagctcttacttgcagaaacttgttgatttttattgtcaatttgcaagattattgccttgctgctcagtgattcttctctactcaaatcaatgataataggagcccgtgtcgcaccattctcacccgtcggctatccatggtaatcatagtagacaggacaacacaaagtggttactttaagaaaatgtatcagccaatagtgacatacacaaattgccgcgcactcaaattcaatacacaacttaccagaactggatgcccaattaggctatttagaactgcagactttccagctccctgatccaccaagaaaagtgaaataacttcagtcttcacataagaaatttttcttttctaagcctaagaagtttcaatcacaaacacatagcaatattttttctgtcttccaacagataagtgttttaggaaacagagtaaatcacatacacttttcgttctgatatacactttctaaaatagatttctcatagtttcaaataacaaacgcatcaaccttctctactatagtaatacctcccaggtttgaatctcatagaatcaaataatccctaataaagagagaaacgcaacaaaacaagctacgaacgaagagatgaagaatacaaaacatcctaccaaactcctaggttacgggaccatttcgaaaacacctcatcgagatccacaagatccacgatatggcaacaaaaatctacactcgatcacagtataaaacttacaacaaacgccaaatacagtcacatctcagaaacagaaaaagcgagagaaaacccaccacattccctagggcaacgacgttgagagaagtagctggccgtctagaagaagaggtctcatcgggatcttcgtcagcgagcagagacgccgcttgtctcatcgaatccgaaagctgagacaactcatcgatcgcctccatcgtaacttgcacagcgaatcgaggtcgaatgaagtacgagatctggacgaagaaagggagccgctagatccgattagaatcaatatcggtagccacgagcggtggattttcccggcgattgggttaccggaatttcgaattcggtcgcgacggtgctaagctaggatttgtttgtctgtgtgtgtcttcgtcggggagagaatgggcaagacgggtcatataactttacataaacacgtagtaattaacacatttttcaaatttcataaatgttgaaaattattaagtggttttttcttttctttcataaatgttgaaaattttcacaactgttcaaagaaattctttacaaatgtgaaagcataaaacacacaaatgtggatgcgtaaaatataaattaacacaactttttgctatcaataaagacattctcagctaaatttgttcgaattaaaatattgtaagtgaatttcaatgtggtacaagaatttgtatcatcgaatgcgcttgtttggttgtatatttttccaaatgaacaaatgcggaagaccactttgtaatcctgatgtaggagactagtatttttgtaatgtttgagtgcgaaatgttgagttgtgatcaaccgagttctaaatttatctccaacagtttaatctctctaatttgtttcgctagatgggataaggcatgtaagttatcaaattcgttagcatgctaggtttgcaagtatatcaccaaattttggtattggtctaactgtttgtatataaatttgtgtataccgtattcataaattgcttgtataaatttgtgcatacaagtatatcactaaattctaattaaagtaaaagctcaaaaaaattatcttaaaatcatacgcggatagatagtaccaaaagtgtatgtaagagtgtcatcatcatatgcattttttgtttttgtatgaaagatatcatctcaatatttcgtaaactatatccaaaaacaagcctctatgatatgcattagagttcatttgtgcaactaatggttcatgccatctaaccccacaatagagacctagcgaattgcaatgtttcgctagaggtatgaacagtaatccaaccatactcaatttatatggacgcattgctaaggtcaacagaagagcacaaaccaccaaaactcacagtaggatgcaatgcttcagtcctagtatgccaaaactcataactaagataagaatccttaccatatatatttaggcattggatgaaacgttcaacatttattaatggtttcagtcaatgttcaaaaaatttacattggaatttatctctattttggaccgtttatgcaatttattcccaaaatattggaaaccaagagaaccggaaataaccgatttggaattctggtttaccactgttttcagtatcctcctgttctctgtactcaatagccgacgacactctgagagagagagccaatcgcgattttgaattttgcatcgacggcgaaaaatg

SEQ ID NO: 8872 - DNA, 3000 bp, Unknown
  misc_feature (1)..( 3000): cDNA_ID_2179402_gDNA_ID_1971910_Annot_ID_177068 3000 nt of promoter + ATG
tgcagctaaccaaacagacccttaagacatttctcatctacaaaccctagaacagagctccatggcttaattaaacctaagagagcttaacaagaaaatgaatgttaaagagtgataatgagacctgatgatgtgaacataactactaaaactatgagatttcaaattttaggagcaagttttcaaacaaactaataaagtcaaaggtcgtaccttgctaaagtctcaagtttttctttgtttatctttagaaattctcacttcattgtagactaaatctgaagaagaaatcgaagaatccacaaaccaacctctgcttaaaccctgcagactaaatcaacccaaacagaagtcaaaaatcaacccaagaatgagaagaaaaaaaaaatagaacagaggatgaacacagaaaaaaaaactcaaagaaaaaatagatgaacaaaagatccaaactttttgttgtgtaaaagaagaaagtcctaaaacccttttagagaatcaactatttatatataagatgaactaaaaacaataaatgcgacaaaaattagacattattgttattagctaacaccaatggagattaggcccacggccagcgacatgaaccttccactgtaataaaaattaaaacttcgaaaacacacaaaaaaaaacaaagcaataatggaatcgaatcattcaccagaaacccgcatgaaagtttaacaaacaaaacttgcttaagtgaaaataatggtttgtacactcaccgaagttagatctctctgtttctttaccttccttgaaaacttacaaacaatagacagattcgtccaaagaaagagtagagagaaaagagagttaaggttgaagatgagagagaaaatgagagctggagatgagaaacggtcagagaggagaagaagaagaagagagtaatgtgaaatgacggaaaaggacaaaagacagagagagtaaaaaagcaaagacgagcattgggagattcaaattgagttttcctaaaataccctttaaagcaaaggctattgacaccggccgttgcgactttgtttagggagagatctcgagatgcgcgaaaggtgtttttggtcattttctaataggcaatatgtatggacttgggtgggtttattaatgggccaactaagatatcaggtaaaagtgtgagttgattgggcttatctgttttgttacgggctcagctcgatttgattaataaagaaacaggttccgattggtgaggcttgggactttcttcttttagagaaaaaaagtttggatcttttgttcatcttacggacaattgctgaaaagaatctaaaaaacaagaagataaaatatatgtctagctcttcacgtcataggcgttaaggtggaatgcaaaaatgccaaaacgaaaaacgatttattttttatagtcttttacatgaaaagctttgagatttttttgtggttcagttcctccactaccaaagaaatggacaatcactttctttgtcatttgactcagtgactcatgttcatcctactttacttttttctctactatcgtctatatcaaccgtctcggtgattggtaatgccaccaaaacgataatggaatgatcaatgactaataataatgaaatcaataaaacgataataattttttttgtttattcttattttttaatctctaacaaatttatattgaataaaaaaattttactttaaaaacgtaaaatttacaatttagttaatgaatgaattttatcttatttagttataatttttaaacgtataagatgaattgaaaaatcatttgtcattttcacgttctgttgtcccgtaaaatgtattcgacagaatcaagttttaaaaacgtgaaaaatcaaccttgttttgaggattttaaaatttcggttattaattcttttctatcttccaaatttggaccagtaaattcaatatactatgggaccagttgattgtaacatatgaacacaatttgcaatctatcctaaatttaatttctcatgatgacgaatattcaaaatttccctctatcatttattatatagtcatgaaaaaattagtattttacaaattatgttcctcaatcaattatagtttaatgtataaaaaagtcagggtttcaaattttgaaatgacgtttctacagaaaacttttgttattacaatttgaattctggaagagaaatctgcatttcgatactacttataaaacggaaattttattttcttaatcacaaatatttcctatcattatactttagagaaaatttgactaaacttagaaataaaatatttattttccctaatcaatggtaaatattgacacttttatagatactttaaaaccgtaattataatttaaagtctatatgtccttccttttgtcctaatgaataattcaacgcactctcttcgtcttccctcttccttctttcttgtcgaggtcaaagatggcggattaacctgcacatctcaaagctttgtagattactagtaaacaaagcttccctaagcaactttaattttcatggattcttcagctcccaagtcatgaacttcaatacttcactagtcataatgtacgtttttttttctttcatttccattgatcctggttccactcttttagtctctgtaatttagggttctttgaattctgcaatctaagaaagaaatattaaaactttctctgttttgtttgatgtgatctggagaaaaagaaagcacttttatgtttctgggttatcaaattcttgaaattagattgtcttggagtttgtgatgtgatgtaataagaccaataaaaactcaacctttatgtagctaaacccaagtcaagcttaacaattgattaatataatgtatggaattagatggatcgtttttcacattgctcctcacgttcctcacacacagtgaagaccactatcgtttctccaactcccttcacgttttttccctctccactcacaaatcacaatg

SEQ ID NO: 8873 - DNA, 3000 bp, Unknown
  misc_feature (1)..( 3000): cDNA_ID_3043873_gDNA_ID_1971910_Annot_ID_177086 3000 nt of promoter + ATG
ttttaaaattagacatttcattattaaagtaggattatttggaaatataataaataaaacgataataaagtaggattatttggaaatataataaataaaactacttataaaagtaaacacttcattaataaaattaaataacataagatttaccagtgcatgattcttacctatatatatatatatatatatacaaagtttgtagtgaacatatatataattatttatacaagaaaaaatgagtatgaaaaaatgtgttgtattgatggtggtggtgttggtagttatggtggctatggtagatgacgttgaagggcggctttcatatgctacatgcatggatctttgcgagaccaagtgtaactttttttttacacatccagaaaaatactgtaaagataaatgtaaccgcaaatgtcgtagacttcaatcatctcagtaataatctcttcatttattttattgaatttctttttttttctttttatgttgtgtgtataaaatttttgacataaattatatgaaaaaattgcagggtggagactataggaatgagaaacataaatggataaataagttgacaaaatagttgatatatttgtaaacttgatgaagctttcatattaataacaatttttttttagaaatttaactctttttttgcaactatatatgtgacgtttcaaaattaaaatacatatcaattcttcatccattagtaaaaccgtaatataactctcatgtatattataaaagattgcagaatgacatagttttctatagttacattttaatctaagaaattgtaaaataagaggttcgaaccctgttttagttttaaaactaatggtataatgatgtaactaagtacatattttagctataaaacttataagtacttcccgattaatagtatcagattttgcattaggtgagttatcattttaagccaagacatctgtaatgaaatgttcttgaaaatccgacaacttgtatgtctctttcattatctttaaatcataaaaagttgcttcaatgttaagagttaagacacaaaagcaatcgtgttatatcattgtctcttgattccacacaaagccaactctcatatttattatcttcatctcctttcaaaattaaaaagaaaatatcaaaagaagatagaggagtacaaaccaattttttagggttaaattttgtattataaattatcggactcaaaatgttcatcaatacaaagcaatatatcatcaatgcaaatctttactttgcatcattttcaacatgcaaatctcatcttcacttgaaaaccttcctttggttcttctccttcatgtctttgtatgcaatatgggacattatacacatattttttcatcgattgagtaatctattttaaaaatatttgaatcacattatatgcataaaaaatctaatattttattaactataagtattttatagaaatttaaaataaattaaataaataaagtcaaataaaagtgaaagaagaatcatatatttatgtttaaattagatagataggttttaaaaaattagcaattaataaaaaaggcaatgtttgtggagtgctaaatcttttattttgatattttttgatatttttatattttaataaaaaaggcaatgtttgtggagtgccattgtaaataagttgaaaggctaaagttttttttatctcaaatatctccaaaattaattatatcattttaaaatatattaaataaactatttataaaaaattataagatttagaaattagttctaaaattaaacatttcattaataaagtgggattatttggaaatataataaataaaactataataaagtaggatcatgtggaaatataataaataaaacgtaaacatattattaatgacattaaataacataagatttaccagtgcatgattcttacctatatatatatatatatacaaagtttgtagtgaacatatatataattatttatacaagaaaaaatgagtcttaaaaaatgtgttgtattgatggtggtggtgttggtagttatggttgctatggtagaagaagtagaagggctttcatatgctacatgcatggacctttgcgagaccaagtgtaactttttttttacacatccagaaaaatactgtaaagataaatgtgaccgcaaatgtcgtagacttcagtcagctcaatcatcccagtaataatctcttcacttgttttatttagtttgattaaaaaaatattttgtataaagaaattgacatgatttatataaaaaaattgcaggatggagactatagaaatgagaaacataaatgggtagataagttgacaaaatagtcgagatatttgtaagattgatgaagttttcatatcaataaaaatattttttaaattataaaacttttttttataccaattataaaagaagcaaagattaaaagaagatagaagagtgaaaaccaacatttttggtttacttttgtagtattataaattatcggactcaaaatgttcatcaatacaaagcaacatctcatcaatgcaaatctgcactttgcataattttcaacatgcaaatctcatctactccactcggaaaccttccttaattgggttcacaacttcataagttcacatcatagatctgtgttattgggctgttttatggcttgtaaaagttggactagacccactaatcattatagcctggactaggcatgtattttcttttctttctcctacaatattatctctcatcaatacatcaaaaccacaacaagtttatgaacaaaactctgaaccgggaagttgttttctgataaaccaaactacacgccgtcttgagttgattgatgacgtgttaaaagattaatggctgattgtcattttccatccaatcacattaaaacacgtcaggataaagcccgtttcatcactgcttctctttcatcaaaagttctttaaggaaaaaaaaaaacgtca

SEQ ID NO: 8874 - DNA, 3000 bp, Unknown
  misc_feature (1)..( 3000): cDNA_ID_2179485_gDNA_ID_1971910_Annot_ID_177093 3000 nt of promoter + ATG
ttacctgatatacacagtaagagatcaacataagaactgaaaggattagagcaatcaacacggacaattgtcttccagaggttgagcccaacatctgcggaagctggacaatgacgaacggaataactgatatagccattattcttgcagcatagctggtccaaatatcaacagttacaccagaatctacaaaaacagagtaaacaacaataaggaacccgcatatagtaaagcacaaatactaaattctactgtattcatcagtcccttataaaaacccatacaaacgaagaatcctgaaggtgtaaccgtataagacacttccttgttaccttttaggtgaaagcctttggtgtcttggttgtttacagcaattgaatcacgaagatcacacttgccaaccacagtacaagttccccagataacagtgagaagcataacagtggaaccagcaagcaaacccattcccacagagacttggctttgagcagttgctgcatctccagatagtccagacactgaaagccaaaagacattgtttataaccaaagaaacaccaaacacataataaataacccatcaagataacaactccacagaaaaaaaagataagattttgactaaaaagcacaaagtgacaagttatgagttcatcggttaacatcagtgtatcatcatcatcttttcacaatttggtatcacaaaacccaacaaaaattcactttttgttaatccctgtatcatcatttgattcacagaaccaatcaaatattcactttttttgctctctcaaaattcaaagaatcttcatcaaagcaaaacaaaattcgtctatttcactcaaaatgaatttcaatttcgcatttgctacataactcgcacacaagcatgacactttatagatcgaattgaatcatacgaaacctcaggatctaaatttgaaactttgaaaaaaattaataaacattttgacatacccatgataagcatagcgtcaggaagagcaccaagcatcggaagaaacaaaccaccgacaattccaggtccaaggatctcaagaagaagctcacttccagcagagagatacgtcgcagccgtaaacatgagaaatccataaaccaaaatcagaaacacgtttccaagagcggtcttagtacacggcataaacccgtatgtctgctcacaagcttcctccttttcctcagccggagccgaaacaaccgacttgataaccgatccggaaccggcgagatttgaaccaccgtcgattccatcggagattagactcgttgaagatgggtttagggagacgaatcgagcgtaagcagatgaagtgaagaagagaaggaagaggagagagatgagagatctgaatctcatgattgatttcgaaagaagaagacaacaaaaaaaggtgaaatcaaaggaggacgttgttcatggagaaatcaatcagtcgagtttttgtggatgagtatgtatatatatacacacacacatatacgtgtacagataataaagttgtgtgtgtgtaattcgtgtggggcagttttttttgtttggagaagatgataaagctaataaggaagacgaagaaggcagtgactaattaccattttagccctgttaatttggcactacaccattatttatgtagtaagtaccaaatcgtttgattttttccaagattttcttctgtttatgtttaattagtcaatttaggaatataccaataatacaaaatttgggtgtataagaaaagggggaatataaatttgttagtgtaagttattaataatacaaaatttggttacatctagaagaaagatgccaaaattagttgttacttattagggtgtgttattaataaattaacaatataaaatttgcccactacaaaaagtaaaagtaaacgtattgggtactacaagtacttcttccctacattaatgggattcctcaaattcaacaatggatttgttcagcatttatttattttcttttttagcattttgatatttaaatactatataaatttaaatactccactagtataaaagttcaaaaacagataaggtagtcatcaattcatccggatttatgatgatttttttttgtggggtagatatgtctacttttttcaaaatttcggttatttatgagaggctgatttttttctatatatacagcataaattaattttcttgcaatatttatttatagttaaaaaattatttgaccttagtctcaacttaaaaaactttcggggtcaatcgcaacaatataataggcagaagctgaaaaaatgaaataaaagtaggtaagggcgattcgggaaccgtacgttttatttgcttagaaacgttcgttagtcattattaccagatttgattacgcggccacacttgtaataataaagcttaagagagggcaaaaatcaaatatttgtcaattttgccgacattatagttagattagataccatacaaaaatcataactatttaaaatatgatttgtctgaattctgtatttatagaaaaatatcaaacgaaagtgttgaccaaaagagcggtgaagacgctgacgctgagctgcgtttgagtaatgtcaaagaatcaaaacgtcacgtagttttgtctttaaaaaaaacaacacgcatgtttgggtattttcgaatgagatcaataattgggcctagtttagtattggcctaaagcccataaagaaaggagcgaaatctgaaaagtcagaagacatctccttgcacctttcttctctcttgctgtttctatggtggtggtattagggttttggaaaacccctaatctcacctgagaaaagcttcatccttttgtgacttttaaacttctcttacaagtcttcttcgtcatcctcctcctgggttcagcaattctcgccgaaatcgtaacctccgagctcacagttctgcaacttgtgggtgtatattgattcacaccaagatttagggattaagggta

SEQ ID NO: 8875 - DNA, 3000 bp, Unknown
  misc_feature (1)..( 3000): cDNA_ID_2179474_gDNA_ID_1971910_Annot_ID_177090 3000 nt of promoter + ATG
acatgaaccagaactacagaggtcctcctccaccaccaaacatgaaccagaactatcagggaccaccagcaccaaacatgaaccagaactatcagggacctccaccatcaaacatgggtcagaactaccagggaccaccaccgccaaacatgaaccagagctatcagggacctccaccgccaaacatgaaccagagctatcagggacctccaccgtcgaacatgggccagaactacaggggaccttcactgccgccaccaaacatgagtcagaattacgagggaccaccaccaccgaacatgaatggaggatggtctggaaactaccagcagaacggtggataccaacaacaaggtcagggtggtggaatgcagcaacagccttacccacccaataggaaccagagttaaaccgtcttgtgttttcatgtataggagcggataccattttgtggtcagtgttcttcagtttgtcactctgctttgtgagagagagactgagagttttagtctaataagttctgcatgagttattgtagccagcactcgtcaatctatttatttattatatcctcaagtcaaccttgtttatttatttagtggcacaagaaaaaaagagaaagctataaactaggagtagaaaagagttaatcaaaatccatcgatttcatggcaaaaagaccaaatctcgataaaacatcacttcctcgttggttcttagcagcttggatctgatcagcaagtgagatatctcctcttgttcgctctttccttatcaaatccaaatccagtttctccagtttagctgcaactgaaacaaccctatccgttccaattgcgatcttaccaagacttgttttcttcttgtgaatctgacaagacatttaatcaaaccaaagaatcatcaagtgggtttctaatattcttcagagtcatcaacggagtagtttttttatacctttgttagtctcttctttagtttagaacgtgaagcaatggttggattctccctttcctgctttggctttcgaatctttccttctcgtcggtctttctcctcacgttctttctttttttctgcagctctcctcatcttctcggtcctggcttttgcagcttcttttgctatcatcttggtttgttccttagctcttgctttctcttcagctaactgaagctgctcagatgaaaaatcttgttttattttttcatagctgtcccagtcaagttctgcctcgccacttcctcctttccttgcagcttctgcaatgttttctgaccacgatgacatgaacttctcctttaatcgcttcgatcttgaccgttctgcccaaacttgtttcactgaagctcttatcttctccttggtttcattactgcaagagacaaacttagcttagatatggctctagcttcattgttctctattctacactcaatactttacaaatctacctgtgtggttgttgatgatcggacatcttcttccgaacctgcaagatattgaagagaagaaaaagttctttgccaaataagttttcttccttcacttctcactgtaaacaatagaagatgggacaacaacaaaatgtccctgaatttgcattgaatcttacttgacttcaccttgggatttgtcaaagcttcgattgttctctgcttgattcgtcttcgagtgtctgttaaagagtatcaacaatctcactacacaaagcctcaaagaagaaacaatgtagaaaatcgaagaaaagatccttctaccttcactgtgtttccttcctttgttccatggcacctttcctttattagctaatccaatcttccttctcctttcctcttctttaatcttcctatcactatcactatcagcttcagtatctttgttcatagctttcacttccaaaagacttgaattgacttctttcctatgaatctcaaacacattgtacaatgaacctacagatttcaactccaagtgtctgatagacctcaaagaagcaagtgaattaggtattctcaaaacgattggttctttgagagtccaatagattgaatttgggaaccaccaagcgcattggaatggagcacgagttgattgaaatgtgcatttcatctccattgataaacctctgcaaaaacagtatttgaccaaatcgaaatcaaaataggtcaaataaaatcaaacaaccagtacctgaacgataaatcaatgaatttctacataattttcatcaaattagaaatagatttttataaatccttgatttcagagatgatttcaaatcacaagagataagagtttgagaatgcagaagcactcacaaatttagtgacatacacggcacggagacgaacaggagacaagagaaaactctgaaaagtttccttttatggtttctcaaacgcgaaagccattgaagaagaagaagaagagtgcgcagacacgaagagagagagagagagagagagagagagagagagcgggagaaacagataaggaagatgaagaacactaatgggccgtgaatgggcctaatctttattaataccttaaattacaatttaccctatttcaaagtaaagtacacctttgttttagaggttctctctctttactactataaactcgaaagtgtacccaaatgagtattatcttcatgtacatattaatttatttagtacggttttgatttatcattgaaatatgagagctgaagagacccaaaaaaatcggaataaatttgaacaccacaatgtgtaaagattttttccctaaaatcaaaaacaaattagacgaaaaatcttaaaaattaaattacgaaaaagacctgaaaggattaaagtaaagagggtggtggtatatctcatcgagtgtctcgcccagcttcttcagtcttcaccacataatattaataaaaagcattttcttctttcgattgcttcagattcgtcagctcactctttcctctccagaagaaaccctagacatctcatcgccaaa

SEQ ID NO: 8876 - DNA, 3000 bp, Unknown
  misc_feature (1)..( 3000): cDNA_ID_2179498_gDNA_ID_1971910_Annot_ID_177100 3000 nt of promoter + ATG
ttgtaaaaaaatattcttgataatatatgatgtgttcgtatcttttttggtcaaaatatattatgtgttcaaaactttaaatcaatatattgaaaattatatatttgattttgcgcgtaagtcctaaagtaatatttttttccatcttcatttgtaagcaattttgtgtcatatttcttagatgtgcataaatgtagataacattttaagttgatcactaagcaaatgtgtgtatttttgtatgaaaagtactaataaagtgtgtctcaatctagaccacaaaggtctaaatccatatgcactatagattccatttgcatatgataccttagattacgagtagataatttgttttctcttcttttagttgcctttaactattttttttaataaacttccataaagccattgttgctttctgctaaaacttataagagtatttttgggagaccgtgtccctcactacaataacctcaaagagtatgtacctctggctctgactgtgagctgtagacttcaattaaaaaaaaaatcatcaaacaacaaatataatctattatattaacactaatttaatatcaaattttgtatagtgttacctatataatttatgaaattatctagacaatgcctcgttattaaaaatctaattatagatgcaacatgtgggatcgtttagggatccacaacactttagacaaaatcatgacatgaacaccatatccattacttcacttggatctcattcttcctatgcccccacagaaaagtcaaacactgatctggcaagtctttgactgccgtactcattccgccacgtgtacagctttaactttgttcctataaaaacacaactaataaacagttaaacacattcacacacaagtaagaaacgttttgaagatggaggataaccggaaaactaccccaaactccggcgagaccaaaccagagacgtccctggagacgtcactatcatcagacttcgagtttggatcattgactcccacatctccatcacaagaccccttctcggaaaattctcccgctgatcatcttttcctcaacggccgtctattaccacactcttttccaacgagcacgataacgacacgttcagtgtcacgtactaccagcgaaaacactttccggagcgatagttggagcagccgaagcagtgatagtagcagcccgacatcttacactccaagaacaagcacttgtaatatcttcaagatcacaagttctagtaccggtcatgggaaagagactaatataacatgttttggtactcggtccgaagagattatgtgcctaaggcccgcaacttcttcaaagaaaacaaacacttgcatcagcaaagaatactatcacaaaccatcgttaatattggatctaaagaagagaccaccggtggaaaatggtaaagccgtaaacacgacaaataaggtttcgtatttgccgcaatgcaagaggaagaaagcgacggagattgtaacggctcagctttacgggtcgtattcacggcggtggcagcatataactccggtctttaaaagagaagggtcggtgaaaagtaagggaggagggattaaggtcggtggacggaaaaagaagtcgacgaggaggaagaagccgaagaaggcggaggagagaagaggaataagtagtaagttaatgaagtggtggaagagaattctaaaggcggtggtgtttgcttgcagggagtgtcatgcaatggagcctcatcagatacttgtaaatgatgatgctggtgtgaaaaagaagattattaaatgtccataatcaaaatttcaatgtttctctaatctatttgcttgtgttttctgctaatataaacaaactttatgggaaaaaaatatttgagacaaaacttttgcaaaaaaattcaatccaaacgatgttatcttacataaattaacgtttgtctttttgcatttttctcttcaaaaacccacagagaacgattaattagtgacgatgtaaaaacatgatcaaaataactagggaactccaagccaaaaatacctagagtaatcaaagtttttttttcttttgattattgatgaaagattaagaagcaataaaatcataaaacttttaaaattagaaggaaaaaaactttaaaatttagaaacatataataattaattactattcagaatcgtaaaaataattaaaatcacaaaatcaatgtctcgtcaaagtttgggctgggcctatcttataacttgttaagattaggtctacgttaaactaagcggtaatgataactcgggccaggtcgtttatctttacttggatagtaaactggtgaagttcaggtcgggtcgggtcgggtcgtcgtaaaggtttttcgtattgtttttaggaaattaaaaaaaaaaaaaaaacagaagtagaaaacaaaaaaatgaaaaattgaataatcaaaatcgagaaaacttgataatcgaagttcttgttcatcttctcgatctcttggtgctcgagaagcattggatagagaattttcttgggaaggtgatagaacaaaagtaagatctgtatatattcaacgcgtcttcttcgttcaactatataaggtaatctgaatgcgatcctagaatttctctgatttttgacatcgttatcgtagaagaaattggacttgtatgctttggtgattgatcgaattggagatatttcaatgaaggcgtttcaaattacgtgtatgttcaaatttttgctatcttatagtgggaaaaaattttagtctttggtttttttgcttgaatcgagtaaagagtctatatgcattgtgattatcagattttagttatagatctcagtttttgggaatgcgtagtgtaatagttgtagggttgactcaattttgggaatttgattgcaagtgagattgtgcttgtaattggcgaatttattgatgtaatcaagtatttgcagagggggaagaaggtggttttagttgtggaaatg

SEQ ID NO: 8877 - DNA, 3000 bp, Unknown
  misc_feature (1)..( 3000): cDNA_ID_3043848_gDNA_ID_1971910_Annot_ID_177097 3000 nt of promoter + ATG
tcaggtgccttacgttactgaaacacaattatatatacatacaaaattcatccgtattattttcttggttaaatttagatcctggaatatatgagatttttacaaaataggagtatgaacttataaagcacctatatattaaaccaaaaaaatttaaaacttataagcacctataaagaagaaaagaaaaagagagaggagcgtacgtatggatgcatcaaatccgaggagacaatcgcatcaagaaatggacggacacaatctcgacgagtcatgtgtcccaaagaaacatcacatacgattactcaaaaaaatggaagtatccgcaggcttttacatcaaatcaaaagcccattcaattttcctttcactctctatacaaaaagaaaactctgcacttttgagttttgatcgagtacgaatatttttacgtgctttagtcgatatgccacatatgttgactaaagaaacaagtaatggatcttcaaactgacattatatattgcacccattaattcttttgttccagccacgaactcatttaaattctctatatgagattgtccaaccaagagaaaaatattattaaaataacggcacaaatatgtcttgaagtttaaccaaacattaaattggagaaaaaatgtttttatcaaacttaaatcgaagcaaactaaattcattcaaaaatttagagaaagctgaccactcagtcatatactatacgaccatttcaaagcaatacgtctcaaaatcatgacattctatatcatgtgatagaatgtttaatgtagtttaaattagagtttacatctctaaatgcaattgaaaaaaactccacctctaacattttgctcccaatagcaccgttttgtcatccgcttgcagacaaattcacaccaacttcaaagcatggtctaattaagatcttccaagaaccagccatgcacttgagatctttattttttttttagtgatgtcttcctgaatatcttatttttccaccgacgattaattgtgtgaaaaaatgagtatattacaagtcttacattttatggttacataattaattatatatgcaggcaccagtgaactccctgattcaccatcttgtttttagcctacataacatatggaaattaaagactgcatgtcacgcacaagctattttgatatggttgttttacttgtttccaaaataagtaattcatggcaaatggttcatggaatgttaagaaggttcacgtgcaagatatccaagtggtattaatgggtgctcagagttagcgacaacatacatagctattagctaacatagtctattctttttatttggatcgttgaaagcactaggatggactatatcttatataaagttatattttgtctcactattttagacatcaaaatttgcatacgaattgttcagagtttatcttatcaatccaagagctttctgagtggcatgcgatttctatcagtttataatctttcgtgataagtatatacatattttcttataagaaattgataggtatgtttcaatttctattttctattttattttattcaacgtaacttaagtggaaaatttgtttagctactgttagaagtagaaacataaccttttttttgtaaactcttcaactccgattttaagttttaaaaaccgtgtggttgaagaaaatagtctagtgggtgttgtcgtgttgatcttttactaaattagttgtgatttaattaaataatgcttatgagacttgtaataggctcacgtaatgatggaaaacttggaattttctgggagagacttgctaccacatttctacttacccagtaaagtattagtcggttattaggccaatttatttggacacaagtaagatcaaagaatctttttcttgataagaagtaatcaaagacttcacataactagaaattaaagcagtaacacttttattgctgaaaattccaaagagcaaatcatgtgaaaggtctttccaagtgggagggaaaaaaccccaactgattttacttttggaaatattttaatgtcaatgtgacaaactgacattataaaatttaatagcattgtttgcggcgtaagtttattatccttagtataagtatctttttaatacgtagaagtaggattattatgaaacattcttcatttccattatctttgaagaggatgataccatattaatgcttgattttgcaacacgcaaaagagtaggcgtataactacggaaaaagtgaaattgaccaaatattttgagtatcttaacttattaataatatccacgtgattgcatacaaaaataaaacaatcaacaatcaatccataatatattcaattcatagtagaatataatattatcgttcgttcttatcagtaactgaaccacttgtcacgcacagattaacattgcggctttttgacggagatccagtactcgtgattattgttattttctctctctactgatttaattaatcaaaatcttcgtatatattctccaatatacacatatttaaaatcctcttactattagactacgtactacaaaatatactaatgtatataaacagagaaatcacatggcttgtggactgtcctgacattgattaattattatgtcatcgcttaagcaatcatagttttgttgaatctttttttatttcttatagttgttgccaaaattatgtattttattacccactttagatacctctaattttacataagtttcaatataccttatatagttgactctattgctctagaattgtaattattttttattttgcaataagttccaatttcagcattatttttcaccgggaaaatccttaaaatattctatgcaaaatccaatatattcactccacatagataataataaaaaacttataaaagaaataattgaagaaaggctgcccatgtgggcacttccaaataaatctccagaatcgatgcttcaaatacattggatg

SEQ ID NO: 8878 - DNA, 3000 bp, Unknown
  misc_feature (1)..( 3000): cDNA_ID_3043857_gDNA_ID_1971910_Annot_ID_177094 3000 nt of promoter + ATG
tgtgtaatccatgagtttatatatataggatatataggattggtggtacatataaaacaattaaagtttttttattgtaagtaataatattagaaatcattaaatcctattagataataccaatcagagaaaaatagtaaaatggtgttgaagtgatatgaaatagtgttacaaaatagatggttatggatggtggtatcgctttcgttttcgttctaccgctttcattgtattgtttacctacaaatcgctttctatttattttattttttgttcgttaactgatatttttcttacaataaaggacgttaattgatagttgttcaaaattttcccgatagggcaatcgaatcattaatctgactgactaaatactgacgaaaaagagaaaaaagaaaagaataaaagagcatattctcttcgtggttttaagacagtagaaagaatctgatccaaactctacacttggaagcaatgttataaccccaaatttacatatactgtattatatcgtgtatgttcttttatttgttagtatcgtctattttgttataaacttgtgctttttttgctacatgggattttctcgacacatacgtgtatggctagtgttattttataaggctacttcgagtatagtataccgtattaaaatgttattagattgaacaaataaaatagatttaaacaaatgacgatgcattcgagatataatgttggcatgtcaatcagaaacactaagaacgatgccatagatttaagtgtatgtcgaattcattctactaatatgttgacgatgaagtcaaacgtctatcttagctcaaagtacgattgtttggttaaattgacattgagcaatcatatacgttcttcaatgtattaactctaatctcatttatctttattttagattattgatataattattattaggatgaatgtgtaggtctcgtccaagcctactaaatatagttttatgttgacatacctctctagtatgtgtaattatgaggattaatatagttttatgtttgttaccattgttagatttagttcaacatggatcgataataaattaataactattatctagaaaaatgtgttaaaattatatatctataattgtaaatagtttttaaaaaatatgtgccaatccatttatttttcttatttttaaattagtaatttacgaaacttcagttataaaaattgcaacaacattttcaaattccaagcataatttaacgccgtttcaccaacaacgccaatacatatatttaaacccgataataacaacgcatttgagtttgagttttttggataggatgtggtgtgtacattttcttagattggtcacaaagttgtgaagccataaattctaaattaatattgggcataattaggtgtcaagctggttcaacaaagaaagcacatggggacacttccccaaagcttgttatgttaagaaaaaaaaacaaataattaataactttgctccaaaattctatctaataaagaaaattaagatgaagtaagtaaataaaccacaaaaacatctcatttaatgaaaaaaaaccttttcgttcattctataaaaattagaaaaaatacattttatccatttgcgttaatttcttttctatttatcttagctaataaaatcaattcttaattaatggttggcatgcttcagcaaccaaacataaaataaagcaaaatcagctctaataaaaacgaaacatttacatatgagatcaaaagtgtacactaattgaagtcattaattttaagtaatcctccatttattataacctaattacgacaccgttttagatctataattagaactccatatacatttctaattaaattattttcaaatgcaaaaatgaccaataaaaaaacaaaatgaatcaaagaaaaaagagtaaccaatgaaaaaaatagaataaaaagagataaaatgcgaaataaataaaaaccttccgtgagagtgcaaaaagaagagaaattttagaatcaagaaaccgacgtctctctcttcctcacctcctctttcttctctgcttcggatctctctcttctctctctctctctccctgattaaacctctaaaatcaggtaattatctcttttaatcatcaccataatcgtcttctctagcttctttttttttgaattcccagtttcattttgttcctgggaaaaacaaaaaaaacgtattttttatttggtgggttttgtttgattgtgaatttatgttatcatcaactttatctgaagaaattgcattgttctgggtttgtttgttttcatgatttcaatctctgattgttgatttttgtttatcttgcagggagtttttttcttctggtttcggattctcagaaaaattagcaagtctttgtcttttgctgctggttgcatagcccccattgaagcttttttcctctcaatcttaatgttctcaaggttagagttttgttccttcctccggttctgattgtagttaggcgtaatgggctagtttcctttctttgtttatgtaataaagttttgatctttagcgtttgaagaattggtattgttttgatatctgcagctaaagtttcattcttttttttccatttattggaaatgatcttggctttaccatgttaccatgagtttgagaatgcacaatgtaatcttccgagaatatggtttctttaagggacatttatatcagtttctaaggctaaatcgaggagaacatgtgctttgtatgttttgctttcgttacttatccccaaaattagaacttgacatatgtgatagcttagttattagtatcagcttgagatgtaataatgttgcattagttggtgctttgaatcaagaagtttgatttgttactcagtcgttgtatggttgctgatgtctttatggatcgaattatatcagagggcttctgcagcaagcgaaatgggacaaagaaataggaatgttgatttagaaatg

SEQ ID NO: 8879 - DNA, 3000 bp, Unknown
  misc_feature (1)..( 3000): cDNA_ID_1397582_gDNA_ID_1971910_Annot_ID_177083 3000 nt of promoter + ATG
atatatatgttcactacaaactttgtatatatatatatatataggtaagaatcatgcactggtaaatcttatgttatttaatgtcattaataatatgtttacgttttatttattatatttccacatgatcctactttattatagttttatttattatatttccaaataatcccactttattaatgaaatgtttaattttagaactaatttctaaatcttataattttttataaatagtttatttaatatattttaaaatgatataattaattttggagatatttgagataaaaaaaactttagcctttcaacttatttacaatggcactccacaaacattgccttttttattaaaatataaaaatatcaaaaaatatcaaaataaaagatttagcactccacaaacattgccttttttattaattgctaattttttaaaacctatctatctaatttaaacataaatatatgattcttctttcacttttatttgactttatttatttaatttattttaaatttctataaaatacttatagttaataaaatattagattttttatgcatataatgtgattcaaatatttttaaaatagattactcaatcgatgaaaaaatatgtgtataatgtcccatattgcatacaaagacatgaaggagaagaaccaaaggaaggttttcaagtgaagatgagatttgcatgttgaaaatgatgcaaagtaaagatttgcattgatgatatattgctttgtattgatgaacattttgagtccgataatttataatacaaaatttaaccctaaaaaattggtttgtactcctctatcttcttttgatattttctttttaattttgaaaggagatgaagataataaatatgagagttggctttgtgtggaatcaagagacaatgatataacacgattgcttttgtgtcttaactcttaacattgaagcaactttttatgatttaaagataatgaaagagacatacaagttgtcggattttcaagaacatttcattacagatgtcttggcttaaaatgataactcacctaatgcaaaatctgatactattaatcgggaagtacttataagttttatagctaaaatatgtacttagttacatcattataccattagttttaaaactaaaacagggttcgaacctcttattttacaatttcttagattaaaatgtaactatagaaaactatgtcattctgcaatcttttataatatacatgagagttatattacggttttactaatggatgaagaattgatatgtattttaattttgaaacgtcacatatatagttgcaaaaaaagagttaaatttctaaaaaaaaattgttattaatatgaaagcttcatcaagtttacaaatatatcaactattttgtcaacttatttatccatttatgtttctcattcctatagtctccaccctgcaattttttcatataatttatgtcaaaaattttatacacacaacataaaaagaaaaaaaaagaaattcaataaaataaatgaagagattattactgagatgattgaagtctacgacatttgcggttacatttatctttacagtatttttctggatgtgtaaaaaaaaagttacacttggtctcgcaaagatccatgcatgtagcatatgaaagccgcccttcaacgtcatctaccatagccaccataactaccaacaccaccaccatcaatacaacacattttttcatactcattttttcttgtataaataattatatatatgttcactacaaactttgtatatatatatatatatatataggtaagaatcatgcactggtaaatcttatgttatttaattttattaatgaagtgtttacttttataagtagttttatttattatatttccaaataatcctactttattatcgttttatttattatatttccaaataatcctactttaataatgaaatgtctaattttaaaactagtttctaaatcttatgaaattttataaatagttttatttattagatttttaaattatatatatgttcattaaaaagttagtatgctaggtgagaatcatgcacaagtaattttttttttttttttttgctaaacatgtaaaaatcatataaaggaaagaggggttttacaaagagcaaaaaaaagcctacacaaaagcaaccttggccaaaaaaaagaagaagataaaaacaaggcttccaatagagtaacaaaagatttgggaaaagctaacaaatccatattaaaatcttatgatcctattttattaaaaatttatttattatttttccaaatgatcctattttattaatgatttttaaaaaaatagaaatagaggattaatttgtgtcttattcaacacaattatcacattttataacttaaattaaaaaaaaataataaatattttcaatctaaaaaaaatcattttgcgcttatgtggtaagtccacaattattctcattttttttttctctttttaattctacaatccttttggccaaatacatttaattacaaatcttctaattttcataaaattaattgccaaacacacataaaagtttttttaatatttaatgttaccaaatttcgatattttgaattttattaatgcgatagctggtagacaacacctactgtttaatttaattaactaatctacgtttgaatccaaacaactttatatagcattgatgagaaattgagaattcattttaattggcggtatatttagtcaatttaacgttgcctaatttctttacaattacaactaaaagttcaaaaaaataattaagaacctaactctaattctctatcctccaacaaaaacacgtaaatatcataattaactcaagttagtataaatatgtgaccggatccgaataattggatccaccggatcggagggaaaaaaaacaaacccgtgacgccattaacgaaggtcgagcttccttgacaccacacaatg

SEQ ID NO: 8880 - DNA, 3000 bp, Unknown
  misc_feature (1)..( 3000): cDNA_ID_3043893_gDNA_ID_1971910_Annot_ID_177071 3000 nt of promoter + ATG
acgaaattcaccgactgaatttgaattcatggctgctactaagacgatatttggatagttgtgatattcttcttctccttcctctccctctttcatatacatgtatacagctaagcttgatagatgtattataatttttaatttggttacagaaaagtcgttaattattattttcccattttcggtctgacagtctttttatcatctattttttattagaaagtttgatagagaaacatttaaaaaataaattaaaaaaccttcaataacagtactgttcgtgtcgtgttaacgtgttatattaatgatagtggtaagatagtggaactcggagcacatgcgatcttttaccgacgtttactgcagttgacgaccattgttttgaagtaaacggcagtttttggctcgccaatgtttgatccgacgtgtcacatttttgatcacaaaaagtttgatatggcaacgatttggtgaatatatcagcagtctgttgccggaatgtgtttgacaactaacgatcccaaggtaacacgttcacggacatagtgataatcaaactcaaagtgtttgctgcgagcgtgataatcaaaaacagagatcaaaagggcaacgttctacaagtatccccttttgtcgtttttttacaagttgcaacgttattattgcttctagttggataaatatcatgatgataccgacaaaacctttacaaatataacacaattaaaagttctttctatatttatcacatttcgtaagaatatagtattttatagacaattttacccatactaacgttatagtgagaataaaaatataccatattaaatagttttccattttttttaaatctaaaattaaatagttttccattatttaaaatttccaaggacgatacatgatcctttccccatagacactcctaattcatcaacctgacaacctgacaaccactacccaactaccttactgtcaattttacatcgtaaatttatttgaaaaaaataaaaataaagaaatatcaaaagaaaagtcacaatagattaagataatttaacaataaatcaaaaatttataatagaaaatcataagtctcataagcatttattaagatttatactattattaaaaaacattgtaatgaaaatatgagatcataattaaaatatagtaaacgaatagttataatgagtatagactcaattttcaaatttttaaacaattataaatatagtcaacaaagcattatgataaaaaaaaaatacaacattttgtgttatattaaagagacaatcctttgaaattttaacaaataatcaaaattaattgttatttaggaaaaaaataatgatatagataacaagttatatatatatttttctcttttattagaaaagttgcatatgattattactactttttgattgatattttttcatatgaagttgcattctttcgctatctaatattctttctttttttttttttttgacggatgctacctgattttcaacgagtatataagggtgttttcgtcatttgcacttcatcagaaccctaaataaagtccagagtgtttcttagttgtctgataaattttcctcctcttcggctaatcgttctgtgtattaaaaagtattgatcttttaggtttcaggaatgaatcttggagtgaagaagatggctgtgctttaccattatccttgccatgacggtgttttcgcagctttagctgctcatctctacttctcagcaaagtcaatcccttcactgttcttccccaacacagtctactctccaatcacaatcaaccaacttccacttcaagacatcagtcatctctatctttttgatttcactggacctccaggtttcgttcaccaagtctctcctaaagtcgacaatgtcgtgatcctcgatcaccataaaaccgctattgatagcttaggtgatgtctctttgacttgcaagaacgttactagtgttttggatatagagagaagtggtgcgactattgcgtttgactattttactcagaagttggttgaagaaagtagaggaagttgcaaagagatgaatgatttcaagagaatgagacgtgttttcgagtatattgaagacgcggatatatggaagtgggagttaccagagagcaaagctttcaacagtggaatattggacttaaagattgaatacgacttcaataagaaccaatctttgtttgatcagctactctcattggatcatgaaagtgtgatcaacagaggaaaacagagtttgtccaagaaacataaactgattcacgaggtgttggaacagtcatatgagattgttcttggaggtgatgaggagtttggacggtgtttagctgtaaatgctgatgagattacagagcttagaagcgagttagggaatcaattggctgagaagagtaagaatctgagtttacgaggtgttggagctgttgtttacagagttcctgagcttggagatgagaataaactgaaaataagtttgaggagtgttgcagaagaagacacaacaccggtttcacagcgattcggaggtggtggtcataaaaacgcaagctccttcttgttaaactccatggagttcgagcaatggaaggtgaaatagaaactcttctactacattaaactagagatgttgtatgaatcaggctatttagctcttgtatggaatggctatttgaaccggtttggtttacggcattgccaatgtcttggtttttgtaaactctattcttcatgtaccctttagaatatattcgatttgatcaaaatgaagaatcaaaaaaagagattactgtggacaacactcagccaatgaattggtagctggataaggttgactttgactttttaaaaatttgatctctcttcttccaaactgagtgttgttattgtcttagtttcatatatatatttttcttcctgtttggtttgctttgatctgtcttttgtagtttgttgtagtatg

SEQ ID NO: 8881 - DNA, 3000 bp, Unknown
  misc_feature (1)..( 3000): cDNA_ID_3043883_gDNA_ID_1971910_Annot_ID_177077 3000 nt of promoter + ATG
gcttccgtaagcatccgcactagtaaagtgtccaaatggatgccgtcaaaacaacaaaagtgttttaaaaaagaaccgaaacaagttttcacacttggtccttagcttctcaaactcttcttcgtcctgataatggactttaattatcatgttatacgtcaaccaagttatcagctaaccatcatcactttattaagtatatgcagccttgtgctcataatattcattatattatactaaaagtctaatcatatgaagaaaggaaaaaaaaaaaaagaggcttgtttatgaaattaaggagtgcacgtaaggccatatttataattctatttcagaaaatgtaaattcaaacacggcaaatatgttagtttcatggtgcatgcatgatgcatttccaactgtttctttttttggggatgaaaatgtatttccaccggttaattaacgaagcttctatttcatgtttccgttttcttttactttttttttttgtttttacttcatatatatcatttgacaaagttaaggctttaaaatggcagtagtttcttaatttgtttttagattttggatttatggtgtttagttcttagtttttttttgcagtaaatttttagttttatataaatgtatgtacccaatacatatcactatatattttatagtccaaaagaattttatgtgatggtgaaaagaaaaaaatgtgtgatcattcgctgaaattaataaattttgcagtatattaaagaaaactagaaaagtgagtacctaatattccaacaattagactgtatcactcatgcctgtcgtctgtcgactgttgacttgtgttataataaagacatttcaaattatccgaatattccattagcacatatgaagatatccaatttttgaataattggagtcgaccaatgtaaaatattcataacgtgacatcacatcacatacatgtacgactttgtcacttaccaaaaatgatctagttatgataataacatcatcacatgagtaagaatgataaggcatgatctaatcagcatcatataccgctactttatttactatcacattttcgttcacaagagtaatattatatttgattttatatatgtctaaaaatttatcgtagactgccgattttagattttgggaggttagaagaactaataaaaccgaaagaaatagatgatggtcggttaaatacttaagtcctttataagaaagaaaaattaaaagtcaactttatcgctgaaagtgaaagttaggttgaaagttcagagatttattcatcaacttccgtgcattgacacatgctcttctctacattcgctcacgtgaattttagaacaacaaattattttacaaacactataatcttccggtaatttaaccacaataaagagataaataatctttatattaaatcgatcgaattctaattctgtaggtactgtgagtcaaacatgaaagtgtaaattttcaaaatatgattggtgttaacttaggtgaatcaatttttgatgtttttttgttgattatataaatcaaaattacggaagaatgcatgttgtttacataagtgatataattaattttttactgatatattaaaaataaaaatattttatgttattgttttggttatttttttgttccacaaaaattaattaatcataatatttctttcttgactatcactagattcaatgaaaatctctcttttatacataaataaaaatcttctcaatgcattaataaatatatataaattgaggaaaaaaagagatagaaatcatggaaaaaaaggttaaaaattccaactataagcgagcatcacatatagaaatagaataatgtataggaatccatcatgatctcactctctatatataggtaagccaagtatcttatttttggttatgtatctctgaaatctgaatctgactgacttcaaaggacacagcttttacttctataactggttagcttctccacacacacacacacttgttagatttacttttcctccgcactatcagcagatttttctcatctgggtctgtttgtttctgttgactcaaagtttccgactttcttattttctgtctccgatttcatcgccgaaatctcagtcaattttgtctttagatctttaatttttggatccctttaattattttgtttggtcttacttcagagcgaagcaggtgaaaaaatggcgaatcggaagttagagaagatggcatcgattgatgttcatcttcgtcaactggttcctggcaaagttagtgaagacgacaagcttgttgagtatgatgctttgcttctagatcggtttctcgatatcctccaggatttgcacggtgaagatctccgtgaaactgtacgttttctccattttggatttgacccttttgctataagatcctgaaactacatgctctgttttgagtattgactaaaggtttcaactttttttgattcgatcatggattagattagttagggttttgaaacgcaggaagatttaaactttatgttagttttgagattagtagtttcatgtgatctaattttgatgatcttattgtgtgtgttgttgtatataggttcaagagctttatgagcattctgcagaatacgaagggaagcatgaacctaagaagctagaggagctagggagtgtgctaacgagtttagatccaggagattccattgttatcgctaaagctttctctcatatgcttaacttagccaatttggctgaggaagtgcagattgcttatcgccgtaggatcaagaagctgaagaaaggtgattttgttgatgagagctctgctactactgaatctgatcttgaagaaactttcaagaagcttgttggagatctgaacaagtctcctgaagagatctttgatgctctcaagaatcagactgtggatttggttttgactgctcatcctactcagtctgtgagaagatcattgcttcagaaac

SEQ ID NO: 8882 - DNA, 3000 bp, Unknown
  misc_feature (1)..( 3000): cDNA_ID_3043879_gDNA_ID_1971910_Annot_ID_177079 3000 nt of promoter + ATG
aaaatgaggcttttgaattaagtattagctattttctttaatcacctaacttgctccaaaagaaaccaccatctgttttatgcataatggcatatttgcaaactatacgcatatcaaaacatgtggttcgaaggatatgaagtataacgcaagatttcggtatattctatgctccataacacaaagtcaagtgaaataatacaatcatatatttctttttaggtcacaaaatattctatgcttgataaaacattgttttatggataccaaaaaagcaaaaagaatacacaataatacttgtgcaatgcaagtgtcggtataccaaacccactactactccgactctccgagttatataaccgctccattatcaataaatctacactttagcatacgtataaccgactcaaacattttgcttttgttaaataacaaattcacacactcactctactttaaattaacaaacgaatctttaatttgataatatggccggattttaagaatggaatcccatattaatatcggaacgtgtatcttagtgttgaaatattacaagactctttaagagaaataaattgcaaaggccaaaagaatgcataaatctttgtcgccaagtgctactattttctgattatttttgcatataaaagtttttattattattattatgcatgttagaaaacttaggggtgcatggctccttagtttttgagacttggctccatattggaagttgtcatgtgatttggttgatggtactttgagtggaagaaggaaagcggagttgtgtacgcggtttgcgggtcttagcatatccatcgtcgtgtgactctcttcatcgaattgaagatgggtctgattctagtgattaaaagtttcgacgaatcgtgatatgattttggtagtgagtactcatgtattaaaataaaaatgaggcttttgaattaagtattagctattttctttaatcgattagtttagagtgcgtcggcctaaaccgcttctatttattttttattaggactgaaattttttttattaagaaatgttagaaaatttgtatagttatatttatttggaaattggatagtcaagacttttgaaaaataataactaacaacaacaattaaccgtagaatttgatactttaaatctaaatttaagttaaaatttcgattataacatttgttattaatcggaaccataatattgggattcatagtgtactactgtatgtataaatttgggataaatgtatacgtatgtaagtaaatgtgtaagcgtaaatttgggtatacgaaagtgtctgtaaaaaaaaaagaataaaaaagaacgatgaagccagaagaagaaaaaaatctcgtgcgaaagaagccaataagagatgagtgcaaattacgaggtcacttattacatcttgatgtgattactgattttccctatcatacccaaatctatcttactagcttcgtttacatattttctattgtatcatccattaatacattatgtgattctcagtagctaaagttttgtttacgaattagatatattgatcttgaaacgttaataaacttagagttggtatatgtatctctagaacaaatttcgtttcgtacacggtacaaaaattcttatttgtacatgtagtttgtttatttactagttaattcccttattaaacccgtacaggtaaatgttaaaactcatcaggcgattttacgtactatagttagatgcagtgttgatacaatgaatttgtttattcgattaataaataattaagttcgttgaatatacgtatactactcctccgtaaaatgcatttataactacaagaaataatgtaatggttaaattatttgcattttttcgcttaacaagatactattaaaaaaggtttaataataaacataaacataaaaaatatcaaatgtttgtagtgtattaccacattttattttagttgctcttatttttttatttttgtttcggacataacacaattttgtatagatgttataggagcgtagacgtcacttcccataaatcgcgagtggggctattaggatgttgtaagctccaaagtacaaagaaaaaaatcgaacagtaccgaaagcgaagtaagcagatttttttaagtatagttatttacaaattacaaattaacaattattttcttaaaccttttttttttgttgaattttttgtcaacatctttttatttctttgattcaacgataaagcgaaattatggagagaaaaaaaaaagcaagaatcaaaaacatgtctcgtgaagcagcagttgaacaagaactgttatttttttgcataacatttaatatattaccatttccgaaattttcttatccatttttttaagtttattaccaaaaaagtagcttaagaaaaaatttaatccaagaagaaaaaaaagttttgttaatttggaactgtgttgtagattttgaacataattttaaaagtttgttaaagtcaattctgttatttattttctttcactttgctagaaatttattattattaaactctgctttcgatttctattttttaattatagaataattaattataacctttctttttctttgtcaatattaaataacttttttaatttataataataattaaaaaatgttaaatattgggtctggttctccatcttcactcctcttcttctgtgaaccttctctcctctctctcttctcttcactgagaaaaaacaagttttctctctctaggcactcacattcattctttgcttcaaccttttaattcacgagatccccaatctctctttcgatgccttttcacagagtatctaatcctcctcctcctccattcatcttctccttctccattcttctccgtcgtctccattaacaaacaaccatttctctcaccggaactccattttagggttttcttcgattctctcaaatttcattcctttcactcaccacaacactcaaaatg

SEQ ID NO: 8883 - DNA, 3000 bp, Unknown
  misc_feature (1)..( 3000): cDNA_ID_4256734_gDNA_ID_1971911_Annot_ID_177114 3000 nt of promoter + ATG
gcggaggctcctgtgatttttgccaaggcctgtgagatgttcattttggagctcactctacgtgcttggatccacaccgaggagaacaagaggaggaccttgcagaagaacgacatcgccgctgccatttccaggaccgacgtgtttgatttccttgtggacataatcccgagggacgagctgaaagaagaaggtttaggcgtgaccaaagggaccataccatcggtggtgggttccccgccatactattacttgcaacaacaggggatgatgcaacactggccccaggagcaacaccctgatgagtcttaaaacttttcccctttcgtttgtttggttgtatcgtagtaaggtagctctgctctgctgggaaccatttctattgtgttctgtaatgacatgttagtatatccccagtctatatctatggcaatgcagtttctgttctcatgtgcattaaataataacaagaatgatagaaagaaaatcactactagtaatgcccaaaactttacttcacaggaattcaactatacagctttcatgtgattgctactttacaaccattttctttatgctattaaaagcttggctcctattcctttaaagtttaaaccttgtcatcctccacatctcccttagtggataaaaccttaacttacttgaacatggatccaaagatacaagtcccttctcgccattccagttgcagtcaggtggtttatataccgagataccgagagcttatctgcttcggtctccatgcattccaaatgagttttttttttatgggctgtccgtattagtaataaattacagaaaatgctggtgcttcaatcatttgcttgaagacatggcttcctcaatccttctaatcacaatgctaagaggacttcccacttggagagcttcaacagcggccctatgtgctgccttgtgccacttgagtagattgtaagattgtagaacagaccacctggcttgattcgacatctgtatgatcaaacgcacagattcgcaatgcttaacaatctgtacacttgtgcaagaaaagtggaagcacatattatactagtcaaatcagatatatatgaatttcattagtcctgacctgagctacggataacggtggttccagaaggactgagatgctcctgaacagattttcatcattctctccaccctcagcctcaccataaactagcgcttcagctgcaataccagcaaatagtaccatgctatacctaagagaaactgaaccagcattaggtttgtgaatgagagaaaactcagagggagagaacaacaccttgactaataatcacctatcaaatgagctaccgctaagtcgtccctcagcaatctcactctccatcttttgatcccagaattgggttccagcctagagaaacacatgataatccatttatgtactcggttccatatgtagctaaaagaacatagaatcacagcactacaaaatagaatagtataacactagagtgaatctaaataatacctggccttgaacccccatttgcatggcaacaaccggatccaatatcacaccacggattgggcagcccatgaggtatgctgcacgacaaataagctgcaatcgttagccacaaaacgagaaagaaatttcataaaaatactaatgatcacgaatgtcttaccaacaagaagatgaccagcttcgtgaactacgattctacgcttatgtggaggccagtagcatgatacttgggctaagcaggtaccaccaagaaaaacggaatccaaataagctagacccaaaatgacagcaaggtttggccgcacatcaatctcctgtgaaagaagataggagactccacccagcaaagcagccagagcaatgctagaaccaccagaaagtccccacttcttcggtgaaagtttagtcactaaccaatataaacagtaaaataagtttccatcgccacacactgagtaatcaaagatgactgaagagagaaatttgagctacacaccttccaagccagttgcagacttcaggacagtaggtgttacctctcttgttccttccaaaactgcatcacagtgatacagaagcaagaaacttatgaaacgatacaaattaatcagttcaaatgctcgcacacatagctaaacattacttttgtacatctatctaaacagaagttgattttgaaggcgcaaagaagagaaaacagagtaccaatactggtgaatttgccgaagttggccaaaagacctctctccttaagaaacctaaacgcacttccaacaagtctcatatcatctgcattcaaacacgcatctaaaacttgccaatccctctccaattcaagagctcccaagccgcttaacttagccgtgacaatagattcaaccgaatcacgctgttcatcattttcaatagatttgaggaatctaagagccccggcgagatcttttctcttcacagcatcttcgtactcccgccattccctgagtgcgctcggcctccgcaactcatgcttccggacgctaccaaagactagagactgtacgcgtggaacaaggaagccaatttggcgagaaaaagaaggcgaaagagatctgagacatggaggagacgacggagataaagccattagaggtgcttctcgccgggatttccaaaataaaataaacgacgtttatattcgaaaggacagaaattcattgggccgagtaaagcccatttagctatttaaatattgcaaatgagttatttaacttcattatatttatttttagagttgtcttttccatatatggaagtaaacttttcgatcaaaagacatgatctttgtgaatgtgggcaacgattgtaagcagagggaaggcgaagaattatgataacctctcatcaacgataagacaaaatccataaactagtaatatcatccaatcctctcacttcttccttattccctcactttcactctcactatctgttgacttcacatg

SEQ ID NO: 8884 - DNA, 3000 bp, Unknown
  misc_feature (1)..( 3000): cDNA_ID_3043916_gDNA_ID_1971911_Annot_ID_177136 3000 nt of promoter + ATG
agcttctttcaagtccatgaaacacgattttaccggaggcgttgagtctcggactatccgccgtcacggtgagaccccgagattcgatacacgccgacgatgatgatgatccgtcaacggaaggcgtcgacggtggatgattccgtcttggtttggctaatctgattcttggttggttaaggtttcgtgaatgagtccgcgacggagcaaagggattcgcacttggtttatcgaggtcaagcgagagtcttggaagatcatcgatctcgtggctagaggaagacgatgaagagagtgagagacgtgaagatgcgactgagattgattcggagatatctgattctttttgcaacggcgacgatgcggcggtagaagatttagatccccggtgaagaaattgcttaaacgatgacgttttggggtttgtggatgaagaagaagaagaagctttaatagattcttcttgttccttggcgttgacgagtctcttgagacctaaaagctctctccatcgagtcgtacaacgaggagctttaggagagaagaggtcagagatctccatctcaagtctccggcatgatttcagaacctctggtgatcctcttggttcggtggtagttgtgttgactgtcgttgacgtcgtcgtcgtcgtcgtcttagggccagagaacttcaaaggtacgagctttccgtcggagaagagctcatcggcagagagcattgtgaccggatcctcaaggcaaaactcgaaatccacaactggatcttggatttccggtaatgggtcagattgttgcttgtcaacggaggaagagcgtctgttgtcgtctctggttaaagacatccgagggctcgtccatccgtacgacgagaacttctccggcgaaacaccggcacttttaacgcaagcggaagccattaagtttgtgtgttggacttgttgataggagaaaaaagaagaatctttggagcatttgccggcaaagaactatgttaagagttagggagagaagtgggagtgacagagacaagcattatatacacagctcactctcaggtacaccgtacacacttgtttcatttaccggaaccattcgggtcggttgtttttaatgggccgggttcacctatcttatgggctcagtattatttgaccctttttttgttgtcaatgcttgtgttattgatagagtgaatgactgaatgttatgaaatttagatctggttcgtgtgagtatttatttttataagttttttttttgttattatgtgaatcgagtattattttttctcattatggtcacctaccaaccaataattgagtctgatcataggcacacgtttcgtgtattcatgcatataagcattgttttctttcaccaaaaacaatccctctttgattaagaaaaatatggtttacatccatagctaatcaatatgagaacacaaatctttttttataagaaacgataacgttacaattctagcatttcaaagcagaaaatatgttctgtcttaaaataaaataactagaattgcaaaagcttaagatcaaagagcttagcggcaagagcggatcaatctttatattatgataccattctaggcaactcttgttgagtttccgataaatggtgagcaatatagattaacatacgtattgcatgcccatattatgctttctaatttgagatgaagccgatacgagacaaaatctacgaataagcaatatatacatatttataacaaatcttcataaaactttatataagtatgcattacacatttcattggtgtaacctgaaaatgcaattcttagtcaaatttgataaaaataattaagagatacgatatacagataaattgttaatagttaatactgtcttttggaacctagctagctcctttccacaacgataaaagattccaaatcacattctatataattatgttgtcatatatgatatataaattatcataaggttgtgtcatattgtgggtattggatattactattcttcaatcgaatatgtaaaatctatgtcaaggaaatatcggaagggactcttggagtgacttgctatctaacataaaatctatatctcacccaccggtcgaatatttgtcttgattcaaaatttaatcttggacatacattaataatagcatatgcatggcctagattgcgatgtaaccatgctctacataataataatgataaaattttataaatcatttcaattacaaaatatacatttaaaatatatatagttgaatgatactttacctaatacgatattaagatgtattttctcttattgttcgaaggcatatccgaataaaattttggcatgcactgtcttttcctacggtgataagccttgatccgttagaaccctcagccgaaataaacttatcaaaaaaacaaaaacaataattcgtatgcatgggctaaaacatacaatattgtatcataatggaatgcacaataccgcacataatccaagaactttggttctatccaatcgaacggagaggaactataactccgatcaaagtacagttgaaattaaatagaaactcaaatagcttttgtctctatccaatattatcaaaaagttaatagaatcgaagtagtttgaccaagtcaactacaaacaaagcttttgttagttgttgttgtggccatcacttctacttctccaatgtcacaaacgacaacatcgaacccaatactttcactactctttcattgaatcttacatctatatatatggaccagcttcttcttcctcttcattattcaataatctctaataaacatgattttagttagttaacattcattattgttgttctaatcgctaataaatatttcaaatcatttaacgactactagcatgtaaacattaattacgatgatctgaggtaatggcgaaaacgacactggctttgttttatacacgaggcacagcaatgaaatagacatatccacaatta

SEQ ID NO: 8885 - DNA, 3000 bp, Unknown
  misc_feature (1)..( 3000): cDNA_ID_3043928_gDNA_ID_1971911_Annot_ID_177132 3000 nt of promoter + ATG
gactcttgctcgtacttgtcctgccaagttctgacctctgaggacagattctcttgctctctttcgtaggtttcaagctttagctttacttcttccaactctttcttttctttctccagcgcaatctctgattctctcctgagaatcatctcaccctcgtactttctttcaaactcctcagccttcaaacgcgtattatcaatttcattttcaacagtttccagttgaatctttaccttctctatcctatcccgttctatggcaagcaaggtttctgtttctttcctatgcctcaactctgcttcaagcttgtgctccaaggctttagcttgtagttgcaatttaccttgttcttccttgtaagactcaagcaactgttccatcatctctacatcttcctttttcatagcaagtgcatcttctgcttctttcctaagctttacttcttcattgtaatttccctccaactctactacctgggaatcaagctaccgttagagagatatatctgcaaaccaaacgttaaagcttaaacatagtcatgtctttggatagtggtgttacccgagaactacgaactagctgattgaatttttcatcagaaaaatggaagtcagctagttttccaatgatggaccgaaataaattcatcgcatcggtaatcctctcaggtggtaagatgggattcataagcacctacgttaccattgaaatgatcatattctcttaattaaacccgtaagtagaagcatatccaagagtgaaaaaaggcaagggcaaggcaaacctgaatcatacttttccgggttgtttctgtgatcttgctattcttataaacttcagctaaaacccttacggttttgatgaatctgtaatagtttgtttcatcaacataaacaagtggtaaatgttctgttttaggggatgcgttttcaagctcaattctgcatttgcgcaagaacagtctctcaaaagttgtaatatcgccgtgagattcatctgatggaagtggaggaagctcgtgaaaaagctctacgcataaacgagcgaataagacataggagttttccaccattgccatatcgaaaacgcaagacactagagactgcaacatatatacaaataccattagaaatagtctcataatatatttatcaacacaaaaagggacggagaaccttcaagatagaagcagatggaaatgattttattgtacgaacaatctcatccttgatcttctcgaagttgcgttgcgtcaaccaattgagtaaactacacgaattcaaaaaccaaaatgaatgaagaaataggtacagatatagtatgaaggagagtttgtgtaaataatattcaatgtagagcttatatagaactctaaaaacgaatccaaacttgcaatatctcttagttacaagatatacacaatttgcaacacaaagtagctaagcagagttccaaagctttttaccacttcgatttttccagcactcgcttctcctcgatcgaacatacaccgatgaaactccggcgagaatccatgagtataagatcgccggaactcttctgcttcttcttatgcaactctgattatctgcgcttcttgagaagctaaaaagttgactaaaacgtttaaacttcttcttgacatgcagagcaagtgtgacgtgtctttccttcattggattagtagtaattaaagttcggcccaccagaagatggaagtgtgactgaatgattcaatctgaattcaatagttaggcccatttaataggcccattgatatagtgggaaaccctagctataaattcgagaggctctcactcaaatcatttctctcttctttctcgagaaatcggcgaatctgagaactaagcatcaacaacaagaacaatgagagcgaaggtaacatcttcttcttcttcttcttcttcttcttcgattcaatattgttctttgtattagaacttattagcgttagtttcatcgataatacccattcatgtatggatacacatatacgtagagagagatagatgttacattctacaatgcaaatgttatatatatccttagtaaagtcgtacaagaagatctgaggattatgtttttgacattagaacaattgaaaatgataatcgattttgcatcccactgttaaatttgttgtactggaagccgtaaagagattctgaaaaaatgttggtaatctcgattggaaccatctctgtgccagaaaactcacttactactggtttatctaaactatagatagagatcttgttatataggttaaggttgttgaaatgaaaactctccatttatgtcgtgtttctttcatcatgtgtatcgtttgttatcctatacaaatgaatttgatactaacaaaattgtggataatattttgcagtggaagaagaagcgcatgaggagattaaagaggaagcgtcgaaagatgagacagcgatccaagtagactccaagttcctcccccaaataactatcggctctctgtgattctctttttagttttgtcttgaaactttttctttcttctagcaaaccttttttattttgattatggaagttttgaacattctgtgatgtatgtaaaacttgctcttgtgctcttatctatctaatcacagatcctttatctaatcactgttgtcaaaatgtgtgaagcttgtttttgtctaattgtcaagacagcaataatcttatgaagaagtattatgagtattaagaaaataattagcttaagctaatgaaacagttgtcaaaatgaattataaacaagaaccaaaatgattagtttaaactcagattctcgaaatgtttattaacatagggcaaaatacgtatattaaaaataagtgattgtgaaaacaaaggaccaatcaacacattctctgtaatttgcgataaaaagataatagacaaaagagacgacgaacacacttagaaattttgagctgagaggctgagaaaattagcaccatg

SEQ ID NO: 8886 - DNA, 3000 bp, Unknown
  misc_feature (1)..( 3000): cDNA_ID_3043940_gDNA_ID_1971911_Annot_ID_177129 3000 nt of promoter + ATG
cggatttcacccgtagtacaccattccatattaatatcgaatcaaacccgtcaattctatgatttcacctgtggtagtatttaattgtataattatattttaattgtcattctatgatttcactcctaattctatcgcaaattattatcaacccaaaccagacaattctaaaatattccgtagtacaccatcccatattaatatcgaatcaagcccgtcaattctaggatttcacccgtggtagtatttaattgtataattatattttaattatcattctaggatttcactcctaattctatcgcaaattcttatcaacccaaacagtcaattataaaatttcacccgtagtataatgtttaaatatttataatgtttaaatatttataatgtttaaatttcttataaaagaatcaaaatgtgttttaaaaaaattaaagttttaagtttttttttttaatattgttaattttgtttagtgtttaagattatataattatattatgattgttattatatgtttttttccatagcatactatcccatgttattatccactcaaacccgtcacaccatataaccccgtcccgtgaaattaaacacaaatttgtcattttattataaatttcaaatatttataaaattagaaacttcaaaaaagattaatattgacccaaacttcatcattgaattttgagtgttatatctaagatttctctcgcagtatatcgtcccgtattaatatcttttatattgtttaaatttcttgtaaaatttaatttataattttttaaactttttaaagtttcaattttttaaaataaataaccctagtaaacaaaccattttaattttggacacctcataaatcaagtttcatgctcattcgtaatcgaaatcattttggtcctttttatagtatggctcttgaccattgtccaatttttttaagcgatgtgggacattctaaaatcgtaattattatccacccaaacccgtcctaccatataacccagtcacgtgaaattaaacataattttgtcattttcttataaatttcaatattataaaatttggaacttaaaaaaatacaatatcgacccaaaattcatcattgaattttgattgttatatttaagattttttctgtaatatatcgtctcgtattaataaattttttatatatttataatgttaaatttcttgtaaaattcaatttataattcttaaaactttataagttttaaaattataaatatttaaagcattttttaaagataaactttataaaaaaatttaaaattataatatttaacttttgataaagttataatatttataattttttgagacattttaaagtttcaattctttaaaataaaaaatcccagtaaaatcggataactattttaattttggacgcctgataaatcaagcttcctgctcattcgtaatcagaatcattttggtccttttataatatgggtctgaaccattgtccaatttttctaagcgatgtgggacattgtacacatattatttcttcataggttgaataatatatgtccatttaaaaaaattagaattacatcatattcagaaaaaaatataatattttattaattatatatattttatataaattcaaaataaataaagtataagatcaaataaaattgaaagaagaattatatatttatgtttaaattaggtagaaatattttaggaaattagttaaggtaaataagaaatatggttagtttagagatattgtttatattaaatttggtaattaaatcattaattttcgtttttaattattagtttttaggtaacttttccaaaaattaatgttatctaagatcagaacagaattaaacatgttatccagaatccgaacagagttaaaccgggtaaaacccacccatttgaattaattgttgaattatggctcaaatcttcaacattatcttcaaaaatcccctccaaaaatgtatatatagataacggaaacaagattaatgtatcatcattcattccttgttgatttaattaaacagatgaacaaatgatatgtaataataaggtctcggtttacagtgaaagtgatttaatttagtatctttgttacttcgattattgaattgagcgtgtgtacttatgaagattaaatcgatgatgcatgggctcatgaagattaaaaaactcaatagacacttaaccagaattaatgatattggcccgatgagtattggcccattaaggcccattaagagagcgaaaaccctaaacgagaaacaagggatatactcagagcatcttccttggttactatataataagctttaggctgctagacgcctgcctccttgcacctcttttctttctctcgttctcatctttctctctaaggttagtcccttgtgtagatcctctcttcatcgattcaatttcatcttccttggtttgatttaggaattttgtcacgatttggtgtttagatgatggagtcttgctgttgatctatgtttatagcactttgtttccatggttctgttgtttcttaccgtttgttgtgcatcgatctggttttggtagatccctcgtagataataatctgaatatgtcaaagttttcttacaagtctgttgtgttttcagttttgattgatattgttatccatgtagtagtcgatcatccaaaaactggttcagtgtgattctccgatcatcgccgctgattttatatttatcatcatgtatagatttgcaggttttattttgttcgttgtgtgtttttgttctttgttaaatttaacctctatgcatttgatgtacatgtttttgtgttggtctcagtttctcttattctgtataagctaagctaaagtctccatggttagtgtctgtttagtattaaaatatttcaatttgctaattctttatgtttttgtgatgatattgcagagattttgtaggtgacaatcaaaagtttgacaaa

SEQ ID NO: 8887 - DNA, 3000 bp, Unknown
  misc_feature (1)..( 3000): cDNA_ID_3043958_gDNA_ID_1971911_Annot_ID_177124 3000 nt of promoter + ATG
taaacccctgaaaccctagtttcgttcgttgtatatttcttctcgctcagtaggtctttagggttttagtttcttctcctcaaaaaatggcgatgtatgttatctacgagtcttcttccggctatggtctcttcgaggttcacggactagatgagatcggacagaacactgaggcggttcggacttctgtctccgacctcagtcgctttggccgtgttgttcagctcacagcgtttcatccctttgagtctgctctcgatgctctcaaccaagtcaacgccgtctctgaaggtcagactcttcattactctcttcttattctttgttctgtatattcatgtgttgtgttgagtagcttgttcttgtatttagagctagagtagacacttcgatttaaaaccttatagttcaaatttcctggatatattgtagaaagagctttaatttatggttgattcttgtttttgtgttctgtttttgtttcattgttttggttttgtcattgatgcttttggaattggttttaatgtgatattggtaggtgttatgactgatgagcttagaagttttctggagttgaatcttcctaaggtcaaggagggaaagaaacccaagttcagtttaggattggctgagcctaaactcggttcacatatatttgaagctactaaaatcccatgccagagcaatgagtttgttcttgagcttctcagaggtgttcgccagcattttgataggtttatcaaggacttaaaggtgtgatctcctttctatgtgtttaaaatctttttgtctgtttgcttatctcatatggtttgtgttctcataaaaaatttctgtttatgtagcctggtgatcttgaaaaatctcagcttggattagctcacagctacagcagagccaaggtgaagttcaatgttaaccgagtggataacatggttattcaagctatcttcatgcttgacacgcttgataaggatatcaattcctttgccatgagagtcaggtttgttttgtgcttttccctttcagattgtgtgttttcctcgagaaaattggtagctgaactgtttataatgttattacagggaatggtattcgtggcacttccccgaactagtgaagatagtcaatgacaactatctttacgcccgtgtttcaaagatgattgatgacaagtcaaagttgactgaagatcacatccccatgcttactgaagtcttaggggatgaagataaggcaaaggaggtcatcgaagctggaaaagcatccatgggtaaaaattttgagctgacttttttggtagctttgagttaatgtgtgtttctgttaacttatgtcctgagacatttactctcttccctattggcaggctcggatttatcaccgcttgacttaatcaacgtacagacctttgctcagaaagttatggaccttgctgactacaggaagaagctctatgattatcttgtcactaagatgagcgacattgcccctaatttggctgctttgattggagaaatggtcggtgcccgtttgatttcacatgctggaagtctgactaaccttgctaaatgcccatcttccaccctccagattcttggagccgagaaggctcttttcaggtgcaatatctggcactatatttttaatgttcaccagtttccttttagtgctgcttgtgacatgaactgctgtggtatttcagggcacttaaaacacgtggaaacactcccaagtatggattgattttccattcttccttcattggccgagcatctgctaagaacaagggccgtatcgctcgttatcttgcaaacaagtgctctatagcatcccggattgattgttttgctggtaaaaatctgaaactccttgaagaagagttttggattatgaattctgttgtgaaagtgttaaattatgtgccctgatgtcctatgcagatggtgcaactactgcttttggtgagaagcttcgcgaacaagttgaggaaaggctagaattttatgacaaaggtgttgccccacgcaagaacgtggatgtaatgaaggaggtgatagagaatctaaagcaaggtatttcttgtagctgtttttttttggttgtaatcagagtcctctttatgatggcaaactcagtgtttttttatctgttcctcctttagaagaggaagggaaggagccagttgatgcctcggtgaagaaaagcaagaagaagaaggcaaagggtgaagaagaagaagaggtggtggcaatggaggaggacaagtcagagaaaaagaagaagaaagagaagaggaagatggagactgcagaggagaacgagaaatcagagaagaagaagacaaagaagagtaaagctggaggagaagaggagactgatgatggtcacagcaccaagaagaagaagaagaagtctaagagcgctgaatagaaagggatgcaacattaacaaaccctgtattgtattttttttttgagctaaattaatgtcgtctgtttttcgtagtgaacatcggagaatttttgttttggtctggaaacgattcaaggtttggcaatatcttaagtttgtttaggttttcactattttgacgtttgcaaccgtgaaggaggctcctccattttataaaatacaattaccaattccagtgctttgcaaatgtttcaataatagctaaactaactaccaaattggaaaactagcttaacaagtttgtgaaaatgaatttggagccatatgatttattattttacccaaatggagtaatagaagaagagcagctcgcgtttgaatggtcagttaacattaacaaaaggtaaaattgaatagatgttaaaacttgtgtaagtaaacaatagagctacctccttttgagaaggatagataaactcgtgaccaaccacattcccagtcccatattcttagtacaaataagaaattcacacccctcaaagaaatataacataatcaatcataggaaatatacttcgcata

SEQ ID NO: 8888 - DNA, 1730 bp, Unknown
  misc_feature (1)..( 1730): cDNA_ID_3043988_gDNA_ID_1971911_Annot_ID_177115 3000 nt of promoter + ATG
aagcttgtcttcttcaacaagggaggagccaacggaaagaccttgcgccttgtagaatgtaaagatcattccaccaccaagcagaaggatgtcacatttctcaagaagcgattcgataactccaatcttagatgagaccttggaacctcccacaatggcagcaaatggtctctttgggtttgaaaccgcaccaacaaggtagtccaactcctgcgaaatatataagataaccaaatgtgattcaattcaaactcataactcaattcaagtcaatggactcctccaaattgcagttgagaaacctattgaaccttgagtttagacctcttacatggaaagacaaagatgaacaagcaatcaatcaattatttcatgatcaaggatatagtggcggcacttgtggtgcttctaaattcctcaataatcaatttaagaaagaatcttgtatcaaaatgtcaccttttgcaaaaggaaaccagcaactgatggcttcaagaacttagtgactccctctgttgaagcatgggctctgtgagcagtcccgaacgcatcgttgacataaaggtcagctagagaagcaagcttcttagcaaaatcaggttcgttcttctcttcctccttgtaaaacctcacgttctcaagaagcaaaactccaccttcaggaagggaagccaccaaggtttccacttctggaccaatacaatcatcagctttcacgacctgcacatttcacaccccaaaaacctcaagagatttccacaacaagatgacagattcagatccgttgaaaatcagggtagtacctcaataccaaggagctctgataatctgggaacaagaggagccaagctgaactttggagtgacaccctttggccttccctgaaaattagagatgaaaatgtaaagacttttgtgtggatttgagttgattagagagatgggtaaactgtgaaccataccaaatgagtggagaggatgaccttagcaccattctcaatcaaaaacttgatggtgggaatggcggctctgattctagtgtcgtcagtgatattctggttgtcatcgagaggtacattgagatcagctctaacaaacaccttcttccccttcaaatctacagaattcagatctccaacactcttcttcgccatcgtaatcactcccctggcgccctttccgcgcacggagtggaccttggacgccacgtggaccgagaaacgagagtcaacgacggcggagaagccaaggcgacgtgcggagacagatgtggagggaatgtgtccaaaggaggcgcgggaggagcgtgtaacggcggcgccaccggtggatttgatgatcgaaagagctgcagttgcggcggtggaagccatgtgaagtcaacagatagtgagagtgaaagtgagggaataaggaagaagtgagaggattggatgatattactagtttatggattttgtcttatcgttgatgagaggttatcataattcttcgccttccctctgcttacaatcgttgcccacattcacaaagatcatgtcttttgatcgaaaagtttacttccatatatggaaaagacaactctaaaaataaatataatgaagttaaataactcatttgcaatatttaaatagctaaatgggctttactcggcccaatgaatttctgtcctttcgaatataaacgtcgtttattttattttggaaatcccggcgagaagcacctctaatg

SEQ ID NO: 8889 - DNA, 3000 bp, Unknown
  misc_feature (1)..( 3000): cDNA_ID_3043978_gDNA_ID_1971911_Annot_ID_177119 3000 nt of promoter + ATG
ttcttttctctctttttacagatttttagaaaccatgcatgattaatgttcttttaaaaagttgttgcatggttgtttttattattgcaaacgtagtagaaggaagaacagtgtcaagtctattagtgcatgcggttatatataatccaaatgataaatacggatatagtactgctttctaaagatgagttagtgaaattaatgaattttgggggaaataaacgccgtactatggtccattcgtacagaatgacccaccaactgactttatatttcttccatttacgtgtcataccaataataccaacacgacttttcttctaaaattaaatgcatgtatctgttctttgaaatgatgattttcttattaggtactgcatagagaacaccactatttgcttcatagttcatacaacgttttaaagtgaagtttagtttggtaaaagttgcatttacatactcaataatttaacagacgttgtgctacttgcgagtaatcactactggtcaattaatatataactcttccggagttactcaaatagtgtgtatagatatatagcaaattagcaatggtttaaatgcgaaagcgtgggctgccccaactgtccagccgtacgctccatgctacggacactttgctttcaacttcgacatttatgtttcttatttaataccatgagaattttggatatgagtttgtcctcacacatcaaataaaaatcatttagacaatcatacaaccaaatcttatctaactgaatcaatttgaatacttgatcctaaaacattgttagctcgaagtctctagttaagttccatcattgttccataaacacaatcttgaaatcaaacatttcaccacggtgatctctaaaagtagaccactagtttgtgcctcgctcaaggccagtgaaatatctgttagttatgtagtcaaaatttcagtcggactttgataataatagccaagagagattgtcaagccagaattttataatgaataactaaataatatgagaagatttagttgttcgttacagacagctctctgcactaacagttctatttaactgacttgaacaacgaagaagacagattcttaatgagttcttgggccttaattattagtaatcgattaaaaaaaaaatagaatttctactgtgaaaatttcaatttatgagtttagtatcatcgatttcatattggaacattcatatgtttgtcgagtgaaatttttaaaagaaaataagactccgaaatattgagatcactgatacaagaaattaaatgtcctcatcaagttaagagaaaccaagagaaaaacctagagattcaacaaagttttccaacctgacactgataggtcatgaattgggcttgtgggctttatattgtttaaagcctgttattcttagtattgctttctatttaagtttgttgtcttgcttggtaaacgtttatcgattaagaactcaagaatgtttatcttcttcatcatctcctttcttcttcctttccttctctgatttcttcagcatctcaacctatttcttctattatctcatctcctttctgttactaaaattgataagcaccattaatttatatgaacgtttacataataattataacatatatttatacttaaccttatggatgtgcacaattatcaatgttgtattcacagctcaaaaccctatttgaccattctttcgacaaaattggctatgcagaattgtttttaggtgtaaggttttagctttgttttttggatgtataaggaggctaattttttattttttttacggtatattataatttatgacattgtacggtttcatagtttattcacatacataattagtaataaaaaatgttttactaaaaatgatattcaaaccaaaacatctaaacgtttattttggaaatcggtcattttatactcgacctaaatttaagtggtcaattcatacaatatttttcttttcttatgtgctaatatattcaaattatatatccaaatttaccaaatcatacaagattatacattctagttcattctactgatgtagatgccacatttttgattattttgatgacgtagttaccacgctcttgacgatgtccgtgtcacgtcctcatcaccttatttttttttgtttcttcacctttttcttcttatattttttattttttgtcttctttatcactattgctcgaggaagctgtaaaaatattatgtgtttgatgcatgtaaaaagactagaaaaattattttcgatactaatgagtaataaccattatttaaatgaaagaacaaaaatctaatagagtttatagtcaattcatcaagtcattcagataaacattgtattattgttttcgttagaaaagtagtaacggcaagaatgtttttaaaacatggtcaaacctattaacttgtatttgacgtccttgtccgaatcataactctatcgcgaaatggtcgtttagtattagcaattggattgcatcagacgtatgtatctttgcgaatattttatacaaagtggaagaaaagaaacacgtatgtattttggtttcaaaatgagacaactggctgatgtcattgatatgtcatatacggttcgattaatcaactctatttaacccggttccaccaaatcagcagtttaaaattgaaattcggaaataacacttgatcacctaattcattagtttaatactaatgattaacaagtaaacaacgactaatgataaaacggccagggctttccgacacactttttttgttttattcatttattggataactaaatacaggaaaaagcttacccacatggcgacattatttatcaaaaaaaagtaattaggctgttaaattctaaagttaaaaccatataatatacatttatttatacgcataacaagaacaaaaatggctagttggtttactctggatccctcccgactctctcacatctttggtcgtcgacg

SEQ ID NO: 8890 - DNA, 3000 bp, Unknown
  misc_feature (1)..( 3000): cDNA_ID_3043974_gDNA_ID_1971911_Annot_ID_177120 3000 nt of promoter + ATG
tttttcgtaagtaaaacgcagagatgggcagtcagcaatgtaggactatttactgggagtaacagtaatcaatacatagctctttcggcaacgcaatttgcaaacacgtcagactcagagcttttccaatcagcgagactctctgcatcttctttaaggtattacggactggggctagaaaatggaggctatagtgtaacggttcagtttgctgagatacaaatacaaggttctaatacctggaaaagtcttggaaggcgaattttcgacatatatgtccaggtctctactattcttaccaatattaacttcgtcttctctgtgaattagttattttggttttgtgaactaggtccgtactctgtagtaactattttgaactagagagagaagatccttgataagctttggcatacaagagatcctttttctattagagtatctggtacaaggttgtagcacatatttcgttcaagtgggggtgaaaattagatgcatcgttttaaggctcaactcttcatgaacgatattctctactctcaaaaatggtttctgacctctgagttccttttgtttctcagggaaaacttgttgagaaggattttgacatgcaaaaagctgctaacggttctagtatccgagttattcaaagagtctataaagcaaatgtatcagaaaattaccttgaagttcatcttttctgggctggaaaagggacctgctgtattcctgctcaaggcacttatgggccattagtctcagctatcagtgcaactccaggtatacatacagcagaaactttcatgatcttcgtagagtccaatgtatcttctaactagcggcttttattctctgcagatttcatacctactgtaaaaaataagttgccctcgaaatccaagaaaaacattgttatcattgtaggggctattgtaggagcagggatgttatgtatattggtgattgctatcctcttattcatccgtaggaaaagaaaaagggcggctgatgaagaaggtaaatgaaaagtcttagctgtggcagttttattaaagtctaatcgttaacaactgtaaccttctaagtggtatttatcaaatatttctcaaatgcagtgctaaacagtctgcacataaggccctacacctttagttactcagaactcagaactgcaactcaagattttgatccttccaacaagcttggggagggaggatttggacctgtttttaaggtaagaccgtacacagaatgtgtaccaatattgggagtctagtgtactagaaagttatgtaaaattttacattatctatattctaaaaatattcattggtacagggaaaactgaacgacggaagagagatagccgtgaagcaattgtcagttgcatccaggcaaggaaagggtcaatttgttgcggagattgccactatatcagctgttcagcatcgcaaccttgtaaaattgtatggatgctgcattgagggaaatcagcgcatgcttgtatatgaatacctctcaaacaagagtctagatcaagctctattcggtaagtgcatgagatcttacatgtgttatccttgtaaaaaaaacaaatgctgttaccttacatgttgcgtgactgtggcagaggaaaagagtttgcagcttggttggtcacagcgtttcgagatatgcttgggagtagcaaaaggtttagcatatatgcatgaggagtcaaatccccgtatagtgcatagggatgtgaaggcaagcaatattcttctggactcggatctggtcccgaaactctcagattttgggttggccaaactatatgatgataagaagacccacataagtacccgagttgcagggacgatgtaaatatcctgaaaacctcacattggatgtggtttgtcaaatgggctaaaacttaccgttgttaaatgttatattgcagcggatatctgtcaccagagtacgtgatgcttggacatcttacggagaagacggatgtgtttgcctttggtatagtggccttggaaattgtcagcggaaggcctaactcctctccagaattagatgatgacaaacaataccttctcgaatgggtatatatctaacttttcctacaaacacatcctttttaattccaaatttggtgaataatttggtctttgcaggcatggagcctacaccaagagcagcgtgatatggaagtagtagatccggatctgacagaatttgacaaggaagaagtgaaacgtgtaataggagtagcgttcttgtgcacacaaacagatcatgcaatacgaccaactatgtcccgagtggtaggtatgttgaccggtgatgtggagataacggaagccaatgccaagccagggtacgtctctgagagaacatttgagaatgcaatgagcttcatgagtggttcaacgagctcgagctggatattgcctgaaactccaaaagattcttccaagtcccaagttgaagaacatggacgacgacattgaaacttgaaaacttgtggtttttctattttttgttcttacataaaaaaaaagaagtcaatatagaaatcgttgttggtaaataacacatatacatattcgtttgaccaaaattggatttgactgtttctcctgaaagttgtgtttggtcccatttttaacattaaaatcccttaaaaccatcattggcatttagtatcaaagtccaaaggtggtgatgcttcttgcactcgtaggcagcagccgccattgttgaaatctcccgttgacaacgcagcggaatctcggtttaagcgcgtccacttcacggcttgtggatgcatcgcgtgagacgcactgctccgcgtagttggttagaccattaattaaattcaaattaagccaaatgaaaagtatctcttcaaagtccaacataaacaccatttttgaaccaaattaaaaccttctccgtctagttttggcggctatcatcttcttctccgtttaattttagtttccgacg

SEQ ID NO: 8891 - DNA, 3000 bp, Unknown
  misc_feature (1)..( 3000): cDNA_ID_3043962_gDNA_ID_1971911_Annot_ID_177123 3000 nt of promoter + ATG
gtaacaaaaagataccctcacaaattatgttctccatgttgaatgtgcaaacatatggacagggctccaatgtcttattggaaaaaaattgttttaagactttcgctattgactggtgtctagattataacttttcgatcaactgcggaggcccagagataaggtctgttagtggagcactatttgaaaaggaggacgcggatcttggaccagcttcgtttgttgtgagtgctgcaaagagatgggcagccagtagtgtaggaaattttgctggcagtagcaacaatatatacatagctacttcactagcacaatttatcaacactatggactcagagctttttcagtcagcacgactttctgcatcttccctaaggtattatgggttggggctagaaaatggagggtacaccgtaacacttcagtttgctgaagtacaaattgaaggttctaactcttggaaaggtattggaagacgacgttttaacatttatgtccaggtctgcaccacttgatcgagctttccggttcacaaatgttactttttggttctgatgaattctaagatctagctccatttttccagggaagacttgttgaaaaggattttgatatacgcagaacagctggtggctcttcggttcgagcagttcagagagaatataaaacaaatgtatcagaaaatcatctcgaagtccatcttttctgggctggaaaaggaacatgttgtattcctatccaaggggcttatgggccattaatagcggccgtcagtgcgacaccaggtaacacaaacggttgatatattttttttcctctgattttcactatctcccgatactagttagtgccgtgtcacatattcttgttcagatttcacaccaactgtggctaataggccaccatcaaagggaaagagcaggactggtactattgtgggtgtcattgttggtgttggacttttgagcatctttgcgggtgtggttatcctcgtcattcgaaaaagaagaaaaccgtacacagatgatgaaggtacagatgtaataagaacataaacaagcccttgagctgaataactttagctctctgatcaaaattaaagttgactatcatctgttaaattggttgattttaagtagtgaattttttatggcagagatacttagtatggacgtaaagccttacacctttacttactcggaacttaagaatgcaacacaagattttgatctctcaaacaagcttggagagggagggtttggggctgtttataaggtaagtcccttactgaatcgaacaaaatagctgtatatttttctgagatactaggaaagaagggtacatgtaataccttttaatacgttttgttttgaataacacgttcaacagggaaacctcaatgatggaagagaggtggcggtgaagcagttgtcaattggatcacggcaagggaagggacaatttgttgcagaaattattgcaatttcttcagttctacatcgcaacctagtaaaactttacgggtgctgctttgaaggagatcatcgtttgctcgtatatgagtatctccctaatggaagtctcgatcaggcattatttggtaatgaacagaaacatgacttacctatctctgcttctgccaagctaaagtaatcattatgccattgggttggatgttacaggggataagagtttgcatcttgattggtcaacccgttatgagatatgtctgggagtagccagaggtctagtttatctccacgaggaagcaagtgttcgcataatacacagagatgtgaaggccagcaacattttactggactctgaactggtcccaaaagtttctgattttgggcttgcaaaactatatgatgacaagaaaacccatattagtaccagagtggcagggacgatgtaagcaaaatccatagaccctgacattttgtttgcaacacaattatggctttatagctcatgttagttgtatcaatgcagtgggtatcttgcgccagagtatgccatgcgtggacatctaacagagaaaacagatgtgtatgcctttggtgttgtggctcttgagctagtgagtggaaggaaaaactctgatgagaacctggaagagggaaaaaaatatcttcttgaatgggtacgtctatatttgtcatataggcgaagttgaagatggtgtgataaatgacaaaagccgataatccttttgtatttcttgtatacaggcatggaatctacacgagaaaaaccgtgacgttgaactaatagatgatgagctaagtgaatacaacatggaagaagtgaaacgcatgattggcattgctctgctttgcactcagtcatcttatgcgttgagaccaccaatgtcacgagtagtagccatgttgtcaggagatgctgaggtcaatgatgccacctctaagccaggctacctaaccgactgtacatttgatgacaccacaagctcctcattcagcaactttcaaacgaaagacactagcttctcgacgagctttatagcgcctggcccggagatgccacttagagacggcgaatcgaagccaatggttggattcaagatcaaggagggaagatgaagattgtcccctctataatttgatatgcttgtatatggaagttgacaattttcttctatataaggatgtggagaaacagatttcactttcattcaataataatattttagttgacaatttttcaatttttgtaacaaacttttgatatcttgcaaggatgaccaaaaaaaaaaaaaaaaaaaaaaaaaaagaaagttaacctgttgtgatgggccgggcattttataagctagtacaactaacacaccgttaaatgggcctggcccattgaatttttcaagagcagcgccatcaacagatgcgcttattaaacccctgaaaccctagtttcgttcgttgtatatttcttctcgctcagtaggtctttagggttttagtttcttctcctcaaaaa

SEQ ID NO: 8892 - DNA, 3000 bp, Unknown
  misc_feature (1)..( 3000): cDNA_ID_3043966_gDNA_ID_1971911_Annot_ID_177122 3000 nt of promoter + ATG
atgatggaagagtggtcgcggtgaagctattgtcggtgggatcccgtcaagggaagggacaatttgttgcagaaattgtagcaatttcttcagttctacatcgcaacctagtaaaactttatgggtgctgctttgaaggagagcatcgtatgctcgtatatgagtatctacctaatggaagtcttgatcaggcgctatttggtaatgaacagaaacatgacttatctatcactgcttctgcgaaccttaagtactcatttatgcccttggtttgcatgtttcaggggataagaccttacatcttgattggtcaacccgttatgagatatgcctgggagtagccagaggtctagtttatctccacgaggaggcgagtgttcgcatagtacacagggatgtgaaggccagtaacattttgctcgactctagactggtcccacaaatttctgattttggacttgcaaaactgtacgatgacaagaaaacccacataagtacccgagtggcagggacgatgtaagtaatccacaaactctgacctttggtttgcatcacaattacaaattagtgagacatgttagtgatgttgctgtatcaatgcagtgggtatcttgcgccagagtatgccatgcgtggacatctaacagagaaaacggatgtgtatgcctttggtgttgtggctcttgagctagtgagtggaaggccaaactctgatgagaatctggaggaggaaaaaaaatatcttcttgaatgggtacgttcttgcttattatgattgattgtaaatggatggagtttagaatggcaaaagccaataatacttgtgtattttctgtatacaggcatggaatttacacgagaaaagccgtgacattgaactaatcgatgataagctgactgatttcaacatggaagaagcaaagcgcatgattggcattgctctgttgtgcacacagacatctcatgccttgaggccaccaatgtcacgagtggtggccatgctttcaggagatgttgagatcggtgatgtcacttctaagccaggctacgtaagcgactggagatttgatgacaccacaggctcatctctcagcggatttcaaatcaaagacacaacaggctattccatgagccttgtggcgcctggctccgagatatcacccagagacagcgactttaagccaatgcttggatccaagatcaatgagggaagatgacaatgtatcatctacgatttatggctatagagatgtttgtatatatgtaagatgacaattttgtacaaaaaaaaaaagggattgacaattttcatctttgattgggaaaaacagatttcactttgattcgataataataatttagtagttagaagttgaaattgatctttaaccgttagtgatgggcctcgcattattcatgtacttagccaaatcaatgcagtctctgaaggtgactgactctgtagtatattcatgtgttgtaatgttttatttgggagtcaaaaatgaaataatctctgtactactttcatgagtgggggttccaggagctctaactggattttcaaagctgcaattcaaatatgtatgcttatgtcatgaagatgtagacgtcacatgagcaaagatcgtgtaaataagtgggggagaaaaccagagctaagcatattggatactttacagtcctagtgtaaatgaagttttgtattgaaagtctattagtgttgaatcaggacgaaacacttgaagctcctctccaaattatgatcagaaacagaaacatatcagttcaggtcttcaaatgatctatatatgtacctctaactcaaaagatcatagcattgctccagcatcagtttctcttgtgcggccctccatcgatctgctaatggaagatattaggttattacacactagtttaatacacgatttatcatgtcacgtttgtcctcaaaacctaccgtgggagaaacgtaattaactattcactgttgaaatgatagcatcagtgactgcttctgcattcttaagcttattccagtttccaagcggttccactgaggatcccaagccggatcagagctcaagaaatctccaaatgatgttgagatacaacaaaaagggaatcaagaaaagacctcaacgtttagccatgcatgcatggacgactctcattacggtacgtttaactaatcgaacattgcttgtatatcgaaactcttaactatgcgtttacttaaaataaaaataaaatacttctttgattcaataaaaatattttagtagctctaagttggacttggagtggatctctaaccggtcgtgatggggctcgcactattcatgtcgttttaagtctttaaccaaatcaaccggtgcagtctctaaaggtgattgactcttccgtagcaacttcttccttccttgatatgtaatcatgtgttatgtcttggaattcaaaaggaaataatgattaagatcactttcatgagtgggttccacgagcactaaatggatattggcatatctaaaggagacttaccaaataatccttaagtctcaagtcccctttttatcaaaaaagaagaaaaaaatctcaagtggttgaaaatggacgacgacttgaaactcgaagtttcgtttatagtcaatcttacattgttgatcagttacactaattctcttggctgtgtgtcaacaagtgggaagatttcatagtaagtcttctctcatagtactagtaattaagtcttctctctgctatagagtgtggagactaaaaaaagaagaagacaacattgtttttatattattatgtgaagtagtgtagtggtgaagaaggaagaattttccaactctacgaaccatagcaatcatagcctgatagccattaacgtctctatacagagaaaacagagagcccattcgctgatcggcaaatctctttataaacacactcatagtggtcttgtttttctgaaccaaagttatatctgttgaa

SEQ ID NO: 8893 - DNA, 3000 bp, Unknown
  misc_feature (1)..( 3000): cDNA_ID_1989267_gDNA_ID_1971919_Annot_ID_58534 3000 nt of promoter + ATG
cattggtctatgttaatgacataatcatcacatgaaacaatttggatgcatttgaaaatattttacaaaatctagctatcagttttcacttaaagacttgggtgagtaaatattgaagaataacttacaaattgattctatcaatcacaaatcgcaaacctgaatgctttcggttgaacaaatctcgtgcagttactagtgttcctcctctaccaaaatgaccaagatgatatagcatcctacgatatgaactaagaaacccagtcttggtgggatatccgaaatcaacaagatagtacttcccactaggcggatgtgggaaaaaggttcattcctcgcacaatgattcaaaacttttgtatcatgtgctctacaagatatactgacatatgcatatatgaatttcatatcgaagttacatatagcaagaacattcattatatgttctatctttctatatttatatttttctacagattgacttagacggcgaaccgggacataagttccatcaagtgctccaacacaatctctaaaaacaggccaatatcaatcatcattcttctaaacagggtttactctcgtaaattcaccttcttgtggctttagtgtatccactacaaactttaaaagagcactcaaaacatcatcaatcttttttttttttaccgtattcaatgaccgttgatatcttgtaactatatctcaaacagttttatcctgaccaaccacctcgaaaagtattagtgatttctacctatatagtgaagaagaccgtaagtattagttccaaacatttagacccattatatagaaacagacatagaatttggaaattttgaataaaccgatcaagctgagagtaactaagagaacacaaataaataagaaactcaaaatatttaagagatttcagtcagtgaataacgaaagtacctcggagtagagattcaacgttgtattagaagtaaccaacgacgggagatctagttgagctcaagtcaccggataatatttcgcaagattgcggcggcggagagagattggtttcaaagagtttgagatcgatgagtgtaagagagaaatgatgaaaaagaagtagaagaaatagagttaggtttgtttgtagtttctcaaacataataagggtataattgtcatttatcatatataatacaacttttaagcgttgaccgcagcattatgccgcacttacttgcatctgccgctgttgcagcaacctagataatcaaacgaacatcttattaaaaaaaaacagaagctgaaagcccaagcttatttaaagatgggccaataggggcctgcataaagttccaattttatttagaaaatatctatttaacatcatttatgaataaagtgtcctccgatgctatttgggtttggttaaagatggattttggaggttttccaaatgatgtcagattttgaagatgaacaatgaaataaatatatctaaagcttatacatctaggtctcttacccaacggcgatgaaataaagaatacatgtactaaaacgacgcatgcaaaataatacctgaaattttctttctacgttggaactcattgcaaaagatgaggaatattgcatagccatggattggatagagccataaagaatcggtacacattgcttttcatattttaatatcgttaaggcgtaatgtaataagtattagaaatggatttttaaaagtatttagatagttcgggtttaaattttattttattgctgattggactttgttttacaattatagagaaataattttgtgttaaattatagtattatacgacattcacacaattacatttacattaacatgtaccacgtctattttataatattgctccaaaacgaaagagtggtcttcacgacgagcgaggtttaaaatttgtagtcgtgcattgcaaaaagctgcgaaaaccgtgtgaactctcaaccaaaccaaatatgatatgaagaaattggttcttgtccattcggtggttagtgtgcatgcatgtcggtgaattttatatgttttccatttacgaccttttctctttatatcatatagatttttaggggaaaaaaaaatcatatagatttttaaaaaatcatgttcccaattaagacataatgtttagtagccaaattgagaaccaaccttttttctgtttattaaataatttaagtggatggattttacacatatattttaatgtcttacataaataaaatatcatgttattttttttgataatatcatgttttattgataaaatccatacatacttgatacttgcaaaaaatatcatgcacaaatttatctctataaatggttatctaccttttttttttttttttttttgaacacaatttacctaataatcttaataaatataagagaaatgtaacgcatacttttgttggacattgtttttggtcgagtctgattggttttttgttcagatctatcggatttatgtatttaagatctaataaacaaattataaaaaatttgattcgatttggttatcgattttattaataatgttaatataatccgacttactttggttagaaaaattaattcaaaagtaacaacaaaaaaaaattggataacaaaaccatctaaaatcctgctaattaattcacatctaataaccgaatccgaacctaaatgaccaaaccatttgtgtaaaaatctcaagcctagtccctatatttcaatagatttttttcttttttttttggtcaagatcaatagatttttttcatcaattcaatttattgcaaatttgcaataatagttggtaaatactataaatgtaaatggtcacgggataacaaaagagcaataataatataataattgcataagacgagtcaacatgaccaagaaacattgaagggttcgtaacttcgtatcatcttcctcctcctcctttgataaacaccaaaaaaaggcagagactttcgaaatcaagaaca

SEQ ID NO: 8894 - DNA, 3000 bp, Unknown
  misc_feature (1)..( 3000): cDNA_ID_1989266_gDNA_ID_1971919_Annot_ID_58535 3000 nt of promoter + ATG
atccctatcactagctcactgctataatcgtattgtcgccactacaatcgtattgccgccactaccaccgtcatttttaccgttatcaccactataatcgttatcatcatcaccattgttaccgtcaatcccaccaccatcgctactgtctatgtcacagcaacagtttaccacgcttgcttgggttcctaatattgtatctcttagggtatagttttttaattgtgatcatatcggtttaactcggtcatttggatcgtcaatattttatctcttacgattatcgtagctattatttcaacttaaattactatcccaccaccactaccaccactattactttatttaatttaaaatattttgttctaaactaaaattaaaactgaattacgaataatttatgaaaatagtatagtacaacattttatttctatacatcataaatagtacaatataaatttacttacaaacattatttactattttataaatacaaatccgattataaaaattcaaactatgttgtatgtagaaaaaaacataaatttttatcttataaatttcagaattagaatctattttttggaaaagatatataacaaaaacataaaaataggtgaaaactaaatgaagagttactaaatcatctctcaccaactattctacaccaaaattgtctttttacaacccttatatgctactttcttattttatatgtatataatgctatattcttaattaagttatcaaatatggctagttttgcaaatgaccctaaaaagtatcactttctgtgaaaaaaaaaaaaaagagtcataagtacatttaacttttttcctaagtatgtagtcatttgaaccttctgaactcagggcctgactgctttaaatgtagcgggtgcgggtgcggttgcgggagtttgcggaaacgggtggttgctgtttcaagcgtttcatgcgttttgaacgactggttgagcgtttgataatgaatgagtttgcgggagttttatgactggtaaaccagcgagtatgatagttattaaataaaaaataccaaaataaatataatatattattattaaaagaaataaaaatataatatattatgataaattgataatattagaaaaaattgattttctgaccaaataaaatacaatatattatctcaaaaattgataaaaaaaaaataaaaatataatatatcatctcgtctgacagaggaaacaaatcgaacatgtattcaatcaaaaactcaaaagaatacaaaaaaaaaaaaaaaacgatgccatgaaatactcaatgaattacactagctaatgaatgaataaaagaagagatgatacttacgttcaattctttattttgattttcatcagtttgggtggatgccataattgagagaatatggttacaatatattgattagagttttctaataaaaataagatatataaaagattagattattttaattgtagtgattagggtttgagtgaaagctataattattttaattaattaagaaaaaaagaatttttttttaactaatcgctactgctcgcaaccgcaaacgcttgcagaaaaaagtttttaactaccgatctcaaacggttcaaaacgatatttaacagtttttataatttgtatcaatcgctaacaactgagggcctgactggtttaaacgcagcgggtgcagttgcggttgcgggagtttgcggaaacggacggttgtggtttcaagcgttatcaagtgttttgaacgactggttaagcgtttggtaatgagtgcgtttgcgggaattttatgactggtaaaccagcgggtgcgataataattaaataaaaaataaccaagataaatataatatattactattaaaagaaaaatacaatatattattatgataaatataatatattactattaaaagaaaaatacaatatataaattgataatatttgaaaaattaaacatgcttaataattaaaaccataaataaaactgaaaattcaaaaataaataaattttataagaaaaagcttaatactttatgcatttggtacatcaccaaaaattgcatcaagtagtgtgataaactgtaaataacgttgaactcgcggattttccggattgcctctttacatatgataaagattcttcaagatatccaaacgatttttaacacatctccaactcaaatttttcccaaacgttaatattcttaagaatattttctttttgaacatcacttagaaatctgattttggggtctttggattcttccgtttatttctccacaataacccgttgaagtaacgcaaatgtggtctcgtctgaccaaatgattttctaatcgagaaaacaaatcaaaaacatgtattcaatgaaaaaactcaaaaaaaaaaaaaaaacaacgatgccatgaaatattacgagaattacactagcaaatgaatggatgaaaggatagatcatacttacgtttgattcttgattttgactttgattttcgtcagtttgggtgaatgccataattgagagaatagggtttcattgattagggttttctgataagaataagtatagggtttgggtggaagacataattattttaattaattaattaattttttttaacctaaccgctaccgcccacaaacgcaaacgcttgcggtaaggagcttttgaaatctggcaatttcaagcggtccaaaacggtatctagcaatttctatgattgatggcaaccgctaataaccgctaccacccacaaacgcagcgtttgcgggcggcagagggaaaaccaatcaaaccctgatactatccgcaaacgcaaaattctgtgcatcagcaaaacccatttccaattaaattataaatattattaaatatcaagtctttgcgtctgaaattgcacatatccaacaaatgttaagttcttcagtttccttcaaaattgggttttcttgagaaagcattacagacacagtaatg

SEQ ID NO: 8895 - DNA, 3000 bp, Unknown
  misc_feature (1)..( 3000): cDNA_ID_1692104_gDNA_ID_1971919_Annot_ID_58537 3000 nt of promoter + ATG
tgatttcgtcggctctaggtacactctttatccatttaatccgggcatgtaccttccccactacgtaactattcactgtcacacctaaaggtgttaacataataacaaagatacacaagtttgcacgcgttaattaacttgtctctatgcaaattttgcataatggaatatacgtgtaataccatgtaaatatacgcgtgtaaaagcaaaacgcatgaatcgtatgatgtgtgttaacaaatttggaaagtttttgctcttttgctgccaccaaatcttcgtattatattttggacattaccattttaacgagatggtcattgccattgggagccatgcggactctagttcgctggcatgttcatatccttccacatcgtcttctactcgtggaagaagcacacacaactacacctttcatcttcaaacacttgtcgtcattaacagtttaacaccataatgttaaactcggtttagcattttggtgtaattctacctctttaaccatacatactaaagacgcagagaagttcatatggtagttaatcgtaaatagctaaacttttaattggggttaacatattatttaacacttaacatttaactattgatctctcattttttttttattaaccaaaataaattcattttagaaccaaacgtttcaaaaactcgtaatgttttctcattaaatcttatctatagctcacacaaagaaaaactacggacatgcatgcacccaattatatacatggattattatttttagtgttataatatgatacaaaataaaaaacatttggatagccgataggcgatagccactataaatataccaaagaggttggattatacatatagccgtaataccaaagagagtatcagatagaaatagttctaatattttgtacaactcacagaaattgcatgagtttcgaacatggcagtcttccgaagtacactggttctgttactaatcatcgtctgtctcaccacttatgaggtttataatatttttggtctttatagttccccaagaacacctagcaatattatactcaattcatgtttatatgataatgactgatcattctcttcagcttcacgtccacgctgctgatggtgcaaaggtcggtgaaggcgtagtgaaaatcggtatgtaaccctaacttatatataacacgttggtatataacttaatatttctgatgggtgcactctcttcccaacttatatatatctttgttatggagaatgtctcaagcttttaatgagatgttatatctcggagaaggaaactatgaactaaaagctttggattcctttgcaacaaatataaacttttgatgggtttaaacggattaaattagttacatgtgtttgatgaatgtatgtatgattgtagattgtggtgggagatgcaaagatagatgcagcaaatcttcgagaacgaagctatgcttgagagcgtgcaacagctgttgttcccgctgcaactgtgtgccacctggtacttctggaaacacccacctttgtccttgctacgcctccattaccactcacggtggccgcctcaagtgcccttaaaatttcttctgtgtctgtttctgtttctacttctatttcgaatatatgtacatgtgtgtgtacgtgtgtatgtatacaagtactgctatgttttggaggacaaaagtatatgtatgagaagctataaactaattagaagttgatggttatgcgtattatcaaaccgtgttacttctgaacaaccaatttcggtttgttccaagtttggcaaccctaaaataaaaattcaaaatgattggagactactcgttaatagacattgaaaacgatgaaatctcgttacgtttttatattttttgaactgtaatattattatgcagaagcggttttgtaatgggccgacaaaaaaaaagtggttttgtaatggatatgattcggatctattctggaaatggtctcaaaaagtagagttgagatctcaatacgaaaatgaaccctttcgtttgatttatcaaagccttttattttgaaaacgttaaatcctcactaggatctctctttatattaatggttaaaaacatatgcatgttttgtgtttttgcatcttctttttcatagacaaaagcaagatgagtcttagaaggacatcaatgtcatagacatggctttagtatcttttgagtgtgctttaaatgatgatgatttaccctgaacctgaaattttacctattaattaatttaagtgtgcgttaaaccataaaccatatactctgaacctgaaattggttctaaagcacaacctaaacttgagattggagaatgctttaaaaggaaaaaaaaatcaaaggaaaccattaatgagccatcaaaaaatattcactaatatgacaagatgcattgtttatttttcttttcagaatcctcagaaactaccactaaactcctcaaggaacaaaaccatatcatgaattaggctggcaatttaactctgagacgtctttcttgtatagagaataaaacatacgcgtgtaaaagaaaacgcgtgaatcgaatgatgagtgttaacgttcgatcgagatgccaccaaatcttttcattaaaatgaattgtggaggacataccacttttaacgaggtcatttccactgggtgacatgtggactctactttgggtggcatgttcatatctttccacatcaccatgtaaacgtgaaaacacccaccacactcacttacatctcaaacacatgtcttcattatcgtacgtagctccaaaaaaaaaaatgaaaactaggtttagtgattctatttcgcaatgtataatatacaacttgtaaaaataaaatatttgaataagcattataaataaacccaaagaggtgttagatttatatacttaattgtagctactaaatagagaatcagagagaatagttttatatcttgcacgaaactgcatgctttttgagacatg

SEQ ID NO: 8896 - DNA, 3000 bp, Unknown
  misc_feature (1)..( 3000): cDNA_ID_1989265_gDNA_ID_1971919_Annot_ID_177170 3000 nt of promoter + ATG
tatcaattacagcagacgcaatgatataattgtgatgattaggatcttgggctgttgcgaaaactagcataccgccgtatacggtcttaagaaaagtggcatccacaataacaactttcctcataactttgaacccttcaatgcaagcacccaaagcaacgaataagtacttgaacttttgttgtgcatccacttccacatatgatattgtcccgggattcacctcctttaatacgtacagataagagtacaagtcggtgtagcttttttcaggactaccacgcacatcattaacgtgttgtcttttccctctccatgcggtagcatacgagcaatgcaaacccattcttccccgaacaatactcattatgcttttaggtggtggagtttgaaactcacctggataatcctcatgcaaaatatacgcgattaatcgtggtgtgctggtatgtttacaattgcctgagttcttattagaccgcttgcatgtgtgcatcttcctgtgaactttaacactaaaacaatctgaactctttacttttgcacatcgtaaatactattgacaacctgttgttttatattgccgacatcgtaacatgagtcgctttggatctgacgctatagttgcggtcgcaaaacaatacttatttgcagctctgttaaccaaatcttgcacggcctccttagaaacaaattcttggtgcaattcaatccccgttccatcttcccattccgtaacactctgacttttctcgctactctgacttccttcaccaacacatgaaagctcataatactcaattctaccatcaacaccattatcttcagcaacatccatccggctatccacatgctccctatcttcaataactacattctccatagcctcttcaaaaacccggttatccgcattctcaatagcctcttctacactattagcctcttcaataatcggttcatcattcacacaattacctcctgcagtttctcctctaaaaatcgtcactactccaccattctccatatcaaatgcattcaactcctcagaattaataccaactgaacttcttccctctacccttgaattttgttccaccctctcagattctttatttactacctccacgttcaaagttggtctaattcctttagcattcactaccgttagataacctaaaaagtcatcatcatctacaatagatgtatctctctgagatgtgcatagaatataactcaatttcaccttccttgaggtttcatctattccaatcttcttgcatatcttttctactaacatagagtatgttacctttaacgttctcaacaatacaccgcttaaagaattgtttgaaatccactcatgctcttttgaataatacccattgtcaaattgtatgaatgtgtgcttgttcttcatcgtctcctgtaattacaaataaattataaaaacacaattacgtaatcattcagatttagacataattgtacctatattataactcactaataccattcacctgtcctaattataaaacactattcttttttttttactaaatcactaatgacataattataaaacactattcttttttttctgtgtggagtagtgactattgaaaacaataattaatatacaattaacgggtttaaatcaatattaatatattatgatatattacaggtaaaattctaaaattaacaattaatatacaattatacaatcttaaacaataaacaaaataaataatattaactaaacaaatacaattaaaatttcagttataaaaatattgtaccatatatttaaattaaacaaaataatacgatatactatagatcatccttataaaaaaatcaattttcttatgaatgtacaactcaatgatgtaacattatgaaaaacaataattaacgagtctactaaattaaaaaataattttgactaatttttgatcatgtttaattctacaaacaccaatatttgaacaatcaaaacccattattaataatctgcacatgaatcgttgaccatatatacacacataataatcaatgtgcatataaagaataaagtaaatgtatgtattcaataatttaaaaacctggaacacagaattcatagtttctactagtttttcagtgtttaaattaaatgatgttgataaaacattttagttaattttctgaaacaacttctttaaaaatagagaaacctccagcataaatttagtttgaataaatttaaattttatgattttatttactccatttgtgtttgacgaacagtccaagtctagtataacacagactgatatataatttggttatctacaacttataatatgcatctactttgaagtaattaatcatatgtcaacacatactctctccatattattttaaatgatattttagagaaaaaatttagtttcatttaaagtgattttttttaatttttaaatgtatataatattttttgaccaataatattttatgatatattttaattattgattgaattagttataattaataatactttatatgaaggagataaaattaaatgaaaattttgtaatttctaaataaatgcgcacaaacaataaatttgtcaaaaaacaaacattggggaaaatggtacccacacccaccataagagagtaaatgggtcggatccaaaggacagtctcgtaactgacaaattcacgccacgtcataccaacaaactgttgctgatccaaacacacgccgtcatttagcccggaagcgcgtgacatttcacgcgccttctctctatctcacccaatcagatcgttttaatggttgtttgtttaatcgatcttcttcttcgtcaagtatctcaaaatcaaaaacaagtttgcttcattcatacttcaaattctctcttcacattctccactctctgcttatgttaacgtagagagagacggcgacgtagaaggagtaggaggaggaggcttcgtcgacaatgcgaga

SEQ ID NO: 8897 - DNA, 3000 bp, Unknown
  misc_feature (1)..( 3000): cDNA_ID_3085127_gDNA_ID_1971919_Annot_ID_177169 3000 nt of promoter + ATG
tgacctgcaaatttaggctcccactgttcttctccatcaggtttatcctccatctgtatgtattgtaaggagggtgcagcaaaattttgagttttcaaaggctcttgtatttgttgactggaattcaacagcttcatctcacaagatacgcctataagatttaaacaacaagagtattctgagtagcaagtacccagaatatgttctttaactcagctaattataacacattacctgaaaatctgtgacttcgagctcttctttttgcatcagtttgcgatgttttccccgacttaccactaagaagagaagacttcccacgtgacctttttgaagtagctccatgaaccttttcaattttctgatgcttggtcgtggaatgaagaaacacagatgcagtctctttgtgagattcttcagcaccatcctcattgtgcctatgactatctttgtgtgattcttcagcaccatcctcattgtgcttatgattatctttgtgtgattcttcattttcatccccatcatgccccatgtcaacatattcatccccttgagtatcatgagaatcaatcgaatcatcttcattagattctgtatcaaatggctgatgatgcccatcattctctttcaacgattgaccaccttttacaagagaagcctgatactccacttcatacttcttcagctcatcacgtccagcttcattgtaaaaaccaacccccttccaatccgaacccttcaaaggattccgaagcgatacatcctttttcacttcagacactgacctctcctcaacaacagatttatcctctacatcatcctcattataatcttcatcccttcttctatcatccttatcccaatctctcgaatctcttccatgtaacactgaaccatgaccaaacttaagtattttcaaaggatcagttcttgacacattcgtaagaaaatcaccttcagctgtatcaattcctgcaacataaaacgtaaaacaacgcatcagcttctttatcctattccaaccatcaatttctcgaatccaattcctatcagctaaacattcatactcaaatcaaggatctagctcgagagaaatcgaacactgacctttatcatctttgccgaaattagtataaccagagaaataatagtaagctgagacacaaacaacgagcacaacacaaagaacaaacaccaaagagccaacaccacaacgacgattcctatctaatcgagtagatcgccgccatcgactagctttcccgtgctgagttacaactccgaaattactaccaccgccgttacggatcccgatcgctacgtgatctgacgaagctccaccgttgacataaggattgtaaccgcttcgacctcccaaaaacctctctgttcctgattgtctatactgagccattctcgcattgtcgacgaagcctcctcctcctactccttctacgtcgccgtctctctctacgttaacataagcagagagtggagaatgtgaagagagaatttgaagtatgaatgaagcaaacttgtttttgattttgagatacttgacgaagaagaagatcgattaaacaaacaaccattaaaacgatctgattgggtgagatagagagaaggcgcgtgaaatgtcacgcgcttccgggctaaatgacggcgtgtgtttggatcagcaacagtttgttggtatgacgtggcgtgaatttgtcagttacgagactgtcctttggatccgacccatttactctcttatggtgggtgtgggtaccattttccccaatgtttgttttttgacaaatttattgtttgtgcgcatttatttagaaattacaaaattttcatttaattttatctccttcatataaagtattattaattataactaattcaatcaataattaaaatatatcataaaatattattggtcaaaaaatattatatacatttaaaaattaaaaaaaatcactttaaatgaaactaaattttttctctaaaatatcatttaaaataatatggagagagtatgtgttgacatatgattaattacttcaaagtagatgcatattataagttgtagataaccaaattatatatcagtctgtgttatactagacttggactgttcgtcaaacacaaatggagtaaataaaatcataaaatttaaatttattcaaactaaatttatgctggaggtttctctatttttaaagaagttgtttcagaaaattaactaaaatgttttatcaacatcatttaatttaaacactgaaaaactagtagaaactatgaattctgtgttccaggtttttaaattattgaatacatacatttactttattctttatatgcacattgattattatgtgtgtatatatggtcaacgattcatgtgcagattattaataatgggttttgattgttcaaatattggtgtttgtagaattaaacatgatcaaaaattagtcaaaattattttttaatttagtagactcgttaattattgtttttcataatgttacatcattgagttgtacattcataagaaaattgatttttttataaggatgatctatagtatatcgtattattttgtttaatttaaatatatggtacaatatttttataactgaaattttaattgtatttgtttagttaatattatttattttgtttattgtttaagattgtataattgtatattaattgttaattttagaattttacctgtaatatatcataatatattaatattgatttaaacccgttaattgtatattaattattgttttcaatagtcactactccacacagaaaaaaaagaatagtgttttataattatgtcattagtgatttagtaaaaaaaaaagaatagtgttttataattaggacaggtgaatggtattagtgagttataatataggtacaattatgtctaaatctgaatgattacgtaattgtgtttttataatttatttgtaattacaggagacgatg

SEQ ID NO: 8898 - DNA, 3000 bp, Unknown; identical to SEQ ID NO: 8895
  misc_feature (1)..( 3000): cDNA_ID_1692104_gDNA_ID_1971919_Annot_ID_177167 3000 nt of promoter + ATG

SEQ ID NO: 8899 - DNA, 3000 bp, Unknown
  misc_feature (1)..( 3000): cDNA_ID_2179369_gDNA_ID_1971919_Annot_ID_177166 3000 nt of promoter + ATG
ctattcgggtttaggttcgggtttttcgggttttgaagtttagacctgttcggtatttgaaaattttaggttcgggttcggatcgggttttttggatcggtttttcgggtttaggtattatgcctaggcctattaattatgttttgttaattgttaattatttttaatactaactaggatatagatttgatatgtcataaatattattttgatatgaaaatgttatcactcaatatgaagtgtgtataatttaaatcgagtttattatgatgacatagatagttaaactgtattacaaaattgaatggtgtaagatagaaatttgtttttttctttttcttttctagatactaaattaattatagaataatggtcggttactttttagaattaaaatatcattgataagattgagtgtatataattaaaatagaatgcataagactgaaattttgtttaaaccaataattattaaattaaatatcaaaataaatatatagattgctatacaatattcaaatactatcataaaaatttatttttgtatcttacacccgcctaaataggcgggccttatctagtacaaaataaagcttagaagtcagaaattcatcagatggaaaaaaaaaaagtccgaaattcatccatcaatgacactcctaacttcctatgtgacctttttaagttttagcatttgagtttgagcaacgtcctcgacatacttgagctgcccactagtactatcccttcagacaacatcttgatgaaatctgcaataagcactaatacataagtgtaattttgaaataaaaaggcggacaaaggcacaaaactataccacttataatcatcagtatacatactaatcatagtttcactctcactctctccatcactcatacatcttctccatccatcacacgacgaagcataatggcaaagtattggaatagattcgtttcctaatcaagaaaaaggaaattcaagaaaagaagaaaatcaagcaaccaagaggattgaccaaaaaggaaatcatgaagaaaaggcaaggcacacaaggaaaagggaaattgtcacaatgtgaattagcaagttactatttttgtgttagaatgataactctataaattaggttgcttgtgttagagttcaatcatagaaaaagagaaatcccaacacaaagccgtaaatacataataccaatgacgaccaaagagtgcggaaaccacggtggtggcggtggaggaggcggaaccgcctgtagaatctgtggagcaatcatcggcttcatcatcatcgtcttgatgacaatcttcctcgtttggataatcctccaaccgaaaaacccagaattcatcctccaagacaccaccgtctacgcctttaacctctcgcagcctaacctcctcacctcaaagtttcagataacaatcgcttcacgcaaccgaaactccaacatcggaatctactacgaccatcttcacgcctacgcttcttaccggaaccagcaaatcactctagctagcgaccttcctccgacgtaccaaagacacaaagaagatagcgtttggtcacctctcttatatggaaaccaagtccctatcgctcctttcaacgccgtggctctcggggacgagcagaatagtggggttttcacgttgactatatgcgttgatggacaagtgaggtggaaggtcgggactcttactatagggaattatcatctccatgttcgttgtcaggcgttcataaaccaggctgataaagccgccggagttcatgtcggcgaaaacaccgttaagtacacgttgatcaataagtgcagtgtcaatttttaggaggtaaaaggacacaactttgacgacgtcaatgtttgcttttactctttcttcttcttttcatttttcttctactcagataatgtttttgcttctatatcgtttaattttctacctttttctgctgatcatataacatacataaaatcaaaaaatttaatatgataaattcatgttagaagaacttgccaaataaaaaccgatacagaattttcttgtaaaacattcttctttcttttttcttttttttttttaactttaaatttccacttaaattaaaataaagaggattacaaggttaaaaacccaacatggccgcaggcctaaaaaaagaaagagaaattcttcaaatttatagttacgtaaaccttcaaatttaataaatttttaaaaatcagacataattatgttgacacaggcggccctaggttctagaacggtataaccgagaaaccaacgtacgacgagagaccaaaaagtaatactaacatatacgatcttacaaaaagtactcatatatatacttttgtttgttagaattcaaaaatattattgtggctaaatggtttacaaactcgtattcgtttcatttgtcagcggttggaatcagttttttgctaaaacgatatcgttattgtaagaagtgactcagattttagttttcgggtttaagtgtgggagaaactcggtgaaagagaggattcgaagtctgttgtgattcgagctgactaaagtcataacacgtgaggcgagctgactaaagtcataacaagcttgagggcgttttggtcttttcgcatgagctctgtaactatatcttcttcttcttctctgtaattctgttagatcgggataagaatttgttgagatcaaagagagagaggagtgtagtgagagaaagcttgaaagcattgtaacagagactaagtttccaagttctagtggatttccggagaggtttctccggcgagacgtagcgttccggtttggaacgtgaactcgttaaattctctgtgttcagcttttcttttactttctttcagttctggtcaattcgattcttagtgctaagttgattcgtgtgtttgtgagattgaagtgaagttagatctttacaaattggtatcagagctcacggttgttgagcgagtgcgaatctaag

SEQ ID NO: 8900 - DNA, 3000 bp, Unknown; identical to SEQ ID NO: 8894
  misc_feature (1)..( 3000): cDNA_ID_2106879_gDNA_ID_1971919_Annot_ID_177160 3000 nt of promoter + ATG

SEQ ID NO: 8901 - DNA, 3000 bp, Unknown; identical to SEQ ID NO: 8893
  misc_feature (1)..( 3000): cDNA_ID_1989267_gDNA_ID_1971919_Annot_ID_177159 3000 nt of promoter + ATG

SEQ ID NO: 8902 - DNA, 3000 bp, Unknown
  misc_feature (1)..( 3000): cDNA_ID_3085140_gDNA_ID_1971919_Annot_ID_177156 3000 nt of promoter + ATG
tcttcaatatttactcacccaagtctttaagtgaaaactgatagctagattttgtaaaatattttcaaatgcatccaaattgtttcatgtgatgattatgtcattaacatagaccaatgaatagaggatggtataacattttgtatgtacaaataaggaaataatgcattcagacacttagtttctaaaactggatttgatgagataattattgagctccaaataccaagcccgtgaattgctataaatatctttagcaatacattcttaacaatattttcaacaatgtatcactcacacaatctttaaacaatttttgtgctatagcaattttataaattataatgttataattatacaaacctcaaaaatttgatagtggagctactcacatactctttttaaaaattctgaagaataacctactcgaactattagctaattcaatatactattatttattccatattttaagttaaaattataaaaattagcagaaaatcctagagcatgagaaaactaataaaataattttaaatattaatattgatacaattaaatatgtaaaattaaataatatgtataattaaccattatttacatttactatttagagaacatgtgataaatgctaaaatgatgatgtatcattcacatgaaaagttaaccaactttcataaatactagatgaattcccacggtacgcgtgggtttgttttgaaaattgtttagataaaaatatgttaattatttttgttactaatttatgttttgtttgttattttatacttagtaaaattagattcatcttatgtacttgcattttttattgttatattcatttttgactctaaatattaatttctatatactttcatgtataatctgattatttttatatccaaaattctaaaatctgttcattatcatgaatatatcacaacaagaatataaggtatttttatttcaagaattttcgtatgaaagaaagaagcaaaaattaaagagttattttagtaacactttttagattttatgctattgcatatagccatataagacaaatggatttattttaaatttcatagtatgtctaacgtctcaaaagactattacttgaaaatgttgaatgtcaatgttacgaaattaccataagatataaaaatgaaaagacagaatttcatatgatacaatatgaaccataacgtaataataataaaaaatcaaggtaaaataaataaactattaggtagcaaacaactaaactacaacacaaataactatttagtcattatagagtgatgaccattgaccattaaattttttaaaaaataagaaataataaaagtaaaataaaagtactaattgatttatttaaataaataattttataattttatttttattttgaaaaaatcatttaaaaaatgaattaatggaggatttaacacaatatgagacttttgattttctctcaattaattttgctgattttttatttaatcaatattcaatgatacatgtcatttttttgtgtgatgatatgtcacccatatggagaaagttagccacctttcatatatgatatatgatgattatcatttcgtaaattatttcaaaagcatataataaaataaatactatacaaaatttcttcctaagactattgttcttcgaaagccataaatagtcatttggactggtcaaatggacaataagccaagacgagactataaggctataactttctaagatggttgatataagtttgtcaaagacaatggtctcattgacaaatattttatctttttcaatggttctcaaaggagagcgaagttagtaagataaccattcaagttgacagaatggtcaatggactctatccaactagttgcatcacttaatctgagttcaatttatgtcggtgcagtggatactaattgtcttccatttaatatgctttgataccagatccatagaaactataggggtagtaaactaataatgataacatttgttttttttaagaaatttgatattgcaaaatttgatatactaattaaaaataaaataatggataatttggatatatcctcttatatttaacacgtttttcgttatattggaataaaacaaactaggtgttttcaatggataattattccaagagatatgagtatggagtatggaccatggtcctagaaatttgggatggggattggcgggtaatccttccggacgtggacaagtttatttttatgatgcatatgcttaataatctattactccagtaatttccttaaaatcttaaacaaattcaaagaagaataattcaattttacttgttaaaacattgaatctttgacaaacttgaaaatcatattaatttattttattaatagtattaaaatattaaacgtcaaataattttctcgtttcagattttgtggtccacaattgctcacaattacatatagaaaaaaatatttagctattatgttagtcaacttatttgtaatatttcaccagattactgtattactatttaaatcttgaactaattagccatccataattcataatcggaaatttatttatttgacacacatgactggacaaatgttttcccaaaatcagcaatatgtaatacttttttttttgtttgggcaaagcaaaatattttgtttttcatgtgaaaattattttaaggtcctttttagcagaaaacaaatgttttgggtacatttcgcaataattccaaagttaactgctgtaaaccaaaataaaaacaaaaaataattattctgaacaattctagatattctcttcatagtctctggtctcttaactcgccttctatggaagctcaagtgtttataatcttccattaaaaccctaaaatactttttcaatttcttcttccaatttgcttcttttctcttccgatacaaatattcatttttgggttacttcgattcctttaaagctttagaaaacatg

SEQ ID NO: 8903 - DNA, 3000 bp, Unknown
  misc_feature (1)..( 3000): cDNA_ID_2154004_gDNA_ID_1971919_Annot_ID_177152 3000 nt of promoter + ATG
actcattgagcggcgaagaaaagaacatggtcatactaacaaacaatattccctacatttcataatattaaatgttttagataaaagcataaagtttaagaaagtaattaattttgagttttataaattaaaaatacaaattaatatctattaaaaataattagggttcaaaagccgtttaatataatgttttgcatagaaacttgaactgtttcttcaaaacatcatataatatgaaacataaggagtacaacataagaatatatgaaaatgcatagagattggatgaagaacaaaagaaatttacctatgttttacttgtaattcattttttgttttgcttatattttacttactttttttcttaaaaacaatattattattaacaaaatttatattttgtgtaattctagaaaaactataacgtattaacataatcgtaaacaaaatctcttattacaaatacattataagcctacactaaaatatgggattatagttttgacaaagaatgtgatttaccttttctaggaatggaacttggtattgtttttcatttttttagctggaacatagcaaaaagtaatcgaaaataaaattagagagattcttacatagaaataatcaaacaatttacaatcaaaattttaaagaaaccaagtagcatatgtggctagtcatctaattctatatactaaattaatattataatttataacaatgtaatcatttttccttaatttgatatagctattaatttttttttatagtttatagcaagtaatcatttgttacaacaatgtaatctatctaagtctaaattttccaatgaaattaaatgatataatattaatttactgtaaaaaaattgaattagacaaaaagataatcatttatttcaatttgaaaactgtattaaatttcagaaaaaggtaaaccattccaaaaacattaattcattgacaaaaagttaaagagaaaattcgctaaacaatttttaattggtttttcatcttataatttggtattaaatgtaaaatacataattttgtttatagaaataaataaactacataatttattgttgacagtgtatacatttatttagatgtgtttctatataaggtgcaaaataaagaaaatagaaaatcatatatatgaaagttggcaaactctctccatatgagtgacacatcatcacaccagtgagtgtcacatgtcattctaaattaatatcattaaaaaataacaaaacttagtgataaaaattgaaaagtttcacattgcattaaatcatccattaatctcactcttaacaaaatatctttatttataagaaaaaatacaaaaaatcatgttaatgtatcaaacactactttcattttacttttcttattttgctatttttataatagtcattacttgataatgactataattttttgtgtattacaacttagttgtttgctacttaacctttcttagtttagtaattttaacttactcttttctttttattacattttttggtttacatgatatggtttttttgtgtgtttatgataaattggtaacattaataatgacatgcatatttttaagtagtgatcttttgagacgttagatataccaaaaagttcaatatacgacgctttctctaatatggatatatgcaaaggcaaagagaaaaacctaaaactgttgacttaaaagactatttaatttaagctttcttttttctctttcatgggaaaacttttaaagtagatgagtagtttatatatttgttatttaaattatgtcaatccaatatttagccatgagcctatcatgatgtgattggaatactagattaggagagaatacatggaacaagaaattgtttgcttagaatcaagttaggcaactttcaaaccaaataagtagtataattgcataccattgtatcatattgttgatgtaagtatttcatgatagttaaaaaagtttagaaacttggatatatagataagaagatttatacatgaaaaaataataattgatatttaaatcaaaagtgaatctaactatacaaatataattacataaaatgaatataactttattaactacataataacatacacgaaaataacataaattagtaataaaaatagttaaacataattatttttaaacaaatttcaaacaacaacccacgcgtagcgtgggtactcacgtagtaaatacaaatgagcaaaatgctggaaaagtagtcgatgtgtgcacattctggatatgctttggtgtttctgtccatttgttacatggttcttggtgtaaagaagaaatcaagaaatctcttccataacaaagaacaatacatagaatatagttgatcttctcgcaggagctaagctaattggactaaaatggatgtttaaaataaaaggaaactcgtatggaagcatcaacaagtataaagcgagacttgtggctaagtggtatgtgcaaaggcatggtgtagacttcgatgaagttttttactctagtggcccgcatcgggacactatactttattattgcattggcagcctcaagcggatggaagtaaatcatcttgatgtaaaaacggcgttcttgcatggagagttaaagaagctagtgttcacttctcagctagagggtttgtgaccgaagaaagtgaaaataaggtctacagattgaacaaagcattatatggactcagaaaagggcctagggcgtggaataataagctgaacaagatctaaaggaattaagctttgtcaagtgttctaaggaaccttccttgtatcggaagcaagataaggagcatctccttcttttagctatctatgtagatgatctacttgcacatagtctagtcaaagtcaaattatcgagttcaagaaaggaataatctccaagtttgagattagtgattttggtctgctaacatactaccttggcattcaggtgtttcaacacggtgagggtata

SEQ ID NO: 8904 - DNA, 3000 bp, Unknown
  misc_feature (1)..( 3000): cDNA_ID_3085115_gDNA_ID_1971919_Annot_ID_177180 3000 nt of promoter + ATG
ctattagtttatgtttgcataatttttggtgttactgaacggatgttaatttagactcatttattgctcctgagtagtctttcttcagtttccagtggcatatagaaaactcacttgtccattgataaattggttaataatatgtgacatccattctctctcttttcatgagtttcattttcctggtttagatgacggatcatcaacttatctttgctggacgagtggggaaagagcgtttacaattcttaggctgcacgaagagttacctgaagaaaccattgatgtggtacagtggactagaagatacagcaactggggcaccacagcttaccatcttgaccaaattgttcgggttcacaagagaatagtgatgaagtgcaatggatcacagattgacgtactctttcaagacatcaccattgctgttacttcagatcaacttctcaccaaatcagaggataagttcctcaagtggttgatcctaaatgccattagcggccccatatgggtatatgccccaacctcttttatcatctcttaagtttattggacttttattattccagaacattaaacggtcctacctgaagaattaaccgacagaacttactgatggttctctcaggtctcagattgtcttactgtgtgagaatagatagaaaacagaggatatgttgctacgtgttattaattttagtaggctatttagcgggtggacaggactggaatcgagtagactaatcattttaatgagaggataagactattacaacagttgtctcgcgcatcaaaataaggcggcatgcttttctaaacccaatgactatgtcttgtcagtttaatatttcattagttgcacaactgggtgttttaataccaagttagtagtactcggtttccacttgtgatcttggaattgatcttcattgttttggtttaagcaggaagttgccgcgagctcaatggacatgaaaatgattgagcatttggagagggaacagtgtgtggagatggagacatcaagatataatctgcagagtgtttggggtaatgaagtatgccaagtggatccgttggtccgagcttggagcttactccaaggtttgctaaatagctgatcatgtagtagtcaaaaacattcatccaccagtcggcgattcttcgtgtccatacatcaggagagaacgacaatttgtcgaccctaagaaggatgcgctgagatgaagcaagtacttgatcttacttatattaatgtcatgagtgtagacaactacaaaatcattcacaattttgagcttttaggcattctttagtatatcccaaaacaaaacttcatatgtacggatccacataaacgatttaaagtaatataagatggtaatgtgttaaaatctattcattagttaattttgaatttaaaactcatgattacttaacatgtttcaaacttcagagtatggttattgacccaaagaggttgacaatgagtcgtaagaattattagagaaagtgtgatctaatttcgaaaaatataataaacacgactcaatctagttatcgttatttggttttgaactagaaaggctatgaaacttaacattgtatctagatacaatttgttgacttgactatgatagtttggtcatgatttctcaaaaataagaaggattaaaactagaaaaaaaatcgataattctttagtcgaaatggtaacatttaatatttggtgggaaaactgcattaagtattattgtaattttaaccacaaccaattagaggttagtaattgggaaaaatgttgtttaatacgtgaactttcaaaacgtggtcatttaatatgtgaaccttttatatagtcagttaatacgtagaaaaatgtaattactctaaatggatattttctctaagtaacttatcagtataacgccttcgtaaatccgttagtaaattaccgatgacttaccgatgaattttttttactgacgttctagaactgattgacaaacctttgaactatttttttttgcagcttttaagctggtatcttgtagatttctcctttttatcctatatgttttatcagactggttaactgataactaatatttatggttaagtgagttggagcaaaacatctcagaaacacttcaaacgaatgtatttttcattttttaaatctaaacaataaaatgattaaatgattgtaaaacttttacaatcatttaatcattttattgttttagtatttgtttgacgattattttatgcgttagtgaaataaatagatttatatataactaagaaataaccatagttactacttaagtaaaagatatggatcatgaagtatgaatttatacataatcgtataaaactaaccaaaattatttaaatcatctagttgccaatagaacaacaatcagtggcggctgagatgggagggtgagcggtgcgaccgccccgaatcaaatcccatattcaataattaaggggtcgattttcgaaaatatttttataaataataataataattcaattaataaaatgaaaataagattgaaaaatgtcatgattatttatatgtatgttgtttttagtaaccatttcttactaaaaatatcataaatttgtttttatatagttaaaagtttaaatcccaaaaaacatttggcattggcattttttttttttgccgtggggtctacgatagtgttgagccggccttgcctacatttttatatctgacaattaaatggtttcgtcaactaaccttatgaacgtgatctattctgtcattgaaccatccataacaattatatttgaagttttaaagaaagactagcaaaagtctgatatgtcaccgacgacttttgagaaaagagagaaagagattttgaaaggagcacatcttgaaatctcagatccaacttatttcttcttttttcttctgcttctttttctttttcttcttcttcttccctttcttcttatacaata

SEQ ID NO: 8905 - DNA, 3000 bp, Unknown; identical to SEQ ID NO: 3227
  misc_feature (1)..( 3000): cDNA_ID_2158031_gDNA_ID_1971919_Annot_ID_177179 3000 nt of promoter + ATG

SEQ ID NO: 8906 - DNA, 3000 bp, Unknown
  misc_feature (1)..( 3000): cDNA_ID_3085127_gDNA_ID_1971919_Annot_ID_58538 3000 nt of promoter + ATG
tcgtggttctttaacaagctgaaaacagttataccagatgaaccaggtttggtttttgtgagtgatagacatcagagcatcatcaaatcaatcatgcatgtgtttccaaacgcgagacatggccattgtgtttggcatttgtctcaaaacgttaaagtacgagtggaactgagaaggaagaagcggcggctaacttcattgcatgcgcacatgtttatactcattttgagatcacgagagagtatgctcgatttaggagaagatttcctaatgtcggtacgtatttggatagatgggctcctgtggaaaattgggctaggtgctattttgaaggggataggtataatatagacacgagcaatgcgtgtgaatcattgaacagtacgtttaagcgtgcaaggaaatacttccttttacctttgcttgatgcgataattgagaaaatttcagaatggtttaacaaacataggaaggagtctgttaaatattctgaaacaaggggtcttgtgccggttgtggagaacgaaatacactccttatgcccaattgggaaaacgatgccggtgaccgagcttaacagcttcgaacgtcaatacagcgtcattggcgaaggtggtatgtcttattctgttgacttggtaaggaaaacttgttcttgccaacgttttgatgttgacaagtacctgtgtgtacatgcgattgccgctgcccgaaactttgtggggaccgaatggatatcagatagtctcgaaatggaagacctaacttcgcattattaccatatgaatacgtggatattggcataccacagaaccatttatccagtcccgcattcatcagtttggattattcctgatgagataagacaattgatagtcttactgccggataccacaactaaaccggggagaaatcaagaaacccggtttccatcaacaggagaacgttgtcgaaggaggactaacaacaagaagagaggttagggtcgatgcgctgcagagccagcaggatgccacgtggcagagagtggccacgtgtgcggattgttacaaagattgtataattgtagtttgattgttaattgtaggattcatccataatataccatattttattaatatcgactcaaatccgtcaattctaaaactgcaacaaaagtataaagtttaaatgtttatacaaaagaatcgagatacgttttaaaaaacaaattaaattatatttattttgttaattttgtttattttgtttagtatttaaaattatataaatatattttaattattaattttaaaatttcacgtgttctgtattattatcgacaaatgaatacacaaataatagaaaacaatggatacataaatcgtaaggtgataagatttgtttgactggaattgtcaaataaaatgttgtgcatgcactaaataattttttttgtagtatgtacaaaacaattaagttcacaaaaaataattaatttatagtgtaaagaccataaaaactcagcttcatcattgtggaaataagagattcttgtgtgggatgttgaaacatcaagaacactcacggtagattcatagtgtaggaggtctccagctactaaaagtggaccagttctcttttcacaacactgtaagttcaaaccggtttaaatagccagtccggtttaattttgaaaaacactaaaccgtgactattggaaacaacgtaaagacgcaattttttctgaaagcgactttttgtttttgcctctctatctctcaacgagacaatggttggttcctaaatctctcacctcaacaaatcttctgatcagggtttctcagaatctttctactttgttgactcggttgcttatctgactcagtgatttgagttcatcggtgaacgagttaagagtatcctcgcacactctaggcatcttttctccacttgcgtcaatggtattctctcaatcgttgtttcaatgcttctctgttcacaatttgtgatttaccttaagttagattctcgaattcgattagggttacacaaaaagtttggatttttattaaaaggggattctgaattggtttaggacaagtcattgtcgatttatatttccattatgattttgttcatcaaatctctctgatttggatcgaaatttgaacatatcaagcttatgcttctgttcctgtcaagttccttaacaaattcacacaaagttttgtcctttatgatgttctctatgatttgtacttagattctattggttgttcaatgctcatttgtgattcagaacactattacttcttcacttactattagctttactcttcttgattggtatgaatgtatctgtaaattagttagttagagggtttagagaggtgttacttgttagtatcggatcagtacttcgtttgatcgcgtatgttacacatttgtacaaactcttatatagtattagagaaccacagcgaaccaatctctctcttttctcttccatatgcagaaatttgcacaaaagttttatcctttataatattctcgtatgatttgtacttagattgtattggtttgttcaatgcccatttgtgattctaaacactattacttctttagttactattagcttcactgatggatatgggtatgatatgtatatgcaaatgagttagatagagagctctagtctcggatcattacttcgtttaatcgcctgtgtatagacacatttgtacatgtttacacagctaatgaaatgagttttacagattaacaaactgtagtatagtattaaagaactaaatctctctctctctctctctcttttctcttcaatttgcgaaattttcgttcgattcagattaagtcatggatctagagcttgactatgcgatagtcttgtttgctaattgatacacacattggtttggatggaattgctgatttcttctgcattatagtttctctcctcaatggttactttgtggtttgttactgaaacaggagatg

SEQ ID NO: 8907 - DNA, 3000 bp, Unknown; identical to SEQ ID NO: 8896
  misc_feature (1)..( 3000): cDNA_ID_1989265_gDNA_ID_1971919_Annot_ID_58539 3000 nt of promoter + ATG

SEQ ID NO: 8908 - DNA, 3000 bp, Unknown
  misc_feature (1)..( 3000): cDNA_ID_1989264_gDNA_ID_1971919_Annot_ID_58540 3000 nt of promoter + ATG
ggtgaccgagaggaagttgatcaaatcatcgtcaccaagataaaatgattggacactaggtcaatgaagtttttagttttagtttttaaaagttcaattatgaatattttaataaggttaaatcaatttgttaatagaatatttatttttggaaatttttggtctcgtagtttatgattaaaaagaatatgaaaaattaaaaaatttatgattttatgaaaaataaaagaaaacttattaggtggaaacaaaatattagagcctcgtttgttagtctaagtagaatggcctaaaaaaggatcgattaccggtcctaaagtaggatttatcatctcatgggatgtgttaagattctacattggaaaattgaaggaaccaacacatatatctaagggatatgggtaattcactgattgtattgtcaattaattttgagttaaaacaacatgaaacttaatcgtccgcttttgcggtctgattctaatttatcaagatttaaaaaaagattaaaattttaactaaatttccatcagtattttcttatatagaaaaatgagtgataatggagttaccgaaccccagtggcggatctagaccaaacttttgttaggggcaaagttgattaattttaagatgttgggggcaaaaggagaaaatgtaaacagttgtttttattatttctcaaaattacattagaatgaaggtttataaaattttgatggtggcacttgtaaaaatcaatagcataaaaaaataagcaaaatcaatagcaaaaatatttctcaactagaaaagtaaaagatcgagagccgatgatcagagataaaccatcaattcatcattccaaaatagtaataaataaacaaataatagagagtagtaaattaaccaataacatggacaagagtgagagaggccagtctccaggatatgcttaaagcttatcaacccctcaattcacgccaacagaacttggagtagaagcagcacgccgttcataatagatttttctaagttgtatcaaaagaatctctacactgttttcaatatctactgaatttgagtaatcctccaatgatttagcagacttcatcagtcaatcctcaagcaaggttgcaagatgaagaatctttttgttggcatcatcagtccttgcaacaggaagcttgtgtagtaagctagcatatgttaaagtagcttaaaattcttacaaatcctgaattagggtttagcaaatcaaaataagaacaagccactatcaagacacatcatatgttaaagtagcttaaaattcttacatccttgttcgcatagctctccagcgctacttgtcaaagaaactattctgatgaagggaaataacatgagccgaaacagcaacagacttgtgagaaacattcatagacgactcatcatgtggagcaaatttgaaccccattgattatgatttatgatgatttggcctgaaagtgaaaaccatccacatgaattatgaatcaaaacaagatctaataaacctctaaatctaggagggatacagtcgtaatattacaacacgaggcctaggtatgcgattgatcaaacaacacaaaccctagtgaacgagaaaaaccctaaacctataaaatgagaatgatcgatgtcgcaaacactcatagagagaatttcaattcgatattgtcacggaacaatggatgcaaaaagaagatttgtattaacacacaatcgaataaaaccaaatctaattaatccttaaaacatattcacttgaacaaaaacaatgaatattggtttgataaaaccaaaaatcaattggacttggactgtatcgaattgaaattcaaaccctatttacatttgctttaagattttacattttaggactctttttagcctttttcttattaattgtttcaacaactattgtagccttcttctattctatattttttttagaacaaagacttcatttcattaagttaaacggatatatataaaaatttctatagagagccaaacgagtgaacttttatggaaaaaaggatacattctatgtaaatatacaatatttttttttcaacaactattttaactttcttttattctttttattttttgttttacaacaaaaaatctattttattaaatccacggaaagccaaacagaaacagtaaactttcatgaagaaaaaaagtataggttttcgtctctctaaataaacatgcaacctagaaatcgttacaacgaaacacaagcttaatactataagataaaaaaaaggattaaaagatatttaaagtggcaaaactcaccgcaaaggtagaccactcaatttggtggcaagctaaccgttgacaggttgcaaaccaccctgaaaagaacaaataaatgggaatgatctcatttccaaaaggagaaaaattgacaagagaaatcacctccttacatttttatgtctattcttcattaagaagtatttgtactgatcacctagcaagagtgacaagagcaccaagtgtgacttttctctaatgtaaatttttgggttttaagattggcttcgtataaaaagataggatcttcactaatatcgaagacgtgtaaagtggaagacaaattaaaaagagagagcttccaaaggagttactttttctcaccacttcactatgcaattgcaaacacacgcaaacgcttatctacctttctcttcttattggattcttgggttgttacgcgtcttcttagattcttcatcacttcactttcttcttccttctctcccattgtctctttttgttgtgatctacaacatttgctctcgaacccctaattcatctccttacccaaagccaccgacttgggtttaagatctgaaagctttcgacttttcactgtaattcgccgaattgagaatacccagtagccaaagctcaggtctttggccttgtgggttaaaaatttaggggtttagggttaagttttgttctgtagaagcaatg

SEQ ID NO: 8909 - DNA, 3000 bp, Unknown
  misc_feature (1)..( 3000): cDNA_ID_1825410_gDNA_ID_1971923_Annot_ID_58543 3000 nt of promoter + ATG
tctcaatcctatgcctctcatcgctcgtcaccggaatcgaaccactcaagtttctctacgcaacatcgagctcaacatacgtttgcttgcagatcctgcaaaccctaggctacgtcttctacctcttgcttcttctcatgtacctcgttctcgtcttctccacggattgtggtttgggccttaaggtattgggcttggcgcagacctttgtgggctttgctgtaggtctgcattattacgtggcggtgtttcatagggtggtgcttcgtcagcctccgaagacgaactggaagatacacggtgtgtatgccacgtgtttccttttgatttgtctgttatctaatgctgagaggaggaagaaagagtacttggaagaaggcggtgacgaagggaagaaaaattgaaattttctttattttattcttctctatctttgtatttttatattttaaattttgaaaaattcggcaaaattttagctgagaaatgcaatagaaagaacaattactggtggatggttggaaactttttttaaaaacttcaattgtatttataataaatcgataaatgtggaataaaatttcataatctcattataattgtctcttttttttctttgtaaaaattacaaatatgttgtgaaatgtggacggcgagaagaatgaattaattaaatgtttttcttgataaccgcgaaaattaaatgtttctgtttgaaataaaaaaaatatgagaagtcaaaaattaaataaggtggggtctacggaatcgtagagtcgacgactttcgtgaggatggggcatttcggtcattgaaggagttaccgacggaactgggtgctgtagtgttttattgacttgtgtcggtggattggcgattgagtgtggggcgtatggtgagaaaaatggggcttttgtgtcctaacgtgttgttgtatgggccactcatttctcaaggcccatcacctcacctcatattgtgccggaatgttgttttaactttatgacgtgacgtgtgtattatgaaactgaaaatagagttcctccaactttgaatctattttacaattttattattattttttttttttgtcaaatcatagaaattacatgcacaactatcacgacgatagaaatttataagcacaattagccaaataaaaaaatcgaggaaaaagtttctaaatgtaggcaatgcccaaatgtcataaatagcctacttattttgtcaatcttgtcacttagaaactcggcacttgtataaaaacgtttcattcaacttttggtatcacatgtacattattcaattgtgaattcctaaatttattgtgtgctgtgataattcaccagatcaaccagtttaaagacccgtgaacaaaaatgcccataacatttttttgtattgggtttcaatcaagttaaggcccattttggtttagtatacggattgtgttgggcgaaaggagtgatgtaatatgtacttatcagaaacaaagtaggaagacatcacagtatcacaacattgatttgtgtgcttcaatcatgcggtgtacaatttgcacttttcccacttcacaaaattcacaccttaaatatcaatttgtgaaaagtattgacttttaactttaccaaattaaactcttttagtgaacaatctttaacaaccattttatttcacatatctgatgactcaataattcgtgcaaatttcaaatgtccttgtatattatcgtgtttgaatttcaactttttttccaaacatgaaataacaatccatgattttattgctaatatgtctatcatatatttaagtttacagaccaatcacaatttcctcaattagaaaaaacaaacttaccaatggaaggatagcagtgtatgtccataggactcgacacttctatacatagtactatttgtattcaaattatacataaaggaaataaatctgtctatacatggttttagtaccaagttttttaataagaaaaaagaaacaattgatagtttgatacattaccaactaggctaagatattttatttatttttacagtacagcgttaacattttttttaacgagaatgaaacggtggctagagttacctgagtaaaaaatctaaaaaataaggtaaaaatatctgatagcattcgtaacgaaatcaattagtactagacaagaagatggtataaaaatagaagaaaagtaaaaaatggcacgagtgaatatgttcgcacgtgtaaaataagcgtcatcatcttctcctcttcccaagtttcggctctcactttctctcgttctctctctctctctctatctctatctctcgatttgggggagttccgtcacggtggactagtacgtctcgttgccgttggtggcgtagtcggaattaatttcctcggcgttgagattcacatggtctagaattctagctaagtggttgttgttgttgttacgatttccgatttctcgagttttttttttatatttagcttctgtttcgtttatccctcccggagacactccttggtcgaatctctcatgctgaggtaattcgtcatggatttgtttaattgcataagcttttttgcaattgtctaagcttttatcggtttgttttgttttttgatttacgaatctagattttgcgctttcttatgtatgtaatcaggatcaaatttgctgggttgttaaacaatttttgtctgtgttaggattctaattacgcgtgttactatacatgaatcattttcattgtttttcttcttgatccaaaagtgtgagaatcttactttaggcgtaattcacattttttgcattaatttcaacggttacacgttttttttctttgctttagatttgttataatttggttgttctaatattcataaccttggagttttggtattacttcaggtgttttggacacttgttgtcaagaagaaaccagttttggttctgattaatcgttggttggaaaatatactcaattccaggcc

SEQ ID NO: 8910 - DNA, 3000 bp, Unknown
  misc_feature (1)..( 3000): cDNA_ID_2686597_gDNA_ID_1971923_Annot_ID_58545 3000 nt of promoter + ATG
taattttaaggtttgcaaataatgttataaatatattgatgtatgttaaaaaatttatcacttaattttagacataatttaaaatcttaacacttatttcttttatttaaaaacatttatatatcaatatctaaactgtaaagtttttttttgtttttaacttaaatttagataaacagttttattttcttacataatatttttgtttttaaaaaaaagttgtaagtatttttgtttaaatgtgtaaaaagaattgaatgataacagattctttactcacagaacaagagatattaaattttctttatgtttatagtatttaataaagtttatagtatttatttccatatatacatttgtttctgtaagaactatccatttgatactagaataaatttcttcatttggattagattgttcagtacaaaactctatttctggcatgtcaataaataacaaatgctaattttggctcttaatcttgttgatagaatactaaacttgcaatgctttttacactaatctttatctctttatatatttatttttaaaaactcttctttcctttttttctgatttaaagtacaaaaaaaaaacaatacatctttccattgaactagaagaaaacattttcactgtccttttgaatcagaagaagaaagagaaaaaaaagagatggagagaaacacgccggtgagaaaccctcacacttccaccgccgatctgctttcttggtcggaaactcctcctcctcctcaccactcaaccccttccgccgctcgttctcaccaggtccgtttcttcaacaaatgttctcactttctctttctatagagagaagctgaggttttttcttctttcttctttcattttcagccgtccgatggaatcagcaagattctaggcggtggtcagatcacagatgaagaagcccagtcgcttaataagctgtaaaagattcatttaatctctatctctcattgcattaccagatctaataagtatacctggatttgttttttgtattacaactgaaacttaaagtttaaagctttgatcttgtgattcaccaaaatggtttctttgaatgatgaagtcacttctttttcttagtgataaatttttatgaaagggattggtcaaatgctttttggcttttctgagaagttttagtgttaatagtattttattacattctttgttcatcaaagccccacaccatttacatgtcaaactactactgttcattatctaatgaggagatctttgtcttctttgttatttttgattgtttcattaagtgacttcatcattacatgtaaaggtctttaccggtctctaatatggcgctttttggtacagaaagaattgttcagggtacaagttaaaagagatgactggtagtggcatatttactgataagggaaaagttggatctgaatccgatgctactactgatccaaagactggactccgttactatcaggtagcttacttgtgtcttgtcttatgtttcaacagatttagacaagtgtaaattgaaacgattgttatgtgaattttgcagcagactctgaatggaatgagtcagatatctttcagtgctgacggtaatgtttccccgaagaaaccaaccactttaaccgaggttgcaaagcaaagagagctgagcgggaacttgctaaccgaggcggatttaaagagcaacaagcagatatcaagtgctaagattgaagagatcagcggtcatgacatctttgcacctccatctgagattcagcctcgatctttggttgctgcacagcaagaagctagaggtaacagagacatgggagagcctgcaccaaggaacttacgcacttctgttaaagtttccaacgtaagtcttgccattgcttttgctttgagaggaaactcaaacttagtgcccaaccaaatcagtaaattttctcttctattccaacagcctgcaggaggacaaagcaacatactattcagtgaagaacctgttgtgaagacatcaaagaagatacataaccagaagtttcaggaactcacaggcaacggcattttcaaaggcgatgaatcacctggtagtgcggataagcagttaagctcagctaaactccgtgaaatgagcggaaacaacattttcgcagacggaaagtcagagtcccgagactactttggcggcgtgaggaaacctcccggaggtgaaagcagcatttcattggtctaataagtaagactcggggctgtatggtattatccgcgcatatgctcaactctcacatttcagcttctttagaatttagtttcttagagtctgaagagagctcattgtacggatcctttaaaaccttttggtgttgtctctaatacttgaagtttcttaactgtttctgcatttctcctactcttcacttaaaaaacaagtatggtttcaatacatcatcgttttcgtgttgaaaagagaaacgactccactggggatcgaacccagaatctctggtttcgtagaccagcgccttatccattgggccatggagtcttatttgactaagaatttctacaaaaggtatttatattaaacaactggtttaaaagggtgaagtatacatctctcatcatagctcgtcgccttctcttaccgaatatgatcgtctttttagttaagctgtctcaaaaacactcggcataaaattcagctctttaagaaaaaaattcagaggaaaattaaaaaaagtggatataatagagaaaaaggtaaaggaaaggaatagtgagagagagagagggagagatggtcttcttgtttagaacatgttgtttccaattattctaagaatggcgttttaggtaaatgatcacagcttattacagatggaagagaagctgactcaatttgtggtttagatttgtcaaagaggatcgtgtggaatctgaaagttttcaattttcactaaaaataggattagagttaaaaaggaggaagaagaa

SEQ ID NO: 8911 - DNA, 3000 bp, Unknown
  misc_feature (1)..( 3000): cDNA_ID_1825394_gDNA_ID_1971923_Annot_ID_58549 3000 nt of promoter + ATG
cttagtatttggcttttctctatattcaagatcaaaaaattacctccatgaaaccaactccaagatcacaaataaaggcaaaatatgtaaagaagcaacattctttgggaacacacaatcataatcgaatacaaatcgacttgtttaaaagaatgcctgatgatttctcgtataaatgttcaagctttaaggtaattttggtacctgatgattttgatcaagaatccccggaaatggtaagcaaagagaccctttcttcttccggcaaaagtgaccaattcggcgactgtacagctctcagccaccggaaatcatccacattggcccagttgttagtctcctcctccaaaccagccgtcttcaaatcttcatcaatccctttgtaatccaaacaataaggagcaaatctgacaccgttactgtcttcaattatgggacgactcctcactctcaggtagaaatcactcttcctagcgcaatggattctgatctgatgcgacgccaataccagaacacaatcttctacgtcatcaatcagaatcgaaccaatcactggacctgtgtagacactacacttcttcagtcggtgaaggaacagagcgttgaccgttcctgttaattttacttgacatgaatcaagatccgacaatgtgaattctccgatcgacgagccttcgaagcttttcacaagagtctctccgtgtttgtttctcaatcccggagaatcgcgtacggggacgagtttcggaggtaaaacgacgtcgggtttctgtatctccgggagttttgattccggctttttggtcgttgatttgctcttgaacgagaatttcttcttcgggactaactcgccggagagaatgtcgagactctgtttgagatcggatacgattttcagagaggatcgaacctcgtaggaaggaagaaaatacgagttctcagcgagaagcttctcgagattgtcaatggctacggagatctcagcaagatccgacttaagctttgacgaatccgtagaggaggaagcgagtcgtgactcggcgatccgagactcgatggatcgctttgaatcggagaatttagcgagaaacgaggaagtcgattcaagagtggaggacgacgaagaggaagagtcaggtgaatctgattttcgagcttggtgacgagcggagagacgctcgagcatatcatggtgcttcttctgcaatgccggatctagggtttcggcgacggagctctgaccatcgtcttccatatcgtttttacccagttgtgtgattgggacggcggcgttcccgaatcgaaaactaagaccaagattaacctaaacggtgccgttttaatcaaatgaaaatactatgatcaaacagtgctattgtaattcaggttatcttattacaaaatagcccaaaatcaagagtagaatgatgataagtgataagaaaaaatgatatcaattgatttctctaaattatttcttatctttgaatatttgttaatgatcatacaaattgagaacaatataaaagcggttttagttgttcaattgagcattttgttcaaagatttgatgtctcggtggtttgcaacaacaactcgacttggttctaaatgatgcacaagtccagtctgtgtaacctttcgacttgcaaagctgctggcaatcgtcattgcacggtccaatacaatcggcttgaacagtaattgcagttgcttgatctacaaaaataataaaaagtactaattaaaaagaaatgtaatgtataaaaccaaaggaattgtaagctttaaaatataatatacatgattatatctaagaacgtattttgaaaatgagaaaaataagagtgcttgattaacctgcaatcaccaacaacaaaattattgcgacagtaataacatctaaagatttgatcttggccatttttttgaagtattgttctaatgtataatgtattgttgtaaaatattttcttatgttttgtgttgagatctaatgagtttttatatagataattggtgacacaaaatccaaccaaaatcaaaatatatacactgaaccaacttattcttatagaaaatttgactaagaagtaatttggtaaaatataatatgtcatatagtaaatttggtagaaaataattatatgtaaggaaatatatcaccaagagattaaacatggattggtcaaaataataacttgattatataagtgaaaatgaaaataaaagatggactgaatatatttaatcaagttgtacattaaggaatggaataccatatttattttatttttgtttcaaaatatcaaaagtattaataaagataaaatttcataccatataattaagttatggccttttaggtgataaaaataaaagtaatgatacttcactatatgtaatattaattaatagagataaaatttttataccatataattaagttataaaattttaggatgtaaagataatttttataatatgaaatttatgtgatattaaaactaatttttttttagaataagttctttttgtttttgtttttgggcacaacatagtatgtattaagttttttgttgttgttgtcaagagtatgtattaagtttaaactatcaaaaagacgaagtaaggtgaatcagagaatttgcaatgcatgacttgggttaggtatataaaataagtttcaaaaactaaaagttaaatgtcgtaaagtttacaaaatttggaggagtaagttgcaattttgactcaaatagtttttgataatcaaatccacatcttccttcgttgcttcgtcgctttggacagaaaagaagagaaaaagtttaatagtaaaataatcgatcctcttctcttctcttctctgaggctcgttggaaatctgaattctccgatcgaatcgaaccaatcgcagaggctaagaagaggacctttgagagaatctccgagtcaggatcagaaaaaacggtgatacggaagctagttctagggctaatg

SEQ ID NO: 8912 - DNA, 3000 bp, Unknown
  misc_feature (1)..( 3000): cDNA_ID_1807488_gDNA_ID_1971923_Annot_ID_58552 3000 nt of promoter + ATG
tttggaggaggagactaacaactgggccaatgtggatgatttccggtggctgagagctgtacagtcgccgaattggtcacttttgccggaagaagaaagggtctctttgcttaccatttccggggattcttgatcaaaatcatcaggtaccaaaattaccttaaagcttgaacatttatacgagaaatcatcaggcattcttttaaacaagtcgatttgtattcgattatgattgtgtgttcccaaagaatgttgcttctttacatattttgcctttatttgtgatcttggagttggtttcatggaggtaattttttgatcttgaatatagagaaaagccaaatactaagagcatgtatatgggtgatacccatatagtatcataaagaatgttttagtattatttataatatttgtttattgtttgagattttttatgatactcttattaaatatgtttacattgatgataccacatgtttaagtatcatgaaataaataaatttgcaatatggattttagaacatgagattattctttgaaatacattcttcttttttttatctattatcatctttctgtcgttcattagattatatatagagggatgacctgaatcaagcctcaaagttcgatcttattctatgaacacaaagtgacaacacacaaaacaagatctaatccttttgtacataaagaatgcatgaatttatcttaagcttcctatgaacaaaataaagcacactcacacaaatacaaacgctcacacacacaatcccgagtttcggatgattgccatttgccacagtagaaacccgacgcccatgattccttaaggtccctcatgccatgaactccagcgatgtaaataagctgggtgactgagagtatgatcaagaacgcctccatggttctctacatagaaaaatgagagaaaatggacgtgtcatgaaggcaacaatggtgggatttccaaattttaatctataatttggtcacagtaccatttctctcagaatttaagaaagaacctgacagagaaatgatttcaaatcggccctgcaacaacaacacatccaatacagctcaatacaagatttaaattccagctccattcgataacaacaaaggtcaaaatgaggccaaggagcaagcaatgcacaaagcacatgagtaaatttatacctcatacttaacagttccagtaggattgctattgttagcttgacgaagcatcacattagtagattcaaagatcacatgtcgagaacatactagaaaactaagaagccaaatctaaaggcaaaacagagactaatgttgaatcagataaatatatgaagttttttaaaaaggaagtattttttctgttcttctcattacaaatcttttcattctctagtcatatttgtacataaagaatgacaattgaaattgaacaacttctacaagaaacaaattcaagaatcatcaaaacaatgtgcagagagaggatatgtatactcaccaaccttcaggaatgaatactgcatcaccaacgttaagagtaacctcctgtgactgcttcagagaatgctctccccttaagatggtttctcggtgctttttctcacctgtcacagtctgataacacaaaatagcaacgatacactcaatctttcaataatcgaagaacaggcagaagaatttcaactatccggatctgagcttacttgtcgagaaactcttggtcgacgacggcagagacgacgaggagtgggtttctcattcccaagaggattccatcgaaatcagaggaagccatggatgatgatctgagaaggattttcgagaaaagggaagagattcagaaggaatcgaaacagaagaaaattgatcggcaaaattagaaggaatcggaaaattccccacgagagagaatttttttgagagaaacagaaggaattttttttcgacaaaaataaatggacgaccaatcagagcctgccacgtaatatgagactgagtatcagaagtctcaatagactgatacggctcagcccagttttttgtggttggtccattaaaaaattgtaaatgggctactgatactctaaaaatatgagctatgtacatggtctaagttgagtctgccacaaaaaacctagtacagttgggctacaaggcccaatataaatgtaagccctttaacaaagagggaaccgcctgctttgactgttgagaacaacttgctggattcttttttcttcccggtaaattgagaaaccaagaaaatcaaacaagtactgcaataagaaagtgttgaatctgattttggaaatattatttgactccattattcccttcataaatatatacagtcaagcatatttatttgaacaagaaaataaagtcatactaataagcatagagataaagtaagatcataaaataagtataaagacatatagcttattaaatcacatgggtctctgaatgggtattggtaggttggtagatggaacaaaatcagtcatacaatcattttcccaaaagattggcctccatcatcagtgattcagtgattcatgcacacataccaaaaccactatatagttttttttttattattattcaaattacacaaataaataaataaaccttttttattaaccggtaaaatattcccatacctgtttcgtcaaaaaaaataaccggtaaaatactaataatttgttctgttttgtgtaaaaaagaatgtatgattttattttgattattttttttgttaataagacattaagactattgaaatgatgttggaatatggtcatgtgttttttgtggaggaattatatagttggtagtagtagtaccattactctccttctcacctgttttcttcctcttaaagtcttctctatatattttcaatataatccgtctttcttatacataaacttattttgtacgatcacataaaactgtaaacccccacacagttattggccgtcggattca

SEQ ID NO: 8913 - DNA, 3000 bp, Unknown
  misc_feature (1)..( 3000): cDNA_ID_1825387_gDNA_ID_1971923_Annot_ID_58553 3000 nt of promoter + ATG
tctatcatgaacttttaaattatgactttaatcaaatatatatttaaaaaaaaaagtatcatgcaatttgtgaaatttgacaggtgagatttggcggatggagcacgtttttatttagtccatgctatatatacaaaaataaactacccttggttggcagagacatggcaaaaataatccacatgcatgattggttaacttttttcccatcactaagataaaattacatacatttatataaaattcgaaataaagaaagcaaaaaaaaaactgatgatataataagcttttattcatcaaagtgggtatggtgataggactacactctctgggttgtgttttggtattactgtgtaagacttcctagattcatgaaaaagtatcgaaagttagaatcgaattaatccaaaaggaattattgtggaattaactaaagcaatccatacaaatcacaacaaaagctcgtcaagtatatataatcagaatagtcaataatttagctttgaatgccgaacttgactaaaactcagacatgttatagtaccaaaatatttgtaatttagggaatatcattgctaatacaatataaaaaagatcatagctagattcaaaatgttgaacatgacctacgacattgttgaattcattgatctggtcttgctaaaaactttaaaattgatgagttcaacatcttcaaatgcatgataacgggtccaacggaaattgacttttttttcatgctcctgatatataataatatctaacgattacgggttccactaattgtcattactcattaacattcctatttaaaagttgtgatagttttagggttttacgtagtcgtgtcatatagcgattaactacgtacttgtagatttatcaattacttctgttgtttacgagaacctaaaaaaaagaagcagatgcctagtttatagagcacgtgtactgtcttgaaaacttaggtaggttggtaaggttaccaaaagaccttaaaggaatataaagttactaattaacttaagtaaagttggtattgcttatatattgcaaagtattacaaaccaatcccctctgtatattgttttaaaccatagatttttttacaattaagtttatgatcaatcaattatttcaccatttctattaaattatgtaaaaagaaaaggatatatatatatatatataattaaataagaataaatcaaaataccgaaattttttattatccattctttgtggacatcgcccctaatatataaaaaaaaaaaactttcgtataactgatttatatttttttgtaaaaacttaaaggaagcctaagaaatatcttgtgatatttttgacaaaatgtggtatatatctttttataatatcatttataaagaaaatattgattacatggtgaaaaacattttgctagcgatcaacaaaattaaataggcacatgttaactgatctcatacgaccttgaaattttaatctttgtgtcgagagaccgatctttatgcaaattatgaaactacacatggtttatgcacggaagatcacattgcatgtataccatattataaaccaaaaatgatcaagaagaaggcgaaaacatttgggtaaattttaaatttcgatcatgcgattttttagctcatcatcaacagacaagaaactatcttttgtactgtaaatactaaatacaaaataaaatcttcatcattttttgcatgtgtcaaataaattacgcgaactttttttttttatcgactattaatagagaaacctgttttatttgccttgatttggaaaaatggagaaattgacttaagacttagtctcggtcacatcggcaacaacggagcttaaacggcgtccgcaacatggaaactcaagccacgaatctgatatattgactatagaagtagtaagtaactttgactcgtcccacatcagtttcaatttccacgagggtatttggcaggtgaactctctacgtacccaaaacataatggctattttatttcataactgatatttagcaattaattattcgtcctttttaaaccaatttctatagttgggaaaataatcaatttttacactttcaatgtatacgttacagatttttttttattagtcatgcacatattttcaatttttacactttcaatgtaaacaatcgattcttaattgttaaaaataggtttacgtaaggaattaaagatttgtttaaaatatgttccggccggtctaataatttacttgacgttaatttcttaaacacttttagataggaggctttgtttatcccaaatgattttgtaccactgcgacaatactagctagacataaaatgttaataaatttttattaagtaatataatcgaagtattagatcaatgtagtagacagttaggttaactaaaacaagagtaaacacttttttttttcttttcaggataggtaaaacaaatttcacactattttgcgtatttccttaaatttgttgttcgttttctcagcaaagatgaatattttgtttcatagtaattcacaagtataaactcgccagaactcctcaaacagtgaaatataatatagcttttaactgtttttcggctggaccgggtttttaagtgcatatataacacgaggaattttggcaggtcaccaacaaaacttttaaaaatattaaaaattcccatcaagaatagaaattaataaacaatgatatctctaataatatagatattttgaaacgttaggaataatcgtaataatgttcaacgttggtggtggtactcaagatggaccctccctcccacattttcctcactccttcgtaagtcctttccacgcataagggtattatagtcatttcacataaactaacgactactagacttgtatataaataggaaggtgaagctctctctttatccatgcagagacaacagaaaccacaacaaaaactttgagtcctcttcttctctatacacaaac

SEQ ID NO: 8914 - DNA, 3000 bp, Unknown
  misc_feature (1)..( 3000): cDNA_ID_1375813_gDNA_ID_1971923_Annot_ID_177222 3000 nt of promoter + ATG
ttacaccacattttttctgtaaaatatattatttatatgctaaaaaaagtcgtagatatttatacatcagatagattacaaacttgattagctggtgacccgtgcgtggcggctcatacaccgtcaacgtcgatcacctcccttgttttcttgtttagattttcaattttgtatttgtcttttctacttatggaatcgtagagttttaacgttgtggtttggtttgctttcgtgtctcatatctgataagacatggtattgagtgtttagatccgttaattctgatggtcgatggtgcttaaagttgcggatccgctccttgcctcaaagtggagtcacaagtagcttctgttctgtctgagaattctcttcgttgagtcaacgcctccattgaaggctctggctttccttcttgattcgtttatcttcttcccttgatgaatctatgcaacatcagataggctcgtggtatctccctcgtcgtcttcctccaatgtgtctctgttggcgagttgcgttagatttgtttagggattttcggagtctctcttttgcggatctttgactgttctgaggttgagtcttgtttgaatgaagtttcggttctagccatctgctttgtctaccttggtgttgtgtttgacatcgatggtcctggaaaatctctccttgtgatgagacggactcgatgctttttgccattggctcttggataaaaatttttggttggttcttctatctctttaagatctgcttcgtttggagtatgtgggtcactaatttgccatcttaagttgtatttcttccagtttaaggttatcgacttctcggggttggtttggaacgtttaatactattcaatgctctatcaagtctttcagtagagagaagagctattcaatgggttttgattcggatctttccacaagacaaataagacaattatgcgtcgatctcttagtttcaagttcagtcattttcctttcagattctcatgattcttagttcactcattgaaggtttttctgcttattttctaagttttagcttatggtatttgtatttttggttatttatacttttttttttttggttcttgtttttagagatattattttgttctgccgacttattttaccgagaattttagttccttctgctggtttttgtaacttgtactccaccatgtatcacccttagcggttgctatttcatgaataattcagacagaaaaatataataattcaaatttgatatggataaatgagaatttccgaatcttccacacttgaacttataataatccatagagacatacatggcagaatttaaaatctctttcattctttttcatcatctttatatcttcaaagtgcatgtgctcgggcatcatcatccaaattccgtttatactaatattattttcgaagctgatcgagtagctatatacatattaaattgtaacatgtatgaaacgtgtacgggaacgttgaattcgacctattttaaatttaaacctgataccaagaccaacaaaaccggtcttatacaataaatggatcaggcctcaggcctataacaaaaaactacagtttaggggtccattatctgaaactgggtcataatgcagaggcctgccttgccatctctttatacctaagttctacttcttacacatttcattttctctcatttagataacgtttctcgaaattgatcacaaatgaaatgaatatgacaaatctttaaaattgaataagtgatgacccaaagcctttaattgtgttctaaaaacatttcattgtctctcggaaaagctccgtttcaaagagagaaccgtcataggattgtttctttggtttgcgttatgtactttcacttagaagaacgcaaatgcaaaattagaagaaaaaaaacaatcaccaaatatagtattgaacttttctataaagcttcgatttgagttgtgacatatgctatagtatattgtatttatcactataccattttaaactttcctgtatgttttttacaggtcgttcaaaacaagaattgatattttttgacggtgccgttcgagcccatagtttttggacaattcaatgaaccaaacccaaattgcgtcagtcttgttcccccacccacaagtctttctttccactcccctgcgttgccaacaataacatataacactaatgtttttaataatatatcccacatctaatatatgggattaaatatgccatccgtataattttataacttatcctatcgaattttaagtttgctcaggaaaattacatttggtttcattaatcaacaaacaaattatagtttatcattttgtcatcaaatcttctgtgacgtaccttctgacgtttttcagaggatgttatattttaaaaatctactttttaaatgcatcttacgtatctctctactatccgctgtttattaatttctctgaatttttaagtttaagaaaatagaaacacccttaaaaaaaataaggttaagcattaccaaaaataaacccatacggtgacgtatcacagactccaccacttgttctaagccgagccgagccaagccgtataactattggttcaaacttaaccttagttacattttaaccctttctctaagtttggtttatttaaagaaagataagtttggtttatttaaagaaagagaaagtgtgaaaccaacttgttcatattgaaaagaaccattgctctctagattaaaagcttctctctctctctctctctctctctctctctctctctctctctctctcttttggactttctcaatccatatccctctctctgttttttctaatttgagcctctaaagtctcctcgttttgttcatgttgttgttcaagtgaagaagctcaattatgtttacaacattgttgtaatttcaaaacttcataagaatttctctgataataaagaaaaagctggagtagaactattttaaagtgtcatcatg

SEQ ID NO: 8915 - DNA, 3000 bp, Unknown
  misc_feature (1)..( 3000): cDNA_ID_1007791_gDNA_ID_1971923_Annot_ID_177216 3000 nt of promoter + ATG
actacagatacatgcatgaatgtacatttgagcttggtatcaagtttggtgtgaattcgaacatggtttaaaccctcttcttgaaacactgaagaagaatgtcttacgaaccagttcaaatctcaaagttaacacctcttatgatccaactcgaagcaatgcattgatatatcacaatcaaaagcaatggcgagaatcgattaaagttatttcattgagactttattaagcttaagttatattaagaagagacactactttttagaggaggatttcttcttggagctaacaacaacaacttgaggtttaggatgtttctctgcttcacttggatctaaccacttaagatgatgacgattaaagcaaggccaattaggtattgtgatcagagtcgtcagaacaacacctccggcgtaaatcaacatcatcatcctaaacgacgccgttgtgtaaccaacaacgaacgacacaacggcggcgatcagaagcaggatctgcattaactgctccgccaatttctgcccttgccaatccatatctgaagaagaaaaaaaaacacaaaattacgatttagatccgatataacaaaatttgaatcgcacagatcgatctctttggagattctatacctagaaaatggagacgattttcaaatctctgtaaaaattctggtttcttcttgacggaagaagacgacgactccaatatttcggttagtactgaaccggaaagtttgactggtgcaaccaatttaatgtaccgtacgtaacgcaccaatcggattttgtattcaatgggccttatctgtgagcccattaattgatgtgacggcctaaactaaatccgaacggtttatttcagcgatccgcgacggtttgtattcagccaatagcaatcaattatgtagcagtggtgatcctcgtcaaaccagtaaagctagatctggaccgttgaattggtgcaagaaagcacatgttgtgatatttttacccgtacgattagaaaacttgagaaacacattgataatcgataaaaaccgtccgatcatataaatccgctttaccatcgttgcctataaattaatatcaatagccgtacacgcgtgaagactgacaatattatctttttcgaattcggagctcaagtttgaaattcggagaagctagagagttttctgaggtacgattcttcgatcctctttgattttcctggaaatattttttcggtgatcgtgaaactactggaatcgctcgataggtggtacgaaattaggcgagattagtttctattcttggccattatcttgtttcttcgccgaatgatcttccggataaagattttaggttagagatgaatcgtatagctagatttcatcaccagatagtttctttgtctagaatctctgaaattctcgatagttttcacatgtgtaaatagattgttcttattcggcgattgttgattagggttttgattttcttgattatgcgattgcaattagggattttctttggttttgtgttgatcttacgatacattccggcaattgaatacgtatggatctaaatcttgttaatttgttgaacagatggctcgtactaagcaaacagctcgtaagtctactggaggaaaggctcctaggaagcagcttgctacaaaggtaagactcgggctctcacatgtgatctgagtagcttgataaacacatttctagatttgttctaattggtggatgttttaatttaaggctgcacgtaagtctgcaccaaccactggaggagtcaagaagccccatcgttaccgtccaggaactgttgcactacggtatgcaatctgtttcttccccaaattcaattgtgtttttactttattgatatcgtcattgattaaactctgtttctctgttttattgatcttgattgacagtgaaattcgtaagtaccagaagagtaccgagttgctgatcaggaagctccctttccagaggctagttcgtgagattgcccaggatttcaaggtaatgtgtctgttcgtctgattcagtctacaaatggatttaactttttacttgttttgtcataaccttgtgttcttatcttgtctctttgattgcagactgacttgcgtttccagagccatgctgtgcttgcactccaggaggctgctgaagcataccttgtgggtctctttgaggacactaacctctgcgccatccatgccaagcgtgtgaccataatgcccaaagacattcagctcgctcgcaggatcagaggagaacgtgcttaattgtgattgggaagtagttggattatgtgaatgtgggtggttttctaaatagatagttggaattagataatggcttaaaaagcttttgggtgtaggagacttggaaacaatggtgttttttttttcttttctttctgtttcttgtctagtcggtttatgatttgcttgtgttcttcttagctacgttttgtggtgtgtattgctttcttctttggcaatgttgaacaccttttgttgttgaattcatctctgaaacatatgaatatgttaaagtttctgactcttgtttcatctgtatctgttcgatattgtatgattgagttttattgtttatcaataagctttctgtttcaaagttcttttcaatatcaacaacttttacgttcacgaaattggtaatccgtgtgacacttaaaatctctaatcgtggccgttgggctgtgttgagaaaacacaatgtacaatagtttgaaccgtaggataaagaatgtgagaaagcacaaaggagcgtatcgtgataaccctttcgtgagtattataaataataattcaactacattgcggccacaaccactacttcaatcatcccctattactgcttttgttacgaaagacaaaaaaacaaaacaaaacaaaagtcagctcaggcgaagaacaggtatgatttgtttgtaattagatcaggggtttaggtctttccattactttttaatg

SEQ ID NO: 8916 - DNA, 3000 bp, Unknown
  misc_feature (1)..( 3000): cDNA_ID_1825373_gDNA_ID_1971923_Annot_ID_177213 3000 nt of promoter + ATG
gagcaagaaggagaagaaagaacatagcgagaagaaagaagacaaggagaagaaagagcagacacatcagaacttcgataagaggatgattgggaaaacttgtagtttcagtatcatgaagctagctcatcacaatcacaaccacaagcacaacaaagaaacatcagaggaagagacaaaaaacgcaaacggtgggaatcatcaagagaatagtgacgaaagtggtgaaggaaactctccaagttcagattcatatctattcaaaggttcgatctttgatatagcagagacgccacatgcacaaatgcatcacaaaaggaggtcttcgtgtacgtttttggaagaagtagagacgataaatccagaggatttggagaatttggatgggaatcatttagaagaaggagagttaaatgacaaaggagcagtagcaaggaagaagaaggcgtttatacgtagatttggtgatcttcttgttaggaggaaaagcttaagtttctcacacaagaaagaatcttccactgattcacaagataagcagcaacctcagactcccacgtctccatctccgccactaccgccgatgtctccggagccctgaagagcattgtgttaatgatatgccattgttgtgttttcttctacagtttgagttttgcaggaacttttcttttgtacatagccagccaaacgtttgaatgtgttgtaataaggacttgatcattttaatatgtgcaggttttgtctttcttaacatgttgaatcgctttatgattttaccggaacgaaccggttgctatggtttcggtatgatttgatttctcgttataggccttagtcggcccaataacgaagattctctataaataaatgaacataaacaaggcttattttgttggaaatatatttaacttgtttcactatttgtctatttatatgggccagagagacctttttcgattttcttatgtaaaacacaaaatgaaataaaactgaaaaagctcaaacaatgtggtaaaggtgtcatagttgcaacttacaatgaaaatattttaatacattaaaaaagaaatccactttatttgaatatagaaagtgaaatcaaaatgttttgttatataaaatatatgtagaaaatcaattttttattagccaatttcgcatttgcactcctcaaatcctctagtgcgattcttttattgccttttctaaaagccttgaaaagttaactttttactagaaaaattcccatgtgtttgtatgctatagctttattttctatttatgctaataaaattgacatccttttcgcatttaaccagattacaaagcgaaatgtaatccatattgtgggaaaaaggtatacaagattccaacaaattaagaaatttcattattataatagtttttggtctcgatatttgggaaatcataatgaaattcataagtttttcaaatgtataatagccttccaataatagcaaccaaaatgtggggacaattctgctatcacccaaccactcaacggtgatgggcttttacatcacggcccaatattaacctcccacgtaacctttttccattacgccctgacgcacaaaacaccacttccacttggcatctagttttgtcacttgcttcgaaattgccacatgtacggatagtatatcgccacgtatacgaatgctttggtttaccttattaattctactatttcgctttctcaaggcgttgacttcttaaccctctatatctctattccataagttcgtgtcttaacaaattgtttagattaacatatctcaagtcttaacaaaataacatatgaaggatatgtataagataacactaagctggataattttccttaagatcacaagagatcattgagaggattttgttaagcgtatcttaaaaaaaacagagctgtttgaatcatcacgaatatagtatttgattatacacacattatttatatgcaaatacattatactaaaacgataaaaatgaaagaaaaaaacaaaaacattatggggggcgactataacgaagtctgctaaacattttgcttacctatctataaaaaaaaagcaagaaaaagattatacacaatgaaagaaacaaacagaaggatcaaataatgatctaaggcacgcattgtttaatagaccacgtaatttgtttaagcaacattttttattggcttttagcttttgatcatttagccgttgacctgttaatttggtcgacatctaaaattttgttttgtaaataaagattaagctcaattattaattcatttataatatttagatgagtttgtttgtttattgggttgcggaaaatgatcacgaaatctaaaatgtgggccattctttatgttttctaagataagaaaattaggtatctttatttaattttaaaacaggtaagtttggtagaaaacttcaatttaaaagattgaatatattactaaaaatgggtaatcgcatttattaatcaggtattcacttttcaatctctgagatgttgatgaactatataacatacaaggattaattatatgtattgacaatgaattatttttctcttgcgagaaaacgtataattcttggtctcttccgaagaaggtacacatcataaatatcgatgaagagacaaaccaaatttaacggtttgcaagttcaccaccttgttcctgtccttgttgttcatgtttttgagagatgccacgtgtcaaatgggcctatattcaacaataatattgacggcccaacagtctcgtgggcccataaaggtaagttggtgctgactgtatctgtacgtatgtctgtatataaatatgctaatatgtgactgaaccatgagagaaaaaaagcttaaattctttagcatcttgctttaataacctcgaggaagcaaaacgacatagtttttgatagagacatagaacaacaatattctctttcttttctctgttctttgatcctccgatcaatg

SEQ ID NO: 8917 - DNA, 3000 bp, Unknown
  misc_feature (1)..( 3000): cDNA_ID_2179563_gDNA_ID_1971923_Annot_ID_177208 3000 nt of promoter + ATG
gcagacccatgtcacaatctggcctgatctgcggactgctctgatcaggtggggaagcttaactctcatgttctcggcacccattctcacaattacagtgattcttccaggcttgttattaggattcaggatttctactagcttaaccagctcaaagggatccattttgttgctcacctgcaacaagagttttggttattcaatcgattccgcttaaaactcaacttaataaactctcgttattcagtggcaaatcaaaccagctaccagtctctcactgaagaaaagacaatcaaaatcaaccgtctgatttgcaagataagagaagaaaaaaacaaaaaatgctacgagaccaagcataaacctctcaaatgttactctgttttgctttatcataaaccaaaagtaatatctacctaatcattggtttaagtatatcagtaagaagctgcatattatcgctctacctacgcgttgaattttgtatttttctttgaaaaagttaaaagtaccttaatgcccagaggattagcaatccccctgagaaactcgacatgagcgccatccaattgtctggtacgctctccgcaccagaccatgtgtgcagaacaatcatagtagagaccagaagttgaatccaaccttgtaagggactgttcataaggcagaagcaaacactcatgggatgtgtagaaatcagttgtagtcataagtggatgatccgtgccaagtccacatgcagacatgaaccccaaggcctcatcaaccctattagctaattcctggtacctgtacagcaaaacctttagcaccttacataacctaggatagctgctatcaccatcactaattcatctagaaaagtttgctttcaaaattgagttgatgagttgggtgtacctgtcagcttgctcactttgttcaacaaaatcaaggttccattgagtaactctttgaatagcagcgtaacctccagtggcaaaggctctaagaagattcaaagtagctgcagattgagtgtaagctcgaatcatcctattaggatcaggaatcctggatttctcatcaaaagtatcaccattgatgttatctcccttgtagcttggtaatttcactccatccttctcctcaaatgcatcagatctaggctttgcaaattgaccagccatcctcccaacctaaacacacaaattctctcaaattccgctcaaaagaaaaaacaagaaagattgaattcatcgatctgaccttaatgaccggaacctggccaccgaatgtaagaacaatactcatctgaagcagaaccctgaaggtgtctctgatattagtagcattgaactccttgaaactctcagcacaatcacctccttggagaagaaaagctttaccaacagcagcatcagccaatctctcttcaagattcctagcttctccggcgaacacaatcggaggaaaagcctctatcgttttaagcacagactcaagctcattggcgttaggataatcaggaagttgcagagccttcttcagtttccagctctctggagtccatttcaatgcaccagacgaagaagacgcaacggattctttgactgaaacagcgtttctagctggctcagccgcgtgtacagccgtgacgaggttaacggatttaggcttggtgttgacggcgggatgaaatgtgaaggatgattgacggttgcttggacggtgagaaagatcaccgccgtagatagatctggtggagagagaggaggcgttggaaagagccatcacagattttctctgactctggatttggttttttagagagagagagaatgagaaatggaggcggttttgatgtgaggagagagaagacaatgtggaaagagaagaaggtatttataagggagagggttggtttcgacttttcagagttttttgttttgcagacagaacactagtgtaccaaaaagagggttgttggccgtcgtaggggtatttatgtaaattgtgtgctttgagatatttttcaggcgacgtggaagcttttgtctcttttggccaccgttaaaggaaacgtttttcatgtaaaaaataaattttataatagatgatgctaaaaagtaaagaatgattcaatttgattgaaccgatccaaaatttggtagatactagataacatttaaaaacttttggttgttgatttacaaagctcaaaacaaaacaaaaggttgaaaaaccagaatttggaaagtataaaaatatattccaatatttatgtttgttaacttaatttatgccacgttacgtataatatttcttttttaggtagctcatttaaaacattcgaaatttgatgccacttatcaaaatttggatgatgacaaaaaaaaaatttaaagggaagtccggaaattgggctaatgacaaaaaaagccttcaccaaccaaatctaccaccactcatcaagttgcatatgatctaaagactaatttgtgtttatcaccacctaacacacacactgaatccttttataagatatgatgaattcatggaccacgcccttttaatatttgtcaccatcttatactaacttccctttatatatatgaaacacaaggattttaaataaaattaatgtgatagaaaatcgaatatcaacccctaccaaaatcattacaataagtttagagcatttaatggatcatagttttggaaatgcttgattgcttgatttttttcttataaaaaatctgtctttattggatgatgatagttttttatatctgcaaaaaagtattattttacagaatcttattcaaaatcctataatattcatcaactaattatttgaacaaaaatacaaaaatggagcggtaaaagttagttattgaccgttatttgtaaagaaaattaggttttcgcaaattatagccaccacagattgttttttttttcattttatcttgagaagaaccacacacacccagagagagacagagattcatcgatatg

SEQ ID NO: 8918 - DNA, 3000 bp, Unknown; identical to SEQ ID NO: 8913
  misc_feature (1)..( 3000): cDNA_ID_1825387_gDNA_ID_1971923_Annot_ID_177204 3000 nt of promoter + ATG

SEQ ID NO: 8919 - DNA, 3000 bp, Unknown; identical to SEQ ID NO: 8912
  misc_feature (1)..( 3000): cDNA_ID_1807488_gDNA_ID_1971923_Annot_ID_177203 3000 nt of promoter + ATG

SEQ ID NO: 8920 - DNA, 3000 bp, Unknown; identical to SEQ ID NO: 8911
  misc_feature (1)..( 3000): cDNA_ID_1825394_gDNA_ID_1971923_Annot_ID_177200 3000 nt of promoter + ATG

SEQ ID NO: 8921 - DNA, 3000 bp, Unknown
  misc_feature (1)..( 3000): cDNA_ID_2994902_gDNA_ID_1971923_Annot_ID_177196 3000 nt of promoter + ATG
tagtgcttttgttagaattggaggatttgatttgattctagatatatataaatgtaggcgattgaattggtggagcattttgagttctcctatggagtatggtcttagctttgaacaaacaaagaatatagtgatcactcaaataatgtacagttcgtttcaatttcctttgttgggattagtttttctatcttataattaaaagaatgaaattgaagtggttgaatctttgctcggttacttttgttgccgatatgtattcaaactgagtttggaatggttcaagagatttgtttaatatttggtatttgatttgaaattgaatggttaaaggaacttataactttaacactgtcgtgccagaaaaaaagcttggtaactgaaaattattactatatacaaaatgaattcacaactgattggctttaccttagagaaggaactagcttcccagagtaggtctattttgaaacaagaagaagatcgttttaagtgaagtatcaatgatttcaagtgtaatcagagtcgagagttccggttatgttgatgctacagcgatgctagtaccgagccttgttcactcttgtattggttaagatatagatttgaaagaaaaatcttacagcctatgtcaccgcaccataaactatttctctttttgtattttttgggtcaaaaccccaccacagactatcttcgataatacgtgcatgagccaatgggcttctttttttaaaatataaataaacaaaaaagaaatctttcaaatttgtgggtatgtgtagttgaagatgttacttgtgcatggcgacaattaaacttgagaaagatttattatttggtatttggaagagagttacagttttataacaagaattgggttagagaaactttggaaaaattcttaaaccctaaacccatggagctaataaaaatctttgtgacttgctttctcctcaagaaatataattgatgttattgtatgaaatgaatacaattaattattaataagattatcaactcccgtttttctcttattcttcttctagtgtcttctaaatacatttgaaatcgtaaataaaacaagtaaacaactcgttcccctagatatatacatacgcttaaaagtaaacgttgtatgcaacggtaactttcgtaatagtaatggggaatatgtaattattgtaatgtaacggtaatattttgttttatcaaaaaaaaggaaaataattaacccacacgactctttaaatacggcctttgcttcttcattaacagatcaaaattctcgtactcaagagagaaaaaaaaaccctagaatcgaatcctctctacaaaagtcctctttgtagaaaaacctatttctcaatcgatcagtggttcagagaatctcttacggttatggttctgttctaatttaatcgtcgtagctagtgcgaagatccggcgatgaagacttgcatgaaagcgatggcgttgaagaaactcgctacagaagactcatcgatctgccgccgagtcaccaccgagattcgctctgttttgcggttctaatgattaattcaagacaacgttgggcttcgtgaatcgtgacaatcgacgacatagagagagcttcccgatcacggtggtggaggaatgctttaccgcgatacagatttgtcgtggattagggtgcaatttttcaaagcccaacaacatcaattctagcccatcaaaacaggtcaattctcagcccattcatcttttaattttttctcatcccaataacaaattcacattacaaatagggttttatacacggattttttatatataaataatacaactttttattcaggtcttcttttttttggaaattttagatagaaaaactttaaagtctttttcttattattttaaataaaatattagataaacagttttttaggtataaataatatttttattttttattttttgaagtgttaaattttatatatgtgtaaactaatcggacacaacatcccgtccataatatgaggtccttcagcggtgtcataggttcaacatgtttacacatcatttgaatttaacactttttttttttttttttttttactaaaaatactttttttgatttttaaaataaaatattattttcttattaagtatacataatatttttattttttatttttaagtgttaaattttagatgtgtgtaaactaatcggacacaacatcccgtccataatatgaggtccttcagcggtgtcctaagttcaacatgtttacacatcatttgaatttaacactttctttattttcatacttttattaaacttaattttaaggtttgcaaataatgttataaatatattgatgtatgttaaaaaatttatcacttaattttagacataatttaaaatcttaacacttatttcttttatttaaaaacatttatatatcaatatctaaactgtaaagtttttttttgtttttaacttaaatttagataaacagttttattttcttacataatatttttgtttttaaaaaaaagttgtaagtatttttgtttaaatgtgtaaaaagaattgaatgataacagattctttactcacagaacaagagatattaaattttctttatgtttatagtatttaataaagtttatagtatttatttccatatatacatttgtttctgtaagaactatccatttgatactagaataaatttcttcatttggattagattgttcagtacaaaactctatttctggcatgtcaataaataacaaatgctaattttggctcttaatcttgttgatagaatactaaacttgcaatgctttttacactaatctttatctctttatatatttatttttaaaaactcttctttcctttttttctgatttaaagtacaaaaaaaaaacaatacatctttccattgaactagaagaaaacattttcactgtccttttgaatcagaagaagaaagagaaaaaaaagag

SEQ ID NO: 8922 - DNA, 3000 bp, Unknown; identical to SEQ ID NO: 8909
  misc_feature (1)..( 3000): cDNA_ID_3044026_gDNA_ID_1971923_Annot_ID_177194 3000 nt of promoter + ATG

SEQ ID NO: 8923 - DNA, 3000 bp, Unknown
  misc_feature (1)..( 3000): cDNA_ID_1824406_gDNA_ID_1971923_Annot_ID_177192 3000 nt of promoter + ATG
ctctcaacgggaatattcaactcaaaatacatggctttaaatatttgatttacccaaaatctctgtgcataggaagagttgcaagaacacacattcttcattagtggttaacggcaaatgcaaaaaaacgttataagaagatgaatatgagaaaacgaatgcaggaagttaccaagtgtttgggggcaacaaaccatttgctagcttacacaacagaaaactacaacgaatttgaagccggtaattgcaacaacagagtctccagctgaggccaaacccaccaagatttgtttcatcattgaagacataaactctttgactaattacctttgtttggaatgaaaacctgcaattttgaatgctagatgatcaatttgcatacctccaatggaaattatatgaaaccaaaacagagaacaagaagtttagggcgctagagaatatcatctctcttatctacctaaccagattgtttcatattcttaagacttcacaatttatcgaagtcatcataacatcaccaatcagttcttagacatgccaaaacctaaaaaagggaaaaattcaagaatgaaacaagaacagagacaatacctcaaactctggtacaagatgaatcaaagtcatcaggagcaacacgtgcaatccaattgtttaacgtccgcttaacatcagtatgattaacataagccaactcatacatactacacaaattcaccaccaagctctcgttcaaagccgcggttggcactctctccaatgcactttccatcaccttaatcgcatccgatagatctctcaagtacatcaaacaaagagccttattgttgacagcgataatatcagagttatccctttcaatgcatttgtcatactctctcacagcagaaacatagtcctttgccacaacataaaccaaagccttattcctaccaacaagattgttgaactgtatctcgttcaataaaccattgctctttccttcattcaacatcttctcaactctatcaaacgtagttttagctccttctacatcaccaaactgcatctgaacagaccctagtttcgaaatcaaaaccgggtctaacggatcacgattgatcaattccttcatcaaatccaaagacaccccaaattccttgtgacctaaatgaaaccctagcaagcaattcatcacaaatgtctctcttttcttccacaattccacagaactctctaaactctgagattctttctctctgattcgatctcgaacaaagtcaagcaaaacatataaacgatctaacccttcctgacgattaccaagcttagtcgggatcaaagcgtagagccatcgtaaagagaaaggaaccatagatcctctccgattagggtaaatctcagggaacgattcgtacctgtaatgcgtcccgtcgaaatcgtgcaaggaattaagctcatgagaagcttcatcggagcgacgaagcttcgcgagagccataacttggtaagtgagataagtgagatgctcgtgaggctttgtgaggaggaagagagctctggcttgagatatcttctcgaggatcgcttgccatgagccacgggtcgaaagctcgtggagcgagccgagatcgtgtgttaattcgtcgagcgaattgaatcgttccggtggtagatcggcgacggatgtgacttgggatgaggctaattcgaatgccgtcggttcccctgcatcggttgactctgccatggcggtggaatcagtggaggagggattgaattcgggtcgggtttcggattcgggtaaatccggatccattgctggagatgactccgtgaacattgtggaagtaacctggtttggtctttggatttgggtcgtctttccaatagataccattacgctaaattcttctttttggcataaaaatttagattattttttattaaaaaaaaacatttgatatgattatgattttaggcggtttattaagatttttttataattagatcaaaaataattagatcaaatactaaaattggaggagaatccaaactttggatttcatatattttattttttaattcactagaaatgaaacaataattaaatccaaaattacaattaacttgtctcggatcgattgatcaatgttgattttttgtcttatgacttttcttcgtgtaacgaaaggagttacttaaatggtggagtaatggtaataaataccatgttataatattgttacatactgataatattattttccccatgttacatgttacatcattgatttttacgtagatatttaatataacgaccaaaaaaaattaagctctgacttggtccaagagattttttctcgattcttaccattgaccctgagctaagacttgaccaaattaaaagtctatgtggaatgtactgcaataagtaagtctttttaattaactaaagaatttcagacctaaccccatatttttttcggataaggggtatgaacatgtaaattattcaattttctattgtaggtatttaaattcgagatttttaaaaaatgaaatgagtgactaactagctagttcaaaccgtaaaacctattattcatttaatgatttgattaagtattttgttttaacaatagtttaggctttaaaaatcttacaatcaaacatcaaaatataatgtggttttactacggaaaaaggaaaagcagtgtagaagcatcgaacatacttgacttttatgacttacaaaacacatgaggtacacagaatcatatactacaattttactttgctaataaaagtcgatgtattattattagaaattatcactaaatcgtagaaaagtgaaacgcgttttctctccagtttttctccaaaagacaaatgagttatctgtaaacacatgacatgcaatgatctatcgttatgtatatatgaattgattaatctcgaactatatattgaaatctcagcttcttatcttctttgattcttggagacacgattggaaaa

SEQ ID NO: 8924 - DNA, 3000 bp, Unknown
  misc_feature (1)..( 3000): cDNA_ID_1841858_gDNA_ID_1971923_Annot_ID_177188 3000 nt of promoter + ATG
aaaatggcacacttcttctaagattatgacaagaagtcgaaggaattaccaaatagcccaaagggcaatgccttactcgaagggtagtctcgagaaggtaattgtgtttttttcccctctcttcaaatcataaagaatttaaattgccgttaaattttgtctttcttttaaatgtttttgtttaatacagatgacacaaaatgtgaagaatctgttaagcaaagctcaaggcaatcaaactctccaaagcttgatcaatcattctcattctttgcttagatgattactgcatccctcctaaatgttaatttttttataaatagtttgaagaatgaatttaattgtatataatatttataccttcattgactctattaccaaataattcaattgatattgtttatattttgtcactaacaactttttatctgatttttacctcaaacttttatgaatacatcacattggtattgtttgtcatctttaaatatattttcttttgtcgtattatctacgacttattaatatttcaacgtaatagtttttaatatttttgtcgtatttattcatttctatttagttttggataagctcttgatcttattttataattaaatatttcaacgtaaaagtttgtccaacttataatcagttgtttttaatttaattttggataagtttctgatcaaatatttaattcttattctgtttaaattggaaacagtttatctgttattaatgtgaaacgaaacaatggataaactgttcccaattgacaaaaataattgattactttattaatgtgaaacgaaacaaagtttgtcaaaaacaaatatgaaacgaaacaaataaaatatatctacgttattgggaagaagaaaaaaaaatatctacatagttgcaattaaattatatattttaatacaactgttataattaagacaaaatatatatgtatatatatatatttactgcttaatatgttttgtttgtcgtattatctattattcgtttgtgaattttattttggatagtagtcttttcatttacttaaaattaaataattcgaaacaaaatagttggacataatcaagcgtacgagaaacttccagcacatcaacatcaccctttatacaaaatgatttttgagtgaaaaaaaatgaatgtgaaacaaagagaagtatgtggcgtggaggaacacagacaaagagtttacaaagggaaacaaattatcaatacacaaacgtacgtatggccacaaccatgcctatcaaactttttcaaagccattccatttccaaggtgtgtccaaaaaccattttttttttttttcatcctccataattagtttttggattcagtttttgaaacttcttatgtcgactagagcaagagcactatatttttatgtagtttttcaaaaattagcattgctgcaatgaataggtgatacgagagccaagatcacacgtttaacctttaacttacaaatcatcataattaacaacacaaagataaaaagagaatgatataaattcaacagataataagagatcttttttaacatgccacacccaaatctgaatataatgcaacatctttaaaagaaattgtattacaaatcagttcatattggtccactaatgaaatgattcattggaagaccgatgtctagaataattttcaaggcatgtgcaaaaagttggattttctttccatctaaacctttcaaatgactaatcattattgaaatagaaatgaaagaatcccggttacaaaaggaaatcaaattacatattttaggcatcatataaactagtgtaacttggaaaagctataacaaataatttaaatttttaacaaatgtttcaatttgtgttaaaatattcaaatttgaaagtaaaatgtaactgatattttccttatgacacattgctcgaccataatcaattaaataatatattcagaataacgtctttctaagacatgaaaaacacgtgaaacagagcagtagaaaaagtgtgaagatgttttacagacaatgataatcagtgttctagactaaatctttttgtttcatatagattcatagttatcaatgtctggttatgatacattactcaaatgtgaaatcacaagtatgaattaatattatatttaaggtattttaaatttcttagatatgtgtaaaaatatatttaaaacacaaatctttaaaaaaaaaaaaaacataggtaccttgaaatcatcggcattttgaccaattaattagtgcaagtatcaattaataacataaaaaatcgtaattaaaaaaaggtaattcacgtgtcaaacccagtcaacaagattccataggacccacttttaaacggcgacaaaaaagtctttaaacggtcgcacttttgttccaaacgaccgttaacaccgatattaactatctcacgcgccaaacgctacacgtgattcctacggcgaccaattgacagctaaacgtggttcgtgttgtgcactctctttccttcgtaactgacaaaacactatctttttagtaactgtaacggaacaaaaggtcccatgttgacgaaacactgtcgttttccaccaaattaacggaactaactaacgttccccacaaaaatgtgggacccatgaaacaaaaaaaccaaaccagactttgctatcatcataacaaagcgacgccacgtgtatggaccagatatctgacgtgtcaattactatttttaattttccgctcctccctcacgtgtgagaccccacacgtgtggctcactatgaaccagaagcatcactagctcacatgcattggacaaatagggaccatcaaccagtgaagtgacgccacggtgtctctatctcccttgctgtctcgtctatataaacttgcacgtctccgctgattagaagcacaaaactcacaccccaaaaccgatccaaattccgagaaagacaaccaaattttccttttcctctgcaaaaatg

SEQ ID NO: 8925 - DNA, 3000 bp, Unknown
  misc_feature (1)..( 3000): cDNA_ID_1825377_gDNA_ID_1971923_Annot_ID_58558 3000 nt of promoter + ATG
ccggtagattcagcgaagacgaagtataactttaattcatcattagcgacgattaatctaataattacattgataattaacttttgctaattattgttttagggaagatattatttcaaacaacttatctcgggagttagctattgtcacgctatggtacgtttagtcttctaatatgaataatctccaaaagtgatatcataccattgaaactactgcttactgaattttattttgttcattttgaatgtagcaaatatgtcacagagaccttaagctcgagaatacactcttagacgggagcccgtcgtcgcatcttaaaatatgtgattttggatactccaaggtataactatatgtacaccatgtaatctaagtaaccttcagtgattagacacaattcattgagtataattttgattttgaactgtaattgcagtcatcagttttacactctcaaccaaaatccaccgtgggaactccggcttacgttgctccggaagtcttgtcccggaaagaatataatggaaaggtacaaattaaattattaattaactacaataatagattgattaaagtaaattaataacaacaacaacttgtttgataaagaaggtcatataatttatattaacatatgatcttaaatgtatatagattgcagatgtgtggtcgtgtggggtgaccttatatgtaatgttagttggtgcttatccctttgaagatcccgaagatccacggaacattagaaacaccattcaggtactgtaagattaaccccttaaattatatcaaacgttctttccactaattagcattttatatataatctttttttggtcactaattaaaatttatttaagaataataattaatgtgaatgatcaatattacttgcagaggatattaagtgtacactacaccataccggattacgtcaggatttcctccgagtgcaagcatctcttgtctcgtatctttgtggctgaccctgataaggtaatcacataataccctaaccagtttatgtaaattataccataccggttccgataattggtttaacaaatgtttcatatggattgattctacattggttactacttttaaaactgaaatttgaactttgaaaccatgacatagagaataactgtaccggaaatcgaaaagcacccgtggttcttgaagggccctttggttgtgccgccggaggaagagaaatgcgataatggagttgaagaagaagaagaagaagaagagaagtgtcgacagagtgttgaagagatagtgaagataatagaggaagcaagaaagggagtaaatggtacggataataatggtggattagggttaatagatgggagcattgatcttgatgatattgatgatgctgatatttatgatgatgttgatgatgatgaggagagaaatggtgatttcgtatgtgctctatgatttcatatgcatgcacgcgtgagtatgtctatgcatatgttttacatgtatgccgcttgagaatatcagatgatcttgtgttgtatgtttgtatgatgaagtggaaatcattcacctctaatcaagttaaataaagtacgtataagctttgtgcgtctttatttatgttattatgtatatgtctataatctattacattactttcctttattgcaatacttctcttgtttaactagaatccaaagatatatgtatataatttattttgcactttagaataatccatagaaaaatatatatgtaattgtgtcttctgattcctaaacttttttttttgttgataaaaatgcaaatatttcataaacaaaaatgaaaacataataggttcacaatcgatgattctcaacctaagctaatggtcccttaaaaaaaaaaaaaataaccattgattttggtctatccactcgactataacaaaagatgtgtgtttttcagagactctgcttctaatgagcacaaagcttcgagtgaagaaacaagtagcgaagttctcgccgttgcttcttctacacgatctgattccatcggaagaaccccataagaccggttttctttgttgttgttgctgtggatctgtgcatttaaggtagatcttcacgatttttgcgcattcagtgactagaagagactcgagatctagttctttggagacgtttggattgcaagtaaccatgtattggaggaacatcatgtaggttttgtaagcctcgttctcgaagttaagtagttgaggctctgttaggttttggagagactagagagcatgctctcttgaacttccttctaaggactgtgtcggtgtttagttgctgtgcgtgagacgcaacgcaagagaaaatgtctgcgaggatatccacgtgtgatgcggacaatgagaactgttttttttctgtaaaagtcactcacaacatgtaaaagaaacagagaagtcaaaaaacagagtcattggcttaaaaagcaagaaacagagaagtcaaaacgtattgggcttttcagtgttaagacggctggaagatatggttatcggcccagtcgtaagcccaaagcatgctttatgtcgcgtgtcttatttatttattttcttctcaaaagcaatgtaaaccaaaccgaaatcaattttagtttaaaaacccataaaacccatcggcgctgtgacgcctccggcgaaaacaaaaaaactcggcgacggtaacaacaaaaatgggaagagggagacgacacagaggttcaacttcgaagagaaatcaaatcgaaaatagcaacgacgacaatgttcgaaaacccctcaaatccgaagcttcctttgattccaacaacttgcaaaagcccatctgctcaaatcttcattttgaggagtattacaaggtacctgtatagaatcaatgacacttgcatggatttggaaacttttcttctaatcaacattgttgcggtgtgtataaggaacaaagaatagtgaaagctcaagagtgggattcgtttatg

SEQ ID NO: 8926 - DNA, 3000 bp, Unknown; identical to SEQ ID NO: 8916
  misc_feature (1)..( 3000): cDNA_ID_1825373_gDNA_ID_1971923_Annot_ID_58559 3000 nt of promoter + ATG

SEQ ID NO: 8927 - DNA, 3000 bp, Unknown
  misc_feature (1)..( 3000): cDNA_ID_2109542_gDNA_ID_1971923_Annot_ID_58561 3000 nt of promoter + ATG
ggcgtaaatcaacatcatcatcctaaacgacgccgttgtgtaaccaacaacgaacgacacaacggcggcgatcagaagcaggatctgcattaactgctccgccaatttctgcccttgccaatccatatctgaagaagaaaaaaaaacacaaaattacgatttagatccgatataacaaaatttgaatcgcacagatcgatctctttggagattctatacctagaaaatggagacgattttcaaatctctgtaaaaattctggtttcttcttgacggaagaagacgacgactccaatatttcggttagtactgaaccggaaagtttgactggtgcaaccaatttaatgtaccgtacgtaacgcaccaatcggattttgtattcaatgggccttatctgtgagcccattaattgatgtgacggcctaaactaaatccgaacggtttatttcagcgatccgcgacggtttgtattcagccaatagcaatcaattatgtagcagtggtgatcctcgtcaaaccagtaaagctagatctggaccgttgaattggtgcaagaaagcacatgttgtgatatttttacccgtacgattagaaaacttgagaaacacattgataatcgataaaaaccgtccgatcatataaatccgctttaccatcgttgcctataaattaatatcaatagccgtacacgcgtgaagactgacaatattatctttttcgaattcggagctcaagtttgaaattcggagaagctagagagttttctgaggtacgattcttcgatcctctttgattttcctggaaatattttttcggtgatcgtgaaactactggaatcgctcgataggtggtacgaaattaggcgagattagtttctattcttggccattatcttgtttcttcgccgaatgatcttccggataaagattttaggttagagatgaatcgtatagctagatttcatcaccagatagtttctttgtctagaatctctgaaattctcgatagttttcacatgtgtaaatagattgttcttattcggcgattgttgattagggttttgattttcttgattatgcgattgcaattagggattttctttggttttgtgttgatcttacgatacattccggcaattgaatacgtatggatctaaatcttgttaatttgttgaacagatggctcgtactaagcaaacagctcgtaagtctactggaggaaaggctcctaggaagcagcttgctacaaaggtaagactcgggctctcacatgtgatctgagtagcttgataaacacatttctagatttgttctaattggtggatgttttaatttaaggctgcacgtaagtctgcaccaaccactggaggagtcaagaagccccatcgttaccgtccaggaactgttgcactacggtatgcaatctgtttcttccccaaattcaattgtgtttttactttattgatatcgtcattgattaaactctgtttctctgttttattgatcttgattgacagtgaaattcgtaagtaccagaagagtaccgagttgctgatcaggaagctccctttccagaggctagttcgtgagattgcccaggatttcaaggtaatgtgtctgttcgtctgattcagtctacaaatggatttaactttttacttgttttgtcataaccttgtgttcttatcttgtctctttgattgcagactgacttgcgtttccagagccatgctgtgcttgcactccaggaggctgctgaagcataccttgtgggtctctttgaggacactaacctctgcgccatccatgccaagcgtgtgaccataatgcccaaagacattcagctcgctcgcaggatcagaggagaacgtgcttaattgtgattgggaagtagttggattatgtgaatgtgggtggttttctaaatagatagttggaattagataatggcttaaaaagcttttgggtgtaggagacttggaaacaatggtgttttttttttcttttctttctgtttcttgtctagtcggtttatgatttgcttgtgttcttcttagctacgttttgtggtgtgtattgctttcttctttggcaatgttgaacaccttttgttgttgaattcatctctgaaacatatgaatatgttaaagtttctgactcttgtttcatctgtatctgttcgatattgtatgattgagttttattgtttatcaataagctttctgtttcaaagttcttttcaatatcaacaacttttacgttcacgaaattggtaatccgtgtgacacttaaaatctctaatcgtggccgttgggctgtgttgagaaaacacaatgtacaatagtttgaaccgtaggataaagaatgtgagaaagcacaaaggagcgtatcgtgataaccctttcgtgagtattataaataataattcaactacattgcggccacaaccactacttcaatcatcccctattactgcttttgttacgaaagacaaaaaaacaaaacaaaacaaaagtcagctcaggcgaagaacaggtatgatttgtttgtaattagatcaggggtttaggtctttccattactttttaatgttttttctgttactgtctccgcgatctgattttacgacaatagagtttcgggttttgtcccattccagtttgaaaataaaggtccgtcttttaagtttgctggatcgataaacctgtgaagattgagtctagtcgatttattggatgatccattcttcatcgtttttttcttgcttcgaagttctgtataaccagatttgtctgtgtgcgattgtcattacctagccgtgtatcgagaactagggttttcgagtcaattttgccccttttggttatatctggttcgataacgattcatctggattagggttttaagtggtgacgtttagtattccaatttcttcaaaatttagttatggataatgaaaatccccaattgactgttcaatttcttgttaaatgcgcagatg

SEQ ID NO: 8928 - DNA, 3000 bp, Unknown
  misc_feature (1)..( 3000): cDNA_ID_1977105_gDNA_ID_1971923_Annot_ID_58563 3000 nt of promoter + ATG
gacactttggtcttgtctaaagccaatttgacacggtttatcaaccagtggtcctaactcccaatagtttgagtcggcagttggagtcaaatattggtttttcacttttttgttttccagatattataaaagtcaaattatcccagaagtaaaaaactgaaattattactactgaatatatcaccgaacctttgttattttcgtttgatctctgagacagtctctgactctgttattgggacagacacaatgtagagagttatctcaaggtcacaataagtaaatggctattagcaaaataattcgtatgtttatgtagtttgtaaagttttttaaccactggatggatttcgttaaatacgtttgacattcaagaaaacggcccaattgtttttcttattaagctgttcggcccaaagaaagacccaatcttataaaatatatgcaaacacattattactttttcatttacattcaaaccaaacagtacaaagataattaagaaatgtgattgcaaggtaaaatattttagttgtaagaaaaatacattactttataaatatagcaacctttactttactcttcatcattaagtaccttcttttttatctggtaatgcaaaagctttccaatctactttgtgcccaactcacaaacaaatctgttgacattataaaagaacaatctttacttctttctttttactttttacttttttttttccttttctcttctactttgacactaatagatttggagtcacattttcctttcgctctttatatttttctccatcttttctttctctctttacataatggagtagtgttgtctcataggaaattcattttaattatgaaattagcatatataccaactgtttattttgttgtcacaagactgcgactagtcagacaatcgagctgaattttcgaatattcataacaaagataacacattaaactttgatattctctcggttattcgtaagaccggatgttgaacgttccaacatataagacaaataagccatagttttggactgatatttaaaaacaattacgaattttttaattgacttttttgcttggaggttcatgtttgttttttagtccaacggaatgtaatcatgtgataggtcacatataagaaattaaaactaaaacatgtccaaagtagaggtacattttgtaactagcaaataaagtttcccacctaataatgcttttagcttaaaaaggcgatgtaccatttgatctacgaaagcaaatgaaaaaattaatttagacttttatatttatttgttccatcttccatgtatcaaccaagaataagaccggcatttaaatatggatattcagaagatacataaataaaatagagttcagacaactaacatctaactactacgataataagttaatggaaatgtgccccactggtattttaattcgcatatgtaaagacaaattgtgtatatgacattttcatatattcgtttttctttataactatacttatatcctcgttcttacctattggttcttgtgtgtgtgttaatcatctatagattctcatctgagtaatcactagataattattatgcatggctaagatgaaacgtagcaccttaaatggttttattgattcatgatcatattattaatcccgaccacttaaaatcgatttcgttatcatgttaatgtactcaacaagaccggaataaaaatgagcattagcgacgggacatgtcacctcggtccacctttaaaataagttttagtagatgtgatgattacagtgctattacatgaattatatagaacaacaatccgaaaagcaaaaagaccactaatcagtgagaaaaagtcaacgagttttttcttttttgcatttttatcagttaagaattttcaaatagtgaatctaagtttcattccacatattgtgaaagacgaatgatgtatggtgatgatattgatagaaatcattatactataaactctaatttgtgaattatggttttgcaactactaacttacacggttgtatatttatttccatatttaaagtcgaaagcaaccgattgaaaacaacatttcttcttctctaaccattttcgacttactgtattataacacttattgtttccctaggattctctaagtaattatagctgttgcgtgctgccgattaccgaatcaatctatcatgagttcaacacatatacatcttcatataagttaattaatcacagataaaagaatcatatatatacacatggttatgaaaagggttcttcttgaatactaatcctctgtcttaagctatgtacgtacgatacggacatgagttataaagtatacatgtatttatgtgtgcgttgatgccagctcgtctcacgatcatcacacaacacaaacgagatgtactagtattttatgattgtgcaaaattcttttgtgggttcgtgctcacatgcgtttttgctaataacgatgcatatcttatatattaatccagcttaaataaacaatgtttagtgtttacattgttgctaaacgtcaattttaaatataaaaaacaaacaatatatatgctactaattacttacacacatttgcaatgtaaataagatcatttgtagtgatcatcttataatatacacaatttcatagaatttataatctcttgttgtttttttctctcaaaattataggtacgagttaacaatattattaatcccaagctttttttcttcaactgcttttagaaaggtgatcatcaacaaaacaactcaacgaggaaaataattataaaaaaacagagtggaaaataataaaacaaagtaaataatatcatatttatctctctctctctctctccaccgtcgtttcccattgattagtttctctctctctcttttcctttgtctccagagccgatgataaacgacggcggttttcaccggaactgagggaaattaagctggtaaacatg

SEQ ID NO: 8929 - DNA, 3000 bp, Unknown; identical to SEQ ID NO: 8914
  misc_feature (1)..( 3000): cDNA_ID_1825365_gDNA_ID_1971923_Annot_ID_58564 3000 nt of promoter + ATG

SEQ ID NO: 8930 - DNA, 3000 bp, Unknown
  misc_feature (1)..( 3000): cDNA_ID_1382581_gDNA_ID_1971936_Annot_ID_58570 3000 nt of promoter + ATG
gtgaattcgttgagtaaggctccgtcccgagggacttctccttctcctactttgaattcgtcgaggccgtggaaaccaccagagatgcctggtttctctttagaagctccaccgaatctgaggacgactttagcagacagaccggtctcagcttcaagaggcagacctggagtagcctcagcaccaggttcaagatctggttccatagaacgcggaggtggccccaccagcggcggcagcggaaatgcaagaaggcaatcttgttcgccgtccagaggtcgggctcctatcgggaacaccaacgggagtctcactggtgtgcgtgggcgagcaaaggcaagcaacggcggaagtggctgtgataacttgagcccagtggctatgggtaataaaatggttgagagagtggtgaacatgaggaaactaggtccaccgcggctaaccgagaatggtggtcgaggatcggggaaatctagctcagcttttaacagccttggatatggtagaaacctctccaaaagctcaatcgatatggccataagacatatggtacgatcacgtctcacaattttagtcaaattttctttgttgagagtagagtagcatccgaaaatcttcgattgagagtttctcacaagctcgctatagattaaacattgggcccaagctggatgatctgactcgcaagaagagtgtttcttaaagttctctggtaataataacacaattgtcgatctttggtgtgtaggatataagacgaggcatgactggaaacctccggccgcttgtgacaaaagttccggcatcatcaatgtacagtgtgagaagtcggccgggtagtgtctcaagctctccggtggccacgagcagcactgtgagctcatctgacccgagtgttgacaacatcaacattctgtgcttagacggaaacgaagccgaaaatgatgatcttcttagtgaaagaagctatgctgcttctccgcggaaccagtaccccaagttcacatcttgacccatattattatgtaatctgtgttcttgttttttgttctcacgcttcgaagcaacttgtttctaagtgatcaaccgtataatctataaacctcaggcatcaaatgtcttttttccttcataaatgttctcccaaagcaattgctaaatgctgtgtctgatattttaaaccaagatatagaacaaagtgagaatcgagaaacagaacaaaacatggaaatagtaaagaagacaaaacagagcatagaagaagaatttaacgagtttggtacctaaatctcgcgggacaaccctctttgtaaatccactaaattacttgaaaatttacagcttttggcatgtaccaaaatggttcattccaatatgaccgatacaaaaaaaaaagttgtacgataagaatctccagatatatatttgaatcttttatactatatgaagggacgaaacagagacatgtaaatgggtttcggttttcttacaagtgtaaacaaaggaacatattcataaacttgtctcgttaggtttataagagagtcaaatatacttgaagaacatgtcgttgtgaggatttggattcggtgaatcgtcttcacgtttagagacaacaagaaatcagacctttaagtgacgagtaaagtaagtagttacatgccacaactccaccaaaatcgtgtttatactttttttttttataaatacttttattactacaattttataacgattactatttcttattgaaaattggtcaaaaacattttagaactttattttactttttttgtcaacaaggtggacttttcaagttttgattttgtggcgcaaataagaaataatggaggattttcgtggaacgatgatgtcatgtgccaactgtaaattcaatttcagaccgcaatcgatagaaattaacaaacgattcgttttaagaaagaaagaaagacgcaaggcaatgtgaaaacaaaaattcctttttggatcattgagttgggatttgagaattcgaactttctctttggatgattgaatgtcagcgtagtgatgacgtcaagtaaaagctcgtttgatgacgttataaaatgttggcaaaaatttcttttttaagagaaaaatataaatgcatggttgtctgaacggcgagaagaacttggtcaaattaaatgtgccgtgtagtttggtcaggtaaacaaaactttattagtaactatcgctcttaattcatacgtatgtacgtatgagtctatgagaacctttcttagttaaacggtacgaggacaattattgtaaaatgtaaaaaaaaggtaggtaagtgatagaatttgtttggcgtatttgtgtgacttaaattgtaataaacaggtctataaaatccattgaagttgaattcttctaaccttgccttagttacaggcagaagaaaataattaaagaagaaatctaatcagtgcgacttttataatagtctcgtcgtgtgaaaaaagtaaaataaaatatagtaataaaagtctcgtcgtcgtgtagctgtcactttcgtttgtcactttcgagcatcagcagccgaacataaacaacaaaataaaattgaataccttttagcgtattcactgttcatgagttctgggtttggtttgctttgtatgctcaacaatttattgacatcttcacgaaaaagtttaaattttaaatcagacaaaagcagtctcatgatttctctttgattaactcaatatagatttcttcttcgcactagcaaataaacacattatcttcttcttcttcttctctcatcgttactttatagatttagtatcgaggagacaggtcgaaattgaggttcttttaaagaaaagttccatttcatatctctatcaaacccttttctgaatattattttgcttgtgaatttgaatttgagcttttttcctctgttcttgggaggaatttttgtctgtgtttgtgatgcgttataattgcttcggacttctagat

SEQ ID NO: 8931 - DNA, 3000 bp, Unknown
  misc_feature (1)..( 3000): cDNA_ID_1989278_gDNA_ID_1971936_Annot_ID_58578 3000 nt of promoter + ATG
agagatgattggactaatgcatccccttagttttggggtcaattagtccatttcttttgcagaactttagtcttaatatttctcttgtggtaaaacagggaaaatttgcaactcttgaggcagcggtactattatgcaacatggaaagctgatggaacgcgatatatgatgctgctaaccaccgatggatgttacatagtagatagaagctttagattccggagggtacagatgcggttcccctttaggcacccaactgaagtgagtaatattcctgctttgtgggcgagattgtgtgaactagtggtttttcttacttatttgtttttggttgccagggcatatctgataaagtgcaccatttcacattacttgatggagaaatgataatcgataccttgccagataaacaaaagcaggagaggagatacctaatctatgacatggtagcaatcaacggccaatcagttgtagaggttggaattgtcattatttatttatgtaatcaataatggttggattggtggctcttttgatcaagatctgagtatttactgaagcacattgtaaatactgtagctgccattaccctcattatagaatattagaacattcgagaaattaaacacattatgtaggccgggcttactgtcgtaattagcttagagtgtttgttgtttgtcatgtctgactttctcgtggtgcaataaatattttgggaattatgaacatatacaattcctatgctcatatagagcatctgactccgatggtgcatattccatgcaaatatgttatatcgtttttcgcagttgttcagtattctttgttgctgacagttaaaccttgacgtaatctggttaccagcatacacatcttgtcagtagtatagagtatcaatgagttgtatttggcttgctatattatgtgttaatttcttaagatactaatagaaagttgcacaattcaaaaatggagcagaggcctttctatgaaagatggaagatgctcgagaaggaggtgatagacccccgtaatcatgagaaggcaagaagtcatatctatagatatgatcttgagccttttagggtgcgttataaaaaaattcatgccacttttccatttttatatttttccttgtataaactgtttatggagctgttaattattctttcacctaggtgcggagaaaggatttctggttgctttctgcggttgagaaggttttgaagggtttcataccatcactttcacatgaagccgacggcctaatctttcaggtaaccatgcgactgaagaggatctttgatgttaaagcctatttttcatacaaaggcagtgaagttttagttttagtacagtgtatattgtcttccaaatacatatctgagatctaaatctctgttaacagggctgggatgatccttatgttccccgcacccatgaaggtctgttgaaatggaagtatccagagatgaactcggttgactttctatacgagcaggatgagagtggccgtggaatgctctccttgtttgaaagagggaagaaaaagcatatggatggaaattctgttgtttttagaggtgtgtatctccgcttataattatatttataactcgtaataaacacagtcaatcataacttacattatttctaagaactacaagctactaatgctgaaactgcaacagatgattcagaccctgctgagtactctgggaagattgtagagtgttcttgggatcaggatgagaaagtctgggtaagcatgcgggtcagggtcgataaatcaacgccaaatgatatcaacactttcagaaaggtcagtaccataatccctctttatatacttgagttgttgcattattggttgacgatcatactttactaacttactttcctcatgtaaataactgacatttctttctgtcttttgagttccggtgtgattgggttaagtctaaaccattgtgtatgtcaaaataggtgatgagaagcataaaggacaacatcacagaggaagtgctactgcaggagataagggagatcatccgtttgcctatgtatgcggatcgtattcaaatggatagcaaagctgcgcgccgcagatgaaacgtctgtttgtttctctcaatatacccaagaagctgagtcaagaaaaagacatgtctgggttggcagtaatgcttttgcttctcttctttgcaaatcccggggtgcttctatactaacattgtacgtaagaaggaaaaaaaaagaacgctgcatttctcgaatgtgtaagaatcccggtttcaaggaggttttagggtgggtttattatgaatcaaaattccgtttgggggtatgtgatgatggttttagcttgataagatgtgtttactcttctaagtgattcatatgtttagatgaaggtgtttgtaatattactagcaatagtacttaggaatgttgtaatcttttagtattagtatcatattattattgttggttccattatacttcagaagcaaaagaatgttagacacttttatcattgagaaagtatcaccactccgattctcatatcatatgtcaatcattttgatttgaaatcttttcatcgcattttacatagaaaaatcaagaacggaaaaggttaaaaatcttccttcgatcattcgaagtgatagggaataattgacgtttctcatatttgtaactaaacagcgagctgtgtcgtgcgttttacttagatcaaaacggcaagcagtttactcttcacagcgtcattcgatttcgccggctgcgatctcccacacacacagagtctcagcttcgtctcattctccttctcgatctctcctttttattcaccattccaaattccctaaaccccgattttggggaggttttacaaaatctatcgacgtagttggatacagttcttcgattctgattcgattttaattttatgtcaagggaatttgcctagtattcgcagagtgtgatcatatg

SEQ ID NO: 8932 - DNA, 3000 bp, Unknown
  misc_feature (1)..( 3000): cDNA_ID_1989272_gDNA_ID_1971936_Annot_ID_177272 3000 nt of promoter + ATG
ctggtggattgggtggcagtgtgaatggaacaatgagcaagtcatcatcactgtctgttgaggtatctgtcaccgttgctctgcttggaccagccttccctttcttcccaattgggtccattattcctttccctttgtcagtagggagacagtcagggcttttaaggcggatgcattcttcaggctctctaatactgattcctcctgtagggaacagctctcgcctggtacgacggtgttgttctgtctctgttgtagcagcggttggctctagtgtaggccccaacacggcactatcaagtgcaaattggtgaagttcctcctctgagtcataatctgaatcgtcactgtcctctgaattgaagttcttgtccgtaacagcaaccggagaacttggaatagtgtgttggacgacagttacacatagattgacctcctctatatgccgccgcatttgaatgaacattgtaacatcactatcttcgctgatgtattgaggtggagaaccgttgccttcatctatcgccatccactctggaaattggtatgccattttaactgtgatgcctcttccacgcaagccaagtttatctttcaccttctgagatagctcttcatacgtcatgttagttctgagtcggatgaatgacgatccttcgacagtcttaggttcaaactgccaggctagattatccaccctgacccactcgccaatcaccaacaatacttcatcttgtcctgcggtctacatggattatggaaatagttcagtattatttagaaagaacataatgaaaattaaatgtaaatatcaatcaataataacagttttccaatttaatcgttcgtagcttttaattacggaataacaaatacagcgtgaatcacgatctaatttaagtaaatactaacaagttgtttagcagatctacaatctaggtaagtggtatattcgaacgtaaaagtgagaatttttaaatggaaactttacactaggcaattaaatcacgagagactaaaaacagaaacaagaaagcgatggttttgtacctttcccttttgattccctgtatttactgctgtactattttcaccaccatccatactgttctgttttgcaggttagatctctgcgtaaaaggtatagcatttactggcaataaatagaaaacagagcatcttctgctccgatatttttggggggaatattttattcaaattaatgtaaaaatctgcaggttatgttactgatgggacaattctcaagcggtgctaggataatttttttactggcttcgaaaggagacacgtcagctggtagaaagaagctcgctcttaccctcacgcgcgtacaagaaatcacagaaacgtggcttagggagtgggttgtaacttcacatacccgtagcgtcactctctcaattccttcgtttatggtgttagttacttaatatttttatggaatatggttattgagctaattcaccctaaaaaaataccgaatattacttttggataaaaagaaaaaatatttggcgataaagtttatgatgggtcaatataatatacatttgtcatgataagatttcacgcatgacatgcggttttatatcaagctcatctccgtcacttatttctgatattagaaatcacttatttctctaaaaatctaaaccctagtatctcctcttctcacaaatacttgagttgttcttattcaaaaaattacacgaaatacaatggttcggatggttagatccaattgtacaaacgttggtgcggtggtgatggcggacgtacaaagcgtgtcgcggaacgcaacctttctctttttctcggagtatggtgttagagcagatttagatcgtaagcttcttgtagaagctaattcttgccgaattgaaccgttggtcgtcgtagggcgttttgaaccggtttgagtggtcagaaatggaaggttgagaaaagtagtgtttgggatctagcctacaaggatgagtcggttggtgactgggatcaaacctctccagtttttgttcgaatgaaaatggaatttgattcaggtgcgtcgaaatgttgttgttcccgacatccatgcttgtgagggtagttcatattaagaatatattatatttagtatctgagagattatatatgtatttaaaagtcatttacgaaaatttttattgcctcagacactagctgctttggagaataatcaataaagaattagcaattacatgaagcttacgatcaaaatatgttcaaacaccatattccgaaagatagagaaaagttgcgttccgcgacatgctttgtagtttgtacctccactatcacgaccgcataaatttctggatgattagatctaaacatcagaaccattatattccatatactattttgataaaaacaactcatatatttgcgaaaaaggagataataaagttttaaactgttaaaaaaaaaagtgatttttgatatcagaaataagtgacggagattggcttgatataaaaccaagaaaaaacgtattagtaccaaacaacaaaaatagattttaagggctacacgtttgatccaccaaaatcttttgtaaaaatgaaaagactagcttaattttttttttaaattggtttacaatttaaatctgttagctaatcataataattttataatgattttttagtctaaatgtatgaagttgctttatgaaaaaagtttaactgtatgaaatttgtctttaaaagttaaagagataaaaatatgattcatttggtttcaaattattaaaatatttagttgataccaaaaatatttcggtctctataaaaagaaaataacaagtatactatgtccgtgcatagcaagctagtaatgattttttattttatttttaaaacacaattattaataccttgttcaaatcagacctaaatctctaaaaccgtaaaatatctcttaagggttatcgccggcgctcttgtcaacttatccatg

SEQ ID NO: 8933 - DNA, 3000 bp, Unknown; identical to SEQ ID NO: 8931
  misc_feature (1)..( 3000): cDNA_ID_3044034_gDNA_ID_1971936_Annot_ID_177265 3000 nt of promoter + ATG

SEQ ID NO: 8934 - DNA, 3000 bp, Unknown
  misc_feature (1)..( 3000): cDNA_ID_3044046_gDNA_ID_1971936_Annot_ID_177256 3000 nt of promoter + ATG
caggagaaactttgtagacaaggaagatgattccaagagagggatgatttcgaaaattgaagcaggaggtgaccggctctttgtttctcgggaatgtatggaaggtgtggaggtctgggaaacttctagtttctccggtgtggtatccgtcgagtaatggtttcccgaagaacggtgatcgatcaccctctgttttcccgggaaaatcttgttaatttcgcaggaaagtaacaaatcttcaaactttccagggtctagtagaagactagtagtactgattgtctctacccaggtccacacttgaacagaatgaagaacatcatcaagattcacactttaccattatataaagtactagagaacactctcttatgttgtaaattgatccatagatattgtctttgtaaagttttggttctagtggataaataattatagtcacaagtaactaacaaatccagtttagagacagaagcttaaaaaaaaaaaaaagacactaattgttgcgggaaaattttgtttaaaaacaatgtaaaggtatgatggaagtgatgtcggtaaaaggagaaaaaactaaccttccttgttcatcttcattgtatttaatctaattgatctatgatttctccatattttaatacccttttaagtactcaacattatctcagcgtaatgattatatctcttttagtttgcaaagcaagtttccattgtatagctaaaattcaactactctttttgtctttctcaacctactctacctaatactcttcgttcttttcttttttgatgaaatgtttaccttttttaacaagacaaagaatctttctttatgtattgctttctttgccaatgtaataaaaccttttgttgcaacttctgtgtagtgcattccacacaaggtcttgaaaggagagaggaacccacatttttaaatgcaagtccttcattggattctttagatagtattgatacattatgtttttgttaggtcagattttggacctacaatttccgaaacgcttaaagtttgttatgatgaaaaaattaaatttcatccttcttttaagaaatgtcttggaattttccttttgtagtatatattaacaagaaataataaaattttgattaatgtaatatggggtcaaaaaaagaagaaagccaagtggggatttcccatgagctttcttgtctttggtcctttgacgccgacccctccttttgaatttaaacctggcttctctctctcttttttatttttttggtcggttacaaaatatcaacgtaacttgtttaaaacaatggaaagttaataaaaacagtgtgatattttattttattgtaaaaaccttagtttgctcaatgaattttgaaaagaagatcaagaataaccatttctagtcaagaacgataaatatttctgttatcgaaaataagaaatttaaaacactcctatacaattctctaacattacagaaaaaaaaaacagagaataggagctctctgtttgaccggacgcaaatccaaaccgggtaaaatcaagaagaagaccacgttgagactgagtttgatctcgacagaggaaaagaagagttcaagaactcaatgcaatcttcaatagcttctgctcgatgagactctgtctcgtttacagactttgacctcttcatataaatagctgacgaagaagaagacgacgacgacgaaggcaacaaaaacgatgacgtttttcttctatcagtagtatttcttctgaaggaaataaaacgcagcgttttggcgaatcttgctccaatacgttggatcaatttcctcgcggccggcgagctccttagaccaaaactgagaattccgacgagaaccacccttctccggctgtgatgtgacgagcttaaaccgtcgtgttttgggaatatgggttcgtctgtggcttctgggttcgggttaaagcttactcttttgcatgctcttcgtgacatattttttgttgtctgaaattgcggtgaagagagagagagagacagggcgaggagaaacagagagagagagaggggttgagagaagaccaaatagcaaatactaaagagaagcaaatgggatattttgaagactatttatggggtgttgtctaatgacataaaagacattggggtgaaattgtaaagatataaatatggtggggtcagtttaacaaccttactaaaaattgaaacttgtaactcacaattttctactttctaattgtataatgtggatttagtgtgagagtggttatatggaaatatttatcttatcttttctacagtttttccttatctataagagctacctactactacatgtgtgtattaatgaaaaaataagagcaacttaaacaaatgctgatcatgatcatggggatgagtactggctcgtcaagggtattgttcgctcgtggaatgagttataagtttttgctcatcttcttaatgaaaaaatagaataaacacacattttgttatactactaggcttttcctaaacccatttcaaactctttaaggtaagtttattaaccaaattatgatccgtcactctaacattaaatggaagtttgttaaccaaaaaaaaaaaaaaagttagtttacattagtactatttatagatttgaacaatcgatctgtccttagatatgtaaataatttatactaattctaactgcgtataagcaaaacttaatggtactaaaatcaaccttagtcagcaaccactactaagacagagagagaaagtgagtgtgtctgtgagggcgaatcaatgtctctgctttctccagaagatgatatttactttttgtgtcaattagctgtataacgtcttcttcacataaaacaagaacactccacttactaaaaaaaataattatttcttcttgaagagtggaattctttctcgaatcttagaaaattccatttagaactaaagaagagagagagatccagtttctcgtcccagttaagct

SEQ ID NO: 8935 - DNA, 3 bp, Unknown
  misc_feature (1)..( 3): cDNA_ID_3042454_gDNA_ID_1971936_Annot_ID_177247 3000 nt of promoter + ATG
gat

SEQ ID NO: 8936 - DNA, 3000 bp, Unknown
  misc_feature (1)..( 3000): cDNA_ID_1989277_gDNA_ID_1971936_Annot_ID_58579 3000 nt of promoter + ATG
ggagaaaaacagagttattttggctgaagctgggaaggattttgttgatgtgctctgtagtcttttgactcttcctatgggtaccattgtcaggttgctcgagaagcatcagaatccgcagtcttcagtcgttggttgtttacacaatctttacaaaagtgttgcagacatggacgttgataatttcgagtctcaagcttgtaagcatttcttgctgcatcctcggagtgcgaaggggagtcatggcagagatctaaagctcaacattgatgacaccgaggcgaccaagttctttgtctgcccaaattttgtttctactgaagcatgccgtaagttattcagcaatgttagtaccatgaagtgtcgttgtggaagctctatgcaccgtgagattccggttgaagaacagcaagctgatggagtatttcccagctgcagaacatcatttgttattacggatgatctcaaagtggcattgaactctatgggtcttgttttgaatgtcctcaatgattttggttactctggttttgataagctgcaagaaatgcttattgatgttggttttgaagaggtacttgaactttttatatctacccttgatgacaacttcttaataacgatctttcttacactactttcttttgtaaatgtagattctaactttgctagggtgtttgttcacttcggaagctccattgacagacaccttcctgaggaaacattgcatgtcaaggaaacgtaaaatgttgacaccacttgtacaagaaagcagtgttgcaggagctgcagacaatctcttaactttgaaagtttatgttagaaagacagacagggctgttctctatgctgagtgcagagaagaattcgttgattttcttttcacttttcttgccatcccgattgagtttgcttgggaactttctattgacattggtaatatgggctgtgttggtaatctgtgcagaagtgtgaaagatttgagctttgagaagcagaaagcagccacagtttctcaatgcatgcttccttatttctactggaagggcacaacctcttgatgttgttatccaggaatcaccagaatatgaatgcttggtcacccattatggtcataacatgctctgtaaaaagattaacaaggctgtgctttcaaacggtgaaataattgcaaagttcacttcagcttctgctagtattggacttgtgaagggagaaacaaatttcatagtgtcagatgatctggttgtcactcctatgaactcgtcctcaacaatttcattgttaagcaagctgcagatgaacattggtgatattgaggagcaagtaattagcattggcaaagctgaggtatggtgcctctaccttttaatttatagtctttgattcttgagttcttaatatttttgaaactacttttgtgttacaggccactagcttacttagagcttctttgatcacaacctctgccttaaccaatggtctctcaaacttcctctcaaagatggacccggacgaagtaactcaatctacacctaagattcaaaagtctgacaaaccaaatgaagcttggcagcttctgtagctatgttcctttttcttgttttgctgcagacagaatctttgagagcatggcgtttgtttgattgtactccatttgctctatgtaaggatttttctgaattaacactatgttgaggatcttgacaactcttattaagaaatcttacagagaaatgtctcaaatgtatgacgtgattgtattatctttgttattgtgatgtttcttgaatctattttaaactggaatatctctttttaaatgatattcaacagattcagacaacgaagactagatgaatcatgaaggtagagtagaagaaacaaactttctgattcatcttagaagttagaacgattacataggagcctcttatatacgtagagcgttctggtttacaaccacttaaccgagataaattatatggttgtttcaacgtggataatcttatagagattttttttctattttaagaagaaatttgtcattttccaaataataacttgtccaagccaatttttttttttttaacttttgcattaaaattacaaaaaaaaaatcgtcatttttcctccacatcattacatccgttgtattttcttttcactatttttattttttaatctctgcaaattggtaaatgaatactcataaaatgataaaaacgtgaaaaaggtaatgttttttcctccacgtcattaaattatcaagggattatttgtattttctcatttgtatttttttgattaccaataagtttttgccttgactcgactggcctcagtatataaggaagacttggtctttctctctctcctttctcaactactctctatctctctcttcctttcgtgaattttctctctctagggtttcgatttcaattttttccactgaacccgcgatttgaactgaaccttcaccgtccatcaccatctccggtggatttcgtaggcatctacggagcttacttgtttcaaagaaccttggatgttgtttccgattctccgaaagctctgtgttctttagtttgatacctcagatattggatgcccttggtgagttttcgcacttattagtgatacgcatgattttgatgtccatatgttttcgagaagaggacgaatttcaaatgttcggctgagatttcgttgattcgtagcttctagggttttattttcctatggtagtcgagttaagttggagaaggataccgagagtatatggatctcttgctctgctttggatcttatttgcttcaattttcggctttgttactctatattgagagaattgggaaatgattttgagtttgcattctggtctgtgttcccgaggttgataatattgtgctttcttcatgcttcagatataacttaggtagcttcttacagaggaaggatatgttaggttaatttctgttcatttgcccttggatg

SEQ ID NO: 8937 - DNA, 3000 bp, Unknown; identical to SEQ ID NO: 8932
  misc_feature (1)..( 3000): cDNA_ID_1989272_gDNA_ID_1971936_Annot_ID_58585 3000 nt of promoter + ATG

SEQ ID NO: 8938 - DNA, 2079 bp, Unknown
  misc_feature (1)..( 2079): cDNA_ID_1989269_gDNA_ID_1971936_Annot_ID_58588 3000 nt of promoter + ATG
ggcacgccaagttcatcctgataagaaccctaatgatcctcaagctgcacacaattgatctttaccaaaggtgacctcaaggaagtgagcgaggaggttgctaagtacaaggtttgttaattgctcttgtttcatatcttatttacaaatgtgtgattatagcttcggatagtaagtatctgatgcatagaggaatcatttcatgcttacattagtttatacatgttctgaatttacttgtgttgctttcgatggtatctgatgtatagtgtaatcatttcttgcttacgtttctgtttatattgcctgtgttcctatgagtattacagtcatcccaagtagagctcatcaattgtgtaaaaagttgatgctttctcaatgcgattgacttatgtataatgttgttgctttctcaacgtgattggattgtgtaatatgttgatgcttttgcaatatgattgggttaaaatgttgatactttttcaatgtgattcgattgtaatggaacttttcttattatgaatcaggttggtgcccctgctcgtgtgggtttggtggctccaattgatgtggttgtccaacctggcaacactggtctcgacccatcccaaacatctttcttccaggtttgttttaaacttacatttaatgtttgatttgattcgtttgacgacaatttgaagttaattgaacatgtatgtgttttggattgttttaggtgcttaacatcccaaccaagattaacaagggtaccgtcgaaatcatcaccccagttgagcttatcaagcaaggtgacaaggtcgggtcttctgaggctgcgcttctagccaagcttggcatcaggccgttctcatatggtcttgttgtccagtctgtctatgacaatggctcagtcttcagcccagaggttcttgatcttactgaagaccaacttgtggagaagtttgcttctggtatctccatggtcacttccttggctcttgctgtgtcgtaccctacccttgctgctgcaccgcatatgttcatcaatgcgtacaagaatgccttggctattgctgttgccactgagtacaccttccctcaagcagagaaggtcaaggaatacttgaaggttagtatgcattaaaactgtgcatctttttcattttatttcggaagtttggagtactgattttgtttatgttaactctctggaatgcaggatccaagcaagtttgctgttgcttcagtagctgcggtgtctgctgatgcaggtggtggtgccccagctgctgctaaggtagaggagaaggaagagtccgacgaagaagactatggaggtgatttcggtttgttcgatgaagagtagattttgtcggttaagatcttacctttttgtcgtggattataagtgttgctttgtttttagtatgttggacctcaattttcttggttttagccaatccagttttatgttactactgtcttttattttttggaaagatttcgttttcttatggttgctttaatatttttcaataatgtctggacgatgaatttgcaatttatctatccgtcgagaaagttaagagcttcttatacatgactttgataaaatttgtatgaagcagaatcttcttagatctacaagttgagtcattttatttcttagaaagtaggcacaaatgtcatattctaaaagtaaatgaggctaaacatgatagaatgtaataaaactgagatacaaatcagaaacggcattaaccttagtcagcaaccactacgagggagaaagtgagtgggactgagaacgaatcaatctctctgcatgtgttgatgatatttaacttcttcctctgctttcttcgcatagttccacacaaaacaacaaacttaaatacttcttgaaaaaatggaagtcattctcaaatcctagaaattccatttttagaaggagaagagtgagtgagtgagtaagagagagagaagagctcgtctctgtagtcattaaatcagagagaaccaattttagtctcagtatagctatggcgatattcaaaaccctatcttttctggtccttttatgctttgagatacatg

SEQ ID NO: 8939 - DNA, 246 bp, Unknown
  misc_feature (1)..( 246): cDNA_ID_1989303_gDNA_ID_1971948_Annot_ID_58590 3000 nt of promoter + ATG
aagcttactgcttctcacaagcctctcatctccagtaccaaaatatctgaaagggtgattacactcattaagcacctattggcttctccagctcctcttcaggttttgtctcgagcacttgttttcctctgttgacttcctttgacaaacatgcactcttagatttctgctatatggaggcctctttgatgatccagttcttatttaaactcatggtaaaaacattctcagcatgtagcagtgatg

SEQ ID NO: 8940 - DNA, 3000 bp, Unknown
  misc_feature (1)..( 3000): cDNA_ID_1989302_gDNA_ID_1971948_Annot_ID_58591 3000 nt of promoter + ATG
atagcggtaaaaacagaggatcaaaaaacaattttttggaatcagcaccacagaggataaacgattctgttttcatagcatgtcagattctatacttgtttaccgttaaaacactttcatgagctcttcataaatctcaccttcagtggtgctgattgcagcctgcagctttaagtaatatggtgaaatctttctgcagcttctggccttctgctttggctatgtcatgcagcatgctagttcatccgaggaatatgtgctttcaaaagtatcttctgtggctgcacagctgatgaaaagaggctggtaagctgcggtgggcttcttctgcttctggtatctaaatttttaacacatgcacattagatgttggacgttagctttcacttctgatgctatgcatatgagaggattcatgaaaaggatgttgtcgttcacagacaattatgatcggtagcttctggaaaaatagacaaaattagttagctacttctgttttcttgcttgctttgttcctctaatggaacctctaatctgaacaaattactcttacaggcttgagtttactccagcccagaaggaagtcttttttttatcaggtatctacattgtttgtaatttttcggactttcatttttagtttctgtatcctatagtttgactagcattaggtgcatatatgtttctctctgatactggccatatgttctaagaaatttacctggtacttcaaaatctttttaactgtaccttaatatatggagaagaaaggatttagacgctaacctatatccttcatgtggtccagtccatataacacactgtttcattctttgacaaagcactcaagagaagtggctacagaaaaagcaatttcctctgtgaaaactccagcttcacatgctatggctcatcatctttacatacttatagccattacacaatccacatacggacgaggaatctctccccgcaaagctttcatgtcataggcagaagtttttgtgctatgtatgtcagtctttgaacaatcggtgaatccgtgattttacaacggaaaggttggagtctttattgtcaaataacgtactagaaagaaactcataaatatgtatgtagtaccttctactagtagtatgtaagtaatatctttctctttaacttcttcaacgtggatttttatatgatgattatatttaactaagaagaacgttgtacttgtatattattatactcaattagtcacgtagatcgaatcatcgtttcattttgaaaatgaaataagtactgtatattatattcacgtagctcgaatcatgagttcattttgaaataattgtttaccatgcataaaaaaggcaattggaatcccgtgggtaagtgacgacaataattttgacaaaataaataaacaagtgacgacaatatacatgtgcagtgtaaaagttttggtaaaaaagaaagttgtttctaattcactaatatagtagcacatagtatgaaacctgccaacaatacatgtttcatagaaattttgaggagtctcacatattcttttactcgtggaccgatattgaaaatcatcgaactcaaaagatcacacactagctatgttgtccaaaatgaaggaaacaaaaaaatcgagaaaaacaatgaaaccgccaagtacaaaaagaaaaagaaatcaagagaaatggtgacaacgcattgatattattaaagtaaagctgtaagtaaattcatgagatctccgttgaacacaagacccatgaacttttgtcaccttcttggcttcttctaggtgcatgtccccaaatcaaaaatcaattattattatttataacgattttttcttcttcttgttatttaattattatgattacttatgaatctgacgaaaaaataaagattgcttataaatcatatagtatatttttctttgataacacaaaatacatatatttgttcaaaatattagcatctagtcttaaaatagaaaagaaacaacacgatttatttactgtttttcaaataatgattttcgtaatattttttcatcaaataattaaaaaaattcttgttttgtcccaactgatagtcgttgatacttatcaactgctctggctatgtgctctggagatcatacaaaataaataagaaaaattgttagaaaaaaagaaaatctattgtccttgttattcaggagaatacttgtctacgacgaggtccacagtaactccgaagacatctagagtctagagtgatctagtgaatctataaagccgccaaatcgttaaatctttccttttaaacatttttgatttcttttacgtttgcgttacgaatcatcttctgcctctctctcaacgcaactcaatccaccctacacgtgttcctctcttttcccgtctaaatttctcagtctcgccgtgaattttgttcttctcttgttttccgggcgaatcaaaatccgtctcatttccaatcgcgtctccgttggtattttacatgaacgtttagcggaatctcgggtttagcttcggagctttgcatttgatcttcgtcgtctgtgttgtcctctctcggattttgttttttcgccgctgcaaatcagagaaatctattcctggaagtgataagatcgcttggaagcgtttcaggtttggaaatcggattcactgttttgtgtaatttttggttaaggacttaaggtggtgtttgattgttcggaaacacaattagtgacgattaagttcgacctaattttgtttagcatgctctgataagttaagaaaattggataaatttgccattctagattccgatttggttacaatgttagatgcttacgtggtttatagggaatcttttgctgattgtaacacagggagttgttggaatggagggtccggaaagatgagagattttgaatacgcagttattctttgatttcttaatagattttacacgtcattggtgaagaaaaagggaaaaagaaag

SEQ ID NO: 8941 - DNA, 3000 bp, Unknown
  misc_feature (1)..( 3000): cDNA_ID_1988834_gDNA_ID_1971948_Annot_ID_58592 3000 nt of promoter + ATG
gcgccattgggaccgtagtttcttgcaccataatatctctaggtatcttactcccctctccctgtaattgattctgttgaaagcttactcctgattagtaattgtggatcattaatattcttgtgatgtttgaaacaggtgcaattcagttctttaagaaattagacattgggacctttgacttgggcgattttcttggtaatgtgttaaggagtttcttttatcgattttttgttctagaagacttgattttttttttgcttacttaatcagcaatcggcgccatatttgctgcaaccgactctgtatgcacactacaggtaatgtgattcgccaattagcagaagtacatacaggcccagaatcaaagtgtaattaacaaaaactcttgttcctttggtgatacaggttctcaatcaagatgagacacctttgctttacagtcttgtatttggagagggcgttgtgaatgatgccacatctgttgtgctcttcaatgctattcagagttttgacctcacccaccttaaccatgaagcagcttttcaatttcttgggaactttttttatctgtttctcttgagcaccggacttggtgtcgcagtaagtccattttcttctctctactgctctttcgtctggctactacttgcacgttcctctgttaactacaatttttttgttattcatcttgcagactggtctgataagtgcttatgtcatcaagaaactgtattttggaaggtagataattggctttagctcatatgtgactttatctctattagtcttctgttatgtagtctaattgggtatctttcttaggcactcgactgatcgagaagttgccctcatgatgcttatggcttatctttcatatatgcttgctgaggttagttttgtgaaattttataccactgtcataatttaggcatggagacaatcagttgtatcttaagaatcctttattgataatatattgtttgggttgcagctattcgccttgagtggtatcctaactgtatttttctgtgggattgtgatgtcccattacacttggcacaatgtcaccgagagctcaagaattactaccaagtaatatgacctccattttctcttgaaaacaaattcaaatgttttccatcttcaatacttacttactttctatgcatttacgatgagacaggcatgcctttgctactttgtcgtttctcgctgagacttttattttcctctacgttggaatggatgcattggacatagagaaatggagattcgtgagtgacaggtatggtcactcagtagaaacataaactctctttttgttcattggctatatacataatcttcttatgtttccattgtttggttttggacagcccggggacatcagttgcagtgagctcaattctaatgggtctagtcatgcttggaagagcagcttttgtctttcctctttccttcttatcaaacttagccaagaagcatcagagcgagaaaatcagcatcaagcagcaagtacgaacaatctactttgtctattgaattcaaatttgctgaggattgttgatacttactaatcttctctcactttgtctgtaggttgtgatctggtgggctggtctaatgagaggtgctgtatctatggctcttgcctacaataaggtaaattgaaagtttaatggatagtaaacagcgacatggtgattagtaaaaatctagcagataatttaacttctttatttctctgtgctctctaatgcagtttacaagatcagggcacacagaattgcgcgggaatgcaatcatgattaccagtacaataaccgtctgtctttttagcaccatggtaagatatctccctctcaggtttggactactaaatgtattttctctacagagatgttgtcaatgaggataaaccaatgctgagccgtgagacggatttgcattttctatatccggaaaactgttccctcctatttgatttgttattccaatgttttctggatcgctaacactgaaccctgataccggacatttaacatatgtttttttttttccacggctttcaggtgtttggtatgctaaccaaaccactgattagatacctaatgccacaccaaaaagcgaccaccagtaccacgagtatgttatcggacgatagcactccgaaatcaatccacattccgctcctcgatggtgaacagctagattcatttgagttacctgggagccaccaggacgtgccacgaccaaacagccttcgaggtttcctcatgcgccccacacggactgtccactattactggagacagtttgatgatgccttcatgcgtcctgtgtttggtggtcgcggattcgttccctttgtccctggttctccgactgagagaagcagccatgatcttagtaaaccttgaggagaaagatatatagaaacttaaccaaaaaacttcttcttgctcttccctcttatggtgactagtattggtgatgtaaatgtatttttcgttcttcaaatttacatattcttctgtaaatttgttattattcgatgatgaagaagcttcttacgtttttgagagacgtgtgggggttcatgtgtgttactattagtctttgttttgtttaacaaaaaaactaccaagtttttgactatgcatcatggggtttgttgttgttggtcagaacttagaacttgactaactctgcttcggttaggatctgattggtacggtttggttcgattttcgtcaatagaataaaaaactgtatgaatagaataatccggttaaattggcacgtgaaatgcgaaatgggctgagtcattcattatggaaagcccatgtgattggtagggaacgacgtcgggtgaagggaggggaagagcttataaatgaaagcagcaagcagagcagttcacgctctttgtacactccgccctctctccccatctctttcgacagatctcttctctctctcgtgtttcacgaaaca

SEQ ID NO: 8942 - DNA, 3000 bp, Unknown
  misc_feature (1)..( 3000): cDNA_ID_1989301_gDNA_ID_1971948_Annot_ID_58593 3000 nt of promoter + ATG
caactctgttttgattcggatcatgtcagactacttactttcataattgtgattgattaacctagaagttcctagttctaaaccgtcacactaagactcaagagtaagcaaaacaccaacattagatttttaaactagactctatgagcactcaaccaaaaataatttacaaaacaatcagatgattacgaaccacgtctccaaagacagatgccggaacactaccaacaaatgaagaatcgacataaagatgtgagaaattgaaaccctagaataagaagtcaaaccaccttacacaggagtcagattcacaagaacaaaaaaaaaactaaaaattacatggaacgaataggagacaaattaaaacataacaatcgttgtcttctagaaccttagaagagtgtggattccagacctaattcccaaatcagtgacttcttctgagtttggaaagttggctaaccaaggccgagaagaaagctccactaaaccaaacgatttggaatttggatatcgagttagtttttttttgtagtataaattttttcaaaaagagtttttcaagttttcccaaatgtacgccttttttaaaaatgatatgaaatggagatgcatcaggaattactgtatataagatatcaacaaaaatttacaacagaaaaataaaagtcatttcaaacatgaaaccaagccctcactgtttaaaacaagcaccacaaggctaaagtgtgtcaaaagaacagcaaacagaagcctgcaatgggttttagattgatcagacccgaaggatctatcttccttgaaagtataaagccaagtactcgagctaaatgcagaatcaagccttgacccgaatcacgaaagagcctgtgaggacatgacaaggatagttaccgaactgaagcaacttataatgacaggtaataagcaatatttgaaataattttctatctttcttccctccaatgtgtgattttgagaatatagaagaaagtgaaagaatataagaatttcgaaaacaagcaaagcaagctgtgaactcacatgtgggaaggcttgatatatctgcagagacagcacaaggtatccccaagttggagaggacacctctaatgattccacacgggaaatagaggtacatgctcaccgcttgtgcagctttgctttcccctggagtagaaggatcttgggtttcattctcagatgaagggtcaattgagacacgagacaaccaccggaacttgttgtcttgtaatacaaaagtaccctgaagagaaacattccatctgtgaataacacacacaagaagagttttggtctttgttcaggtaaaatcccagttatcttacccggtgatttgtctttaaattatcaatctgcttcttgaagacctcagaccagaagtctttgcagataaacttgattgcctctagatggtcactgaaccttggtctttccatagtgtacctaacgacataaaaaaggctgaagttatgcacaatcaagtaaaatgctaaatatctgccatcatacaacactgtaaaacagtttttatgtaggcaaacaccttcagaagcaacaaaacatgcctcaacagactaaaatcattcttcgtacacacacactataactaatcagggactaagagaatcattcttctgagacaacaagaaaatttcctaaccaaaacattgcacgattaaatacaaaaattagccactagagcaatgagaaaaaaactcgaatcagcgccatatatcttcccatctatcacattctcagccaattacacacgagaaacgataaatccaatatcaaagagaatcattgctaacgatatacattcgccatcatcttcagatctacaactaatactagcaacctagagatacaatgatcaaccagatcgaaagaagacgatgatcaagtgtaaaacaaacctctcggagagctggtggccgacctgataaccaatggcctcgatcctccgagcggcgagttccggcttgttagcatagaatcggccactgtacatcgccaccatctccattaacatagtgtctacacagctctccgccacttctctccccatttcttctctctctctcagactctttccgtcttctctccaccggtttggggcttatgcaacgaagctccgatctattaacttgtagagtatttacatttaagtccttaatagttttctattatttctgatctgtgacttcattttttaaagagtcatgataaccttaatctctgacatttaaaccggatcgtcttggttcaattttccttcaaatacccgatttatacaattatttcaagtgaatggaaattacttttggtgtgctgaatgctgatcatttatggttaaaaatcaattttacttgtataatatgagatataaatataaataaataaatcatgattattgaataggacttttttaatatctttttggtgggcaaaagagagacaattgtctcccacgttttctaatttaattaaaaagaataacacattattgattattaaatagcacttcaaaaatttacatttcataagattgattttgaaattagatcagcttgtaataagtctttcaaatttaagatacagaattgaaaagaataatatttaaattctttaaacatcacatgtccaataattaactctttaaacatcacatgtaaaatcagttaaaaataaaaaggatgagaaaaatgatagttttttttttttgttttagagtggaagtgggagaagcgatgataattacctataataccctttaacttttgtgtaattactcatgtttgcgtcaagtgtatggatttggtcgccagagagaagaagaaatatacgattcatacgaattctgtatcgcaaaaacatcaaatctcgaaattgagctccttttctggaactagggattgctttccgctccttgcgctaagtctacttggtttctgattcgtacaatttgatgaaatg

SEQ ID NO: 8943 - DNA, 3000 bp, Unknown
  misc_feature (1)..( 3000): cDNA_ID_2991568_gDNA_ID_1971948_Annot_ID_58594 3000 nt of promoter + ATG
cacggatctctatttgtcgacgaatgttatttacaataagtgtttcttattttctttccaagatcgaaatgccaaatgtatacgagagacacaagtatgttacatcataatatacaaggtgtctccatagttttggtattagcacacaagtcaagagtatgccctacaaggaaaagattttttagatatcctattcaccttgtatctacagactgacaagacactaggactcctgttattcccaatcagcgtcgaagaatccagcatctttcatttctgaatagtagacattctccaaattcagatcttcctcctgaagcaaacacaagtgaattttagcaccaaatcatgtggtgatgaagatggtactatggtaatggtgatggtactatggtaatagtgatggcgatggtgatggtactatagttataaagaaggtgatggtgatgctgctatagtgatgaaggtggtgatttattgcatgtttgtgggtacatagatattatgtatagagactagagagagagagagagggagagacaaatgttaatttgagggatttacctggaaaaagtctgcaagaaaagtaacatacaaaagaggaagatagaaggcgtggtaacaaacacttgtgatcccatacaacctgcaagaattttcaatttgtatttcctaatgttagaagcaagaatctgacttagacgatgttactcttttgattgtaaggcttttatctaaagggcttaccataatccaaaatgagcaccgtttgccgtaagagcacatgcaaatagggagagcccatttaaggcgagcatgacagttatatacttgtagaatgcaggtcttgctgtcaaaccggaaaataaaaacatatgggatgagtaatagaagccagtgaacagctattggcttatgcaaccataaggaggatatgagtggtcgatgtattcacctggtaatctctctctccatttggagttgtacatgaagaatatcatcccataaatgccagctagtaagagcttgtggatgacccataagccccatttgaacttatgtatatgttcattgttgtcgataaacaatggtactccaaagccaaacagataaattgcctgaaaggaagaatgaaaaccgtgaagaaattaaactgactgtagttgagtaaccagacaatacaagtttgcatatatcaactgtagtggacacatgatctaatgcagaactaagatcatgtcaatatacctcaaggaagtatatctatctatatatcagaaagtgtatctaacagttatgaacacaaatctaccttgagaagcaaatcgagaccaatgacaagccccgagatgaggaaagttcgtgttaatgcttcagcaccgcttgcatagtttccttggaagagaaaggctaccaagcttacttccagaaacaacattccagatgttgtgaacaaagttaacaaattccaaataacttctttccccggagtgcattcccatgcctaaactcatgaaaagtaaattcaaaacgaaatctggagtaagactaaatcaggtaaaacatttcctgttaagcagcatctaaccaagaaatcaacactaatagcttacacaaaatacaaaagctttctaatcaccagtgtagaataaaaacaatgttgataagatcgcaaagtttctacatttacagagcctaaaacactctaaaaagcattcttcttcaatctaagttctgatctctttacacgcaacataggtatgagttacttgtgaaatgaatcgaagtaaagaagagaactttaacaaacctgaaggcaacaccaagcaagattgagcaagctaacaagccaaagaaaaccataataggcaatcataatgtaagatctccgattagacaacttggacaagctcttcttcgcctcgtacgctaagtaagcgacgaatagaatagatgctaaaaccaaaaccgtgttatgaagaaacccatgacacttcccgacccatccgccgataaaccctccggtggccgtcgaatcagggcttagccgagaaatcacgaacggtgactccgcaatctcgctgagcactcgcatttcatcaaattgtacgaatcagaaaccaagtagacttagcgcaaggagcggaaagcaatccctagttccagaaaaggagctcaatttcgagatttgatgtttttgcgatacagaattcgtatgaatcgtatatttcttcttctctctggcgaccaaatccatacacttgacgcaaacatgagtaattacacaaaagttaaagggtattataggtaattatcatcgcttctcccacttccactctaaaacaaaaaaaaaaaactatcatttttctcatcctttttatttttaactgattttacatgtgatgtttaaagagttaattattggacatgtgatgtttaaagaatttaaatattattcttttcaattctgtatcttaaatttgaaagacttattacaagctgatctaatttcaaaatcaatcttatgaaatgtaaatttttgaagtgctatttaataatcaataatgtgttattctttttaattaaattagaaaacgtgggagacaattgtctctcttttgcccaccaaaaagatattaaaaaagtcctattcaataatcatgatttatttatttatatttatatctcatattatacaagtaaaattgatttttaaccataaatgatcagcattcagcacaccaaaagtaatttccattcacttgaaataattgtataaatcgggtatttgaaggaaaattgaaccaagacgatccggtttaaatgtcagagattaaggttatcatgactctttaaaaaatgaagtcacagatcagaaataatagaaaactattaaggacttaaatgtaaatactctacaagttaatagatcggagcttcgttgcataagccccaaaccggtggagagaagacggaaagagtctgagagagagagaagaa

SEQ ID NO: 8944 - DNA, 3000 bp, Unknown
  misc_feature (1)..( 3000): cDNA_ID_1396989_gDNA_ID_1971948_Annot_ID_177324 3000 nt of promoter + ATG
atacatgtttatgtacattattcattaccattgaccaatataaaatcgttacagacgaatatttctaattaattatttataatttattcatctttattattttcgttataggttttgttaagttttttcgtcttacttcacacccacttataccatcgccttgtccatgaaacaatttatgagacctttagtagtttagggcaaaggcaaaccgcgtgagcatattaaattatagtaaccatgtcaacgtgaaatctatttttctttttataaaaggtcaccaaattatagagagatgttcaaatccactactttgtaccttagaaatgtgcaatcatattgcagggatgttcattgttcaatcccatcaacttgtggctatatcctcgtcttgtcttttcaccgtggtcgtattatagaattttgaaactaaagatatagatagaatagcactccttttcttatgtagtcattgtttgttttttatatcgattaatctttcattttcccaaaatgtactataactaaagaaagataacttgtttacattaccaacaataggaatgagactatttgtaactaacatgttaggtctttatctgagaaaattctgactttgacctctttagttctaccggttgctaaaagaaaattaattgacctacatagtttttgttttagaaacaaaaaattcttttaacctttagcaaaacaaaattccattgtgttgttgttaatggagtgatcagtgattcattaaaagatcggaacaaaagttctagtacaacaagagggcccaaaaagcccaagattagaatttaaagcccaacagttttaaaaataaaagataaaaaatttcggattgtccccgaagttattccttttgctgctcttgacttgaaagttataaaccctcacgattcatccttaaaccctaagcctaaagcagaaacgcagaagccctgataatggcggatccgatgaaccatagcaccgggcatcaacaacagcagaagtaccgtcagtacaatccttaccaacaagtcaatcttccgtaccgtaagctctacgaactcccaacttctcctgagtttctcttcgaagaagaagctacgaaaaaacgcttaacatggggagagaacctcaccttcttcaccggttggggttattgcactggatctgttctcggagccttcaagggtacaattgcggggatgcgagccgccgaacgaggcgaatccctaaagatccgaactaatcggattttgaactccggtggactcgttgcaagacgcggcgggaattgcttaggatccgtagggttgatgtttgctgctatggagagcggtgttacgtatatgagagacggagacgacggttcgttgacaactgtgatcgctggtttagccactggtgtgctttacagagctgcttctggacctagatccgctgtggttgccggagctgtcggaggagttgcggctttggctgcagttgctggaagacgcatcgtcaagcgattcgttccaatctaatgaaagtttctcaatctctcaaggttagggtttaagaactagtttaaaggaggggcttttagatagtgaatcattggtactggatttagggcttatgaattcaatttccactgtataaaagttgacatttttattgatctaattgctcaatccgactcaactttttgctgattttgtcgaattcacgaaattgaaatgatctcacataaaaactcaattgataattttacaaaggagaaaaatttgtcaatcaaagaagaagagaaagattgaacttttaacctcacttggtcataacttcaacgccattctttccagcgataatgacagaagtagccattccgagaaacagaccatgctccaccactccttgaaacttcccaatctctttagccgcagcgaatccatccttcaaaggagtcttaaaatacaaatcaataatgtaattactgttatcagtcacataaggcttgccatcaccatcaactctaagctttgattcacatccaaattccttgaagaggtcttgcaatctaatcaaattaaagttccagcagaattgaacaacttccaccggcatagctaatccacttccaccgagtcctgtaacgagtttggtatcatcagccacaacaataaacttgtcagccacagcttccaccattttctcacggagaagagcacctccacgacctttgactaaatcaagattcggatctacctcgtctgctccgtcaatagcgagatcgattctcggatgtgtatctaacccaacaagaggaatccctaacgaccgtgcttgttcctccgttcgtttcgacgttgggataccgacaatatcgtagagttcaccggaagagagtagtttcccgatctgatcaacagcgaaagctgcggtggatccggttccgagccctagaaccatcccaggtttaattgcctccacagctttctccgccgcgagcttcttcaaatcgtcctgtgaaagcgcgacggattgagccttgacggagaatgaaacggaggttcgaggagaagagccagtgctgcgtagggcaatagaaggagtgcgtagcgtaaggtgagaagaggaaacgaaggataaggaagccattggagagagaggattgagaatggttggagaagaaataaaatgaaatcgaaaggtttggtttttgacttttgagtggaagaggaaggtttagtggcaagttatagagttttgtagttggtttgagggtagtattggaatactagttttaaggttgttgtatttgggttggtgaagataataacctgctaaaccaatcagagtgttaaatatacgatgtcgtttttgtttctttgagaacagagttatataaaaaccttttttggtttggtttcgtggagagtctaattattttcttccactttctcgatctttgagatttctttcaaaggaagaaaaaaaaaaaaactcgcg

SEQ ID NO: 8945 - DNA, 3000 bp, Unknown
  misc_feature (1)..( 3000): cDNA_ID_1395928_gDNA_ID_1971948_Annot_ID_177318 3000 nt of promoter + ATG
tgggaatgcctttaagagcctgcaggtagttaccagggcatttcttcagacactgcagctgtttcaaaacgcccgattaaaactgatcatcatggaaactcatcaattgtagaaaccaatacatgagtagtttaaaacttactatggctctttcagcaacgaggtatcgcggtagttgccttagagtcccgtcaatgtcaccagtttctttgtaatattcccgggcatcatttactacatgcctttgtaaaaagaatcttaaagtcaagaaaaactatgcaatgctgcgtcctttattttcgtagagccaaatatggtattaagagggattagcaattaaagctgagactaggtcatgtaaaaggatatcagtttctcttggatcaagaatcatgtctacagcatctttccactctcctttcaatagtgcagctcctacatggtgggttggtactgaaccacttccaaaacgctgtcacacaattacaaaattcataagaaaatatttctatttgataatattcaagtactactcgataccacaatgcaaaagtgtaagttgaattagctactaaaaactaaaaagagaaaataacatatatatcattacaactcgacaagagaatagtacctgcaagccaaagtagttgatgaagccatctttccccaaggattctgcagattgttttatagtttcttcagaatccgcaaccactcctctgagaatataagaatttatacgtataatgatatttcacgaaaataaagatctttgcatcatttctcagctaaatttgatcaaaatgtttcttaaagaagagaatctggaagttgacagaggatcataagagattcttttataaatgtccagttatattcttaccttaatgtgatagtaaatctgtttcccatgagctgcccaaggagaaggccctctttgacattgctggaaaacggcagcaatcatcattaacactaagaccacataaatatgtccaaatgaaaacattcaagaatatgttggcttaccagaagtcaccaactttgatcccaaacaatctcttgttaagcgcagccaatttgctagcttgctgtttgaacacagttacctaaaaagcccaattctcttattatgtattgtaaccattaaactcatcttacaaagaaaacacgtacagataacttacacgctgagtagaaacagaccgcttatcttttgttccagagaatccgaatgactttggctgtaaattcaaaaaccatttcaatacacagcttatcaaggaaagtacaatggctagagataaaacagcccctttatagatggatagaagaagatgggaaacacctgaacgcctagcatctttccaatcaatcccaaggcctcttgtgtatctttgttctccttgtaaagatggaacctattaacttaaacgactcataaatcaaatgacacataggttgaacgtccaaatgcattaataaaataaaagcactacagagattatgatgtataaaatacaccctttcgttttattgtatcagtaattttaagacgctaatctacatctctaaagtgggaaatccagttcaggtatccatttttcaggatagactaatgtactaggtccaatatatagtaactttaatgtcaaataaatgttgatttaaagatattacctgagaaacttgccaacatgctctggccaatgctctgaacctctgctatcaaaaggcttatcgcctctttcctttcgtttttttgatctattacctctgttgttattggctcctgaattcactcgcacacggatgcattttgaagtagaatcaggaccgtcgacagtgtcagtcactaggaacttgaaattctctttaacaaagttgtggatagcctggatagtagtatacgaaaaagaaaatctagtaagaagtcaaaagctaatgtcgacaacagtatatgtaactctgcaatcaaaacctataccgttctcttggatttgtcagaacttggatcaagaacaactggtaagacttcaccatcagttcctgaggtgacttgattgatcaatatttccaaacgctctgcatcagtaacactggaaatagatttgaaagactcaactgcagaagtataattttggggtacattatcacaacttttcgctttatcctcctccttcacagcctgaacaacacacaacaacgcattggcacaaacaaaactaaaagatacaatcgaaacaaaacatagcttattgaaatgaggagagagacaaaccatctcaggaggcaagtccaaggatgtcaaatgaaccacattaccatccatatctacttcattaacaataaagtctgcgtatctacgaaacataaatacagaaaaaaagtttcaatttttctcctatatggaacaagaacgtttgtgtataagaagaagcataaaaacgtaaactgatctcacgacctttgtttgaggattccacggaagccagggagctgggagataaaacaggagatgcccacgtcagcttcatctactgttttcataccttcaaagtttgtagctatcgtcgctattttcgttgtccagctcaagctcgagtagggttttagcagagacggcaaacaagacaagacagttctacttaatttcattgccttcttcaccggaacggcgacgacattgaaatcgaatactcagtaaaacgcaccgttcgttccccattgacctgacccggttattgatatttcaatcccaacaaaccgataaatatattctcaaccaaattgatataccaatgaatcagatgttttgttaaaacgcagcgtttcgttcgtcaatatgctctaagtttaaaccagatcggtgcgaatattaaaccgaaccggttcatgtcaatgtcttctttgtagaaagagactttcctgatcgaccttccactactaacagatccacaaatttcataaggttcagagcaaatcggagagagagagatg

SEQ ID NO: 8946 - DNA, 3000 bp, Unknown
  misc_feature (1)..( 3000): cDNA_ID_1027928_gDNA_ID_1971948_Annot_ID_177317 3000 nt of promoter + ATG
gtcataattaagcaaagactttttgcacctgtagtatctcaatctagttcgatttgtttttgttgtcttagctaaaagagctgcttgcacattatgtttgttttataaaactaaaatacaaagcgtattcctttatttgtgcagaatggaccctgtatgagcaggtagcaattgcagctatggactgtcaatctctcggtgttgcacaggtgaatttcccttacaatttcaattggtaacttgaaaactacatgatcctattttaagatcacgttttgttgaaagcatcagttatctagggctgtaggtgtatgctatttcttcggtttgagcctcttttctagagttttcttgcatttttgatatattctatgtatcatggatgcattgtgatgtgagttgttttctgaaaattcttttgttatgacaatttcttttttgcagaattgcatcaaggttctaaagaagaaatttccggagagcaaacgtgttggtaagtcaatatcaacccttgacacactgagcaattcttcactctttgttggacatcaaattttactcgtatcctttctctagcctccttggataaaccacatacgatttgataacttaggaacaagaaacataaactccacatcctttccattttctttatacttattctcgcatatgcttctctaaagtaagaacaaattatcaagttataagtaagaacatattatcaagtttaaagtataccagctacgtcaggctgaattcacgtggtgtacatgtgtaagttttgtgtcttcacatgtccgtactcacaagtttttgtttattttgccatttttgggtcttctgggtgttcatatctgtgctcagaggttttctagctatactgaaagttgggctctacaggcacctagtttcttagttaccttgataccaatctgagctgcatcttggtaatatattcaggcaagctggaggctctgctgctagaagcaaagggaatgtgggaagaggctgaaaaagcatatacaagccttttggaggataatccacttgatcaagtaagcttccgcattttttcgtcatgaaactacccacaagctacttccaaatgttaactgttgtaagtcaaactcgatgtctaggtaattcacaaaagaaaggtggctatggccaaggcacaaggcaaatcttccttagccattgaacatctgaacaagtatcttgaagtgtgagtacttactaaccccaagctggactgatagaaagtactttagaagaaatatatcaaacagctgataacttttatatgctcttctttcttatatagattcatggctgatcatgatgcctggagagaacttgcagaaatttatgtttccttgcaaatgtgcgtctctctatcctctgtcctcagattctatttgacaaacaattaactactcaacgattaacaaatgtttttcattttgagggtgctctctttataacccctttaaatttataatctgtaacaggtacaagcaagcagctttctgctacgaggagctcatactaactcagcctactcttccattgtaccacttagcatatgccgatgtaagtcccatcttttatttatttgttaaaaaaaagtaaaaattgttctctggctttgttaaagaaaaaagtcaaattttggccatcaccaaggagcatcaaaatgtcttagtttgtttaagacaatgtatctagtatgcatcctataatcaattttgttgttccttatatcttacactggaagttcattgtcattcatatgtctattaatgtagtagcaatagaagagcgagctattttctggaactttgcattatttgcactgcacatatcaaactcaaaactgagaattctaaaagtttggcagttttttttttatatagttcgaaactctaaactacagcattgatcatgtatgattgtgtaattaacgtaattttcattttgcgttgcaatcgccaaaatcaggttctctacacaataggtggactagaaaacctcatcgcagcaagaaagtactatgcagcaactatagacttgacaggtggtaaaagcacaagagcacttctcggaatatgcttggtatgaaccctttcttcctcacaccagtttaatccactttggttatgcaagtgacaaaatgaccgatacatgttctgtttttgaaatcagtgtggatcagcaatcgcacagatctcaaaaggcaggaacaaagaggacaaggacatggctgcaccagagcttcagtctttggctgcaactgcattggagcgagagtacaagcaaaaagctcccgctaagctcaacctcctcacttctgccttgagaaacttgaaaatcgcttagttcaaagcactagagcccaaacaattttttggtattttggtattgtttaaacttttttacagtcagacttttgttcattccttttcttttacccttataatttttttcttattcacttggctatattgttgaatcactgatacggtttactaaggtgtgtttaatcaaataataaattaaactaattcaatctaaacgttaaacgttaataataaatttgtgaagttttagcaaatcatgcaatttatctaacaattaaataaatatctatatttttcactaattcataaaatacaacttctcatatcctaaaatcatgtatggtatttgttttttaatttcttttcacatatatatagtatggttttataatcgatttcagactcaagtggaaaaaagaaatattggacaccttagtgggccattagatgcaagtaaatacaactttaggcttagtccattactggtaaatttgaaggcccaaaactttgtttatcctgggtgtgaaactcaaaccctagaagaagactttaaattgaagaagcgccgtagcagcattttaggttaaaacttattgttgattcttctctattcgtcgtcgacctattttcctcagccatg

SEQ ID NO: 8947 - DNA, 3000 bp, Unknown
  misc_feature (1)..( 3000): cDNA_ID_1989295_gDNA_ID_1971948_Annot_ID_177304 3000 nt of promoter + ATG
tacatattttaattagattggtagaacaaagaaatccaaaaaaaaaaaatacagtcgtaatttttatgattcttaatcaattctacgtctaataaatatcgatttgatgtgtttttttatatcatcgataattatatcgttacctactaattatgtccaagcagatcatatcaataataatcaccattatttattttgtcagctaatctttagtattatttaatttgagacagatagttggatccatatgcataattaactattcgttaagtgacaacgaggcaaatattgtcagtttcttagtaaaaactaaagttgttttactagtagtaactaattgaggttaggtgattgcttttgggattagcttacactgattatttcagtacgggcaaccacggatcaccagccaagtagtcaaacaaggtccgatttaatcattaattagtctctaattagttcttttggcaatcacgttatttctattcgttattgttagcattagtgcattaccaatattgtttttcatattttttggggtggttgttctctacgtatatctctttctagatgatagtttatcaaattcggtttgatacctcgttctacctagtttagtattaaaaaaaaattagtgtaaaatacaaatgatattcacagttacttgcattaacattaaataagaatagaaaattaacatctatcaaacaaaaaaactttatggtaaagtaaaatggtgtgagaggaaaaggccaaatggataagatttgtggttggtctgattcattattcacaaccaaccaagtctttatttgcttctttttttttcgtttaaaaggctatgctgatcgtgcatgtctttgtattcacccacatgcacatgtgtgttctttctctaatataagattggcccccatcaatctgtttatttccaaatattatgataaatcaaatatttataccctgaattaaatcagacttgattatagttagtcatattgcacatgattcctgttcactgtacgatatgtaaattatgttgatggattgtcgtgtaaatgaaatgatgtatggtcaagactcaagatagataacacgagcaactttaacttaacacgtggccaaactaacctttgttgcctcctttggaacatctagtcgacatgctaatgtatggtctcgctgtctccaatccatttcagaattcttaaattttgtgtttttatttccaagcttctattggtaacatttagttagttatttgtaacaaaaacgaaaacatgagttagttatatagcattgttgtttgatggtagaagaagtagactagtcgttacgatgtagttgtatatgttatagcgattgcaatgattcgttataatgattttctttttagatgaatgtcgtctaatcaaaattttggttccagtttttttttacctttttctaaaaattaattttccaatagcgtatatgaaaccaaaatataagacggatactataattcagattaaaaatgttgtagctaatattttagtatgtaaaatcaacacaaaaagcatgtcagcaaacaatattcaaaactttatatctaaaatctttctaaaaaaaaaagtaactttacctaaaatatggtcaaattcgtagtgcattaggggatgataccattccccaccaatgaacgtaatcatagaacaatgatcatatcctttgatttattcaaacgaacgatgatcatttcaaaatactagaatatcaattatatagttgaaatgatgatggcatatacgctaatacaaatgcaatccgcacaatggaataaacgtatggaacagtctatcattcccatcactcaaaagatacgtacgagagagcacctttctatttccttttctaagatagctgagacctgacacgatcacatccacacgaggcaacccaatattcatatataatttgttttgaatgttgattgttctaattgaaatgaaaaccagtcgaagtttttaatgacataaactaaacctttatcagaatatggttctaaatgtagtaatttgttaatcatatcacacagtttagccggtagggagaattttttttcggcacgttatctcgatgagattcattattttggtaggttcaacatttatttcacaacaatactccgtcggctaatggaattattactatttgcaagcatcatctttgtgtataacaaaacaaaactaaaatcaaaacaaaagaaaggtaaagtaatagtaacatttttgttttctctagcttgtgaatttgtatagaataatcactaaaatgaatcaatcataattttcaagtattcaagttacttttccaccgaacaattgttaatactaccacagaataatttccaataaataattgtcgatagaggacactaattatatataccgtataaaataaaatccgttgcaattatttagaagtatgtaaaaaggtttaaggaacaaaaaaaaggttccataagaagaagaagaaaaaaaatgaaggatagatatttgtttagtttatatcccatttttggaccaccgttccctaaagaaacgcacaccgtctttgtcttctctcacgaggtgcttgtatttctctgtcatcaaccaaaaaaaaaaaacttccattgaactattgaagagagaaaagcttggcttctctgtcttctaagctcaaatcctccttttctctctctctctatagagtttgagtatttattagaatgtaataatgagagagtctatacagatactgttcttatctactacatgagtttcattgccctgttcaactccttttgtcagagaagaacaaaaacaataatatgattatgcagaaattgctataagaagaaacctaaactctctcccatttattaaaagagagacgtttgtattggtagatctattcttatttttccttttgggatttttttatttggttcgtaattgtgagattgaaagagagatg

SEQ ID NO: 8948 - DNA, 3000 bp, Unknown
  misc_feature (1)..( 3000): cDNA_ID_1023490_gDNA_ID_1971948_Annot_ID_177303 3000 nt of promoter + ATG
gaaagattggtaccaaagtgtctgaaaagaacaacttcacttcctgttgatgccattgattcttgattacattctgtttcttcatgtatacatacatattgtttcctattataaagacttttacagtgtaacaagaacaacacacaagtatacttaagagatcctcttcaaattcttttggggttatttgtacaataatacccttcaatctaataacttcaaaatgcaatacgattataattttttttattactgattacttgaaaattttcgtttctagcaagttgttttaaaatcttttcagcattgacatactatagcaaatgataataattgatgacaagcaataatgatagcaaattattgagcgatgtgaagtcagcaatcagtttcggaataaaacttcggacaataaaattactcaaaagtacattaataactttaataaagaaaaaccaaaaaaaacaaatgaattagtgtctactatgttcttaaaacactttggataatgcaaagagaaatcgaatgagaaaaataaaaaaggaaaaaagtgacaaaaatagtcaattataagagtaaccccacatcagcacaacgccatgttccattgccgaccaatcaactagaaatttgggttcatccacatgcctttgtatttatttttcatcaaaaatatgagatatatattgtattaaatataacatggttggtttgtcgttactatgtgattattataggaaatggttggacattttcaatatgacctttttttttcttccatatactagaaaacgattcttcaaatagagacagaaaatattatctcaagctttatgacaaaatggaaaataaaaatatcacacgcatctaatttttttacaatcacgtgtgatttgatgctgtaagccctatatattatattacaagttataagttattgtccaggggcggatctactatcagaggagggtgggcacgtgccccatgctaaattttgaaaaaacataattgatcattatacatttagttaccataattcatttggtaataagaattcatttagtgccccatacaatattaaaatgttgagatcgattcccttctgtagttttttgttttgcttttttctttaattttttttttttgtttgttgctacatccgatacatctttttgtttagttgtttcttacattttgttgtttcttttaaatagttgcattttttttgttttacttttcttcttaatttttctaagtaactgtaaaactttgctttttttctttaattaatctttcgtattccaatttaacttttgataaacttttaagatatgtttctatattgtaaaattagtaactacacttcaattatatattttgtgtaaactagtaaattagtaaaaatacaatttttgtttgcagtttatttaatatttatggttgaaatttgtgaaatatatatatatatatatatgtaaattatatatatatattagcattatttaattaataaagtaaaatgatatatttttaatatctaatatatgtaatttagtatatttaaaaaccaatagctataatacttttaaaacaaatttttaatatctaatatatataatatataccctgtacaaattcaaacttgaaaatttatgttatacgcgtcaagaaaattcaatggaactaaaacgaataaaaaagataatgaaaaatggcagtagggacatacgaagaattgaattaggttgacccattaaaagaagataacaataattgatcttaatagtagataataggctaagaaagcaaaatggtaaaatggtcgttaattgatgacatgcatgtgggtattgaatgtacagatcaacgtacttctattcgtacccaactccaacacacacttgttcagtgccaaccattcttctcatatcttccctccattcattttcttgtcggtccttataatctttccctcaagattttccttgttactttataaatatattattttgtgtctatccattattatgaatataatgcaagagggtctcatcactaccagcaactaataatcaacgaatagatggtgttattaaattttgtcctcatatatatatttggcgatcttaaaatttatacatgttccagcgaatggtcgaaatctgatcagtacaaccttcaaatgatcttttgcggtggaagccaactcattttaacacactcgtggcttaacaagatcaaaacattatattctgttttataatagtttcttttgagctttaataattactcttctttcccaaaagtttcataatatttctttgcaataactccggcaaacaattcttatttgttaaatagtaaaagtaacacgttgacaagacaaaaaatgattattccctacattgtaagtgtaaaacaccaaagcacaacgaataaaataaaataaaagtttcttagccgtttgtgtttttcttttcccaaaagtttatattaagtgtcaaagtacaagttaattagttctaatcagctgaacacaactatacatatacacattaaactgtcatttagtcttaagtgtttgacattggttaattctaactcaaaattgctgaattcgtagcattaatgaaccccagttttgtgttatgtacagaaaatattgactcgtggcgtgggggaaacaaagactttaaccaatgtccaatgacaattgtttgtgacactaggctataaatattttaggcccagtgggcttcgttttattttcccatgtaaatgtttattaatcaaacctagaaaaccaaacggctaggattaagtaagcccaaattaaaagttgaggcccatacaaagagaacacaaaagaaaccctaaggaacttgtaactatataaaagctccgacttcgattcggcgtctctttccttcacctgagcggacgaaaacactcaagcttgcagagatctttcactttaatccttgagaagtagcaaaaatg

SEQ ID NO: 8949 - DNA, 3000 bp, Unknown; identical to SEQ ID NO: 8943
  misc_feature (1)..( 3000): cDNA_ID_2991568_gDNA_ID_1971948_Annot_ID_177294 3000 nt of promoter + ATG

SEQ ID NO: 8950 - DNA, 3000 bp, Unknown; identical to SEQ ID NO: 8942
  misc_feature (1)..( 3000): cDNA_ID_2037739_gDNA_ID_1971948_Annot_ID_177292 3000 nt of promoter + ATG

SEQ ID NO: 8951 - DNA, 3000 bp, Unknown; identical to SEQ ID NO: 8941
  misc_feature (1)..( 3000): cDNA_ID_1988834_gDNA_ID_1971948_Annot_ID_177291 3000 nt of promoter + ATG

SEQ ID NO: 8952 - DNA, 3000 bp, Unknown; identical to SEQ ID NO: 8940
  misc_feature (1)..( 3000): cDNA_ID_1989302_gDNA_ID_1971948_Annot_ID_177290 3000 nt of promoter + ATG

SEQ ID NO: 8953 - DNA, 3000 bp, Unknown
  misc_feature (1)..( 3000): cDNA_ID_1988787_gDNA_ID_1971948_Annot_ID_58598 3000 nt of promoter + ATG
gtggcatatgcgaaaaaactctaattatttttttataacgatgatattatttttttcgcaaaaatagaatcatataaagatgagaggtgaactataataattaataaaaaattaatatgataatttagatatcaaatctaatttgttgattttaattggttacttttttggaaattaaaaatgtatttcgtttttgagttaaatttaattaattaaattagtatttgactttttaatttttaaagaaatgaattaatttactctttaaaattttatttctaatggtatacctatgtaattacttacaaaaaataaggttacattttaaaaattaatatgataatttagatatcaaatctaatttgttgattttaattggttacttttttggaaattaataatgtattttgtttttgagttaaatttaattaattaaattaatatttgactttttaatttttaaagaaatgaattaatttactttttaaaattttatttctaatgacatacatatgtaattacttacaaaaaataaggttatatttaaaatgtactttcccaaataatatagtaggataagtagattctctatttggtatttatattttctcttatagaaagaaatctaatcatttttatgatatttagattttctatttgtactgttgttactcacttcttactttcaagtttcaaccaacaagtttctcaggattttaatatttttttttggtcaaatattttttggtaaaaaaaaagaacattattccattttaaaaataaaaataaattattgtttccgatctttgaaacgctgcgtttaaggttcagggttttggattccgacacggtgaagaacaatgggatccattcctgctatcttcttcctctgctacacctgagaaaccctgaaaccctaattcttcagtaattagtttccaaagcagttaattttgggcggaaaatgtggtcttcgagaactctcaagtatattttcaggctaagacctgaaccaatttcttcctcatcgtcttctgcgtattcgctctctcgcatcaccggaggttctccaattccgtcgcagcagcaacgatcgattacctccacggcgccgcttaatggatggatggattcgatcaaaggtgtttttaccgggaacaaggatactcctttagaagaatcaaatctacccgttgaagctttcactcttctccgtaagtcttacatggatacgtgtgattgactgtaatggtggatagatcgatatactcatcaaagctattctctttggattgaaaattgaatttaggatttgctgatgaattgaagaatgctagacggttagggaaattcaagcagtacattgtgggacgaagcagcgaggccacttttgctgatgcatttgagaaacaagaagctgttattagatatcttggagctcttgatgctacaggagaggttggtttctttcttagcatactagagtccagctatgtatctgtcgtttctatcacacacacatgacttgctaacaatttgcagaatccttgaaaacaagaatttttttttggtacgttagtcaatgtctgactgtggcactaggtttcttgatgtgtagaatctccaagcgagtcaaaagcaagatgcggctaaacattgcaaatgcactataactgatgtggagaatacgctgtccaaatttacttgggccaggcaagctcacaagaagatgacagagttgaaagaaggaggcaaaccgttaccaaagaatatgggagaggtattcttctcactttgtatactcatatgcttttttagctccataagctcctatgtatgactgtgtggtcacgtttctcatttcttagacttagaatagtgtctaatgagattttgcaataacacgctcttcttcgttttgatcatcctctaaaaaaactttaagtttctacacctaactaattcccggctcaagaacagggttcccttataacaagagctcgtttgtaacttggtgtttttggttagatttgatgttcattggttagaaacaggagtcatcttgcactatgttggtattcttaagattttagtttacatttaggcagtttgttacttgttggtttactgtttccctttgtcctgcatccatttagctagtagttatgatgacactaaattgttatattggtctattgaagctgcaaaaaatgatggggtcaacaccaatggatctggcgagatcaaacttagccaaaagtgggcagatcagccgcaatgcactttgtccctgtggttccaaaaagagatataaaaggtaaaaactttgaagagctttcctttttcccggcaaatacataagactgttaatcaaagttgcacttctatgtaaattcatcattttgttgcttttccatttatcgttgtgttgatatatttgcactctcttcttccttgaagatgttgcggaaaggattgaagaacacagaagttgatccaaagcatctaaagatacgagctttcttttgtttgactcttttcttggcttcatttactatttaagattgtagtatttgtatttttttaaggttatcccataatcagttcatctgaatactttatttttgaaaaatagttcataacctaagttaaagtcacatgtttgctaagtatatcatttcgttgaaagaaacccaatccaacggctacaaaacagaacgtacaatagtgaatagttgatggtcaaacttgagagcagtctaaattcaaatccaacggttgagatctcttgaattgatctaaggctaaaaatcgaagtcatacgtcacgaaataagaatgctcagtgaggttctttctccctcccatttctggtaaaaattgtctctttctctcttcttttctttctacaaaaacagaaacaaaaataaaaagtaaagctttctctaaaaaatctctcctttatcttcttctagctcttctttgtgcctctttcaccatg

SEQ ID NO: 8954 - DNA, 3000 bp, Unknown; identical to SEQ ID NO: 8948
  misc_feature (1)..( 3000): cDNA_ID_1023490_gDNA_ID_1971948_Annot_ID_58602 3000 nt of promoter + ATG

SEQ ID NO: 8955 - DNA, 3000 bp, Unknown; identical to SEQ ID NO: 8947
  misc_feature (1)..( 3000): cDNA_ID_1989295_gDNA_ID_1971948_Annot_ID_58603 3000 nt of promoter + ATG

SEQ ID NO: 8956 - DNA, 3000 bp, Unknown; identical to SEQ ID NO: 8946
  misc_feature (1)..( 3000): cDNA_ID_1027928_gDNA_ID_1971948_Annot_ID_58610 3000 nt of promoter + ATG

SEQ ID NO: 8957 - DNA, 3000 bp, Unknown; identical to SEQ ID NO: 8945
  misc_feature (1)..( 3000): cDNA_ID_1395928_gDNA_ID_1971948_Annot_ID_58611 3000 nt of promoter + ATG

SEQ ID NO: 8958 - DNA, 3000 bp, Unknown
  misc_feature (1)..( 3000): cDNA_ID_1989291_gDNA_ID_1971948_Annot_ID_58612 3000 nt of promoter + ATG
aaaacagaacatgtatcggtcattttgtcacttgcataaccaaagtggattaaactggtgtgaggaagaaagggttcataccaagcatattccgagaagtgctcttgtgcttttaccacctgtcaagtctatagttgctgcatagtactttcttgctgcgatgaggttttctagtccacctattgtgtagagaacctgattttggcgattgcaacgcaaaatgaaaattacgttaattacacaatcatacatgatcaatgctgtagtttagagtttcgaactatataaaaaaaaaactgccaaacttttagaattctcagttttgagtttgatatgtgcagtgcaaataatgcaaagttccagaaaatagctcgctcttctattgctactacattaatagacatatgaatgacaatgaacttccagtgtaagatataaggaacaacaaaattgattataggatgcatactagatacattgtcttaaacaaactaagacattttgatgctccttggtgatggccaaaatttgacttttttctttaacaaagccagagaacaatttttacttttttttaacaaataaataaaagatgggacttacatcggcatatgctaagtggtacaatggaagagtaggctgagttagtatgagctcctcgtagcagaaagctgcttgcttgtacctgttacagattataaatttaaaggggttataaagagagcaccctcaaaatgaaaaacatttgttaatcgttgagtagttaattgtttgtcaaatagaatctgaggacagaggatagagagacgcacatttgcaaggaaacataaatttctgcaagttctctccaggcatcatgatcagccatgaatctatataagaaagaagagcatataaaagttatcagctgtttgatatatttcttctaaagtactttctatcagtccagcttggggttagtaagtactcacacttcaagatacttgttcagatgttcaatggctaaggaagatttgccttgtgccttggccatagccacctttcttttgtgaattacctagacatcgagtttgacttacaacagttaacatttggaagtagcttgtgggtagtttcatgacgaaaaaatgcggaagcttacttgatcaagtggattatcctccaaaaggcttgtatatgctttttcagcctcttcccacattccctttgcttctagcagcagagcctccagcttgcctgaatatattaccaagatgcagctcagattggtatcaaggtaactaagaaactaggtgcctgtagagcccaactttcagtatagctagaaaacctctgagcacagatatgaacacccagaagacccaaaaatggcaaaataaacaaaaacttgtgagtacggacatgtgaagacacaaaacttacacatgtacaccacgtgaattcagcctgacgtagctggtatactttaaacttgataatatgttcttacttataacttgataatttgttcttactttagagaagcatatgcgagaataagtataaagaaaatggaaaggatgtggagtttatgtttcttgttcctaagttatcaaatcgtatgtggtttatccaaggaggctagagaaaggatacgagtaaaatttgatgtccaacaaagagtgaagaattgctcagtgtgtcaagggttgatattgacttaccaacacgtttgctctccggaaatttcttctttagaaccttgatgcaattctgcaaaaaagaaattgtcataacaaaagaattttcagaaaacaactcacatcacaatgcatccatgatacatagaatatatcaaaaatgcaagaaaactctagaaaagaggctcaaaccgaagaaatagcatacacctacagccctagataactgatgctttcaacaaaacgtgatcttaaaataggatcatgtagttttcaagttaccaattgaaattgtaagggaaattcacctgtgcaacaccgagagattgacagtccatagctgcaattgctacctgctcatacagggtccattctgcacaaataaaggaatacgctttgtattttagttttataaaacaaacataatgtgcaagcagctcttttagctaagacaacaaaaacaaatcgaactagattgagatactacaggtgcaaaaagtctttgcttaattatgactcttcatcagctaaaactatgtttaatttcccaactaggaatgaaacagtgaacatataaatccaagaataccagatttagcattgagcagatataacgtagatcaagtatcagtaagcactggaagtagaacaatatcaaactgaatttcaagtaatttcatttaaatgaaactcatgaattgaagcaattgagtggagcacgatttaggaaatcaacaaacaaagacactctcaatgagaaacacatcgaaatcaaggaactgaaaatcaacataccatctggaccaagagcggatcgctttcccgaatcgttcaagatcgagagaccatgcttgagcacaatctctgatcggcgaaccttgagcttacgaacgaggcacagatactcccaaacacctcctcctccattctcaacttgattctcgagttggtttaactgtatctcctccgttttcgtcaccatctctctctctccgatttgctctgaaccttatgaaatttgtggatctgttagtagtggaaggtcgatcaggaaagtctctttctacaaagaagacattgacatgaaccggttcggtttaatattcgcaccgatctggtttaaacttagagcatattgacgaacgaaacgctgcgttttaacaaaacatctgattcattggtatatcaatttggttgagaatatatttatcggtttgttgggattgaaatatcaataaccgggtcaggtcaatggggaacgaacggtgcgttttactgagtattcgatttcaatgtcgtcgccgttccggtgaagaaggca

SEQ ID NO: 8959 - DNA, 3000 bp, Unknown; identical to SEQ ID NO: 8944
  misc_feature (1)..( 3000): cDNA_ID_1396989_gDNA_ID_1971948_Annot_ID_58616 3000 nt of promoter + ATG

SEQ ID NO: 8960 - DNA, 3000 bp, Unknown
  misc_feature (1)..( 3000): cDNA_ID_2993985_gDNA_ID_1971952_Annot_ID_58618 3000 nt of promoter + ATG
gatttcagtctataatgcacgccgtcctatgaaacagaggtaattctgacacatttgaatgttttgctcatctcatttcgggagtataaaaggtttgaaccctcactaatcaaatttttctttctagctgaccagtcactctttattcctggcataacatatggtttaaggctttgcatttattttggctttagttattacctatttgggttagatgaataagttgggatgaggaagaatactgacttatatcctaatgtattgttagaaatatttgtttattttggtactttacatttctttgcataacgggtcaatctttattgctcttgtagatatcattacaacgttgcagacttaagacttgcacagcatgttgagaaaggtaatgaggatggccttttcataagctgtgtagcatcatcagctaatctctgggccatcatcatggatgctgggactggtttcagttctcaagtttatgaactgtcctcagtcttcctgcacaaggtaaaacagctgaagcattaggatccatctatctgtcatacctattctctgactgtagcagctcaccatttgtttctggattctttgcaggactggatcatggaacaatgggaaaagaactactatatcagttccatagctggtgcaaataatggaagctcgttggttgttatggctaaaggtcggtagtcacgtctcatgataactttgccaatgaacttattgattcataaagcatgaaagccgttttacttattccacttcatgtaatgcgataggaactccttatacccagcaatcttacaaagtcagcgactcatttccattcaagtggataaataaaaagtggaaagaaggttttcatgtaacatccatgaccaccgctgggagtcgttggggtgtagtaatgtccaggaactcaggctactctgaacaggttccgatctctttacctgaggcatttcaacttttctttgtttcctttttgagcactataatgtattaacgaggtttatgtggtgtatattataggtggtggagcttgacttcttgtacccaagtgaaggaatacatcgaaggtgggaaagtggatacaggataacatcaatggctgcaacagctgatcaagcagctcttatattgagtatacctaaacgaaaaataaccgatgaaacccaagagactctccggacttctgccttcccaagtacccatgtcaaggtgtgttcttaggaaacaaatgaagcatgttggctacatgaaactacaaaattcggattcttctccatttgttctatgtactgacttggacctgcattttctatttcaggagaaatgggcgaaaaatctgtacattgcatcaatatgctatggtcggacagtttgctgatgaaacatggagtatactgtttcaacctctctcactctctctctagggttttagggacgatctctctctagaagcctgacaacgtgtagccttcggtttcagtacaatccaaaggtaaaccttaaccaggagccaacctatgtgactgtgtaatgaaatgaaatttgtctctatgtatgtagtaagtacaagataaaaggaaaaaaaaaaaattgagtagaagagacgaaatcattattactagaaatgatgaagagctgcaacaagattatgcagtttctggcttatttggctttgtacctgatttgagtacagaatcaggaggaagcaacatgtttgttataatgaacatataattctaagaaggctttcatcttttggtctcaagttttttgcttccagttttggattttaacattgcaattatgttaagatatgatataaataacaatcttaatagaagtcagatatttcaaactcaaagcatcgttttcaattagtcttgagcagctccaaatcttataaacaaatgctcagtcaacgtactagtcaacattatgaaatttcaactaacagccttcaaaaagattacacaacaatcactgacaataacacaatcactgacaataattgtgaaactaacatggatttatttttaaaattttatttatttaaagtcttggatcatcatcatcaccggaactcacagagtctctcacaaggaaagaattagagaggaatctacaccagaccaggtaaaaaaaattcaatacattcgttttccagaagtttggatcatcatcgtcatcgagaaatacagagagttttgattttttttctcacaaggaaagaattagaagaagcgagagagagtatctatttattttatataagcaaagaggttcaaaagaaaaaggaaattgctaaatcacaattaacggtcacataaagatttccttttttctgtaatgggtttagacatttcacacaacaacctctttggcaaattttacaagcccagctagctaaaaacaagcttactagtagaaattcatgaaagtcctcagctagatagattcaacgatccaaacatttacgtgaacaacaacgaactctgtggaatgcaaatacaagtatcatgttctacaccacagaccgagcaaccaagaagaagtaattctggagcaatgttttcatggaatgtttcagtcataggttgtccttgtggattacttatggctgtgtttgttataatgaatatgtgattggctatttcagtgattcatcaccaccaagaccatcccccagaaacagaggattcaagaaatatttaaaactaaaaacagttaattaatcttctacaaaagcacaatcttcactttggttacttgagaagaaagaatcaaacagtactttaaacttttataaaggaacggagataaaacggtttggttaaatgttagactaattcccggttcaactaaacctaatacggttacagatttaggataatacccaatcaaaaccctaatcaaacactcgagaccgaagagacagagaggacgaaggtctctgtggaatccattagagaagtagaaaaa

SEQ ID NO: 8961 - DNA, 3000 bp, Unknown
  misc_feature (1)..( 3000): cDNA_ID_1989317_gDNA_ID_1971952_Annot_ID_58622 3000 nt of promoter + ATG
agatggaaaaaagcaaaaggtaaaacaaaaacaaaaaagctttcttcgagaaccagagcacattgattccaaggtaattactttctcaatgccatggaaaaggacccattttgttcccctttcctgtaatctaatcgtttcaatccgtgattatctctgtcagcttggaggaaatgacttagatttcataaatcgattcatgagttgtcagaaaggatttaaattttgttggtttgttcttatttcttctgtagctgctatgaatttttagatttagtttggctatgattctaaacctacgtctttatgaaagcacttacattttctagacacaagatcatagtgagttcatatgatgcggaaaagttattattctcttggtcttccagtttatatttatggaggaacatagtctcattaacaagcttgcattgttctgttccattggattgttataaaaatattcattggtcaattgagaaatcagtgtctaattttttttgaacgtgtctttgcagattgaatgctgtttctggtggattagtttctctgagttttggtgatagatcagattaacaggcagaattttgagaatgtcgacagtgggaaattcaacgaacatattttggcaagaatcccccattgggaaaactgaaaggcagaagttgttaaatcagaagggttgtgtggtgtggatcacagggctcagtggctcaggtcaatcttctaaaaaatcttaaattcttttcccattgtgatacttacttaagatgccttctttatatctctgtctatattctaaaatcttagcctcaaactttgtgcagggaaaagcacgttagcttgctcgcttagtagagagctgaacaaccggggaaagctatcatatattcttgatggtgacaatcttcgtcatggtttgaacaaagatcttggtttcaaggcagaggatagagtggaaaatatacgcagggtcggtaagtagtacatagttgcttactatcttttgctttcagttgatgaaagtctgattccgaagaaactcactaatacaaatgcaaatcctttaaaaaggtgtctcatatgtagtgatagtttacatggtaccaatacctcattgatatacatattggtatacacctaaaagctgatagattctggttaatgttgaaagaaacttctctaaagggcaaaatactaaagaagaccaacaatttgttctaaatgcaggagaagtagccaaactctttgcggatgctggtttaatctgtattgccagcctcatatccccgtatagaaaagaccgtgacgcctgcagggaaatgatacagaattcatcttttattgaggcaagctattcaaaaccaggctttacagtttgtaacccccattcggttggatcttaaaaacatcttgtttgatattgtggccaaatttgttaggttttcatgaacatgtctctgcaattgtgtgaagcaagggaccctaaaggcctatacaagcttgcacgtgcaggaaagatcaaaggtgagataacatagcttcaaggttccatataaacagaagatagcaagttgcttcaatatcatttgagttgttctataaaagtttttttttcttcatacccttttgtgtaggtttcacaggaatagatgatccgtatgagtctcccttgaactgtgaggtatgtgatccatgtgaacataagattcttcttcaagaatattgcaaacaacgcgtatgtgaatacgtttctctgtttcttttgtatgttttgaaacataacagatagagttgaaagagaaagagggagagtgtccttcccctgtagctatggctgaggaagtgatctcttatctagaagacaaaggtttccttcaaaacgagtaacgtccatcataatctaacgaccgagatttgtttttccttttactttttatgggtgttctctgtttgttactttcctgaaacactgcaaattcttaagaagtttcaactaatgaagacatatatagcttcttctccttcttctgaaacttgtcttctacactgaaactctagtcagtcaataccagaattcgatcctatacaacaacaagagccatgccattgttttcattgttaatttatactacgatacaacgattatactaagacaaccattaatttacatagtgtcatagtatttagaattttagtttttttgggggtcaaaaacaatagttttagttatgttagtgaataaatagattcagaaaaaactgtcgatcttatttgaatagttcgtaaaagagagggttctgtttgcaattttcctaacttttagatcctgagttctgcaatataaataaagaacaaaacaaaacacgatcacgaggcaattttgagacaagaatggtgttgaatagtcgattggtggagacaacagttaatctgtcggcggatctctggcaatatgttgcgtgtaaccccgagatacttcctcgcgccaccgtcatccatttcatcttctgcatccctctcctccaactccgccgtctcgcttcctctctaggatcatacctatgcttcgattccggcgccggagttgatcaccgtactcattccgattaagttaccggcgcgtttccatgaatcgtctgttaaatttcgacttttgattgtgtaatttttgttctgattgtaatgtaattttgtttgtttgtaaaccgaaagggacatacaaatttaataccagaataaaccggaaacatttaaatacacacagaaccaaaccgggttgtgtggaattgttgtcgtcacaggagagaaataagcagagacgtgtaaaccaaagaacaacgaaggtttcgtttcgtggggaagaagatgaagtcgcttgtggctcatttctcaacgcctttaatcaccgctagattagttcctagatgtatcatccatcgagcttcaatctccgccgtctctttttccaccgtccgccgtcgattttctcctctcacc

SEQ ID NO: 8962 - DNA, 3000 bp, Unknown
  misc_feature (1)..( 3000): cDNA_ID_3044194_gDNA_ID_1971952_Annot_ID_58624 3000 nt of promoter + ATG
ctgggtctgcttcatcaccagtggacttttccgtttgcaattacgaattcgagctgtttcgattcgatttagaggccaaatgtcctccttctctgtatccaactcctcctattgaggtacgtttctcatattgtgagctctaaggtttgtttgaaataagcgtgaggttatgtaacttattatctatgcggattagactactcttccaatgcaaatattgaattaggaaacattgatggattttgataactattaagcattgaagttgaagctcagattcgtcctcttgttcttcaagtttggattatcatcttacctactactgtgacttgaaactctgtttaggttcatagtttaatgctcttgtaatgcagattgtgtagtagctgctctgtccgcaaatatgatatagcaaattttgaataggtgttctttgtttcttctaaggggatctgaagctttattcttaactaaagcagtgtcaaaattttcactatgcaggtagatggagactcactagacaggctaatggcttcacaacatggaaatgcttatatgtctgtactcttttatgcttcctggtgcccattctcacgtgctgtgcgccctaagtttgatatgttgagttccatgtttcctcaaatacaacacctagctgtggagcattctcaagcactgccatcgtaagaagtctacttactattgtttttccaaagactacattgtctattgttctatttccatactaattaggataaatagcaaggaagtgggattgaatgattcacatcaagaatttttgggtactgatagtttagtttgagagtaaaaaaaacttaaattgcatatcagttatttaataacttgatccatataaggtgcttcttcttttcactttagtagaaggtcatgtgtgtttgctgttacgttatcttacatttcattagcaaatattcatttgatctatcattaactagttagttcatcattaccttatctgccttgtgtatactaagttactagtaggttcaagtgcttttaggtttcttcatgtgtctggctgtttcttttgtcttactaactggtttcattaattgctttgttgcagtgtcttttctaggtatggtatccatagcttaccttcaatcctgatggtaaatcaaactttaaatgctcggtaccatggtcgaaaggatcttatatccctgattgagttttatgaagaggcaacaggtgatacaccaaaccacatcgtctgcttttaatttctttcagtctacctgagtagtctttgttttatgtccaacctatgactagcacattttgggtggatcgatttagaaataactggttgttgttctggctttccaggcctccaacctgtccagtatgtggctgaaggggaaccaacaggcttaaatgccggtgatggtaacttgatcacatggttgcgcaaggggacatctattagagaaatattcaaacaagatccgttcttggtactatctctgctgtttatctgtttacaaatggcaatccttgtcttccccatagctgaatcccgcatgagagcgttatgggcttcttacgttgccaatttgaacttgggaagatttggagagataagccaactgttcaaccgtggtattcacatggtcgatgtgaggaggttatggttgaaactaagtctcgtcaaaacaagaaacttccatgaaagggcaaagaacgcacaagcttgggcttcatcgctggcatctgtctctctaggccaaacttcatcagaccaatcctgatctcaagggtaagatcatgtcagtattgggaagagatgagcttttaagtgtgtgctggaaatctgagagttcctttaatgaatgttatatgacttatttgagtttgatttgtctgcaacgaagcatgtaaatccaggaacagctttgcttctgtttgtgaatatctttctcccttttttgttctataaatttgagatgtctgtttttggcctcatttcttttactgaataatttgattgagtcaggtaaatttgtctgaattatcttacgcagctttgtcttgtaatgtcagttcgagtttggttggctctaccatggtttcatgttatggtacattatcatcatgtgcatcagtgcatgttgcattatataggatacaacatagcattttatgagtgttagccttgctcactctctacaaatattattgaaagttgaaactgaggatatgtcggtttggtttagtatggtatcattaattgcgtttttattgggttacggttctgaattctgattgtgtcagatatattttctgtttcttttatagttaaccaaggaataacgttttagctagataggtataaagaaataaatatgtagccgactcaaattttactattaaaatttatttgaacaaattattatatgatcggtctaaccgaaaacctagtgatccaaaaaaatgatttgaatttaggaacgaagacttcatgaaagaggaagaattaaggaccttgtcaaagaaggcaatcaatggttcttcttcgaatggggtccccaaaggaccacttcttcttttgtcacttcattgcgttagataagctctaattcattttcgtcacccacatcttcaaatcaattcattactttttataccacacggcacacgcgttatcaaagcatattgtgttgcttcgtttaagaaacgaaattagggtctcaatcttatttctcttaattattattattaatccaaacattctcagaactagtttgaatcttttattaaaggatcttgagaccccttcacatgggagagagaaagaaagagagatagcgagagatgttactccatgagaataccaaacccacttcgctctaataattcaaaagatttcactttctcaaacaaaaaaacttctctctttcttttctaatttctaaaaccctaattgaagttccaacaagatcgatcaaggagaagatg

SEQ ID NO: 8963 - DNA, 3000 bp, Unknown
  misc_feature (1)..( 3000): cDNA_ID_1989315_gDNA_ID_1971952_Annot_ID_58625 3000 nt of promoter + ATG
aaggttgttcaagtctgacgaagcttcctgatcttttaactgccactagtctcaaaaccttgaatctagacagctgttcaagtctaatggagctcccctccttacccgggaatgcgaatgccactaatctcacgtatttgtctcttcgaggatgttcaagtcttgtggagctcccctcctccatcggaaatgctactaacatcaaggaattggttctcgacgactgctcaaatctggtggagcttcctttctcaatcggaaaccttcataagttattgagattgattatgagagggtgctcaaagctagaggttctgccgaccaacatcaacctggagtctcttgaggaactttatctccaaaattgctcgctcttgaaaacttttcctgagatttccacaaacatcaaacttctccacctcaccaggactgcagtagaagaagtccccttggggattaggtcatggtctcgtcttgaagaattgcatatgtcatattgcgaaaacctcaagaactcgccacatgctcttgacagtatcacagatttgcacttgaccgatacagaaatacaagagctcggtccatggatcaagggattctctcgtctacgtcgacttgtactaaacggatcgcagaagctggtatcactcccacaacttccggattcccttttgttcctagatgccgaaaattgtgaatcccttgagaaactagattgctctttttgcaatccagatatgtctctcaacttctataactgcttcaaactaaatcaagaagcgagagatctcatcatccaggcatcgaatcgtccagtttcagtcgtacccggtggagaagtgcctgcctactttagtgaccgagctactggaagtattgtaacagtgaagctgaatgagaggcctcctcataaacctttgagattcaaggcttgcgttatgttggttgataatgttgacaatccgccatgtggtggtacgtacagtatgtatctgcaatataagatcatggacaaacagaatggcgtcattgttccatgcccaccgggatatctctctctacctcgcgcagtaacatttgtcgggcatttgtatacctttaatttagaagtagatgtgacttccaacgagctttgctttgagctcacagtctactgtaaagaatgggatgtaaaagaatgtggagtacttcaactctcctaagtctcttcatgttgatggaacgtgagattatatgtgcattttcatgttgtaaacttgtttgattatcgtggtgatgttggtttatgtacatctgaattcataatactgatctgcttatgtatgtatgtctttgcataaaacagtgagacatttcttctttgcaaatgatttcttgctcagcatatgtctacacagtcaacagaatgtagaactttatctatatgaagctgacccaaaagataaagaaagacaatcagcatcctgaaaatcatcttgggatttagtgtttttgaagattttggttgttatcttatacgtaacactgtaatagttaatatctctacctgccacaatgggcggatcctagccgtaaaatagtggagatgaagacaaacaggtgacagcagcaaggatttagatacagtctcaagtataaatgtcaacttactgtgctgaactccacgattttgctgaatgtcatcctcataagactgtctggctccgaactcctggtgttcgtcgtgtgtaccaaactgcaaacttgtactgaaaacatggtaagagattatagagccactgtagtaaaggccaagcactaaatctcaattaatcaaagcgtgcatcaacaatgatagcaatactaagccatttgttcttaagattcagctgtcttagtcgtagatagaattaatgctttgtgaattgtaagaactggattaggcttatatgggagaaattgtactaaatcaaagttcacatcaaaaaaatgcatatgattattgatcaacagaagcaaatgaaggcgagacggtagaggatgcaaaaccagctttgagctcacaaaaatagggttaatcgaaaccatcggaaacttaatcgtggagatatactgaaactttgtttctttaatctcttcttcttccctcgtctctgtaacctccatttttctactcgatttcgagctttctcttctgcagagccctttgttttagctggaggatgacccaatttgggctgaatttaaggcctcacatattcataggcccatatatgtttcaaacccaaatttaaggatcttgattaactgtgttacttttcaatcataattaatagaattgagctgtctaaaaaaaaaaacgaatttacctgtaaaacaaagaatgaaagaaccataaccatcccaacaaaaaaaaaaagtcaactatggcatgatatcatattttgggaaaagaatttacagaaaataaaaaaattattggaaacaaataataaaaacataaatatagttatacggaaaaaaaattcaatgttaaattttttagtttcttgaaaatgaaaatattaagtcacgtttttcatttatttattcttactcacttgcaaaagataatgttaaattagtaaaagatctggaaaatttaatatttttttcagcaatgaacaaagcagaattaaatggtgctccagaatttgtaagatcgggtggtgctatttaaatccaatatcagaaacacgtcgaacgagaccaatagagctagcttctgatacatttcgactttggcgtttctcgatctgttgtttctgctcccaaataaaaataaaaaaaaatcggatcggggatttccccaaatcgtaaaattaggttttgttcttcatttctagccctagcttagttttatcgttatcttattcattaaggtttgattctacctttgtttcgcttccctcctcgaattttgcaattccgttattaaaggatcctagtttttctggctcttgtactacgtcaagtttcatg

SEQ ID NO: 8964 - DNA, 3000 bp, Unknown
  misc_feature (1)..( 3000): cDNA_ID_3044175_gDNA_ID_1971952_Annot_ID_58631 3000 nt of promoter + ATG
tcatctgaaacatggagctcccgaccacttccaaccccaacagccacatttcctgttgttattgacagtgaagaggaggaaagtgagagcgacattctaagaactcgtgacagccatgtgaaacacttttccagtattggtggtactcgaatggattcattcttgcaaccagaagatgagctgactcaacacaattccaaagaagtccgagctttgaggaaaaagttgcaacaaattgagatacttgaagcaaaacaatcgagaggacaacttcttgatggtcagcaaatagcaaaacttcaaaagaaactagatatcgaaagttcactggtagaacttggtattcctgtggaagagtttccagaggcaaaagcaacaacagctttaccgctagaaggaaaggccaacaagaagggaaaaaagaagaaaaagggtaatcagagatttgtacaagttgagacattccctgaatttggtgaagttaaagtggaaatagatacgatgcaagacaaagaaattgaagaaatctgtgaagctatcaagccaaaggttagtttgggtactggtttttcatgatgaaatgtcctttgttaacacttgatcatattatccatctgcgtcagttgaattatttttgctttgtatttattctactagggtggcaaaaccatgttggatacgacgatgattagtgggttccccaaagaatcagactttgtctcactctcgcaaaagaaagataatccacccgattcgccgagaagcaagaaacttgcaacggcagcaaacaagaagaagaacagaaagggtgggctttccatgttcttgactggtgctcttgatgatgtccctaaacctgttgttgctcctccaccaaggcctaagattgaaggtcctgtgtggggtggggctaagatttctaaaggattatcttccctgcgggatattcaagatgaacaaagcaagacccgctctcatgaacctgttaggactactaaaaatcagtcaggggatgattctcctggtaaaagtgaaggaaagatattactgagttccttcttgacttcgaagccgattccgatggaaccagccaaaagtttgcagcaatctgatgtggaaaaaggaactcctccttgggcttcctctgaaactccgcgtaaactgtctcgaccttctctcagagatatccagatgcaggaggtacgttgtcctctgtttgaagaatactgataccgtagacaagattatcttgttgcatcatagtttatgttttaaagctcatttttctttcggtgtctttgtcttgtctaatgcaggtgaagaagcaacagtctctgtcccacagtccaaagacaaaaacatcaggcttcacagtcgcaaccgggcaaggatctccatcagattcgcctggaactaatcgctggttcaaaccagagatagatgctccatcagcaatccgatcaatccagatagaagaaaaagccatgaaggatctccgccgcttctacagtagcgtgaaggtagtcagaaaccagccttgatgatgtgagtgaatgagacattacttttcaagagctctcattctcaaaactcaaaagtgttgtagttgtaactgtacagatgatgtctccactgttcattgggtctcctcttaactggtcagccattttttttctctttctttcaatgtgttagtctttggtagtagctgtcaaagtaatactcatgcttatgtacatcactggtgtacatgaagctctttagtagtcttcacaaaccattttagatgtatatatttcgtaataataagaaaaagcttatatgatttatttcagtaatattcccttgtgtaatctaaaacattgacttaacaaagtcagaaatgtagaaggtgtaaagtgtaactgtttcctaagaagatataaagacacagaagcagagtactctcttgtgcaaatcaatcatcaatcttcctgagatttcaaaacggataacggcaatttcggattttgatttaagtccggttaaatcggatcggttagattggatataattaacagacaaaaaacaaacacaacccaaacgagaatagggccttttgttaacacaacccaacccaaaattgggcattttcttaatataaaaccaaacgaatgggccttttctgggttatatgaatccggcccaaaggctaagctggtgaagtactagcttgcggcccgtaatattaacattaacattaatattatcaaatttcttaagtttcccttaccacgtgtcttgtttttctacagttaattgaaatctttgattgatcggatagatctttctgaatctcttgaatttttactgaatgaagccaatgaggcgctgattagtgctttttttctggttttcttgagagctaaaggagatagatacctttgaacaagtagaatctgagacggacttaactattttacacattggttttgtagatgactgtaattgacctaatggtccctatatgtaatattagtttttttcttgtgtagcaagaaagcgtcgaaaccagctactgactgttgtttggtttgagtctcattgtaaagatactgtcccaaaataagagtttgactaaagatttgattagtaatctgttaacaacgaaatttacctctcttttttgttgttttataaagagcatagaatttcaaatgaaatcttaaccgttgactcgaaccttacgtgcctaacaatctcacatttgtgctctgctttatacggtgacgaagctcccttgtctcttctattgatttttataggataaccaaaaaaacaaaaacaaaaagaaggaagagaacaaaagagatctgggtttattacaaaaccaggtttgtttatcttctaattgtggccattttctttttcattgattttgccaaaattttgttaattgtttgacaagtttcctgatgcttttatagatcttttgctctgttcccgttctctccgacaatg

SEQ ID NO: 8965 - DNA, 3000 bp, Unknown
  misc_feature (1)..( 3000): cDNA_ID_1989310_gDNA_ID_1971952_Annot_ID_58632 3000 nt of promoter + ATG
tctacttggactgggctgttcactctttcagaatcaccaactgtggcgtccaagacagcactcaggtaacaacactgtacacttaaaatctcaaatagtgatgaatgtttctgcaactaacttctttattttatcttctagattcacactcacatgtgttactcaaacttcaacgacatcatccactcaatcattgacatggacgctgatgtcatcaccattgagaactctcgttcagacgagaagcttctctcagtgttccgtgaaggagtgaagtacggtgcaggaatcggtcctggtgtttacgacattcactctccgagaataccatccacagatgaaattgcagacaggatcaacaagatgcttgcggttcttgagcagaacatcttgtgggttaaccctgactgtggtctgaagacaaggaagtacactgaggttaaaccagcacttaaagccatggttgacgcggctaagcttatccgctcccagctcggtagtgccaagtgaagagcttgaagatattatttctatattccgggatttttctacgtggtttgtgtttgttcagtttcaataacttttcttccaagaaaaatattttagccaaagttaggttttgagggaatggagtcacactctctcgctttcgttgaagagagtttacggctttatactatatgtttctcttgttgcaatgttatatgtatctttgttttctctaatgaaatatatgcttctttgatctcttgaaagtgtggatacgaattaatttgttatacaagcccccaaaatgtgaaatcttaaaatcactactagtgttgtagaactaaagaatttgctgaaaataatccattattgttataagatcatccaccatactacaaaaagatttgatttgataccatgaaaaaggacacagtttcgaacctttggaatgctcgattcgtgcatgtaaagatcacttgacgtggtataccagagaaccaaaagtagtactatattttcatgtcttgttaaccatttcttttgcatggtgtaagcatttcttttcaaagtaccaaaagtgcggtatttcattttatgtggaatttcttttccagaaatttataaactttatcaccgaacgcaagttacacaataacactgcaaaagtgaacccaaaaaaaaaaaccctgtaaaagtaaaaatttgcttaaacttaacattctttcaccgctccgtgacgtggacatttggctggcaaagaaaaggcataacatccaatcaaagatatccacgtagtccgatttatgtcacgagagctgacgcgtcacattatgcattttttttttttttttacacattatgcatttgattaagcatctgtttaacttcttttaccattttgtccctcaaattttcattccctctaattaaaaaaaatagaattaatccacaataaattcttgaaaaactgatgatgccacagaaattcacaaaattattgaaaggctacaaaaaaaaaacagagaagtttcagacatatgatgactgtgtatgaccttgtcaacgtctgacgtgtcgcacatgtcaccacgtgtcataacgatgtaaagcaaaccagttaggtgtctggagagagagatatggacttcatctcttctccgagtctttagcacgtcacaacttcaaaggactctatcgtcattcgccgtaatttctatcttaattactgtattacccttaggctcggagatctctcttctccccgtttctctctctctgtctggctcattcagaaacttttttatacgcctctgtttcttatggggaagagggtatattctctgttttgattcgcttctgtcttaacacattgaaattttccatagaagattccattgtgctcttttaatcctcttctctttctctctgttttaaatacctgtctttaatcgcttctctctatctctctctcttgttaaatctcatcggagttcaatttcaggtaacggaaaattagtttttatttattttattggtttctctcttgtctgattattttaaactcaattccagtttttgatttttacccaaaaaaaacagttttttttttctttggttctattgaagtctcgaattggagcttccgaaagttgtaaatttccgtgatttatgtattttctcgatgaattttgaacattttctatcgaattgtgctactcattgtgtcttggagatcgagttttatctgtttgccattctcgatttgtgtgctttgtggagatttttttttttgttttggcttcactttgtctctgtttcacacttcacaagagatctaagtttaatgttaaaggcgtgatcttttgtagcgtgtcacattcgtggactaatttttactaattgtatgttgttgcttaacaaatgtccttactggagatccttccttgttttggttcaaaacaatgtacttgttggtagaacatctctttagttctgtttgagtgacactaaatgagattctttgctttgtggttggtggaagtattagtctctagatgcatctttttgtgttttgtttttagaaaaggagcgatgctttccactactcgggtttacttgtttattctttcttctctagatttctcaaagaagctacatgaatattattaatccaatataatctatatccttatcttttatcatcaggactctcggcgctcttatgaagtgattgtgaagatttgcgtacactaagcctttgcttcagaaagttgagtgatttgtttgactcactttcaagatgaaaaatgagctctagcaaagatggatggcgtaaactccgttgagggctatagaaatccttttagttgtccgtttagtgagagttatccgagtctttttctttggagacatttggtctagacacaacatttgtggcgaacaaggttttagtgggaattcttaccgtctagaaatatggaattgtcagtctctcctcaaacccaaaagatg

SEQ ID NO: 8966 - DNA, 3000 bp, Unknown
  misc_feature (1)..( 3000): cDNA_ID_2993961_gDNA_ID_1971952_Annot_ID_58633 3000 nt of promoter + ATG
tgtcgatcatgaaactcacatctgtaaacaaacaaaagagaagggaagaattatgaaaatatattcttgcatttcatattaaaaagagtccaatattaacaaactggctacaataacgatttgttcgataaagcgaagagattgaaacggaaacatgtttatagtactatcatctctagactacacaaaactatccgaaagattaattcgatggtcatggttatattccggagatgatacacaacaattgttttaaataattgggttttgtaagtgcaaacgatacacataagttaaatcttgaaaattatgtatgtataaatacaaaagaaaaacattatgcattcagaaaaagaagtgaagacaaagtaagaaatgaaatgataaaattaagataattaaacgagaaaagtgatagattaagaaaccattaattgtcttgagtaatttttccaaggatttcttccatcccggcgtaggagattctatcttcaaaagacatatctgcgcttaaaaacataagatttatacacactttcaaataaacataaaatatatacacaaatcttacaatctattatgcgtttacgcataccatgtgattggaagatgattccatcgatctagattagatatgttttgttatttgttcctgctcttgagaaaccttaggaaaacaaaaaatttgggaggttttgggtggtgaagaaaagtttcttcttttattatattttggaaatatggatatatgatgataagagatatcaatctatgaattttttattttccttaattagtaaaaaatttcgatctatggatatcagtatatcgtctatgaattttttattttccttatgataagagatatcaatctatggatatatgaattcttttagtttccttatatattgaatatcatattctcttttcaaagtatggaaactttatcgtctcttgcatgtgatctcgccgttaaaacttatagtatattctgtaggattgatgatatgtaaacgtgtttattcatttaactttcttacaaaaaaaattgaaagtaaattaggtatgtaatgtgtaatgcgatatttcaagacgcacaagtatatattagtcggaacattttgtcaaattcttttactttgggaataccgaatacgcatgatacattaggcattagcgagaaataagaaaaaaaaaatgtctcattaaatggtcgtgcgtttttatatctatatcccaccgacagccgacaaaaccatagcaaggcatctactgatctactaatgcttcggaatagaccgatgttggatattgtgaggaaatataaaatttaccggatacaaatatttctgtgttttgttttgaaatttgaagttacttgttaagcgtcttgatggattaaagttttttgagtcgaaaaacaaaagaacggactttctcatgtgaaagcattaaaaaaaagagttcttgctacaaaacaagttacaagagatggtagaaatacacttctttattcgaaacatagaattttcgtattagtcgtccaaacagagcattgaatattctttactgaactagtttaccatttcatactagacttctttacatacattatagacgtatattcctcattaaggtgaatattatgacaacttatggttaataggtttcaaacgtcattgttgaataaaaaaaattatgtgaagatcaaaccataagagggacgtggaggatctcataatcattcaccaactttgtttaccaaacaaatctccaaatttgtgtggcaagaattgttggtactgactcccaaaaatgaaattaaaagtgaatatctcaccaactccctaatgggctccacccaccaatcccgctacctccttctcctcatgtatactcttcacaaacaacacacaccaactctcctccccaccttcacattttcaattccataattaatcccctcttaagctcttatatcttaattaatactacgctttacaatacaacatacactaaccccttaattaacccttaaacaattgttttaagctttaactagccagtgaggacttgacaaaagtcaactaaaattaccagtaaactagtactaattcaacggaattaagttctaccagcttatataattgtaatgtcatgccatgatcaaatacatttttttattatgtaaaccgtcgttatacgtataattctcgaaagttgtatataattgaccgtgcccttaaatttgaaagataaaaattagtatcattctggatacatggattacacgtatttttatttatcatatagtataatgttgtagagagggtaaaaacctaaatatacgtattttgatgtacatgtacgtattattaatttaaatagaaaaataatcagccaccacgagtgagtgagagaaaccaaggaacgatgtgtaattgatttgctataaataagcttaacacagaacactctccatcgtcgctctctttgcccatctctcatctccactcttctcattccgtaaggtacgcttccgagtttccatggcttccgcatgactattcttgctctctcccttcccactctcttatttaccttccgtctcttcgttttcttctcaattcaattttcgtttgattccgtttcttcttcgttcgttaatacttagatcttaatccggtgagtgaaattctatgaaacacagatctggattttttatacgatcagattcgtaaaatctctgttttgcgatctttctctgcgttagatctctgttttccctagttgtgattcgttttgatctttaaactctctcatactctgttttcaataaatacgacaaaaaaaactgcaaaagttttttacttttttaacgattggtggcttttaccatatgacaagaagtacattttaggattgtgtttggtttactgactgattttggttttgtttgtggttcaaatgtagtaaaaaaacaaaaaacaaacaaaaatg

SEQ ID NO: 8967 - DNA, 3000 bp, Unknown
  misc_feature (1)..( 3000): cDNA_ID_1989307_gDNA_ID_1971952_Annot_ID_58636 3000 nt of promoter + ATG
tctcctatgatccacatagtattcgacagtggaaacactaagttacaagatctccgcttcatgatgtctgatcctaacttcagcttactcggattgtcctttggcttttttattaccttttatttgctcaatcttctagttctgccattgggtcatcactgttattgttgtcattattgtttctaccgcttccattagcgttcacaacttcgacccaaacactctggcttctctctgctcctccattgatatctccccaagtctgtgcttgtcttccgtttgtctcagctccaccgtctgagaattggccccatacgcttctcgtcttccctcctcctccgcttaactcctcttcgcaacccgcaactgttttcagaagctcagactgaagtgacgggcagtgttcccttagataatcaaacccatctgacctcataacagctgcatcaagaaaaatgtttatgcaatgtaagtttggtgtgaaatcaatttcagtgatgagcctgtcagaaaagatcattaccgatgagattttctgctgcgaatttcagacaaacggatttcaaggcggaagcattgtaacggtcagcaagcgccaaaatatttgcaacggaatctactgatatatccttgcagagcactgactcgcacattagacttaatctaggcaacttgtatttatcagcggctcctagtagctttgcagctaatgtgtctgaggcagatggaccaacagatgaaccggaagatgatgatgactctgcatcttcaatgagagcatccttgtatatgtagtggagcaaagccttcaccagaaatgcatcaaaacaattagagagaaatgcgatgcgtttacattgtgtgatgttacatacttggtgtcaaaaagttgagagaaagtttaccttgaaaaccttaggctccatgtcagtaacttcgatatcacgatcttcttctcccgtaacatcgaggaactcgctttcaaagacaggagatcgagcagccaatactaacctgtgagcacggaacttttcaccagagacgttaaaagttatatctgaaccgtcctcgttctctagaagcatcccgaaatgagatccaatatcagatgcagggacatgaatagaatgtaaccgtgggcaatctatttctgagaccacaactcccacggtgcaattaattttcagacaatcatccttcagaaaatcagatgtttccagcataagtcttcgaaaaaagcgcttgtagcccctgtaagcatataaaattgaataaggatccgttgagcgaaacagggaagtacaaaactctaagagggaattattcctctgcattaataagcaatgagatctttctaatagagagacaaatcaaagccaaaggcatcaccttcaagaagaagaaaccagagacaatggttgattaattcatacaagcagacttaacaacagatgtttaaaaaagcaggaaaaccaaatgtacgaatattgagagcaaaagacaatactctgttgcttaactcatacaagaagtttcaaacctaacatgaacagtttcataaaagcaaggtttgtgctgctatatgcaggtaaacagtaagcaatgttcctacttcagaattagcctaccatattgaaagaattggtgcctatatagtaaaacatcacaatgacaggtctttgaaatcatgccaacatgtgaaaacacaatacttttcaagaaaatcctaaatatcatcagtccaaaccctctctcgttcccaatcaagtttccttaactacagaaccaacgctacatgctggtgaagcagcaggaaccaaattctgtttatgaaaagttcaggtaaactagttacagaatgtccaaaacaggtaatagaaccttcatattctagaaacttgcttcttctactcaaagccctctctctttccatacgtcacagactcacagtttcaagcagaccacaaaaataaagccaagcagcctccagcataaaaaataaagaacattgtttatcgctctcaccacccatctttcaatttcatatacaggtcacacaacaaaaaagaaacaaacagattgagaaatccacagctaatgtatctttatttcctctgaatttctcaatctcttttatattttttaatgttgtgagctcaatctcattttgccttcaacaatctacactcttgagtcttgaccactaataacatccgtaacctcatataaaccccaacaaaggagcaaaatttgttctaaaagtaatgagctttcactagaaatcagagaccctaagccaattcttcaccaaaccctagcaaaatggctaagagaaaaataaaaaaattgaaaagaagaaatcgaagaaacgaaccacatgctgccacgatacttgagagtataaggaccgctctcaagagcacgatcgaagtggctatgaaccttatgcttccctttaccactctgatcaagcaaagaaagctcaaaaagagccctaacatcggtaccatcgctagctaaagcaatgaaaacggagacataagccgaattatcctcaggattcttgccatcaggatagaaatagatagcccattgataacccccgacggtgaaagtatcgctggcgatgtgttttccgatcccgattcctttagccaaagaatagcctttgattgtgaagctgtgtgatccgtttatggtctgtgtcaccgagagagaagtcgtcgtcggtggcgatggcatttcgaaatttcgtcgttgttgctcgctcttttgcaatggattttgtctttgtaagtttttttcctctgtgaaaatgacagatttcattacacagaccaaagcgacggtagtaaatctatagttatgattaacacaaaaaaactcgccatttttctttaaaaaattcttactgaagtgaaattaaaatagaatttaaggatataaatagaattaaacgcaacgacgtcgtttgtatatcgctggctgagaaaaaatatg

SEQ ID NO: 8968 - DNA, 3000 bp, Unknown
  misc_feature (1)..( 3000): cDNA_ID_2179705_gDNA_ID_1971952_Annot_ID_177362 3000 nt of promoter + ATG
ttcgctatatatatatatatatatatatatatatatatatttattatcttaggtcttattaaatgtaaatatattagttatggttagaactagtataacaaacttatggaaatgcgtacattgcgtctgaaaccattaattagcgatatatacatttgagatttataatcataaaaatctagagtccttttgcttatacaagacgaacacttataaacgtttccaaaggggggaactttcgaaagttgttgaaatgagagatatacaattgcgaagtatagagaaataaacttcaggacattgacaataatatgaaatgaagtacacgatttagttgataagaaaagaaaagaaaaaaagtatacacgattaatttccttttagaaaaaccaatcatacatcgatttgatgtttaagtctagaatatgtgatgcaatttaaattatctgtttttgttttccctgagtacccaagaatattgggcggagcagattgatgccaatatcaatatgtaatcagtacatgcatgcatgtggtatatatagagagaaaattgtatgtttttgcttacataacttaaatcaaccagacaaccagtgatgcatgcatgtggtatataacgaaattcacatgaatgttctttatcttaaggaaaaaaggaagataaatcagacgaaagttaattgtctcaaaaggtaaaacaaatgtacgatacaatgattaataacaaattgtatagtatagctagctaccacaatctaagtatcgtattcgtacgtaatttcgtatggatagagaagtaagtatatatgtgagagtgtctgagagaggagaggcacgagaatcgtgttgaccgtttcgtgtggagttctttagtaagctaaccaaccttcatgtctgtcgtgctccttttcttcacaacattaatcctcccttttctttttccgtactttgccattttcaaaattagttttatttcacgaaattcttagtatttcatgacttcattttggtgggttcattttcgtgaattacttctaaatttcccccattccttctccaaatcagtagagccgctattaataagaaagtgtaacttccgaatgacaatgacggtgcttggttgtgtttgctacaaacatagaactcgaatttttcaaataataagagtgttggacattagtatagcgagacaagatgatgatgaattcaggtattctcacaaggcaacgttcccaaacagcaggaactaccacaagagcagtttagcttgtcgtctctgttctctccggccacacttacgtctccataactgaaacttaactcctcctctgcgattatgtcctttgctgcaaagaaacagagccgaggaagcaacgctcctgagcttctcaacagaacagtggagagatttccaccgtcacaagaatggttgatgaatctagcaacgttcccaattcttgtggcgtcgatgtttatccttaaacaagcttgtcctgaagggaggtgttcgcgtacgaccaaaagagctgaagcgaaggattgtgttgatctgagtttgtcgtaaatgttttgacgtctacgtgcttcatctgttgtcaatagctcacctataagaagagacgacaaaatcaagtttatgacttttgcataaaccaagtcattaaggcagatcacaaagaaaaaacacattcaagaaagaagaaagatttgtcattatctctaatctccaaatccagcattgtgatactacctctaaacgattgaaacaagaacatttcgaaagctcagatctttcactgatggagatcactcttaataccatgctagaatctcatctcaacgcatcgagctaaatcatatgcagtccaagtgtaaaaggctaataactaatgctaatattcctcaaatcatgtaatcttaagcttgattttcaagttccaattatcaatcttccaaaattagtgacctactgcaataaaacgaatcactatactattaggaaaccaaaagttggttaacgttacctaatgctaatattcctctaatcatgtaatatgaaatcgaaatgtaattgtaacctgcatattcacagatgaattggccttgcttgataagctggtcagcgtacaagcaccaacctttcttctcatctctcacaatcttcaaactaaccgaaacccccttctgcgtaacccggttcgaacaatcggacccgcatccacaacccgacccacattcgttagctatctcttccatccccgcgaaagctaaacacttgcagtatccttcctcacacctctcgcattcgcatcctgactcgtccactaaactcaccccaaaacgtccgctttcactcactgagtcaaaacaaggtctagactccgatccacattcattagcagcagctccccaccattgtcgcggcggaggaggagatgaagcggggatctgaaaaggtgtgtagatgaagtacgcgtatcgttgagaatcgatggagttgtgaaacgggattgagatgttttccaaggatcgtgcagcgtcgagagatcggtgaatggttagagatttcgagattagggataaggttttgcaggtttgagcaacaacggcgagttctcgagggtttagccatgggagaatcaaattcgcacatcggagaaatcgatcggcggccggaataatgtcggaagcttctccaagacaacgcgtcttcggtggtggtgactctcgcagtcgctgcatattttttctcagccagcgatatacaaacgacgtcgttgcgtttaattctatttatatccttaaattctattttaatttcacttcagtaagaattttttaaagaaaaatggcgagtttttttgtgttaatcataactatagatttactaccgtcgctttggtctgtgtaatgaaatctgtcattttcacagaggaaaaaaacttacaaagacaaaatccattgcaaaagagcgagcaacaacgacgaaatttcgaa

SEQ ID NO: 8969 - DNA, 3000 bp, Unknown; identical to SEQ ID NO: 8967
  misc_feature (1)..( 3000): cDNA_ID_1989307_gDNA_ID_1971952_Annot_ID_177361 3000 nt of promoter + ATG

SEQ ID NO: 8970 - DNA, 3000 bp, Unknown; identical to SEQ ID NO: 8966
  misc_feature (1)..( 3000): cDNA_ID_2993961_gDNA_ID_1971952_Annot_ID_177356 3000 nt of promoter + ATG

SEQ ID NO: 8971 - DNA, 3000 bp, Unknown
  misc_feature (1)..( 3000): cDNA_ID_3044175_gDNA_ID_1971952_Annot_ID_177355 3000 nt of promoter + ATG
aaggattgcctcttaggaaagccgaacactctttctacttggactgggctgttcactctttcagaatcaccaactgtggcgtccaagacagcactcaggtaacaacactgtacacttaaaatctcaaatagtgatgaatgtttctgcaactaacttctttattttatcttctagattcacactcacatgtgttactcaaacttcaacgacatcatccactcaatcattgacatggacgctgatgtcatcaccattgagaactctcgttcagacgagaagcttctctcagtgttccgtgaaggagtgaagtacggtgcaggaatcggtcctggtgtttacgacattcactctccgagaataccatccacagatgaaattgcagacaggatcaacaagatgcttgcggttcttgagcagaacatcttgtgggttaaccctgactgtggtctgaagacaaggaagtacactgaggttaaaccagcacttaaagccatggttgacgcggctaagcttatccgctcccagctcggtagtgccaagtgaagagcttgaagatattatttctatattccgggatttttctacgtggtttgtgtttgttcagtttcaataacttttcttccaagaaaaatattttagccaaagttaggttttgagggaatggagtcacactctctcgctttcgttgaagagagtttacggctttatactatatgtttctcttgttgcaatgttatatgtatctttgttttctctaatgaaatatatgcttctttgatctcttgaaagtgtggatacgaattaatttgttatacaagcccccaaaatgtgaaatcttaaaatcactactagtgttgtagaactaaagaatttgctgaaaataatccattattgttataagatcatccaccatactacaaaaagatttgatttgataccatgaaaaaggacacagtttcgaacctttggaatgctcgattcgtgcatgtaaagatcacttgacgtggtataccagagaaccaaaagtagtactatattttcatgtcttgttaaccatttcttttgcatggtgtaagcatttcttttcaaagtaccaaaagtgcggtatttcattttatgtggaatttcttttccagaaatttataaactttatcaccgaacgcaagttacacaataacactgcaaaagtgaacccaaaaaaaaaaaccctgtaaaagtaaaaatttgcttaaacttaacattctttcaccgctccgtgacgtggacatttggctggcaaagaaaaggcataacatccaatcaaagatatccacgtagtccgatttatgtcacgagagctgacgcgtcacattatgcattttttttttttttttacacattatgcatttgattaagcatctgtttaacttcttttaccattttgtccctcaaattttcattccctctaattaaaaaaaatagaattaatccacaataaattcttgaaaaactgatgatgccacagaaattcacaaaattattgaaaggctacaaaaaaaaaacagagaagtttcagacatatgatgactgtgtatgaccttgtcaacgtctgacgtgtcgcacatgtcaccacgtgtcataacgatgtaaagcaaaccagttaggtgtctggagagagagatatggacttcatctcttctccgagtctttagcacgtcacaacttcaaaggactctatcgtcattcgccgtaatttctatcttaattactgtattacccttaggctcggagatctctcttctccccgtttctctctctctgtctggctcattcagaaacttttttatacgcctctgtttcttatggggaagagggtatattctctgttttgattcgcttctgtcttaacacattgaaattttccatagaagattccattgtgctcttttaatcctcttctctttctctctgttttaaatacctgtctttaatcgcttctctctatctctctctcttgttaaatctcatcggagttcaatttcaggtaacggaaaattagtttttatttattttattggtttctctcttgtctgattattttaaactcaattccagtttttgatttttacccaaaaaaaacagttttttttttctttggttctattgaagtctcgaattggagcttccgaaagttgtaaatttccgtgatttatgtattttctcgatgaattttgaacattttctatcgaattgtgctactcattgtgtcttggagatcgagttttatctgtttgccattctcgatttgtgtgctttgtggagatttttttttttgttttggcttcactttgtctctgtttcacacttcacaagagatctaagtttaatgttaaaggcgtgatcttttgtagcgtgtcacattcgtggactaatttttactaattgtatgttgttgcttaacaaatgtccttactggagatccttccttgttttggttcaaaacaatgtacttgttggtagaacatctctttagttctgtttgagtgacactaaatgagattctttgctttgtggttggtggaagtattagtctctagatgcatctttttgtgttttgtttttagaaaaggagcgatgctttccactactcgggtttacttgtttattctttcttctctagatttctcaaagaagctacatgaatattattaatccaatataatctatatccttatcttttatcatcaggactctcggcgctcttatgaagtgattgtgaagatttgcgtacactaagcctttgcttcagaaagttgagtgatttgtttgactcactttcaagatgaaaaatgagctctagcaaagatggatggcgtaaactccgttgagggctatagaaatccttttagttgtccgtttagtgagagttatccgagtctttttctttggagacatttggtctagacacaacatttgtggcgaacaaggttttagtgggaattcttaccgtctagaaatatg

SEQ ID NO: 8972 - DNA, 3000 bp, Unknown
  misc_feature (1)..( 3000): cDNA_ID_2179667_gDNA_ID_1971952_Annot_ID_177348 3000 nt of promoter + ATG
tatgattagcgttatgattagggttaaggttaagagtattatccggatccgtggcgcaatggtagcgcgtctgactccagatcagaaggttgcgtgttcgattcacgtcgggttcaaatcccccgaacaataaattccggaatatttttttacgtagtgtcggtcggcacattcaacatagcgttcgccgttaggctatttccagctttgccctttgcgtttcaattcaacctgtaatctcttaaggggcagagataagatttcgactgtcgatgatctctccttgaaagagttctgaaacagtaaattgtgatttgcttgaattccaaattcagttatttctagaggacgaacaatcatgcaagtatttttgcaaccatccttctatggatgcggataacgtaaactctaagtctctaagtccattcacgttcatggacacggagagaacatcagaggtaaatggggatgaatgtgcagagacaaattaagaagggccataaacgaatggaagtttaataaacgatgagatttatcccctttttaagactttcatttagataaatcttaccaaattgatccatgttggattagatttcattttggcgggaacttttccatttttcaaatcaaacgaaaaaaggaagaaaaaaaaaactgaaagtgaaatgaaactaatattcaacagtaatttgcgtgcttatgaatatgatatatttcagtgtgtatttgaaaatttaaaatggaaaataacgaaaggaagttacagaaaaatcatagttaaatggtaattgtattaattagcgtcttcagagagtgttttccttggtagcatcttaagaagagttgatttattgaccatgtcattttttcaagtgacttttttttttttttttttactttgagatttgttggtaacttggtaatgtgacaagagtagagctattgactttcacaaacgaaaaaaagaaagtagagctattgaccaagtcatcttttaagtgaccttttttttgtttgacttcgaatctaagcatattgagaagaatagagctattgaccacgttatctttttcaagttgcatcttttcgtccgacttcggaaattattggtaaattctattagcaacttaagaagagttatatgatttaaaccaagttgtccttttaagttaaattattatttttttaataattttcaagtgaccttttttgtttgacttcaagatttcatggtaaattatatgtatcttgataattgtagagctattgatcaagtcatcttctttaagcgaatattattggtgaattctattgagaagaatagagctatatatgtattgaccaagttatcttttgaagtcgcctctttttgtttgcctttgataattattggcaaattctgttagcaacttgagaagagtatatgatttcttaaaatcaagttgtctttttttaagtgacttttttttttttttttgacttcgagttaaatgacggtgaattgcaaaactaaccatttttgataatgtaattaagaatatagcatcgtatatatataaattaagaaagtaacatgtaaggataggaaaaagacaattttagtgttgagttataggtgagatgatttactaacctttagtgtagttttcacccatttatatttgtttgctatatatattttctaaaaaatagatttcaattctaaaatttattagagaaaaatatatgtttttttctacatacagaatagtttgaatttttaaaatcggatttgaatttaaaaaatagaaaatagtgtttgtaagtaaaaattatgttgtactatttaggatgtatagaaataaaatgttgttctatactattttcataaattattcgtaaatcaattaattttagtataaagcgaaatatttttaatataaagtaatagtgttagcagtggtgatgggataatagtttaggttgcgttaatataacattataatcattaaatgtttttgatggaaggatactaaaccctaaggagataatatatagggaacccaagaatttcaatctaaagaataatatactttaaccaaaaaaaatagaattgtatatgtctgtcaccaataccaccataacgtgaagaattttatggattttcttatatgtaatatttttttgttagaatagaatagaagctagaaacatagaaagagagggagagggagagggagagggagagggagagggagagggagagagagagggagagagagggagggagagagagagggagagagaggagagagagagggagagagataggagagggagagagaggaaagaaggaaggaagggcaaaataaaatttgtgattaatacacaaaatattaaaaatatcatcacttttttgttggtgttattttcttaaatatagtatttttttgtgttagatttgcaaatttcccttaaatgacgaagtttgctcaaaaatgaatcgacgaccgagtttggcatatatgcttttttttaatagaaaaacaaaacaattctatatcattggcggaagatccatacactataaaagtataaagaaagagccctacactatatagcaataattatcagaatagctttaacaaaataattatcaagatatcgaaacataattacgttgttatcaacctagtccgtttaatagatatacgatattgtttcctattaaattggaaatttcggttacaatccggattcaatacacttttgacttttgatttggattcggtatagtttggataaactaaaaagtaaggggaattatttgtaataaataaaagtagaaggatattagaaaaaaaattcaaattgtaacaagtcgtctttttctctgttcataataaaaaattaaaaacccttgtctttccaactgttgaccaagacaagccctctccacttcagattgtttctaaaagcaattctcaatcttttctacaccgaaatagcaacaaaatg

SEQ ID NO: 8973 - DNA, 3000 bp, Unknown; identical to SEQ ID NO: 8963
  misc_feature (1)..( 3000): cDNA_ID_3593635_gDNA_ID_1971952_Annot_ID_177346 3000 nt of promoter + ATG

SEQ ID NO: 8974 - DNA, 3000 bp, Unknown
  misc_feature (1)..( 3000): cDNA_ID_3044194_gDNA_ID_1971952_Annot_ID_177345 3000 nt of promoter + ATG
cttctctgtatccaactcctcctattgaggtacgtttctcatattgtgagctctaaggtttgtttgaaataagcgtgaggttatgtaacttattatctatgcggattagactactcttccaatgcaaatattgaattaggaaacattgatggattttgataactattaagcattgaagttgaagctcagattcgtcctcttgttcttcaagtttggattatcatcttacctactactgtgacttgaaactctgtttaggttcatagtttaatgctcttgtaatgcagattgtgtagtagctgctctgtccgcaaatatgatatagcaaattttgaataggtgttctttgtttcttctaaggggatctgaagctttattcttaactaaagcagtgtcaaaattttcactatgcaggtagatggagactcactagacaggctaatggcttcacaacatggaaatgcttatatgtctgtactcttttatgcttcctggtgcccattctcacgtgctgtgcgccctaagtttgatatgttgagttccatgtttcctcaaatacaacacctagctgtggagcattctcaagcactgccatcgtaagaagtctacttactattgtttttccaaagactacattgtctattgttctatttccatactaattaggataaatagcaaggaagtgggattgaatgattcacatcaagaatttttgggtactgatagtttagtttgagagtaaaaaaaacttaaattgcatatcagttatttaataacttgatccatataaggtgcttcttcttttcactttagtagaaggtcatgtgtgtttgctgttacgttatcttacatttcattagcaaatattcatttgatctatcattaactagttagttcatcattaccttatctgccttgtgtatactaagttactagtaggttcaagtgcttttaggtttcttcatgtgtctggctgtttcttttgtcttactaactggtttcattaattgctttgttgcagtgtcttttctaggtatggtatccatagcttaccttcaatcctgatggtaaatcaaactttaaatgctcggtaccatggtcgaaaggatcttatatccctgattgagttttatgaagaggcaacaggtgatacaccaaaccacatcgtctgcttttaatttctttcagtctacctgagtagtctttgttttatgtccaacctatgactagcacattttgggtggatcgatttagaaataactggttgttgttctggctttccaggcctccaacctgtccagtatgtggctgaaggggaaccaacaggcttaaatgccggtgatggtaacttgatcacatggttgcgcaaggggacatctattagagaaatattcaaacaagatccgttcttggtactatctctgctgtttatctgtttacaaatggcaatccttgtcttccccatagctgaatcccgcatgagagcgttatgggcttcttacgttgccaatttgaacttgggaagatttggagagataagccaactgttcaaccgtggtattcacatggtcgatgtgaggaggttatggttgaaactaagtctcgtcaaaacaagaaacttccatgaaagggcaaagaacgcacaagcttgggcttcatcgctggcatctgtctctctaggccaaacttcatcagaccaatcctgatctcaagggtaagatcatgtcagtattgggaagagatgagcttttaagtgtgtgctggaaatctgagagttcctttaatgaatgttatatgacttatttgagtttgatttgtctgcaacgaagcatgtaaatccaggaacagctttgcttctgtttgtgaatatctttctcccttttttgttctataaatttgagatgtctgtttttggcctcatttcttttactgaataatttgattgagtcaggtaaatttgtctgaattatcttacgcagctttgtcttgtaatgtcagttcgagtttggttggctctaccatggtttcatgttatggtacattatcatcatgtgcatcagtgcatgttgcattatataggatacaacatagcattttatgagtgttagccttgctcactctctacaaatattattgaaagttgaaactgaggatatgtcggtttggtttagtatggtatcattaattgcgtttttattgggttacggttctgaattctgattgtgtcagatatattttctgtttcttttatagttaaccaaggaataacgttttagctagataggtataaagaaataaatatgtagccgactcaaattttactattaaaatttatttgaacaaattattatatgatcggtctaaccgaaaacctagtgatccaaaaaaatgatttgaatttaggaacgaagacttcatgaaagaggaagaattaaggaccttgtcaaagaaggcaatcaatggttcttcttcgaatggggtccccaaaggaccacttcttcttttgtcacttcattgcgttagataagctctaattcattttcgtcacccacatcttcaaatcaattcattactttttataccacacggcacacgcgttatcaaagcatattgtgttgcttcgtttaagaaacgaaattagggtctcaatcttatttctcttaattattattattaatccaaacattctcagaactagtttgaatcttttattaaaggatcttgagaccccttcacatgggagagagaaagaaagagagatagcgagagatgttactccatgagaataccaaacccacttcgctctaataattcaaaagatttcactttctcaaacaaaaaaacttctctctttcttttctaatttctaaaaccctaattgaagttccaacaagatcgatcaaggagaagatggatctcgaggattgggaattagtactccccaagaacagcttcaaggatcttgatcttgatcatgacgaggatcatcatggagccatg

SEQ ID NO: 8975 - DNA, 3000 bp, Unknown
  misc_feature (1)..( 3000): cDNA_ID_3044198_gDNA_ID_1971952_Annot_ID_177343 3000 nt of promoter + ATG
taaatgctctctcaagggaccaagtctcattattaccatcacctccgagcgttctcttctctccatctgtctgccgctcctttaacgtcggttcccattttcttattcacaatgaccccaagaaactcgaggagatggaaaaaagcaaaaggtaaaacaaaaacaaaaaagctttcttcgagaaccagagcacattgattccaaggtaattactttctcaatgccatggaaaaggacccattttgttcccctttcctgtaatctaatcgtttcaatccgtgattatctctgtcagcttggaggaaatgacttagatttcataaatcgattcatgagttgtcagaaaggatttaaattttgttggtttgttcttatttcttctgtagctgctatgaatttttagatttagtttggctatgattctaaacctacgtctttatgaaagcacttacattttctagacacaagatcatagtgagttcatatgatgcggaaaagttattattctcttggtcttccagtttatatttatggaggaacatagtctcattaacaagcttgcattgttctgttccattggattgttataaaaatattcattggtcaattgagaaatcagtgtctaattttttttgaacgtgtctttgcagattgaatgctgtttctggtggattagtttctctgagttttggtgatagatcagattaacaggcagaattttgagaatgtcgacagtgggaaattcaacgaacatattttggcaagaatcccccattgggaaaactgaaaggcagaagttgttaaatcagaagggttgtgtggtgtggatcacagggctcagtggctcaggtcaatcttctaaaaaatcttaaattcttttcccattgtgatacttacttaagatgccttctttatatctctgtctatattctaaaatcttagcctcaaactttgtgcagggaaaagcacgttagcttgctcgcttagtagagagctgaacaaccggggaaagctatcatatattcttgatggtgacaatcttcgtcatggtttgaacaaagatcttggtttcaaggcagaggatagagtggaaaatatacgcagggtcggtaagtagtacatagttgcttactatcttttgctttcagttgatgaaagtctgattccgaagaaactcactaatacaaatgcaaatcctttaaaaaggtgtctcatatgtagtgatagtttacatggtaccaatacctcattgatatacatattggtatacacctaaaagctgatagattctggttaatgttgaaagaaacttctctaaagggcaaaatactaaagaagaccaacaatttgttctaaatgcaggagaagtagccaaactctttgcggatgctggtttaatctgtattgccagcctcatatccccgtatagaaaagaccgtgacgcctgcagggaaatgatacagaattcatcttttattgaggcaagctattcaaaaccaggctttacagtttgtaacccccattcggttggatcttaaaaacatcttgtttgatattgtggccaaatttgttaggttttcatgaacatgtctctgcaattgtgtgaagcaagggaccctaaaggcctatacaagcttgcacgtgcaggaaagatcaaaggtgagataacatagcttcaaggttccatataaacagaagatagcaagttgcttcaatatcatttgagttgttctataaaagtttttttttcttcatacccttttgtgtaggtttcacaggaatagatgatccgtatgagtctcccttgaactgtgaggtatgtgatccatgtgaacataagattcttcttcaagaatattgcaaacaacgcgtatgtgaatacgtttctctgtttcttttgtatgttttgaaacataacagatagagttgaaagagaaagagggagagtgtccttcccctgtagctatggctgaggaagtgatctcttatctagaagacaaaggtttccttcaaaacgagtaacgtccatcataatctaacgaccgagatttgtttttccttttactttttatgggtgttctctgtttgttactttcctgaaacactgcaaattcttaagaagtttcaactaatgaagacatatatagcttcttctccttcttctgaaacttgtcttctacactgaaactctagtcagtcaataccagaattcgatcctatacaacaacaagagccatgccattgttttcattgttaatttatactacgatacaacgattatactaagacaaccattaatttacatagtgtcatagtatttagaattttagtttttttgggggtcaaaaacaatagttttagttatgttagtgaataaatagattcagaaaaaactgtcgatcttatttgaatagttcgtaaaagagagggttctgtttgcaattttcctaacttttagatcctgagttctgcaatataaataaagaacaaaacaaaacacgatcacgaggcaattttgagacaagaatggtgttgaatagtcgattggtggagacaacagttaatctgtcggcggatctctggcaatatgttgcgtgtaaccccgagatacttcctcgcgccaccgtcatccatttcatcttctgcatccctctcctccaactccgccgtctcgcttcctctctaggatcatacctatgcttcgattccggcgccggagttgatcaccgtactcattccgattaagttaccggcgcgtttccatgaatcgtctgttaaatttcgacttttgattgtgtaatttttgttctgattgtaatgtaattttgtttgtttgtaaaccgaaagggacatacaaatttaataccagaataaaccggaaacatttaaatacacacagaaccaaaccgggttgtgtggaattgttgtcgtcacaggagagaaataagcagagacgtgtaaaccaaagaacaacgaaggtttcgtttcgtggggaagaag

SEQ ID NO: 8976 - DNA, 3000 bp, Unknown
  misc_feature (1)..( 3000): cDNA_ID_3044167_gDNA_ID_1971952_Annot_ID_177366 3000 nt of promoter + ATG
aacaaaatgatagaacttattgacaaagatgtatgtatatatacatatatatatacaacagaagaatgatgattgatgaagatggttaagtggaacttgggattcaaggaacactcctggcaaatacaacgcatctatgcctacaccaacaagcaacggtcatgcctctcgcgtgcagattcaagaaccaagaataatgtctcctcttcctccttcttcttctccaatcgccttcaaggtatttctctcttttgaatcaagaatcaggaaacaccttgatctctgtatcttctctctctctgggttctgttttgctttctactttatgctatctgttttgatcctctctcgttgacttccatcactatttcttgactcaagaacaaaaccaagacccagcttctcttttgtctcttcttgttttcttcatggtgctttttacttgcatgttcataacgaattcacattaaccagctttgaataacctgttgatgagacaccatttttttttttttttttttttttgcaggaacaacaaggtagaccacctccaacaacacaacaaaccatagcaggaaaactctttagaactcttttcaagggtcttctcttctcacaactaaccttaatctcacttttggtgatcgttctcaccattcgcggtctcatctcagcaagtacacaccatttccacctcaagaaatggtaccctcctttactagcatctgttgctgtctcaggaattgcatctttagcatggcaatgcatctttatctacaatccatcaagagcagtcaaagcaacgttctggcttagtccaatactcacctgctcggtaggaatcttgcttgttttgattggctcagcggtagatgcaggtataggtgcagtgtttgtccttttcgccattactcagtccctctatggttgctggattactccgaggcttgagtacaccgataaaatattatcacttgccacagcatttccacctgcaagaaccagagaagtagtctgcttatcaatcatagtcagtgtcgtttactctggtttcttggtgactggaattggaggagcaacttccactagaacaaatcttgatatcttgttcatatccgtaatcataataagcttagcatggacgatgcaagttatcaagaatgttcaacaagttgcgatttcacgggcgagatatgtaaactttgcacatggagaagatatggacgcttggaatgctttccgcatcactatgaaacacttgactgggagcatctgcgttggctcgacgcttgttccaatcatcgtattcataagaggatcaataagaagtgttaatctaatgtcagggagcagcgatgaggtcatgtattcaggtgctgattgcttctctaccattgctaacaaactcattacacttggaaacagatggggctttgtacatgttggaacctatgataaaggattcatggaggcttcgagtgatacctggaagaagttcagaagcacaacagggttggagaaactgattgactcggatctcactagctccttctgttttctcagtgctgtttctgttggagctgtctcttcattaactgctgggatatggatgttgttaatacacaaggactatgccctggaagtgactctctatgctttcataattggatattttgtggtaagatagctaattttataaaactaagaagaagactttaagacaaagtggtttatgttgtgtacctggttttgagtgttttcagggaagggtaggtttggcgtggctacaggcatgtgtattggcttactatgtagcttattctgaagatcctcagagcatgagatttgatggaacaattccacaacgtattcagcgtcttcaaatgttaagtgctcaccgagataacagggagcttgaggtgggtagagacagagaagaagatagttataacaattgttgagtcatgaaggagtctcgctacatacatgtaaagaaaaacaaggattactactttatttcttcaaacttatagattcttctattgataggcaaaaatcttagcttcaatgtgtttatatgtatgccaaaactccaactaaagaaagaatgcacatactttttctctcaacttagccattatacagtgggacttaggattattgaaattttcaacacttaaaaatcttagagtttttagtatactaccaatttacagcaaaaaataactaaatttgttccatatgtgacacaagtatactagtgattataatcacaatcattatcaacattaagcacaagtacattctaatgattaacggaaaaaacaataatctgaagcaatagaaggaagagaagctactgcacatttggaatcgaatacccgataagggaatccgccgcagattctggagaagaatttgcagtttgtcgtagagagcttttgattgaagaaatcaaacaaaaatttaggaggagagatctcgaaccggaacaaaaagtttatattggtattgaaattacaattgattttgtgtttggtttatactggtttagagaggaaaagaaaaaaatattcacgcgatggtgattttagagacaagtgcgttgataaaaaaaggcacaatttcagaaggtaaacccctacagaattgctctcacgctctctacgcgcactttgtgagagtggatctgaaatagaactttctgattggctaaaaaactctaaaaaaatagcaatagtagacatgttgctagctcttgttattatttagcttttctacaaaacgcagtcgtttctatttcgatcgtttcagcttttgacattgatccgaaccaatcggttcaactggcttagtctatccacaggttcgtataaaaaatctcatttttggtcatcaaattaaacagtaaatttatattaattaatcataagttaatgtttaaagacaaattctatttcaaatttctaacgaatcagacctaattgtccggaataaatg

SEQ ID NO: 8977 - DNA, 3000 bp, Unknown
  misc_feature (1)..( 3000): cDNA_ID_3044171_gDNA_ID_1971952_Annot_ID_177365 3000 nt of promoter + ATG
cctaatattcaaaatcgtaaaaaaatgtccctgaagaaggagatgtgggattccaacgaaaagacatgcgacgattcgaaccagcctatacttgtcgtggacctgattagatcaatcttggaacgtttgagctttgttgatttccatcgagccagatgcatttcttcattatggtacactgcttcggaatcatgcatcggaggaccatcaactccatggatcatcctctttccgaacgaatttgttgaaagaaacaacgattcatgtaagttgtatgatcctcgtaactatagttcctacatagtaagagatctcaggtttgatatggctaggagtcgttgtttggccagtccgatagctggttccttatgttagactataacaacgatttccacgttttgaatctgtttactcgagagaggattcctcttccgtctctagaatcaaccgatggatttccgatgaatattacgaatagactagacactgcggttttgtgggtagatgaaaaaagcagagattacttagttgcttggagttacggtgacatttttgcatatcgcaagaatggagatggaaacaatagctggaaagtgattgagcctttaaagaatcaacgatgcgttgatatggtgtgtaaagaaagcaagctttacgtgtttagtgatactcgagtcactgtgtttgatttctcccgtagtgattctccaatggaatgtgcaagtttattttttatctggagtttcacaaaagtcctgttgtgactttgtctggagaagttttggtcattgctagcagagtggaaccacatcctgggacgttcttattcttcgtctacaagttggatcctaagtcatcaaaatggagcataatcaaatctataggggacgaagcattgattttggatcttggaataattgttgcagcaaaagatggagttatgaaaaattgcatatatttagtaatgatcattttcataagtacagtgggattagtctatgcggtgataacggtaacagtattttcatctaccatattgggaccaaaaaggtgatccaagtgtttgaacatcttactgcttcattgccaatactattcaggatgctcgttggtttttccccactatcggtggaaaatgtttgctttaaaactatctagttttgtcttttttgtaaggctacattatttgcttgtctctcgtggaacaagagtgtttacaagttttctttttatattcaagtgttttggacttagaaaggtttgaaaaatcgtactcaaattatctatatatcaacaactaatcctctttagatggttttgtttttgtagataaatttggcttttagttcccatcaacatttcttccatgggtttaagtgttgatcatgagcttaacaagtcattagctatatcaaattaccaaaagactgattctcaaaaccgatcaagaaagagcatcattttataatctaactcgtgtagagtactgaaattttgatttggaaattaattctcaccgacttaacatggaccaaatgtacttgatgtgcaccgacttaacatggaccaacttggtcgatatcaatacaattctggacatctagaggacgcttatggtacgttgattaggcttcccgtgtgtattttgcttgtgatctcggcattccattgccgaaggttcgaggatgcgcgcattctttcgattgaactatctacaaacgcacccaagcttgatgacgctgatgacaggaaagcaatccattataaatccttatgtggacgaggcttagccaacatggctttaggccactattacacagccgctgttttggtacgtaaactcatatagatatatttatgttttgtttataattatgtttggtataacttatattcatcaatatttattgttttcgcagtttgcgcatttggtcaaatgctatgccaagtggtcaaaaaactcttttgacctctttacttgggaggatttgttcatgtacacggcatggtgtggtcttgccacgatgaaaaaagatgagcttgaggtaatacaatattaatcgattatatatatataaaaataaataagccgacttgtaaactttttttattgatgattttttaggagatttctgagaggatgggaagtcaaaaagttggccaccatttccaacacttgattagaaaaactcttggagggtaatatataactcttaaaaaatttctattgaatacacttgtcggcaattaaacaagcttggtttatttgttgcaggatgtttaaaccaccatgcttggattttttgaaaactcattcaaaaccaaagcacttttggacttatacctccacgaccatgtgaatgctcttgagatcctcatccaggagaaatttagggtgtgatgcatggttgctttaaaactatctagttttgtcttttttgtaaggctacagtattttcttgtctctcttggaacaagagtgtttgcaagttttcttttatattcaagtgtgttggacttagaaaagtttgaaaaatcgtactcaatatcaacaacgaatcctcttaagatggttttgtttttgtagataaatttggcttttagttcccaccaacatttcttccatgggtttaagtgttgatcatgagcttaacaagtcattagctatatcaaattgccaaaagactgattctcaaaaccgatcaagaaagaaagcatcattttataatctaacttgtgtagagtactgaaaatttgatttggaaattaattctcaccgacttaacatggaccaaatgtacttgatcattttcaatataacaaactagtgcaccgtaccgtattataaagtctttatgtatttttttttaatataaaaacattttcagatatatttatttccaataaattcatttattttaagaaattaaccaaaaagaaataaaaatgaacaaacatatataagtatcttgattagaagaagcaggagacaaaccctag

SEQ ID NO: 8978 - DNA, 3000 bp, Unknown
  misc_feature (1)..( 3000): cDNA_ID_3044202_gDNA_ID_1971952_Annot_ID_177342 3000 nt of promoter + ATG
tgttttggtttgatgaaaaaaaaacagagtaaaacaaacctctggatgatatctgattccacctttcatgggacctcttgcattgtcgtgttgaactctgaatccaacaaaggatgctagagttccatcgtcttttggtatggtacattccacctgcaatagttggttagttccgttcaaatgatcttgaaccggatcggttctgcagatctgttatagatggaagaagaaaacagaggaaaacatcgaaccttgatctctctgaagggaatgagaagacttttctcgagctttgagtctaaaccaagaagcctagaagcaagcttgaagtttctgttggttgctgctaaagcattcatggctttcttctctcttctttattttgggtttatttgatcagagagtctgatatgaagacagttggaaaaatgtgagtcttgcttatgttattgcaagtttatttatatagagtgatacgtacacacttcgtgttatggaatatgagaatgaaaattttgttatttatatttataataaaagataatttatataaggaatatgaataatcatataagatgatacccataattgatcctgattttgagtattcagaatactatgtgtctgtttagcaaagttctcacacaaaaaaaatatatagattatagaaatagcccatgtcttcaccatgtgtataaactagatcagaataatggaatattcattaatgaaaaggaaatccgtagactaatcaagcagaataaatatattcttttcattacaaaaagatcagaataaaaataggaaaaatcaagatttcacaagattataaatattacatggatgaaagagatagctcgtaaaatttatcttattgtgtcacacactgtcattttattcattttaaatctagattaaaggaaaaaataacatttcgtattacctaattagtacccacctaataagcaaggaccaagatattgtttttcagaatttgtttttttttttaaataagaaaatatgatacaataatgatctagcaatagcatgcattggaccggatgactatactcgtgcatgaaaaatcatagtcaaattgtaatacgttaatgtgggacgataataatactttttttttgttttattatctacgattatatatatattaataatcatttacatatttgtgatatacgacccgaaatgaatcttgcatgtcataagatctttacgtgttattaacttattcaattctacttgcccctacacatataggcatagcgtatacacttttgtgagagggtgacaaaaaaaaacgtatacactttagtgagctagtgggaaaaaaacgtataaacttatcacacacatacaatattcagttttaattgaaaagattctacggatatatgtttttttagatactcaaatcagaatctttttggaattagaggaggacacgagaggatgcaacaaatcaagaaacatatagaattacaagattccaccatgaaagaatctttttggaaaagagattccccatgatttatgcttccactaatataattgatttattgtggatttccaccaagatttctttctctttcaatttccaaaagaagatatcaatttcgtaataacaacattgaccgtaaatagtgtttccaaatttgatctcaccctctttggtcaaaccaatatatagaaataataccccaataaagaatccggttcatggtaggcttggtagctaatgtcaaggatttagtatttttaaaacgttatgcattagctttctatcactttttaatacatgaaaaaaaaaaaaaaaaaaaaaaccaattggactttctcctaaaaggccattccctaataaacaacaaactacgaaaagctaaacatgtatttaaaatattaaagtgatagaaagctaatgcataacaattaaatgaagcaatttttttatattctttggtcaaaccaatatatatacagaaataataccccattaaagaatactgttcatggtagctaatgtcaaggatttagtatttttaaaacgttatgcattagctttctatcactttttaataaatgaaaaataataactcaaacaaatataaaaggccattccctctacgaaaagcaaaacatgtatttagaatattaaaaagtctaaaatcaaacctaaaattcaaaaatcaattaaaggccacaattgtcctataaaattatgggcttgaagcccaataatatctaagtgaaaaactaaacttaaatgctctctcaagggaccaagtctcattattaccatcacctccgagcgttctcttctctccatctgtctgccgctcctttaacgtcggttcccattttcttattcacaatgaccccaagaaactcgaggagatggaaaaaagcaaaaggtaaaacaaaaacaaaaaagctttcttcgagaaccagagcacattgattccaaggtaattactttctcaatgccatggaaaaggacccattttgttcccctttcctgtaatctaatcgtttcaatccgtgattatctctgtcagcttggaggaaatgacttagatttcataaatcgattcatgagttgtcagaaaggatttaaattttgttggtttgttcttatttcttctgtagctgctatgaatttttagatttagtttggctatgattctaaacctacgtctttatgaaagcacttacattttctagacacaagatcatagtgagttcatatgatgcggaaaagttattattctcttggtcttccagtttatatttatggaggaacatagtctcattaacaagcttgcattgttctgttccattggattgttataaaaatattcattggtcaattgagaaatcagtgtctaattttttttgaacgtgtctttgcagattgaatgctgtttctggtggattagtttctctgagttttggtgatagatcagattaacaggcagaattttgaga

SEQ ID NO: 8979 - DNA, 3000 bp, Unknown
  misc_feature (1)..( 3000): cDNA_ID_2179705_gDNA_ID_1971952_Annot_ID_58637 3000 nt of promoter + ATG
acaagaacgagcgtatcaatgggaagaaggtgtgaggcacacgtgcaaagagagtgtttaataaagtaataagtttataattagtatttcgctatatatatatatatatatatatatatatatatatttattatcttaggtcttattaaatgtaaatatattagttatggttagaactagtataacaaacttatggaaatgcgtacattgcgtctgaaaccattaattagcgatatatacatttgagatttataatcataaaaatctagagtccttttgcttatacaagacgaacacttataaacgtttccaaaggggggaactttcgaaagttgttgaaatgagagatatacaattgcgaagtatagagaaataaacttcaggacattgacaataatatgaaatgaagtacacgatttagttgataagaaaagaaaagaaaaaaagtatacacgattaatttccttttagaaaaaccaatcatacatcgatttgatgtttaagtctagaatatgtgatgcaatttaaattatctgtttttgttttccctgagtacccaagaatattgggcggagcagattgatgccaatatcaatatgtaatcagtacatgcatgcatgtggtatatatagagagaaaattgtatgtttttgcttacataacttaaatcaaccagacaaccagtgatgcatgcatgtggtatataacgaaattcacatgaatgttctttatcttaaggaaaaaaggaagataaatcagacgaaagttaattgtctcaaaaggtaaaacaaatgtacgatacaatgattaataacaaattgtatagtatagctagctaccacaatctaagtatcgtattcgtacgtaatttcgtatggatagagaagtaagtatatatgtgagagtgtctgagagaggagaggcacgagaatcgtgttgaccgtttcgtgtggagttctttagtaagctaaccaaccttcatgtctgtcgtgctccttttcttcacaacattaatcctcccttttctttttccgtactttgccattttcaaaattagttttatttcacgaaattcttagtatttcatgacttcattttggtgggttcattttcgtgaattacttctaaatttcccccattccttctccaaatcagtagagccgctattaataagaaagtgtaacttccgaatgacaatgacggtgcttggttgtgtttgctacaaacatagaactcgaatttttcaaataataagagtgttggacattagtatagcgagacaagatgatgatgaattcaggtattctcacaaggcaacgttcccaaacagcaggaactaccacaagagcagtttagcttgtcgtctctgttctctccggccacacttacgtctccataactgaaacttaactcctcctctgcgattatgtcctttgctgcaaagaaacagagccgaggaagcaacgctcctgagcttctcaacagaacagtggagagatttccaccgtcacaagaatggttgatgaatctagcaacgttcccaattcttgtggcgtcgatgtttatccttaaacaagcttgtcctgaagggaggtgttcgcgtacgaccaaaagagctgaagcgaaggattgtgttgatctgagtttgtcgtaaatgttttgacgtctacgtgcttcatctgttgtcaatagctcacctataagaagagacgacaaaatcaagtttatgacttttgcataaaccaagtcattaaggcagatcacaaagaaaaaacacattcaagaaagaagaaagatttgtcattatctctaatctccaaatccagcattgtgatactacctctaaacgattgaaacaagaacatttcgaaagctcagatctttcactgatggagatcactcttaataccatgctagaatctcatctcaacgcatcgagctaaatcatatgcagtccaagtgtaaaaggctaataactaatgctaatattcctcaaatcatgtaatcttaagcttgattttcaagttccaattatcaatcttccaaaattagtgacctactgcaataaaacgaatcactatactattaggaaaccaaaagttggttaacgttacctaatgctaatattcctctaatcatgtaatatgaaatcgaaatgtaattgtaacctgcatattcacagatgaattggccttgcttgataagctggtcagcgtacaagcaccaacctttcttctcatctctcacaatcttcaaactaaccgaaacccccttctgcgtaacccggttcgaacaatcggacccgcatccacaacccgacccacattcgttagctatctcttccatccccgcgaaagctaaacacttgcagtatccttcctcacacctctcgcattcgcatcctgactcgtccactaaactcaccccaaaacgtccgctttcactcactgagtcaaaacaaggtctagactccgatccacattcattagcagcagctccccaccattgtcgcggcggaggaggagatgaagcggggatctgaaaaggtgtgtagatgaagtacgcgtatcgttgagaatcgatggagttgtgaaacgggattgagatgttttccaaggatcgtgcagcgtcgagagatcggtgaatggttagagatttcgagattagggataaggttttgcaggtttgagcaacaacggcgagttctcgagggtttagccatgggagaatcaaattcgcacatcggagaaatcgatcggcggccggaataatgtcggaagcttctccaagacaacgcgtcttcggtggtggtgactctcgcagtcgctgcatattttttctcagccagcgatatacaaacgacgtcgttgcgtttaattctatttatatccttaaattctattttaatttcacttcagtaagaattttttaaagaaaaatggcgagtttttttgtgttaatcataactatagatttactaccgtcgctttggtctgtgta

SEQ ID NO: 8980 - DNA, 3000 bp, Unknown
  misc_feature (1)..( 3000): cDNA_ID_2993965_gDNA_ID_1971952_Annot_ID_58639 3000 nt of promoter + ATG
agccaacatggctttaggccactattacacagccgctgttttggtacgtaaactcatatagatatatttatgttttgtttataattatgtttggtataacttatattcatcaatatttattgttttcgcagtttgcgcatttggtcaaatgctatgccaagtggtcaaaaaactcttttgacctctttacttgggaggatttgttcatgtacacggcatggtgtggtcttgccacgatgaaaaaagatgagcttgaggtaatacaatattaatcgattatatatatataaaaataaataagccgacttgtaaactttttttattgatgattttttaggagatttctgagaggatgggaagtcaaaaagttggccaccatttccaacacttgattagaaaaactcttggagggtaatatataactcttaaaaaatttctattgaatacacttgtcggcaattaaacaagcttggtttatttgttgcaggatgtttaaaccaccatgcttggattttttgaaaactcattcaaaaccaaagcacttttggacttatacctccacgaccatgtgaatgctcttgagatcctcatccaggagaaatttagggtgtgatgcatggttgctttaaaactatctagttttgtcttttttgtaaggctacagtattttcttgtctctcttggaacaagagtgtttgcaagttttcttttatattcaagtgtgttggacttagaaaagtttgaaaaatcgtactcaatatcaacaacgaatcctcttaagatggttttgtttttgtagataaatttggcttttagttcccaccaacatttcttccatgggtttaagtgttgatcatgagcttaacaagtcattagctatatcaaattgccaaaagactgattctcaaaaccgatcaagaaagaaagcatcattttataatctaacttgtgtagagtactgaaaatttgatttggaaattaattctcaccgacttaacatggaccaaatgtacttgatcattttcaatataacaaactagtgcaccgtaccgtattataaagtctttatgtatttttttttaatataaaaacattttcagatatatttatttccaataaattcatttattttaagaaattaaccaaaaagaaataaaaatgaacaaacatatataagtatcttgattagaagaagcaggagacaaaccctagatgagtgagtccgaggaaaagacatgcaacgacgatccaaagcagccgacacttgtccgagacctggttatatcgatcttggatcgcttgagattctctgattttcatcgagccagatgcatttcttcagaatggtattacgcctcgaaatcgtgcatcagagtaacaactccatggatcataatgtttccatacaacacagattggaaagaaaattcatcatgtaagttgttcaatcctcgtgaccatagttgctacactttaagagatgtcgggtttgatctagctagtagtcgttgtttggccagttccggtagatggttccttatgttagaccatagaaacgattttcatctcttgaatctgtttactcgagagaggatttatcttccttgtctgggtgcaaccgatggatgtccgatagaattttggagaatcaataataataatttttgggtgactctcaatgaccaaaacaattctgcaaaaaaaaaaaaaaacttcacatatggtcatgtgtcttagaataggcaaagctgttttgtgggtagatgaagaaaccagagactacttagttgtttggaattatgatggcttttttgcatatcacaagaaaggagatgacaagaataactggaaagtgattcaacctttaatgaatcaacgatgcgtggatatggtgtgtaaagaaagcaagctttacgtgcttactgatactcacgtcactgttcttgatttctcccacgctgatgcttctccaatacaatgtgcaagtttcaaatctccgaattatggtaatgattcgttttgcggcaagaatcttgctgtgactttgtcaggacaagttttgatcgttatacacagtgggggtgtctacaagatggatcctaaatcattagaatggagcagaaccaattctttaggagacgaagcatttatttttgatctaggaataactgttgcagccaaagatggagttatgaaaaattgcatatatttttatgctgacccgccttatcgacctaggaggaggtttgtacgcaatgctgaaagcggtattagcgtataccatattaaaaccaagaaagtggtccaagtgtatcaaccagctcttactgcttcgtctccaatatctttctcttctgctcgatggttcttaaatagttgcttcaaacctaaatcaagttttgtctcttggtaaagtttggagtattttcttttgttttgtactggaacaagatttgttgcaacttttcttttttatatattcaagtgttttggactaaaggattgatgaattggagattagacgggtgattattgattgtctataacatttgggcgtaatctgttataatttacattaccgttctgtttttggtaaagagaagatccacatgtccatcaatttttactgtgacattgtaaaaaaagtaaaatctgttaatctgtttttaagctgaggtgcagataaatctcttaggatagagaattcatgaatcaagagttgcccattgcacaaattagcccaattgttaataaaaaggaagaaataaacaaaatcacaaaagtcatctaaactttgaagaatctttaccaacgagaatctcacaaaagttggaatcgtgcacgcctctcgagttatctccggctccgatactccatctggtggattctgtagaagaaaaaatttcaatctttgttggattttctgggaaaaactcagatgggtttgctctgaatcgattggaaaatcaaaccggtgtggactctgcaaagttggttgat

SEQ ID NO: 8981 - DNA, 3000 bp, Unknown; identical to SEQ ID NO: 8976
  misc_feature (1)..( 3000): cDNA_ID_1989304_gDNA_ID_1971952_Annot_ID_58640 3000 nt of promoter + ATG

SEQ ID NO: 8982 - DNA, 3000 bp, Unknown
  misc_feature (1)..( 3000): cDNA_ID_3610002_gDNA_ID_1971953_Annot_ID_58648 3000 nt of promoter + ATG
ctcacgggggggggggggggggcttacgtagacggcattaaatttttaatcacagctggatgcgatggagttagtgtggtgcagatgcgatgcaacattaacaaatttttttttaaaaacaattatcgattttattcacttccacgcgagtcttttttgacgtgtgtgtcacgctctggttttcgtttgttctttttgggttaactttggattttgttgttgtgcatgatgacttctttctgatcaagaacaggaacttgattgaaaaaactaacgtatttgataatcactagatagctagagatagatatctaatgagtgattttagaattttgttcatgtacaaacaaaatttacaatttgctgatttcttcgtattcacgtaagtttaacaattatcctttttaaaaaaaatcaagttcaacaataatctcgttgtaaaatgagacttatcctcatattcgatttatatttaaggttatttatgaactgaagtgataaaaaacgatacagaagacaatacgtacatttctaaatactttcttgttttattttggtaatacttaattactcttatactagttttatgaggccaaaagactaattttttactccattaccaaaactcctgatcttacgaaaccttctctttaaggattctcatttatatatacatgtggaacgagtaatttatttttatttatttctgacaagagagatattttgtactattgtataatgtactgtatactactaccctgtcctttcaggttcatgatttataaggtttgtttttccgcaataaacaaaagacgacgacgtgtttttaaagacgtgattgtagacaccttttcatggactgtggaatcggtgatgtaagtgaaaccaagcacaagtgggaggacgaacattaccacgtgtcgagtatgcaacacctatatcgactaagcatagaaggaatcatgaacaaataaataaataaatcttgtaatcaatcaatacgaaaccaaaatatctcaagcatggacaatgcgtgtgaatgagatgaaacctttgtagtcagatgactcagatgattgatagtataaagtcttctatatgtaattatggattgtggtgtaggttttaatcgttttccaagttatgaaattctaacatcaaaactaggactagaaaaaaaaccaaagccgaagatttattatattgggttcgaaattaaacttgaacccgaagatttactatattggatcctaaattttttaatccaaaaaatctaagtcgaatccgaaaataccggtattttattcgaaaatctaaatttattcgaaatctaaaattttatccaaaaattcaggtatttactcaaaaattcggatatcggttctaaaaggaccctgaaaatttatatccaaaccgattaaaaaccgattggatacaaacttaaaccaaaccgatattttggatttatcccattgaatcttaaacttttatatccaaaaaaatcatatctaatcgggttttacccgaacttaacccaaatgcccacctttaattattcaaaaccaaaaaagaagtgtttgatgctgaggtttgaactcatcagatacacgtaactattttccaatttattttcgtttatgtgcatttcagaatttcaagcataaatatactcttattgtttaaacatttcaaattgcatgtgtgaaataatatcagagttagaatatatgttaatcttctcttctcctagattcagttagatacgtttctatcttcttttaggcaacatctcttgtacaaatagtctctttggcaattcaatacaatcaaccttttacgatatatatatttgttatttcttgtacaaataggatcaaaattgttatttctgaagcaaattttctttagtttggatgtcaattatatcctcgattaatatgtaatcacggaacggattcacgatgcgttattttagaagcaaatttatacttgatagtacgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaaatg

SEQ ID NO: 8983 - DNA, 3000 bp, Unknown
  misc_feature (1)..( 3000): cDNA_ID_1989337_gDNA_ID_1971953_Annot_ID_58649 3000 nt of promoter + ATG
tctccacgtttccatcatattttctttttttgtttccctatttgttctttgaatcctcgaaatattttctaatcatcaattatagcctctatcttttggaatcttaatttatacccatttgatcattcgatgaaaagtttcttatcgaatgtttttgacagatttttatggttcagtagttttacaaggttataaatatttactttgctaaacgttttacatgtttgagatcctaacattagttccatattgtaaatatcaaacatgtataaatgttcgaatcgaaaacatgtacattagctgttattattttgtctcaataaattttgaatctggaagaattgataacatcctataaatgtggtgacaatatgcaaagattgaaaacaaatttctctctgtttatagattctatggtagcatataatataaatatataatatgatactaatagaatattgaatttcttcttttcttttcaaaaatagaatattgaatttcatcttgatattttttgataagctataggatgtttacacacgtcctctttggttaaagagagcagttctaatctcaccaagcttggaacagctataaagcacgacaatcgaactatactacgacacgttgcagtttgaagctgtcatgaaacagacctaccactagtaccgccacgtgacggtcatacccaaagaaacgaaacttgtaagaagagatcaccggcacgaacctaacacatcgcaaattcgaccggtctcgctagacacgttatgcatgttttttgttcgtttaatgaatgacgactcttcactttcgtttttgtattagtcaataattataagagttggccagttaggttgattacattaaatattcgattaggggagactaaaatatttgtactattttgtacacgtaaccttacattagatgtcttcgaaacttctttccatatgagtcatgacaaggaaaacttctttctatgcgttctcttacccaaaaaaaaggttctcatttttataattggagattccacatatatattattaattctcggcttagtaggattctaccgggtaatattgtaaactaaattttcaatattcaaaattattgttattgaaatctcaatggaatgactcaattaagataacaaaacattgaaccaatagatcacttgtgaatagttaacgacgattttgatattttgaagataaattaataataaataaataaataaaactgttacctatttaattgcgtctgctttttgacatttgcgtgcgtaaaatatttttatatttccgtggattcggcatgcacgatgacattttcctaacatgcaagcaaacgacacaattttttaaaaataattattcgatttgttttctacttaagaacttgggacggtgtaggacctaccccattctctgtaaattctattccatgatcaataatgtgaatctcttaggaatagatcaattgcttaaaccatctaattagcgacaattcttgcattgatcgataatatttggatatatagtgccggctttgaggtcctataagctcaaagcaaagtttaaaatgcgtgcacacaaaagaagcagacagatattttaacttttcgttgggccataaaagaagcccctaacaaatatgcacctaagtcaagcgacataagagatatgagacgatacagacccacaaggatgaagtaacaaacatcgatttggatcaagtttgttaaagataaacccaattcggagagagtccactcaatagtgaaatgcctacaatgggctcttattaagcaatggactctaagagacgtgccttttttcaatttaggcaactgtagtctattgggtataacaaatgctattctttgccatgtatattaaatactttactctttgctgcttctttaatttcttcttaaatggtttatctagtaaacgatggcaaggtatactcttttgagttattacgagagacagagttagttacatgagctagttcagtctttaattagcctttctttatgtacattatctcataaatctacatgtgaaaactttatttactctttgtggagagaaaataaattgtaaagcagcagcacaagatcgatttactgttgatttcacattttgaatgtagtactgggccttgagggacatagaaaagctaagattgcactgcagtactgcacccattcattttgtgactcggcccctccccattttgtacgtaaacaagaaaacgcgttcgtgattcactttaactttatggaaaaaaaacaatttggcgacttgcatcgacgtgcgcgtttatattatataaactgattttcaaaagaaggcatgattcatcaaagcatgtatattagcattcttaattatatctttgtttcaatcatgatccaaaagatgtgagttgatctattgttgttgtttccacgtatgttcgtctatatccaattttcagtgtattttattattctgctacatatttaattttagctcaaacacacattttaaccatattctccttggcaatttatttattagtcgatagcaatttggttgcaataatcttctgttatacttgaaaaacgatctattaacaaatatattcgaaagagtttcaaaacaatctattaacaagtattcgaaagtcgtcacatcgttgactaaagctgaggacaactctgtcatttttatcttattcacgtggctacctcttcttcttcgtctctcattttatgtgtaatcccacagagcttgtcactccaaaaaaggcaaaacaaaaaaaaaacagcttctaaaaataaaaaacaaaacaataatccagccaccgtaggggtaattccgtaaatttgtaacagaaactccattcccgcggcgtatgcagagggcaatcccgtaaacttaacccatctccggtgatgaataatatcaattccttcacgccggagtgattttccacaaaaaataagat

SEQ ID NO: 8984 - DNA, 3000 bp, Unknown
  misc_feature (1)..( 3000): cDNA_ID_1989336_gDNA_ID_1971953_Annot_ID_58650 3000 nt of promoter + ATG
gtgttagtctgctagaaaaagcatgttggagtggatttattgaataaagtcacaaaattgttgaccaaaaaggaaaatattagtcattcaattatggacattagtacctttttccctctattcgacttatatatgttaagtactcttagttgattgcagttacagtttttacgttaagtactcttagttcattgcttgatataaatgctctccgaccgttttcccaaattttataagtttatttagttttagtgagtggttcttgtttgttgtggtccatgaatgtggcagaaaattgtttctaaattcgtgggtttaatttattggtggagcacatgatactgtcatgttcagatacatagcttttaatcatgtctagctactgatcagctttctgcaatgtgcttgttttaatctttagtgtccgctaaaatcttatactatttgatatttgttaatcatatctgtggttcttaagatatttatgtttattgttttatctctatgtgcgtgtcattatcactaagatcacgtgtagtgtctaaagggaaattccaatttatatgtctattgataatttgatattcattataacatggtagtacagtcgtgtttggactcacattcattctttgttttgtgttctgtgatggaataattatattgcagcttgacataagaggagatccatacgggtttctagcggcgcatccattggcaccgcttgtatcgttgcatcaccttgtttacttagacccaatgttccctaacaaaaacccgatcgagtcgttacagaccctaatgaaaccttataccttagacccgaatcgaatactccaacagattaattgtcatgatcgcaaacgtcaatggtctatatccatctcttggggatacaccattcagatatacacttacttcttgactgctacggagctgactacgccgttgcagaccttcaaaacttggcggtcttccagcgatggacctttcgtgtttaacactcggcccttgaaacctgacccctgtgagcgtccggtcacttatttcatggatggtgccgaggatgtacgggatagtgggacgaaaacttggtatagcataggggataagaactatggtcattgcggaaagattgagcatactcgattaactaaagtgaagaggatattggtgacttcaatgaagacggatcctgagtattggaacaaggtacttagtgtttgtatatttctcatattgaatttaacattttgggtgagtttaggttacatctttttttttattttttgcttttgttgataggcaccgaggagacagtgttgtgaggtgatggaaggaaaagtaggaaaaagaaaagagaaagaaatgttgttaaggattagaaaatgcagatctttggagaagatataaaaaaagcgttttaattagagagatttttgcacatacagatttagattcgatcattagttatttgtttctaaattcctcaattcctagtaccaagagaatgacgattttctctagtaatactggcactcttcgtttttcaacatgtaaacattactttgtataattagtctatatcaaataaatagttacaacatgaacgtaactatttatacacgagggtaaatttttaacaaatttaaaccgaaccaaaaagatttcagttaatcatagttttgttacaagcgaaatctgaaatattcaccctcaagtttgttacgtaattgtctaatctgtgtttttttgtgctagtgttataattgtttcctcgaatgttaagcaccacatagaagtatacacttttcttttattattttcgttcttcttccatttagaaacttttattaattctactgttaaatccaacgttattagtttattttctctgatgaagttctaattttttttgtttgttggaaaaagggttacttttctgatgaagttgccgatttgtttccaaccaaacctcagctaatatagttagggagacggataagaaattgcataaagggagaggctttgtaaacacgcaagtttacgtcaacttgacacatataaactcgtatataggaattgtgtaaaatgttaatcaatatatgtttatgaatatagtccttttatttccttaatctatagtcatgttatcatcatatcggcaagaaaattactattacaacatatgtttccgtgcttcgatttgtcgatcaggtaggcaaccaaaccgggccagattagtcacaaatgaaattaggctccactttggcaagttttttcacaattaaaaattagaaagtctaaccaaactaatagaaactgaaccaaacaaaaatgttcacgcaattacgtagcacttctctatgaaatactgtggataattcgatttgagctaatctatggtaagtcgtttctctcaaactgaattaagctaaaccaaaccgaaaataaaccgttgtagaacacccataataaacatatatatgttctctactcttatttggctatttttccatttgcagatacgtgtgacaacattccaaatataggcacatgatacaaattacaaagccagaaattataatttataaactatacataataaggtcagtagcctaattacatccatatatttagttgggcataataaggatagcctaattttggtgcatcccgccaaaaattcggacaaatggtgaatttcaaaccatgaatttctttgttatacatacattacgtgcactattacatcaaagaaaaatagtgacgtgcataaacgtattttcttcacataatctatatataatatatacagccatgtacatttttcaacatagaaaaatcatgtatacaaatacggtaggtgcaatactgataaactgccattcccattgcattagacgctagtcaatccaaaccttataacataaaaagttatagtccatttctttcatatccaatcgagtcaaaataatattcgagcaaaaaacaaaagaa

SEQ ID NO: 8985 - DNA, 3000 bp, Unknown
  misc_feature (1)..( 3000): cDNA_ID_1989335_gDNA_ID_1971953_Annot_ID_58651 3000 nt of promoter + ATG
gacttttatatatatgaagcgataaagaagagcctatttggtgttttctccaatgatgtgcataaaatatatataattaacaaattaaaaatacgttaactgagatctcagatactcaggtcattagtacaaagtacaaacgtctaatagaggccaattttgtcatccatattcaattcaaaccatatcatttgccataaccgtacccatatatagatatttgttagtctacaaaagactgtataaatcgttttatcttgtgttcaagccatcaactatgatatcaaattaccagatcactcatgctaaagaatccatcgaaatgtattaagtttgtcgaagttcgttactctatatggtggattttaaatatttgatttggttagataatttttagttataccgtcaaataaatttccaactatttagtcagcgaatttaaagatcaaacactaatcatcagtaatggtttgctgaaaatcgtcagaatttcttttactagtgagcaagttttaagatgaaataaaaggtgtgaaacgaaatagagaaaaggtagagagggaagagacaagcgtgagacacggagaagtggaactgatctctttacgttcctcgtacgtttaccaagttacactgctttccatatttctatattattattccctccatccctttcttcacatactttatgtaacttctttttaaaaaccaattatttgtattctaattgattgaatcaaatagtttctataagactataaataaacataattcgaattcaaattcggcagcgttgaaagatatatgttgaacaatacattaccacacttattagtagaatatatttatttctagagtctcaaaacataagccaaaaagccgaaagcacctttttatctttgtgggtttggtgcaatggatcatatatatggtacattagcatttttatcatctttctcttttatcatttttcttgtattgtcgggcttgcgtcaggcctgtacttatcttcatacaacattatttatgtacataaccagaattcaggccacaaacaatacgtgagctattcaggatcacgaggtccacgcgctcgctcaccttcctctttcctcaaaggctttagctaattgttaactagatggaaaacagtgctatggttgaattttaacatattggttactactatctcaataatattttgtaatacaaatgtcggtagatgaattgatataccaccttcatggatgatgaagatccacttttaaagcccaattttttgtttttcttcgatgccgaaatcaatatgggcacatgtggatcctactatagcagttcctcaatttgagttaaaaatctttgggttttaggcttttagcccaaggaaaaaaaaaaaaaaaagaaccaatttttattttttataatttaataagaaccaaattattcatcattatatacttctgacaacaaatatttactatgtatattatatagtgaagaagctgtgacatgaaacagattcaagccaatcgtctgattagctagagaatcactgtcataatctattagttgacaaagaatgaatgacactagtacagtagttaatatgagtgcggattctcgtaatctcaacgtatctacgtcaataagctcatttatacatcattaaattaaagtacaacattccaatttatgtttggtgggttcctttttatcaagacgtatacgattataccaaacctttatccataattatttttaaatgatacatttcgtaaatattaatattacgattattatttttaaacctaaaatctttgaattttataaaattttaaaattgataaaaaagatacgggattttttttgagttaattgattttctaataaagatattggattcttagtgttttttttattctataatttatttataacgcggaaataaaaagcaaaataattaattaagtgaggagagttttaatattttgatgtttatttctaaattcatctcttttttccacttctgttcagctctgatgaatcttcttcctctgttactttgatctctttctccatccttgtctctgtcgattctctgagatatcttctctcgagctttttcccgcgttatctctctcccactcctggtaatattttcttcttcttcttcttctagattgttcttccgttactagctcttgaatccatttccacggatctctgatcttcaatctctgttttcattctctctaatcagttgttgagcttgatatttttagctaacgtttttccgattcaaatttacgatttgtgtgttttccgataaccaaatcggatatcttcagctcaaactcgagctccgatttcgtctcatgttgtagatctcgacgacttcgtatttgtctatggtttgctgattgtattcagattgctagatactcaatatagagcttacttttacctcagctagggttcgtctttgttgtacctttagttgctgctttttgattcttgtatatatggattttgattgttcaatcgtaatttctggttcattgaaaatcgatttattagtattcgaaattggaactaagatttagagattgcgaatttgatacagaagtcatttcaaagtatcagagctataaaatggtgcttagctagtttctggtttccatttctggattttcattcaaatacgaaatctattcgtcaaaatggtgtcactagtgttctgtagaaatttcattacagacttttagttgttgcctagtatcaactcatatctcagcggtagatatgatgaatctactagacatatttttcaattatcgcctccttttacaagtttatcatgtcattattttgttgataactacatgaatgctggctgaaatattaatttgtctctttttcctcttaattggttcaggttggagcttgatgtctaaattgttattgaactgctggagtctgtcttgctttaagtagaaagag

SEQ ID NO: 8986 - DNA, 3000 bp, Unknown
  misc_feature (1)..( 3000): cDNA_ID_1989334_gDNA_ID_1971953_Annot_ID_58652 3000 nt of promoter + ATG
ttctcattatgctgcaatctgtattgaagatgatgaagctagtggaggtgcaattttcagttgacatatctcttgatactgaaaaatccattttattcagtaatttcttcatcacatctttttccttcttgcaggagctcctatgagggtgattgtccgaaaaaccatcccgtttgtagaagatgaacttatatctgaaagcaaacttctttagttagtgtagccttaaaccttcagatttctctgtaatcattctgttttgagtacatcctctctgtagtatacattctgtgcaagcgaaaaataaaagtagcctattattggaccatcatgtttgtgagacacttggaagatcaccagtaatctttgcacgagcagaccccgtctttgaaatagtggaaccgagatgcatcccttacaacaaactggcgatctacaatcttgctaacctgcttgaggaacacatgacaatcttcacaaaccctcaaattctttatcacaagaatttctgtgcctggaatactgttgagaatcccaaaagctattgctaacctctcgctatgctcacgggtagtgctcgaaacctcttcgcctctatcacagtccatgtttcccgcaagctccatcacagaagtctctaactcatccaacattctatggacttcctctgtttgctcatgacttctatcgccagctaaaaacaagtgaactcttcccttgtgttccacataactatacccaggctttttcctgaatgctctctctctcatcattacccggattctccagattccttcttggtttttcgagtctgaatatatatttgacatcaatacatagtagccaatgttattgggttcaaactcaatcacctttgcaaaagctaactctgccatatccacattcttatggattttacaagcacccaatagagcaccccaaacagcaccgtccggttcaacaggcattgactctataaactccatggcttcatctagccgaccagctcttccgagtagatcaactaaacaagagtagtgttcaggaccaggctccagcttatactctctcttcatcgctctaaataactctaaacctttatccgttagccctgaatggctgcaagcagataaaaccattacaaacaccgccccatctggtcttatgcctctttttatcatatcatcaaaaagcataagcccaatctctcccattccatgcatcccatagcaaccaatcatggcggtccatgaaactaagctttttacaggcatgatgtcgaaaacagcacgtgcctttgccaagttaccgcatctagcatacatgctaatcgatgcattgcttacaaaaacatttggtacaaaaccattggattctactaacttccctacttcgtgaccaatcttcttagctccaagatgggcacaagaagacagaacactaaccaatgtaaaaggatcaggacaaacacccgatgatttcatctgctcataaagttccagaacatcgtaagctagcccgttctgtgaatatccagaaatcacagcattccaagtaatcaaacccttcacaggcatctcatcaaacaacctcctaccagcttctaccgacccgcatttcatgtacattgtgatgaaactattcaaaacagctacttcagaatccagtcctcctttaacacattgaccgtgaagagacctcccaagccagaggtattcaggaaccgtgcatagcgggacaagcccaagcattgtaactgaatccacagacacaccagtttccttcattctacgaaacatatacgcagcatcagtgaccttcgagtttgctgtgtacccagatatcaaagcattgtaacaaacactaagctgacttgactgaggattttcttcgaacactttacgtgcatctgcaaccaaaccgcatttacaatacattgagatcagagccgttagtacaaacggctcagtctcgcaaccgcctttggtcacgtggcaatgtagctgttggccggagacagggagcgaaagggaagcacaagacttgagaatgaaagggaaagagaacgcgtcgggagaagaaccagaacggagcattgaccggtaaagagatatagattcagaaaacaatgactgatatgcgagctctctcaaacgtacgttccatggcgtcgaagccaccgcagcgacggcggagttccgtacaaagcttgtaacgacgatcatggtctcccgcgctgattatgacttgtttgggttaaaacgcatagttctaatttttatgagaataaggcccaaatagtatgggcctgtagcccaaagtaatccgaaaatttgggggaatagagttatacgtaaaaccaaacgggtattaatctgtgatagaccatttcttcttctcagatactttcctccatctggaaatcgttgccgccgctatttcctcaataaaccagattaaaccttctcttcttcatcatctttctcaaccgccgtaggttggagggaagctcgcgcggcaagtaatagccggagcagcttccgaccaacggatcggggttactaggagctcagtttctggtaagagaatcggtttaatcactgttgttttattacttatggtagctgagtggttttcgaatgttatctgattgattcgtgaaatatcttaagattgaataagatcatcttttgtttgtgcataaggggaggataagctgatagtagaaaatctagattagacaattgatggtactgagtaataactaataactaaccttaggagtatgattggtttctagggttcttatgagatgtattttgcgatcatgttcctttctttttcgtcatttttatggagtttcatactcggagttgtattagtagctttgatcagtgtcttgcgaaaacaatgtgtttttaaaccaggccttgtgaaaccattagcctttgtgtaacatctggagtttattgtgctgttctctcgtttacttggttaatg

SEQ ID NO: 8987 - DNA, 3000 bp, Unknown
  misc_feature (1)..( 3000): cDNA_ID_1375398_gDNA_ID_1971953_Annot_ID_58655 3000 nt of promoter + ATG
taaataaatttaaatgagactttcgtgttccacatggtctctcatccctctctactcggaaatggaactgttgatacggacaacggagtttttctcgaccgcaaaacataaattgtcgagtactatttgtaatttgagatggtttacgtaaattgaaatagtcctttctgatcataaatggcctgttttctccactcttttaaatgagtttggattgttcatagacagattttctcatttttttcgatatatgtaaatctccgattattaaattgtaggccggattgttagataaagcttctacaactatagatttgttgagttgtcatacgtaaacagttttgcttcaaattcactaacctaggaccctccttttgatattaatgtgtggttgttagaaaaacaatttttcgtgttccatataattttagaattacgtggcatggaacatttacatcggggataaattaagcgtcgtccacagattttacgacaatgctccatataagaacatgcattacaaaaaaaaagggaaaaaatgcatgttcatgtatggtcgtctgtctgtttataattgaaaaggactttgatgttgttaatgttattaatggagattactttgaatctcacacggtttgattaaacgaatcttcgtcagcacacactctgttcacacttattatttgagactagcagaagaaactcactagtttatcatagattctgaccttcgcacttgttagtcttttaataacttgaagatactcgccattgtatatcacaactaggcgatttctcgttcatttaaaatgttaatattcgtgtttaatgtatatttaattgaagtaatgattttacatgtacaaatgtatcctagtattttgaatcttctagtaccaagtggttttctcttcgattacctttttgtcttttttcattacaacatgaacaacaccagcaataattaaaatatcgtgctttttgtttttgtcattttttggggtcatacatatataatatatacacgtaagttcaaacatttgtttgttgttctttttgtttgtcttggattcgacatccttagaaataaaaaccacatttttaataacgaaagttcattaaaagtatttcgaatattttaggcatgttggtttgattagagtttgtattccttattcaaactaatgtcgttgttttttactgtttagatcgaaagaaaagttttttttcgtaattttcgtttatttattttgtgaaatcactagcaaagaaaaacgtacgtgactatcacatcaaaccactataacatctcattttatctatcgcttaattcgttttttaagatcagatctgagatcattgtgcatttcaattgtaaaaccgagcctaaagtcaataatataacattatttcagaaccaataatttttaacagacgttgtttgtttttgggtctcaagctgaacgactttgcaactagtacacttggcatatgtttcatgttttttttataaataatgtgctaccttgatgaagttccctctctctataaattgaagtgtgtgagatgcatcatccatacacaacatcttccatcttccgataattctcctttagtcttataatcactaataagtacgataattgaaatggatccaagattcatcaacaccattccttccttgaggttcttatctccaattcatgtatcattaatgcaacacattcacacacacacacacataaatattctgtatatagagttaatgcttcttaatttgatttagttatttaaatatagatcgatatatatccatgcagctgtttatgtaacaatatatgcatgtatgtcgcgatgcaggtatgatgatgataagtgtgatgatgaatatgcgtttgtgaaagctctatgtatgagtggtggagatggtgccaacagttactccgccaattctcgccttcaggttcttcaatatcttcgcttacttttagggtttaagcagaaacaaattattaatgttcagatttttctctggtgatacaaacatttttacaatcatttaattatgataaaattgtaaaaactgaacatgaactaactaattgtcaatatcaaatattaaatgaatttacatataagaacataatatttaaatgtctttatatgaattgcaaaaacttcaaatatattatgcatgaagtagaaaaatataaacatatactcaatagaaatagattttcttgtttttaaaattgaaacatatgttctttctatctatatgttgagacagtctttaataaaattctactcaaaaagagaagttatgaaagatgcatgatttccatctattttatccaatcaaattcattcatatcatatgttagtttgtttttaagaagtttacatttgtatttaggaaagtaaaaatatattaaaaatataagtaatttaaaacgaaattataggtttcatttaaaataaaaaaaataaaatataactaagatatttatgttagattaacctctactaattgactaaaaaatggtatatatgttgaccaaaaaagaaaaagatactaatgatacaattactaacatatgcgttctgttaacgacggttctgccaaacaaattaaaatgttgataaatgacgattcttaggactagtataaattctctaaattaaaaagggctcattacatcacctataacttataaacctacaagtcattaaagaataataaggcatgtacatgcactagtcaaattgtaaactcgaaaatgcataaacactagtaatatataaatgtatataactcaaaatcatatattgttgttgttatcgtatgaagcatgggtccagtatcacattatcacggatcgacatactgtaaagaaaaaaatcatattttctaaacgaattataaaatccagataataatactattttttataactaagcttctttttttgttgttttttttagaaaaaagttttatca

SEQ ID NO: 8988 - DNA, 3000 bp, Unknown
  misc_feature (1)..( 3000): cDNA_ID_1989331_gDNA_ID_1971953_Annot_ID_58656 3000 nt of promoter + ATG
cgctctggagactggaatcaatcgagtaaagtgttcgtagctgagaaaaaccctaagctctcgtttttcgtcttctccgattctgcaagtatgagtcgatcaggtcagcctccagatctcaagaagtaagttctcttcgccacttttttccttttgatttctaatttctctgtatccatttagttgaagtttttggtttcatagagctcctacttcttcgtgtttctgattttgttcttcgtttgtttcatgtaatgcaggtacatggacaagaaactccaaagtaagctcgatctcttcttccactttttcaattttaaagcgtctttaagtcgaacctaaatctcttactcagatgagaattgcttgcaacccgatttctcaacttaagagctatattaatgccatttcagttcatgtattacttgggattgcgtgtttttgtgtactaattaaacttgtgtttacaattccaatatatagattcaatgctaatcttggttaagaatatatcaatgtcacataaagttaagagttgtatggattcttaggttttgtatctcgttcatttagaattttactagactttgtttgttatcatgtttttgtaacttggtatggtcaagtgaagttcttgtctgcttttttttgttgttacccccaatgtagttaagcttaatgccaacagaatggttgttggaactctccgtggctttgatcagttcatgaatcttgttgtggataacactgttgaagtcaatggtgatgacaaaactgacattgggatggtggtacgtttctctccatctctctaactcacccacagaatcttcttgtcatttgttttgtttaaacattctacttttttcctggatgcaggtgataagaggaaacagcattgttactgttgaagctctcgaaccagttggaagatcttagcttatgacttttcacccccaagtaatcatcttctgtaatatgagactttgacttactttgctctctgtaccggcatgaatcaatcttgattttatttgatgaattcctcttctttggctcctctacttatgtcattttacccttgttcggtcctgtttgttccctatagatttttctgaacccttgatttgatggatacaaggaaatttggatacttactgtccttgtgttataatctcttatcatatgtgttagtcaggtataagttatataatcatttcaagttagagaaatcaatgtagtaatgaaaaagctaattttgaatggtccaaaccttagagaaagcaaaatacttttgttgtggggatctgaattttgggtaaatgagctccaacggttgtttttcttttgctttattagtattttaaacccttttttagccctctttttatcaaagtgagatcataatcatgccgtttggctcctctgttactattaaagatgttgttatatgaataagaagaagctaaaagaaagaaaaggagaaataagagaagtgaaagtggaaggaatcaaggaagcatgtgccccacgaagtattgtgtgtgaggcaaaatgaatgaaatcggtacaatatctatcaatctccaatgaaacagcaacaacaacaacatgtaaccacaacggaatgttcggcacgtgggtcgtcgtcggcacacacgtggggtgggctttgttccaacttacattcatatcaagtattatcaaccacaaaactatgagttgaaatgccttttttggtagaaaagtaggtatttgtgttttgtctataaattctaaattattttctgtccaagtcattatacaatttgatgtgttttttaacatttcgtggtcggggatctccaactaatataacaagtaaacgaattttaaacacatggatttacaactaatccaaaaagaactttcaccaacttcactttctcttttattcttttctctttggtttttggggaagagaatagaaagagtacgagagattgcttctttctaaattctaacggtaaacaaatattacataaaaatgttaaccatcttcgtatattattctcatggaccatttgcaagtaactaaaagattcactttagatgcaagctgttcaatgaacttcaccatccttttttttatttctttcaaatttgattttacaatatcaatctcatttttgtttgtcacaatatcaaaatctcacatcttagcgtggattacaatttgtgtttaactattccatcatcattaaatttaatgaccaaaagccatagaaattgtgttattatggatcattggttgttattaggtttaccaagtacatgagactagtctcattgtagataatcttttactatttttttttctcaactgattattatggatttatgctagatttcttcttcttcttttttgtgtgtggtacattcatccggcagagaaatgatactataaaagttaattaatactccaaatttgagatatcttgtaagatttgatatacacatagaaacaaaaagttattacataatacaaaatttgcaaggtttctttacttcataaagagaaagacaccaaaaaaaaagtaagtcacaaaataaaaaagacagctcgacattcatcttcctcgttaatccttcatcttctctcaccaacctccaccaatctctctctctttcttctctgtgtataggatacgaagaagaagaagaaagaaagaaagattgtgaagtgataattacaagccaccaactaatatcctttcttcaattcaactctacgcgtcgcttagtaatacccaaaaagttttaatcttttgagtttcccaattattttccccaacagaaatatcattaattactccactaatccaattttctaggttttctctttttccccctaaagattgattctttatagccattgattttgacctctccatcactgttttcagagagtacccatcactccaagatttgatttttttggattatcctttgagaataatg

SEQ ID NO: 8989 - DNA, 3000 bp, Unknown
  misc_feature (1)..( 3000): cDNA_ID_1008840_gDNA_ID_1971953_Annot_ID_58658 3000 nt of promoter + ATG
cagtttgattgtttatctgtttggagtttgcgttgatatatgatgtttatcccttttgtaatgatgtgacttgcaaattgctatgtaacctcaagattaagcatagagttatttatttcgaagtttactaaattgcattaagtaattttgtggccttgtgatttaattaagagacccatgttcattggataaaaagcactatcttacaacaatggtatattaataaagtgagaatgctacctttcttgtaaggtggttcatataaaatataaattcaaacaaaaaacgaacgaccaatctttaatcgtttacatgaactgtggtgtgctaataaggtgataacaatatttaaacgttgctttgactcccttaaaaaagaaaagaaaaccaattataggaagaaatcaaactccaaacttgtcactaatgggaagaaataaaccagtaattaaaactcggaccttgtcattaagtgtgtgaaaggcgtgaatcttcacaatcctataagacaaaacctccttatccaccgttagatttaaagttcatcatccaacggctagaagtctaatcccgctaataatttgaccgttgcgattatgcttttaatggctcctcctctcttctctatcccttaagcgctctctctcaaatctcaatcatccttcttctcatctagaaaccccttatcttggagtaatcagagagtttgaaaacaccagaaatcatggcgacaggaccagttgttcatcctcaaccagttagaggtttgtttctcccctctgatgaatctttgttttaactctaggatctgcataaaaactctcatctatgaatccttttatttagatgttatcaaagattgcttacaaatctgttttccaaggatccaaatcttgataggttgctttttgttaaaatttatcaggtgatcccatcgacctcaaaaacgcagcagcaaagaatcgtcgtgctcttggcgacattggaaacgtcgattctcttattggagtcgaaggaggaaagcttaaccgccccattactcgtaactttcgtgctcagttgctagaaaacgcacaagttgcagccgccgctaacaaaaaggctccgattcttgatggagttactaagaaacaagaagttgtaagagcggttcaaaagaaagcaagaggtgataagcgtgagccgtcaaaaccaatcgaagtgattgtgataagtcctgatacaaacgaggttgctaaagctaaagagaacaagaagaaagtgacatactcttcggttcttgatgctcgaagcaaggtagattctttgttcaacattgaaagcataatgtgcaaagttctgattatttggttttgtgattggtgtacacacttaggctgcttctaagactttggatattgattatgtcgacaaagaaaatgatcttgctgctgtggaatacgttgaggatatgtacattttctacaaagaagttgtggtacacttacagtgaaaccttcttttgtttatgcttatggataagttatgtgaatgtcttctttaagtttgttgttttgttctttgttgcagaatgagagcaaacctcagatgtatatgcatacacaacctgagattgatgagaagatgagatcaatccttattgattggcttgtagaagttcatgtcaagtttgatctctcccctgagactctttacctcactgtcaacataattgatcgttttctttctctgaagactgtgcctagaagagaactacagcttgtaggtgttagtgctttgcttatagcttcgaagtacgaagaaatctggcctcctcaggtcaatgatttggtatatgtgactgataactcctacaacagcagacagattctagtgatggagaaaaccattttggggaatcttgaatggtacttgacagttccaacacagtatgtgttccttgtgaggtttattaaagcctcgggttctgaccagaaactggagaacttggttcactttctagctgagttgggtttgatgcatcacgacagtttaatgttctgtccttccatgcttgctgcatcagcggtctacacagcaaggtgttgcttgaacaagactcctacttggactgatacactgaaattccacacaggctactccgaatctcagctcatgttagtcttcttaattctttacactagcaagtttgtgatcatattgtttgtatattaattctctatgtgcgtttctgtgtgtaatcagggattgctcaaagcttttagctttcattcactcgaaagcgggggagagcaagctacgtggtgtgttgaagaagtattcgaaacttggaagaggtgctgttgctctgatttcaccagccaagtctcttatgtcatctgctccatgaacaaggcttgaaagatggctctcttgcaaactctgcattttagattctctatcttttatcgttttatatgtaaaggtattggttcttgttgagaaatgatgtttccgtatgaattcaaaagtattataatgaaattcttcttctcttctataatcagaatcgttttggtcctttttcccatcatattctttaactatggagtcaaattcaaattacatagttatctgttataacttgaaaacttctttgttcttcataagaccaagtacgatggtacgatcaaggtgaagttgttcacatttgtcaaataataatttccaataagaaatctggtgaattttgttacttgtcaaaaaaaaatcaagaaaattaacaagactaatagtaataatcgaacgacgacgtaatgtttaagaaaaaaaaacaccaaacgacgacgtaatgggtaatgaaagtgatgagggtatttacgtcaattcatagaggtactccgatgtaaccctaatatataacgtgcatttgtagcgccgtgagtgtccttcttgtttacactgagcagaatctaaaaacacttatcgtttcgtctcttctctgatccattgttgaagatg

SEQ ID NO: 8990 - DNA, 3000 bp, Unknown
  misc_feature (1)..( 3000): cDNA_ID_1989330_gDNA_ID_1971953_Annot_ID_58659 3000 nt of promoter + ATG
tgtttaattttgtgagctagggtttctgggttttgcattgttcaaactcactcattgtttgctcttttctaaattttttccgatgctgatttcttctggaatgctcaaattgctttcttggtacagtgtaagttctaagacttgatgctctttaattacccttgttgttacatctgccagtgtattctcgtgtgtcgtgatcttacagattttatttttcttgattgcacagacttgctggacttgctttcatgttttcatctagtatcctcctacagatcctggtacgtttctgaatatagctatctgcttataacccttgaagcttgatcataagatcatgacttagtagctttaaatcctgcaagagatggttagctagttctgctgttaggttgtgagctgagtatactggtctccttttgtacccttgttgatgtagcaaacagagttgtgagtcttttggcccgttttactgggagagatactctgtgaagtaaagtttgttacattcaaaccttctttcatatttgaagttttgagctttactctcttgtagtatgttgactagcgatctctggatcccaaaaaccaaaattacacttagaattcttatccttacaacactatttgaccggagcatatggtaagctggggtccttagccgacctcaatgtctaacttgttaattgacttagactttctgaacaacttctataaactcaagcatcttctctcctcagcttatatcaggtccttgtataggtatagtttttttttttttttgcacttcgattagaagaagaaaggatcatctgatttacaaatctgatacgtttcccatattttgtgatttcctttggtatacctggttataccatgcaatgagtaacacgtgttatagtcatctgggagatatagtgataactatttgttcataatggtcaggcatgcgcgatatatggtaactggtggccaatgctatcagcactcatgtatgtagtggtgcctatgccttgtatgttctttggaggaggctcaacccaattccttattagtcgggacggtggagggttagttactagagactttattgcttctttgagttaaacgaaagatcgattaccaaattggctcgtccataaaacgcaggtggatagacgcagcgaagttcttgaccggagcatcgaccgtgggaagccttgctatcccaatcatcttaaggcacgcacagatgatcgagacaggtgcaatgctcatagagttcacatcattcttcatattcatttgcactgtcatgtgttttcaccgggctagtctcgatgatgactggtaacgtagatgttgctgctcgtgaattactaattggattcgtatgagaaagagagtgtgaagaaaagatgaggttactatgagtggttaagaaagttgtgttcttctccctctttttgtaaagctttgtatcactcaatgtttgtaaaaagttttattcatcactgtgaatcttttcctgaaactaagtgccaaaatattttgtttcgcatgtttaggaaaaagtttaattcatcattgtgaatgttccctaatccctagattagcttcgagagattaacaaagaacggttcaactgtaacacgtggtcatgaaataatgtccgaaggcccttcagataataaaagcccatgaacttcataagggtagaagcgtaattttaaaagagacccctttcatatatatatccttgcgattattattagccgtcatcgtctagggttggttgttctgcaatttagttttttttttttgtgttttttataatctgcagcatcgtttcttgtaatctgaggaattgtttttcagactgcacgatcgtttaattttgttacgttggttgtttctttgaagtgaaaaacggcgagggatgatgattcaattagatgtgcgaatggtttcatcatgagctcaaaaactttatttggcattttataatctgacttcgccgtcaactcttttttctgtaatttggaggaatggtaaatggatgatgattcaattagatgtgcgaatggtttcatcatgacctcaaaaactctatttggcaatttatctgacatctcccatttctctatgttcaatccaatatatctcctttatgtggttttaactcgatattgttttattgtctgcgaaatgtttgataatgatgagttaacttttatagagtgttacataattattttacttattcatattgtagttacgccattgaaaaacagtttgattgtttatctgtttggagtttgcgttgatatatgatgtttatcccttttgtaatgatgtgacttgcaaattgctatgtaacctcaagattaagcatagagttatttatttcgaagtttactaaattgcattaagtaattttgtggccttgtgatttaattaagagacccatgttcattggataaaaagcactatcttacaacaatggtatattaataaagtgagaatgctacctttcttgtaaggtggttcatataaaatataaattcaaacaaaaaacgaacgaccaatctttaatcgtttacatgaactgtggtgtgctaataaggtgataacaatatttaaacgttgctttgactcccttaaaaaagaaaagaaaaccaattataggaagaaatcaaactccaaacttgtcactaatgggaagaaataaaccagtaattaaaactcggaccttgtcattaagtgtgtgaaaggcgtgaatcttcacaatcctataagacaaaacctccttatccaccgttagatttaaagttcatcatccaacggctagaagtctaatcccgctaataatttgaccgttgcgattatgcttttaatggctcctcctctcttctctatcccttaagcgctctctctcaaatctcaatcatccttcttctcatctagaaaccccttatcttggagtaatcagagagtttgaaaacaccagaaatcatg

SEQ ID NO: 8991 - DNA, 3000 bp, Unknown
  misc_feature (1)..( 3000): cDNA_ID_1989328_gDNA_ID_1971953_Annot_ID_58661 3000 nt of promoter + ATG
cagaaacgtaccaggatctgtaggaggatactagatgaaaacatgaaagcaagtccagcaagtctgtgcaatcaagaaaaataaaatctgtaagatcacgacacacgagaatacactggcagatgtaacaacaagggtaattaaagagcatcaagtcttagaacttacactgtaccaagaaagcaatttgagcattccagaagaaatcagcatcggaaaaaatttagaaaagagcaaacaatgagtgagtttgaacaatgcaaaacccagaaaccctagctcacaaaattaaacaattcacgaagcacaaaataactataatctgagtaaatcaataccaatctctaatacgtatggaatatatgaacatagagcaagggagaaaagtaaaaggggaaaatcgacttgaatctgattcgattccgtcgggaaatgatacagttggaagataggtgattgattaccttcgatggtcatcgccatgtcggcgaatgaaaatgttctgattaccggagatcgagtcttgaatgatcgccggtgacgataaaagagaaggtgatgatttcgttgttccccttagagagatacagaaggagagagcccagagaggagtcgcgatttgagagcaaaatgaaaattagtgaccggtcaaaattggttttctcaccgttcatcgatttcatctttttggtttggttggtttattttggttataattggtttccaggattgtggttttgataatacagctagtagtcgattttaaaatatcacaaactaaatgacatgaaaaaaaaattacgatcaaaatttgggttgcaaggaccacataaaactcattcctaaatcatacgtaataaaaatgattttataactgaaatttttaaccaaagttcataccaatcatcaaaatatgtgaaatgctaaatatttttttcttttcattttttgttatttaaatgcaatcaactatgattgaaactgcatcaacgaaaaagtattattaaactattaagcaaccataagttgagttgattcgtttccataattttagttagagtacgtaaatctccatcataatacactatctatgctatcattgtttgttttttttttcttttttttgctaagaatgtaaatatcattagaaatgaaatgtttggtattacaagagacgtattacctaaattaaattaaccttggcaaaaagaaataaaaacaaggttaagataaagagtagttaatcaggagagattaatggatccaaagtagcataagttgtttccaatgctttctatgtcttcgagaagtaatggtattgcgcacctcacgatctatgctatcatggttggtgcgtttatgacatgctgctgctggtgacgattcaaaagtgtttatcagttgttcattatgatgccattgtgatgtaccattactaatttcttacttaaataaggtgttgttttttgttttgctccaaataataaggtgttgtttaaaaggggctctttcgttttggagtaaaagtctctctgagtagctgtatattatttaagtagcatagtccaattatttgacaatgaaaaaaagtgtatagtccaatgaataccaaatgaattgacgtcaccactagttgagacctgagacaagcaagtgatcgttaaatcaaggagaacgcaagtggacgaggccgacatgatcctaactattggactcccacttgtgaaacttacttgatccatttcccacttcataatttcgtaaaaaaattaagacaatgagaatgaatttatttatttatttttcggtagaacaatgatttttattttgtccaaataaaacaatcgtgaaaaattatgttttggacattatcaactttgtgagtaaaacaaattttgtagtttcttttaaccaatattttcgaagtcaacttttttctacgtgtgagtgtattgagtaaatgatagatatgtcaataataacataactcatcaatcaatctggcttcaatagaactagagaagttataacgtttttttttttttagacaagagggttttataactctagactagtttcatagtccatgaaaaaaacatcaaatctcctaaatggctggacataattcagatgattttgtatgaaataaaacataaaacatatattttcttgcatatctggagatttttgtttctttattacaatgactaattaatttaccttgttcctttttatttttgcaaaatgattactgttatctattttgtccgtttctaataaaataaaataacaatctgagctgtggaaagaaaaaaaaaggaaaagcgaggagagctaatctgagtcgttgcctctgtccactggctcggaccgacctcgtacctctttcatttgtcctcgagcttataatagaggctacgccgtcgccgccacctccgctccatccattcacggccaagcgacgactccaccgcttaggcttggcgtctgaggtatactgatcaacgctttctgttttcggaggagcgaggcggagatcagcttctcttatgtctactcaaacatatcattcttctttagccactcgatttcttctctagcggctccagaggtttcgtcgctacagagtcaagttcctcttttcaggttttgtggtaagtaatcgttaaaccctaagtatcggaccttgttgtttaatctgttcgtgtttactctcaattacatatgcattcttctgcttaatcgtttcttttagtttaatttctagggtttacatcccaaaggtctgatctttttgcatatttgtgtgaatcttagtttttttttttttttttggaattgaatgtgatgagttgggtttgatactgttaaagatcaaatctttagcttcgttgaagcttcatatttatgtcaacaatgcaaggtttatttttcttccacctttgatttgatatttataattgtttctttgaaggtgaacaagattttagttacaaaaaa

SEQ ID NO: 8992 - DNA, 3000 bp, Unknown
  misc_feature (1)..( 3000): cDNA_ID_1989739_gDNA_ID_1971953_Annot_ID_58662 3000 nt of promoter + ATG
gtttcatggtgcgattcaaatgtaggtgttctttacagagatgctggaaatataactatggctatcgatgcttatgaggaatgccttaagatagatccagattctcgcaatgctggccaggtatctatactttagcgtggtcttcttgttatgaggttgaaagatatatgtgtttaaaaccttcttgtccccttttgtagaaccgattgcttgccatgaattacataaatgaaggactcgatgacaaactatttgaggctcacaggtaagcacatatattattaatgtagatttgtattatgttgcttttatgggtcttacagtgaaaaaatcttctgaacacagagactggggttggcgcttcacaagattacaccctcaatacacttcatgggataatctgaaagatccagagcgacctatcaccattggatatatctcaccagatttcttcactcattcagtatcttatttcattgaagctccccttacgcatcatgattatacaaagtacaaagtggtggtttattcagcggtagttaaggtaggatttttacctatataacttatatagatacattttccctctaagcaattcatttcctggttctcgtggcatttttcccttttgagcaatcattggtctctcatggctttgcaggcagatgcaaaaacatacaggtttagggataaagtgttgaagaaaggtggagtttggaaggatatatacgggatagatgagaaaaagatagcaagtatggtcagagaggacaaaatcgacattttggtagaactcactggtcatacggcaaacaacaagttgggaacaatggcctgcagaccagcaccggttcaggtgagaggatatattaaacctatctcattttgttgtttcgggttttgcctttgactttccatttcaagtgtacttatattggctaagataccaggttacttggatcggctatccaaatactacgggtttgcccactgttgattacagaattacagattcgttggctgatccaccagataccaaacaaaagtacgttttggttcaagatgcaattttgggtttcggaagtgctccaaataaaaatcttaatttttatttatttattttgtgatatttgattgcaggcaggtcgaggagctggttaggcttccggactgttttctttgttatacaccttccccagaggctggtcctgtttgtccaacacctgcgctttctaatggctttgtcacatttggtagtttcaacaacctcgcaaaggttaaaaaatttgtgtccttggattatgcacaccaatctcccctagtatctctttcaatgttttgacaggtttatctctgtttgtgcaaatcagataactcctaaggtgctgcaagtgtgggctaggatactgtgtgcagttcccaattctcgtctagtggtaaaatgcaaacctttctgctgcgatagcattaggcagaggtttctcaccacgctggagcagcttgggttagaatcaaagcgtgttgatctcttgcctttgattcttttcaatcacgaccatatgcaagcctattccttgatggatattaggtaagatttgacacatagtgctctgtaaaacaccgaggcttatagattcacatatttaatttacatttattgcagtttggacacattcccttatgctggaactaccactacctgtgagtctctctacatgggagttccatgtgttacaatggctggctcagtacatgctcataatgttggtgtcagtcttctcactaaagttggtaagctcttagcaaaatttttttttttttttttgcaaaaattgttgttagtcggacatcttttagctaattcagccatttcttgattcaggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctagataaccagcaaatcgagctgctgcgaaatgccggcagagagtcttgacccatctggaaaaggtgtgaaagaaagagtcgatgagcttttcctgctatttacttccaagacaataggaactagactttagattactgcttgtgtagtaaaaagaatagtaaaaccagctctttcttttgttgtatctctttctactcttagtttagctttacatgattcttgggaagtcgttaggtggtagtggatttggagtttttcttctcatttgagagatcaagttgttgtgtatcgattagggttttaaggctttttaggatgttttcatgtgttggattttgactcatatgatagtaaatatagttatagaaagcttttcggtgcctttacctatttcataatataattatctaaaactcctgcttaagcttaatcccataggtgagacccaatgaaagacttttgacttgtatgattatgttgccaactccatatctctctttaattaattaatatggagagagtaaaaaggcaagcaactaactactcttcaattcaacacttcttctgctccattgcttccaccagaaccctaaagaccttataaaacccaatcccaaatccctttgctcattcaccaccaaagcatccaactttctttgcttcctctttcaaagcaacacaaaatattaaatctcaagaaacaaagtaaagaaaa

SEQ ID NO: 8993 - DNA, 3000 bp, Unknown
  misc_feature (1)..( 3000): cDNA_ID_3409603_gDNA_ID_1971953_Annot_ID_58663 3000 nt of promoter + ATG
atatttaatttacatttattgcagtttggacacattcccttatgctggaactaccactacctgtgagtctctctacatgggagttccatgtgttacaatggctggctcagtacatgctcataatgttggtgtcagtcttctcactaaagttggtaagctcttagcaaaatttttttttttttttttgcaaaaattgttgttagtcggacatcttttagctaattcagccatttcttgattcaggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctagataaccagcaaatcgagctgctgcgaaatgccggcagagagtcttgacccatctggaaaaggtgtgaaagaaagagtcgatgagcttttcctgctatttacttccaagacaataggaactagactttagattactgcttgtgtagtaaaaagaatagtaaaaccagctctttcttttgttgtatctctttctactcttagtttagctttacatgattcttgggaagtcgttaggtggtagtggatttggagtttttcttctcatttgagagatcaagttgttgtgtatcgattagggttttaaggctttttaggatgttttcatgtgttggattttgactcatatgatagtaaatatagttatagaaagcttttcggtgcctttacctatttcataatataattatctaaaactcctgcttaagcttaatcccataggtgagacccaatgaaagacttttgacttgtatgattatgttgccaactccatatctctctttaattaattaatatggagagagtaaaaaggcaagcaactaactactcttcaattcaacacttcttctgctccattgcttccaccagaaccctaaagaccttataaaacccaatcccaaatccctttgctcattcaccaccaaagcatccaactttctttgcttcctctttcaaagcaacacaaaatattaaatctcaagaaacaaagtaaagaaaaatgaagaacgaatctaccttcattgatgtccctgcagaatccagctcagccatgaaaggcaaagctcctctaatcggtgtagcaagagaccacactactagtggctcaggtggatacaacagaggactcgccatctttgacttcctcctccgtttagctgccattgttgcagctttagctgctgccgccacgatgggaacaagcgacgagactcttcccttcttcacacagttcttacagttcgaagctagctacgacgatctaccaactttccagtacgactcatagatgcttgattgatcaaacagatgcttgtgtttttcttgagaaacacgtcacctaattaggtcatattttttcttcaggttctttgtgattgccatggcccttgtaggaggatatctcgttctgtctcttccaatctccgtcgtcacaatccttcgccctctcgccaccgccccaagactcctcttgctcgttcttgacactgtatacactcaaaactcttcaaattatattgctttaaaataaaactttagtatcaagtaaaatactaagaattgtgttgggaacagggggtcctggcgttgaacacggcggctgcatcatcggcggcagcaatatcatatctagcacacagtggtaaccagaacacgaactggctccccatttgccaacagtttggagacttctgtcaaaaatccagcggagctgttgtctctgcctttgtctccgtcgtattcttcaccatcctcgttgtcatctccggcgtcgctctgaaaagacactaatcaaaaccttatatgtgtgttcatcattattgtaaaatttatgtcaccattgtgtaattattactcatccatggccttgtgaattgtgttgtattaatctttttaaaaaggaaaatgaaagtgtgattgtagctctgcttttctggaaaaaaattgaaatgagtttctcaattttttgtccaccaaagcctatgagattataaatgtctcctatatttgtctctacgaaaatacccggtaatgataatgttacagtgagtagcagagaaatatcttacgtggtgttatcttagtggacgttcacggagttgtcgttggtcataatgtttctgtcttcctttttttggtttaaggataaacgagccttcctggtgccacgtcaccttttcgtcttctgctacttcgtcttcttcactaaatgattcagtattttctcctcaatcttctccattttctcaccaaaccaaaatcgtgaaagaatattttcccgcttcatgtagatggcagctagactacaacgacctgggcttgtatcctcaaggtaaatcaaactcactacaattttcagatcattcccagaaatttattagtggaattaatcaaatttggggttttctccgtcgtccatcttcaccagtgttcaattttcgattccgtttatacactcgcttagctcaatcattagagtaggtgcagcttagtttaagtcaaacccagaaaagggaaacttagacgaatgattcaattttgtactttgttcacggtagatcattcttttgattttagtggctgcttaataactgaatctcgccttttgtagctctacttcaaaaccatgtcttccaagg

SEQ ID NO: 8994 - DNA, 3000 bp, Unknown
  misc_feature (1)..( 3000): cDNA_ID_2993983_gDNA_ID_1971953_Annot_ID_177418 3000 nt of promoter + ATG
ctcattcttcaaagcctcattttctgtttattaagagtcactatccattatatagttctttttcttcccgggaaaaatctagaaatttcggtttatagtttacgtaaatgggaccaagaattaaaatcttactaatcgcgatttattggattttatatacgaattcatacaacttttgtggttgcaagatgatttgcgattgaccaacttgcactctcctaaaatttctttgtaactagataaccaaacattttttacataaaccatctctctgacaattactattaaactaatctgtttaaaacaaacattttgatggttgacacttattttgttggaaggaagagacaggggaatgtactttactggagctgtgaaaaccggttcttgattagagtggctacgtgctgcgcaacccatgccgagccagccaccgtgcagcagaatccgtgcgtgtgaccttccctctcgatagataaggaagtatgcggagcttgctttgaaatctggacaatggagagattctatgagagaccttccttctatcgttaggataatgcattttgattaagcgagaagaagggaaaccaagtaacctcttcaaagagttgcagtggaccccaatgatcatcaatgccaaataaaaatgcaagcttgctctggttttctctcatgaaatcccaatctggctctgctgcaagcttatatgccaaaaatgaaacagtggatcgtcacctagaatgctttagttggagatcaactatagggcaagcttggtcatgttgtagagctttcaagtaaacactttgcatactttgaattcaaaatgagactctaaactctatacaacacattgttgaaagaagagtacctctctaaactctgactttgccatgaagagaacattgcgcatggtgtgatactgcaagcatcagatgaagttaagtcgtctgaatagttagtagggaataagaacttaaagtatcaagaaaagaagatgtaatggccatcttcaagtctttatacaactaggttcaagtgtaaaacccaagaaaatcagtgaatatgagataatcaatacctgcctcaagtgagtgcaggtagcttgaacagcagtatcagaccatgaagctccaatggatttagatacaagcagccgtgcagctgacataggtaaaagtctcagcgatgcaatcagaaaacttgctgtagccgacagaacagaagacctgcacaacatgataacgatttcacaacattctaaataaagactgattggttctttcctatcgaggattcgtattgagaacaaaagctcacgctgcaagtttgccaattaatgattgctttgttgattgttggttcaaagtcaaaaatggatataggccaatgcaatataccacctgcaaagcattccagagaataatataagaaaaatcacatagcactgaaagaaattgtgatggagaaagtactactcttagaggaagccatctataccttgtccgagaatttcttcaataactcaagggatatataagacccaatagaatgcccaacctaccaagatcaattaagcttagagttgtaaattttcatgaaaatctggaaatccatccaactaatggacatatatattttggtcataagaagcaatatgtcaatggcttatacacatgacagtcttaccaatattattggaactttcacactctccaactcctgtctgataaaatcaatctgtatgataactaacagattaagatcttaacttcacaggatgaacaatacaagaacctaaaggctttcaaatccaagagcaatgaagaaaaatgatttttattaccttatgatcaatttgttcttgaaatgaaaatagcctcccagactcccagtcctaaaagtgaaaataatcaagtatcatgaaagcctatcaaactaagatattatatgaagagaaccatcaaagtttacacacagtaaaacctgaaaccaaagttaacgtaccttgctcgtgtgagatatttgcccaatagctacacaaataaaacaaaccactccaccattagagatcagaagaacaaactcaaactcagaaataaacagcttccatcttaaggactcaaagaaatcaaactcgaaaagtagagcagccataccaattacagaagcatttccaccaagaaactcgtataaagattccaaaaagtccttgtaaaatgacacaactcctgaaaaattacaagccaatgtatgaagcacactagtatatacacgtgcatgcataagagtcttgagcataataatgaaacctggatttcccggaataaacaatacatggaatgtgggattctcagcttgaatttccatcatctccgtcatcgaactttgatcacaaatacaaaaaacaaaacaaaaagtgtaactatagtcaaagaaattagaaaatttcgtaaaagattaatgtaacaatacccagaaactctgcacaatctggatttaacatgtcttttagtttcattcatcaatttgttttgagtctccatgtctccggtcacgcgattcaacttatatcttctctcagaactgtcaacacttgaaaggagaagatcgagagaattaatgagacaacagagaaaccactaaaaatcaaaactttgcaaaataagtgaagaagccttttaaagtaaaccaagtgaagagagcacaacaatgcacctgaaacaacaggagtagattagatactttggagaactgaaccaccgatcggaggaagaaagtaacggagagacggagttacccaaggtagaagaagaagacgcatatttgcagcaatagtaatacgacctcgttttgagtaacgcgacgtcgttttatgagtttgggtgtcgtcaggcttatctccacctcatacttccactacaaagagaggtgattgacagatagataagagtgtttggtagctcagactcagagagtcacaaagtgtgtgtagcagca

SEQ ID NO: 8995 - DNA, 3000 bp, Unknown
  misc_feature (1)..( 3000): cDNA_ID_1989324_gDNA_ID_1971953_Annot_ID_177414 3000 nt of promoter + ATG
acaaaaaattattgtattttctaatttttttttttaactttattttctttacgaatgaaagatgtgttttaataaagaacttacattatggggataaataataatagaaaaataaaaataatgaaagcctatatatatgtatccctctaatgatgtgtataattaggattagacatctcataactctcaacaagttgacttgttgacttagctcttcgtcaatgagagcgaacatgtttgttggaacacatcattagtggacaaatgaatgcagattaaaagaaaaattataatcaaattttctagaaaaacatatgacagatactttgagagataatagagtttttgtttgattgaatataacatattgtggtttgttttcacgtggtttagaaaagaaacaagagtgggcttttaaattgggcccacagagtggcagaagcagggctgagagagtaatgggtcctacaaaacgcccatgatcccaaaatttccaaagaaaatggagacaatcttctgtgtttatccgaaagctaccctcacgctttggattttcttcttcttttttttttctctctcttttcttttttaatactacttatttttctataaatttgtatatctagctataaaggtaatagaaaatggtaagttattttttccttccggtacaaaagatgaaaacatgcaatagtcggcaaaggtccacactccacacatttgtctgcacatctatccaatattcattcataggttcaaccacaactttatctactacatatatattttttattttattgaacgaatttatattcgttttccatttctgtcatatatcatagtagatgttgatagttgggtaatggagcaagtgaaagattgatggttggtagaccatagattcatgcattcataccataaggtatactgatggtgattgggtaaatttttgagtcagctattacaattgaaaagttcatcaaatgacaaaactattacaacttagatctttgacagccaaaagaaaaaaaaaaaaaaaagagaaaaaaaaaactaaattgttgttagaaattagaagtcagaagtaagaagactcccataggaatacagttctggcaaccaatttcttagttctttattgggcattcatatcttagttgggcctgactcatatatattttgaactttttgtacgcaattgtatctaacactatagtcttacattgttcatatatttaatgttttatattgattgctacctatatattttgatatgatgtagatccaactatttctaggttgaattgtcttttcgaacagattttgtttccggattcaccataaaaaaaaaaaaaaacttatgtgacagaaagtactatagaaagaatcgtgtttacaacaataaagagacttgacccaaacaaaaaacgtttacaacaataaagagttgaacaataatacggtacgattgtgtatgttgaatcatctcctccacttggacgtgtccatttgacaacggaaaaaagtgtggccgtgttatctttctttgtaacgtttacagtttcaattgtttagtttgatcaaataattaacttgtgaattttatggatgcaatatcttgaaaactaggaaatcatatctgatcatcctgctataaaaaaaataatacatgcattttaatattcatggtttcacatgaatacttcggtcatccatttttcaattacacgagtgtaaatctgtaatatcaatattcatttataattataacgggttgtgatttgtgaaattgtgggtatagataaaacttcaaaacctattgaaatgaatatctatatacttggaatagtagtagacacattttgtaatgagtaacttaagcacaccggttctcactcacactcgtctaatggagaaaaatggtatattatatacctcatataggaacatgatcatatgatttaggagtcataagcatgagattaacaagatattttggtccacattaggaatctactaaaggaactattttcttataacctaaaaatcttggtttggtaaaaagaacaaccttagattatttggtcttttatcgattcatgtaattgtgtatcaaatgattaaaatctaatgcatcctactcaaacacgtcatttaagaaaccctatatagtacaaacacgatccaatctccaaattaacccatagtatatcatagacgagcataatatttttggtcaaatataaaattagatgcactagttccctttatttaggcagatggactttcttctaatcgaaaataattgttctcaatgagccgtcaaactttgtgaaatatggatataaattcatgacatctacataatttttggtttaacatgtgaaattgaacttaggatctatttcattcgaattcttaccatatactaaccaaatataaataatgtttactgctaaatactatttatataagtttgttcttcactaaagaaatttgttgattagtttgtttttctaattgagaatctcttatttcaggaccgataaaaaggaagtgatttccggttttcgattcaattatttcggtttaagtcggtttacaaatcatccaccctgtaaatcacggagcaacatccataatccatacagatcaaaccacgtggacatgttacagtgttccttatcacagaagatgagtactcctgtcatctttccccttttcactttaacataacactctgtacactagtctgatcaaaaaacctcaaaacacagcaaccgccatttctttccaaattcccccaattcccattccaactttatcttctgaagtagaagaagaagccatagaaatgctttgaagtttctgtaagtgttcttactcactctaaaaacttcaattttggtctttgtgcttttttctaacagatcggtgaaattttctgaatctgctttttgtttttccaggtaaagagaaagatctacaattgttttgaat

SEQ ID NO: 8996 - DNA, 3000 bp, Unknown
  misc_feature (1)..( 3000): cDNA_ID_3044221_gDNA_ID_1971953_Annot_ID_177411 3000 nt of promoter + ATG
tgatttagcattattgactagctaggatcgggaagctagtaaatcaaacccaattaacagaaactctttatcttgttaaattttatttttctaaacctggaatctaatcagtcagtggttactggatcagtgattgtctagtaatacattcatttaagataggctgttcatatatagtaacttctaaaaaatcgccattttacaaaagaaagcttaatatttgatgggagacgtcggtagtatagtttattttttaaaaaattacgatgcgtaaacaaaaaattctgatacacctgttttctcttataattttttagtagaaaaaaagacgaagtaagcaagcgaccaacaacctctattattcgtgggaagggatatgtcccccaaacatgtgctatattcatgaattaatacttaacaattagactagtcttacttttattcaatatttattcgaaaatatacttacgaaaataaaatactttaacttatagtgaattgaagagttagtttaatttgatattaatggggtcgagttgcagacgtacatgcaaaaaggtgcctctaaatcgacctggaaaatcatgtcagtttgtccttcagtgcctcttttaattatgcaaaactaatatttgacaatgacatatcttagacataattaacatggatcactacaaattttattttattttatatcacttattttgaatcgattaagtgtgaggagaggagtgaaacacgtcaaatataacgaatcttatatctttgttttttttcttttattcttacaattatcttggaatttggaaaccctagttgtttcggctatttgttatactattgttataacagtcacaagacttgacctcaacgaaaacttttacaaaacgtgaattggaaatttttacaaaatatgctcttaatcgttaatgcttcccaattaggtgagttaaattgtgagaggaaccatttcttagaggaaatggttcatgaaaacaaatatgaaatagtatcactagtcttagttttgcgagaaaattaggaaaaatagaaacgtgtaagcaccaatgatattcctgaaagcacgtgacagatatttcatgatcctataattaacaagtgataaagatattaaataaaattaacgatacttgagaaattcgtcaaataaaatagaagaggaccactcacgtaaccatttgcacgtcccattgatttttgtggtagacttggtatgttatattacttatattcacagaattatatacgaaactcacgacttaagatgcacggtaataactacagatggaaatttacccatcaaacaagaaaacaacatttactcaagcatctagctagaccaaaatgtttgtttacttgttgacttgcgatccatagatatattagttagaactttttcttctacaattgatcaaatgtttcacactgttctcaatttctcatctagattcatgacttatatgtttggtcaaatatcacagcttgatgagcattaaatagcgtcgaagtataggatggttacgttgttcaatattgtaaaggaaaaaaagagaaagagtgccaaaaggtcaagtcgatttcacaaataaatcttgaagtctttatccctctcgattataaaatgattaggaaaagaaaaagagagaataaaatgtagataaagagaaagagaaagagagagaggaacataagggatggtatgaagtagaagtgaagatgcatgcgatggtgtgtcggaaaggcaaagcacatgctacacaacttgagcttctcacttgcgtcagggataagtatcctctgtaccttcttacttttgcgtaatatgtaccacctcacttctcaaccgtttgatctttaatccttcattatttcttcattaccttctctttttgtttttgttttcgttttcaatttctcatagattcatttacaaactaaatatcataggaaggtgttatctctagttaatttcttatcctactttaacaaaatttaattgtcaaaagattatttttacgtttatagacaaaagatactgacacatcaattccacgaaccaaatggttgagaaaaacaaaacgactatctttgtcttgcaaataaattaatggcagttagtaagattctcagctgaaaattcatacaagagtaaatgatcaaataaccatttatgagagaaatttaatccttcagaaaccaatgaggatctgatcaagtaattgcaaaccacatgagtccatgataaaggattgtttgacttacgcaatccacatatttatggctgcttgatatgtaaggtttatctgctttgacagtctatagaatcttgctaatcaatacgtcatatccggtgaatactgaaacttttttaattaagaaaacacaaatcatcttttctccggaggatttcgaatttagttccggcaatgctgaaataacatatgttgaacttataacattccaagacatcaaattttactaatatataaataattacatattcttcttctacatgatcaaaaccttttcaactttaattaaagggttacgtcgcggcgttttgtgtggcttactctttttttacactataactatagaacactcgtggatccaatgccgtttaggacaagattttatcagacgagaaaaaaaaaaacaataccacatttttaaatatatatggattatggactgcaacaacaatatagaaaagaagagaaaaaaataaaaataatgattgaaaggaaatatcatcacgcaaaaccttaaaagtactatcggtatcgtgtcgtcctctcctcatcaaatagttcccacagttttcacatcaatttaaccattttcaatttttttcactctctgtctctctcctttgtataatactatattagtaccattacccatctctctttcaccaccaaaccaacacctgcaaatcctctctctctctctcactccaagaaaccaaaaaaaaagatg

SEQ ID NO: 8997 - DNA, 3000 bp, Unknown
  misc_feature (1)..( 3000): cDNA_ID_3044226_gDNA_ID_1971953_Annot_ID_177408 3000 nt of promoter + ATG
tccttggattatgcacaccaatctcccctagtatctctttcaatgttttgacaggtttatctctgtttgtgcaaatcagataactcctaaggtgctgcaagtgtgggctaggatactgtgtgcagttcccaattctcgtctagtggtaaaatgcaaacctttctgctgcgatagcattaggcagaggtttctcaccacgctggagcagcttgggttagaatcaaagcgtgttgatctcttgcctttgattcttttcaatcacgaccatatgcaagcctattccttgatggatattaggtaagatttgacacatagtgctctgtaaaacaccgaggcttatagattcacatatttaatttacatttattgcagtttggacacattcccttatgctggaactaccactacctgtgagtctctctacatgggagttccatgtgttacaatggctggctcagtacatgctcataatgttggtgtcagtcttctcactaaagttggtaagctcttagcaaaatttttttttttttttttgcaaaaattgttgttagtcggacatcttttagctaattcagccatttcttgattcaggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctagataaccagcaaatcgagctgctgcgaaatgccggcagagagtcttgacccatctggaaaaggtgtgaaagaaagagtcgatgagcttttcctgctatttacttccaagacaataggaactagactttagattactgcttgtgtagtaaaaagaatagtaaaaccagctctttcttttgttgtatctctttctactcttagtttagctttacatgattcttgggaagtcgttaggtggtagtggatttggagtttttcttctcatttgagagatcaagttgttgtgtatcgattagggttttaaggctttttaggatgttttcatgtgttggattttgactcatatgatagtaaatatagttatagaaagcttttcggtgcctttacctatttcataatataattatctaaaactcctgcttaagcttaatcccataggtgagacccaatgaaagacttttgacttgtatgattatgttgccaactccatatctctctttaattaattaatatggagagagtaaaaaggcaagcaactaactactcttcaattcaacacttcttctgctccattgcttccaccagaaccctaaagaccttataaaacccaatcccaaatccctttgctcattcaccaccaaagcatccaactttctttgcttcctctttcaaagcaacacaaaatattaaatctcaagaaacaaagtaaagaaaaatgaagaacgaatctaccttcattgatgtccctgcagaatccagctcagccatgaaaggcaaagctcctctaatcggtgtagcaagagaccacactactagtggctcaggtggatacaacagaggactcgccatctttgacttcctcctccgtttagctgccattgttgcagctttagctgctgccgccacgatgggaacaagcgacgagactcttcccttcttcacacagttcttacagttcgaagctagctacgacgatctaccaactttccagtacgactcatagatgcttgattgatcaaacagatgcttgtgtttttcttgagaaacacgtcacctaattaggtcatattttttcttcaggttctttgtgattgccatggcccttgtaggaggatatctcgttctgtctcttccaatctccgtcgtcacaatccttcgccctctcgccaccgccccaagactcctcttgctcgttcttgacactgtatacactcaaaactcttcaaattatattgctttaaaataaaactttagtatcaagtaaaatactaagaattgtgttgggaacagggggtcctggcgttgaacacggcggctgcatcatcggcggcagcaatatcatatctagcacacagtggtaaccagaacacgaactggctccccatttgccaacagtttggagacttctgtcaaaaatccagcggagctgttgtctctgcctttgtctccgtcgtattcttcaccatcctcgttgtcatctccggcgtcgctctgaaaagacactaatcaaaaccttatatgtgtgttcatcattattgtaaaatttatgtcaccattgtgtaattattactcatccatggccttgtgaattgtgttgtattaatctttttaaaaaggaaaatgaaagtgtgattgtagctctgcttttctggaaaaaaattgaaatgagtttctcaattttttgtccaccaaagcctatgagattataaatgtctcctatatttgtctctacgaaaatacccggtaatgataatgttacagtgagtagcagagaaatatcttacgtggtgttatcttagtggacgttcacggagttgtcgttggtcataatgtttctgtcttcctttttttggtttaaggataaacgagccttcctggtgccacgtcaccttttcgtcttctgctacttcgtcttcttcactaaatgattcagtattttctcctcaatcttctccattttctcaccaaaccaaaatcgtgaaagaatattttcccgcttcatgtag

SEQ ID NO: 8998 - DNA, 3000 bp, Unknown
  misc_feature (1)..( 3000): cDNA_ID_1989739_gDNA_ID_1971953_Annot_ID_177407 3000 nt of promoter + ATG
ataactatggctatcgatgcttatgaggaatgccttaagatagatccagattctcgcaatgctggccaggtatctatactttagcgtggtcttcttgttatgaggttgaaagatatatgtgtttaaaaccttcttgtccccttttgtagaaccgattgcttgccatgaattacataaatgaaggactcgatgacaaactatttgaggctcacaggtaagcacatatattattaatgtagatttgtattatgttgcttttatgggtcttacagtgaaaaaatcttctgaacacagagactggggttggcgcttcacaagattacaccctcaatacacttcatgggataatctgaaagatccagagcgacctatcaccattggatatatctcaccagatttcttcactcattcagtatcttatttcattgaagctccccttacgcatcatgattatacaaagtacaaagtggtggtttattcagcggtagttaaggtaggatttttacctatataacttatatagatacattttccctctaagcaattcatttcctggttctcgtggcatttttcccttttgagcaatcattggtctctcatggctttgcaggcagatgcaaaaacatacaggtttagggataaagtgttgaagaaaggtggagtttggaaggatatatacgggatagatgagaaaaagatagcaagtatggtcagagaggacaaaatcgacattttggtagaactcactggtcatacggcaaacaacaagttgggaacaatggcctgcagaccagcaccggttcaggtgagaggatatattaaacctatctcattttgttgtttcgggttttgcctttgactttccatttcaagtgtacttatattggctaagataccaggttacttggatcggctatccaaatactacgggtttgcccactgttgattacagaattacagattcgttggctgatccaccagataccaaacaaaagtacgttttggttcaagatgcaattttgggtttcggaagtgctccaaataaaaatcttaatttttatttatttattttgtgatatttgattgcaggcaggtcgaggagctggttaggcttccggactgttttctttgttatacaccttccccagaggctggtcctgtttgtccaacacctgcgctttctaatggctttgtcacatttggtagtttcaacaacctcgcaaaggttaaaaaatttgtgtccttggattatgcacaccaatctcccctagtatctctttcaatgttttgacaggtttatctctgtttgtgcaaatcagataactcctaaggtgctgcaagtgtgggctaggatactgtgtgcagttcccaattctcgtctagtggtaaaatgcaaacctttctgctgcgatagcattaggcagaggtttctcaccacgctggagcagcttgggttagaatcaaagcgtgttgatctcttgcctttgattcttttcaatcacgaccatatgcaagcctattccttgatggatattaggtaagatttgacacatagtgctctgtaaaacaccgaggcttatagattcacatatttaatttacatttattgcagtttggacacattcccttatgctggaactaccactacctgtgagtctctctacatgggagttccatgtgttacaatggctggctcagtacatgctcataatgttggtgtcagtcttctcactaaagttggtaagctcttagcaaaatttttttttttttttttgcaaaaattgttgttagtcggacatcttttagctaattcagccatttcttgattcaggattaggacacctggttgccaaaaatgaggatgagtatgttcagctatctgttgatctagcctctgatgtcacagctctttctaaattgagaatgagtctccgggatctaatggctggatctcctgtttgtaatggtccttcctttgctgttggtcttgaatccgcatatcggaatatgtggaaaaagtactgcaaaggtgaagtgccgtccttaaggcgaatggaaatgctgcaaaaagaggtccatgatgatcccttaatctcaaaagacttgggaccatcaagagtcagcgttactggagaagccactccgtctctcaaggccaatggttctgctcctgtaccttcctctttaccaacccaatccccgcagctctcaaagagaatggactccactagctagataaccagcaaatcgagctgctgcgaaatgccggcagagagtcttgacccatctggaaaaggtgtgaaagaaagagtcgatgagcttttcctgctatttacttccaagacaataggaactagactttagattactgcttgtgtagtaaaaagaatagtaaaaccagctctttcttttgttgtatctctttctactcttagtttagctttacatgattcttgggaagtcgttaggtggtagtggatttggagtttttcttctcatttgagagatcaagttgttgtgtatcgattagggttttaaggctttttaggatgttttcatgtgttggattttgactcatatgatagtaaatatagttatagaaagcttttcggtgcctttacctatttcataatataattatctaaaactcctgcttaagcttaatcccataggtgagacccaatgaaagacttttgacttgtatgattatgttgccaactccatatctctctttaattaattaatatggagagagtaaaaaggcaagcaactaactactcttcaattcaacacttcttctgctccattgcttccaccagaaccctaaagaccttataaaacccaatcccaaatccctttgctcattcaccaccaaagcatccaactttctttgcttcctctttcaaagcaacacaaaatattaaatctcaagaaacaaagtaaagaaaaatgaagaacgaatctaccttcattgatgtccctgcagaatccagctcagcc

SEQ ID NO: 8999 - DNA, 3000 bp, Unknown
  misc_feature (1)..( 3000): cDNA_ID_3044230_gDNA_ID_1971953_Annot_ID_177406 3000 nt of promoter + ATG
ctccggtcaagaacttcgctgcgtctatccacctgcgttttatggacgagccaatttggtaatcgatctttcgtttaactcaaagaagcaataaagtctctagtaactaaccctccaccgtcccgactaataaggaattgggttgagcctcctccaaagaacatacaaggcataggcaccactacatacatgagtgctgatagcattggccaccagttaccatatatcgcgcatgcctgaccattatgaacaaatagttatcactatatctcccagatgactataacacgtgttactcattgcatggtataaccaggtataccaaaggaaatcacaaaatatgggaaacgtatcagatttgtaaatcagatgatcctttcttcttctaatcgaagtgcaaaaaaaaaaaaaaactatacctatacaaggacctgatataagctgaggagagaagatgcttgagtttatagaagttgttcagaaagtctaagtcaattaacaagttagacattgaggtcggctaaggaccccagcttaccatatgctccggtcaaatagtgttgtaaggataagaattctaagtgtaattttggtttttgggatccagagatcgctagtcaacatactacaagagagtaaagctcaaaacttcaaatatgaaagaaggtttgaatgtaacaaactttacttcacagagtatctctcccagtaaaacgggccaaaagactcacaactctgtttgctacatcaacaagggtacaaaaggagaccagtatactcagctcacaacctaacagcagaactagctaaccatctcttgcaggatttaaagctactaagtcatgatcttatgatcaagcttcaagggttataagcagatagctatattcagaaacgtaccaggatctgtaggaggatactagatgaaaacatgaaagcaagtccagcaagtctgtgcaatcaagaaaaataaaatctgtaagatcacgacacacgagaatacactggcagatgtaacaacaagggtaattaaagagcatcaagtcttagaacttacactgtaccaagaaagcaatttgagcattccagaagaaatcagcatcggaaaaaatttagaaaagagcaaacaatgagtgagtttgaacaatgcaaaacccagaaaccctagctcacaaaattaaacaattcacgaagcacaaaataactataatctgagtaaatcaataccaatctctaatacgtatggaatatatgaacatagagcaagggagaaaagtaaaaggggaaaatcgacttgaatctgattcgattccgtcgggaaatgatacagttggaagataggtgattgattaccttcgatggtcatcgccatgtcggcgaatgaaaatgttctgattaccggagatcgagtcttgaatgatcgccggtgacgataaaagagaaggtgatgatttcgttgttccccttagagagatacagaaggagagagcccagagaggagtcgcgatttgagagcaaaatgaaaattagtgaccggtcaaaattggttttctcaccgttcatcgatttcatctttttggtttggttggtttattttggttataattggtttccaggattgtggttttgataatacagctagtagtcgattttaaaatatcacaaactaaatgacatgaaaaaaaaattacgatcaaaatttgggttgcaaggaccacataaaactcattcctaaatcatacgtaataaaaatgattttataactgaaatttttaaccaaagttcataccaatcatcaaaatatgtgaaatgctaaatatttttttcttttcattttttgttatttaaatgcaatcaactatgattgaaactgcatcaacgaaaaagtattattaaactattaagcaaccataagttgagttgattcgtttccataattttagttagagtacgtaaatctccatcataatacactatctatgctatcattgtttgttttttttttcttttttttgctaagaatgtaaatatcattagaaatgaaatgtttggtattacaagagacgtattacctaaattaaattaaccttggcaaaaagaaataaaaacaaggttaagataaagagtagttaatcaggagagattaatggatccaaagtagcataagttgtttccaatgctttctatgtcttcgagaagtaatggtattgcgcacctcacgatctatgctatcatggttggtgcgtttatgacatgctgctgctggtgacgattcaaaagtgtttatcagttgttcattatgatgccattgtgatgtaccattactaatttcttacttaaataaggtgttgttttttgttttgctccaaataataaggtgttgtttaaaaggggctctttcgttttggagtaaaagtctctctgagtagctgtatattatttaagtagcatagtccaattatttgacaatgaaaaaaagtgtatagtccaatgaataccaaatgaattgacgtcaccactagttgagacctgagacaagcaagtgatcgttaaatcaaggagaacgcaagtggacgaggccgacatgatcctaactattggactcccacttgtgaaacttacttgatccatttcccacttcataatttcgtaaaaaaattaagacaatgagaatgaatttatttatttatttttcggtagaacaatgatttttattttgtccaaataaaacaatcgtgaaaaattatgttttggacattatcaactttgtgagtaaaacaaattttgtagtttcttttaaccaatattttcgaagtcaacttttttctacgtgtgagtgtattgagtaaatgatagatatgtcaataataacataactcatcaatcaatctggcttcaatagaactagagaagttataacgtttttttttttttagacaagagggttttataactctagactagtttcatagtccatgaaaaaaacatcaaatctcctaa

SEQ ID NO: 9000 - DNA, 3000 bp, Unknown; identical to SEQ ID NO: 8989
  misc_feature (1)..( 3000): cDNA_ID_1008840_gDNA_ID_1971953_Annot_ID_177402 3000 nt of promoter + ATG

SEQ ID NO: 9001 - DNA, 3000 bp, Unknown; identical to SEQ ID NO: 8988
  misc_feature (1)..( 3000): cDNA_ID_1989331_gDNA_ID_1971953_Annot_ID_177400 3000 nt of promoter + ATG

SEQ ID NO: 9002 - DNA, 3000 bp, Unknown
  misc_feature (1)..( 3000): cDNA_ID_1375398_gDNA_ID_1971953_Annot_ID_177399 3000 nt of promoter + ATG
taaagaagaattaagttttctttcaaataaagttttactaggccataacctgagagacttgtgtcatatacaaggggcaggttcaggttactaagatgatcaatcttcaattagcaaaatcaaataggaaactccaatggctaatgatggaaaactagatggtaagtaagtaagaattaccatacatctagcaatggtggtccgaaccaaggttcgagcaagcaaagcattcttcttaagctcatcgcctcgcatctgaagaactttctctttctcggttggtgacagaagttgagagtagtgttttagaagagatgtactcttcacttcatctggtcgaataaaccatagatgagtctccctacatgtcaaaagataacacaatgtagaagataataaacagataagaatgttgaagatgagtttcaacacaatttggatcattgcacaacattaggaacgtacatccgagatggaagttgcagaggaaccagtgaaggcaattcgatcgataagcttcgctgcaattgagacatgactctgattctcatcagctccaacaaattcttattctattggaatcccaaaatcgcaacattcaaacaagaatcagtaatccaatcagtgacaagacaaatttagagaatcgatctagaattctaagaacaagtaatcaactggacttggaatcaattattcagatgaattacccaaacggaaattaatactccggctaaacgacggcgaggtcccttgccggtgacggaggaaagatactctaatcgaacggagatggtaatactttctgtttgagaaaaaagtactaacagtgtcgaaccaaatcgaattttattttgaaccaaacggttttacttatccttaaaccaaactaacccgtaaatactttggttcccagttccgttcgctggataccgggaattacatttaaccggatattagaattacaacattttttgttttgttttgattaataacagagttctacacttctacttctaacttgtgaaccttaaagttccatagttaaggaaaatctcatgatatacaagattagggcaacatttttttgttttgtctttaacttatctaataaaaacaaaattttagtaaattcgaaattcagtttggcctgtaggagaggtccgaccacccatccaatatctccggtttatgaaacatggactagattataaaagaatcttttatcgtacgaggaaatttgaacgtatgattcatcatgcatgctttgccgattttctaggataaaaggtggcgtaccatcaattggatggggccgccgcagaaattagttactagtactaccaaagaaataaataaatttaaatgagactttcgtgttccacatggtctctcatccctctctactcggaaatggaactgttgatacggacaacggagtttttctcgaccgcaaaacataaattgtcgagtactatttgtaatttgagatggtttacgtaaattgaaatagtcctttctgatcataaatggcctgttttctccactcttttaaatgagtttggattgttcatagacagattttctcatttttttcgatatatgtaaatctccgattattaaattgtaggccggattgttagataaagcttctacaactatagatttgttgagttgtcatacgtaaacagttttgcttcaaattcactaacctaggaccctccttttgatattaatgtgtggttgttagaaaaacaatttttcgtgttccatataattttagaattacgtggcatggaacatttacatcggggataaattaagcgtcgtccacagattttacgacaatgctccatataagaacatgcattacaaaaaaaaagggaaaaaatgcatgttcatgtatggtcgtctgtctgtttataattgaaaaggactttgatgttgttaatgttattaatggagattactttgaatctcacacggtttgattaaacgaatcttcgtcagcacacactctgttcacacttattatttgagactagcagaagaaactcactagtttatcatagattctgaccttcgcacttgttagtcttttaataacttgaagatactcgccattgtatatcacaactaggcgatttctcgttcatttaaaatgttaatattcgtgtttaatgtatatttaattgaagtaatgattttacatgtacaaatgtatcctagtattttgaatcttctagtaccaagtggttttctcttcgattacctttttgtcttttttcattacaacatgaacaacaccagcaataattaaaatatcgtgctttttgtttttgtcattttttggggtcatacatatataatatatacacgtaagttcaaacatttgtttgttgttctttttgtttgtcttggattcgacatccttagaaataaaaaccacatttttaataacgaaagttcattaaaagtatttcgaatattttaggcatgttggtttgattagagtttgtattccttattcaaactaatgtcgttgttttttactgtttagatcgaaagaaaagttttttttcgtaattttcgtttatttattttgtgaaatcactagcaaagaaaaacgtacgtgactatcacatcaaaccactataacatctcattttatctatcgcttaattcgttttttaagatcagatctgagatcattgtgcatttcaattgtaaaaccgagcctaaagtcaataatataacattatttcagaaccaataatttttaacagacgttgtttgtttttgggtctcaagctgaacgactttgcaactagtacacttggcatatgtttcatgttttttttataaataatgtgctaccttgatgaagttccctctctctataaattgaagtgtgtgagatgcatcatccatacacaacatcttccatcttccgataattctcctttagtcttataatcactaataagtacgataattgaa

SEQ ID NO: 9003 - DNA, 3000 bp, Unknown
  misc_feature (1)..( 3000): cDNA_ID_1989334_gDNA_ID_1971953_Annot_ID_177396 3000 nt of promoter + ATG
atactgaaaaatccattttattcagtaatttcttcatcacatctttttccttcttgcaggagctcctatgagggtgattgtccgaaaaaccatcccgtttgtagaagatgaacttatatctgaaagcaaacttctttagttagtgtagccttaaaccttcagatttctctgtaatcattctgttttgagtacatcctctctgtagtatacattctgtgcaagcgaaaaataaaagtagcctattattggaccatcatgtttgtgagacacttggaagatcaccagtaatctttgcacgagcagaccccgtctttgaaatagtggaaccgagatgcatcccttacaacaaactggcgatctacaatcttgctaacctgcttgaggaacacatgacaatcttcacaaaccctcaaattctttatcacaagaatttctgtgcctggaatactgttgagaatcccaaaagctattgctaacctctcgctatgctcacgggtagtgctcgaaacctcttcgcctctatcacagtccatgtttcccgcaagctccatcacagaagtctctaactcatccaacattctatggacttcctctgtttgctcatgacttctatcgccagctaaaaacaagtgaactcttcccttgtgttccacataactatacccaggctttttcctgaatgctctctctctcatcattacccggattctccagattccttcttggtttttcgagtctgaatatatatttgacatcaatacatagtagccaatgttattgggttcaaactcaatcacctttgcaaaagctaactctgccatatccacattcttatggattttacaagcacccaatagagcaccccaaacagcaccgtccggttcaacaggcattgactctataaactccatggcttcatctagccgaccagctcttccgagtagatcaactaaacaagagtagtgttcaggaccaggctccagcttatactctctcttcatcgctctaaataactctaaacctttatccgttagccctgaatggctgcaagcagataaaaccattacaaacaccgccccatctggtcttatgcctctttttatcatatcatcaaaaagcataagcccaatctctcccattccatgcatcccatagcaaccaatcatggcggtccatgaaactaagctttttacaggcatgatgtcgaaaacagcacgtgcctttgccaagttaccgcatctagcatacatgctaatcgatgcattgcttacaaaaacatttggtacaaaaccattggattctactaacttccctacttcgtgaccaatcttcttagctccaagatgggcacaagaagacagaacactaaccaatgtaaaaggatcaggacaaacacccgatgatttcatctgctcataaagttccagaacatcgtaagctagcccgttctgtgaatatccagaaatcacagcattccaagtaatcaaacccttcacaggcatctcatcaaacaacctcctaccagcttctaccgacccgcatttcatgtacattgtgatgaaactattcaaaacagctacttcagaatccagtcctcctttaacacattgaccgtgaagagacctcccaagccagaggtattcaggaaccgtgcatagcgggacaagcccaagcattgtaactgaatccacagacacaccagtttccttcattctacgaaacatatacgcagcatcagtgaccttcgagtttgctgtgtacccagatatcaaagcattgtaacaaacactaagctgacttgactgaggattttcttcgaacactttacgtgcatctgcaaccaaaccgcatttacaatacattgagatcagagccgttagtacaaacggctcagtctcgcaaccgcctttggtcacgtggcaatgtagctgttggccggagacagggagcgaaagggaagcacaagacttgagaatgaaagggaaagagaacgcgtcgggagaagaaccagaacggagcattgaccggtaaagagatatagattcagaaaacaatgactgatatgcgagctctctcaaacgtacgttccatggcgtcgaagccaccgcagcgacggcggagttccgtacaaagcttgtaacgacgatcatggtctcccgcgctgattatgacttgtttgggttaaaacgcatagttctaatttttatgagaataaggcccaaatagtatgggcctgtagcccaaagtaatccgaaaatttgggggaatagagttatacgtaaaaccaaacgggtattaatctgtgatagaccatttcttcttctcagatactttcctccatctggaaatcgttgccgccgctatttcctcaataaaccagattaaaccttctcttcttcatcatctttctcaaccgccgtaggttggagggaagctcgcgcggcaagtaatagccggagcagcttccgaccaacggatcggggttactaggagctcagtttctggtaagagaatcggtttaatcactgttgttttattacttatggtagctgagtggttttcgaatgttatctgattgattcgtgaaatatcttaagattgaataagatcatcttttgtttgtgcataaggggaggataagctgatagtagaaaatctagattagacaattgatggtactgagtaataactaataactaaccttaggagtatgattggtttctagggttcttatgagatgtattttgcgatcatgttcctttctttttcgtcatttttatggagtttcatactcggagttgtattagtagctttgatcagtgtcttgcgaaaacaatgtgtttttaaaccaggccttgtgaaaccattagcctttgtgtaacatctggagtttattgtgctgttctctcgtttacttggttaatgcttaatcattgcgacagaaatcagggtggatattcacttggagtaaggtgcagctcgtataaactgttcatcatg

SEQ ID NO: 9004 - DNA, 3000 bp, Unknown; identical to SEQ ID NO: 8984
  misc_feature (1)..( 3000): cDNA_ID_1989336_gDNA_ID_1971953_Annot_ID_177393 3000 nt of promoter + ATG

SEQ ID NO: 9005 - DNA, 3000 bp, Unknown; identical to SEQ ID NO: 8983
  misc_feature (1)..( 3000): cDNA_ID_1989337_gDNA_ID_1971953_Annot_ID_177392 3000 nt of promoter + ATG

SEQ ID NO: 9006 - DNA, 3000 bp, Unknown; identical to SEQ ID NO: 8982
  misc_feature (1)..( 3000): cDNA_ID_3610002_gDNA_ID_1971953_Annot_ID_177389 3000 nt of promoter + ATG

SEQ ID NO: 9007 - DNA, 3000 bp, Unknown
  misc_feature (1)..( 3000): cDNA_ID_3044247_gDNA_ID_1971953_Annot_ID_177386 3000 nt of promoter + ATG
atcctggaataataatttgttgagaatttaattacaaagtaaacgatgacttacatataaaattcgtaaagtcttggtcaatcttaattataaagaacaagttggtcattgcttattataaaaaaaaaatgaaaatgcttgttgtcaagtaacattaactccattttttcttgcatttactcaacttcaccaaatcgtagagaagttggagaaataaatgatcagaaacacacatcaatcgcaaccaagcggtcaataaaatactaaatagacaaagaagaagtagctccagctcctccgccttggattatttttacaccggagaagcaaaaaagaaaagaagatggacatgaaagaagtgcctccacctcctccaccttctggattcaaacgatataagaaaaaaagaagcaaaaagatggacaacaaagaagtgcctccacctcctcctcctcctcctccacctgttctgcctcatatccgatcaagaaaaaagatggacatcaaagaagtgcatctacctcttccacgtcactatcctcctcctcctccgcctcttccgcctcctccgccttatggattcagacgacatcataaccaaagcggcaacgagcttgagaaacgaatagcacgtctaggctttccaactcttcgcccttttcaatccaaacgatatgataaccaaacccttccaaacccaagatgtcctctgtctaatccaacctacccccacacactcaatcctaagttcagcgtaaacactacaaatggttgttttacatgcggtgaaaacacatccccctggattgaccaccataatgtccatttcttctgcaagaggtgccatgtcgagttccactttggttgccacacgtaccctagtgagttaacacatccttatcacctccaacaccctcttattttcacatttcataactatcaaactggggtcatatcagacgccaggatagatgaatccttttgcactacagttttgtctggctccgatcctaagaagtctggctctatagataaatgttcatggtgtggaaaaaatatccaagggaattggttctatcgttgttctatatgcaaattttgtttggatctctcttgctcccaaactgatccacctctgctcgttgcaaacccaaagagtcatcaccattcactcgtattctatgctcgaccactcttgactccgtgtgatgcttgtgggtcggtcaatgtgttggatccaagttatgcttgctttcaatgtaactacatggtccatcaaagttgcatcgacttaccacgagtcataaagatcactcgtcaccagcatcgtctttttcatactccttacctccattccacgattccaccatgtcggatctgctacaaaccagttgacatcaagtacggtcagtattcttgcaaacacgaggatttctcttacgttgtccattccaaatgtgcaacacatgagaatgtatgggatgggaaagaactcgaagaggaaccagaagaacccgacaacattgaagatatcgtcccatttgagaaggttagtaatgatatgatcaagcatttctctcatgaacatcatcttctgaagctagaaaagtatgaccgtgttcgagatgcagagaagcaatgccaagcatgcatccttcctatcaactctcacgacttcttctataactgcatggaatgtgattttttcctccacgaggtatgtgctggtctacttagaaaattggatcatgcgttgcacgttcaccctcttgtcctagacccttctcctcaacgacactataatcaaaatggttgtttgggttgttcgagaaaatctactggtttcaggtacaagtgctccatagagaaatgtgtgcttctcgataacgttcagatagatgttagatgtatcttagttccagattttttcacccatacagctcatgaacatcccctatttatatccacatccgagaaagggaaaagtaagatttgttgcgaggcttgcaaggagatatgtcttgtgtcctacctacagtgttctgaatgcaaatttgctatgtgttatcagtgcgctaccattccaaacgaagtctactacaaatacgacaagcattttctctccctttgctacggagaagtagtgtttggtacgtattggtgtgaagtatgtgagaaagaggtagatccaagggattggttttacgcatgcaacaaatgttgtatcactgtccatcttcaatgtgtattcggatcctctggttatgtgaagcctggtttcacattatatcattacttcacaaaaatggaagttttaagcaacagtaagagcactcgaccgttttgcactgaatgtggtcaacgttgtccaagttccgtctactacaaacttggttggttgggaactagtactttttgttcgttgaattgcttaacgtcaaaagaaaaattgatggtgttgtcaacatgatgagtttttttttaatgtgttattggaattttttttttttaataatgtttttcagagatttgtgtagttattatttagatccagagagtttttcagagattattggattttaatgtgttattggattttttgtttttaatgatgtgcaacaaagagagttttttcttggacatatataattaacattcaatggacattaacgtctgggtagtgtagtcggttatcacgctagtctcacacactagaggtccccggttcgaacccgggctcagacatttttttctccttcatatttacgtttctgccacgtcatcatccgctacacggacgctaggttctgattcactttttctttcgtcttgggaaaaaagcaaacacaaaacctgagaacaaaaacatccgcagaatcgatatccccagaatcactactctacaaattcgaatccaaagttcaaaccctattcttcgattttcgtagagcagattattgtttccctttaggtgtctccatagtttctgaagagagaagg

SEQ ID NO: 9008 - DNA, 3000 bp, Unknown
  misc_feature (1)..( 3000): cDNA_ID_3044251_gDNA_ID_1971953_Annot_ID_177382 3000 nt of promoter + ATG
aagacactcatgcagagcacgtttatctccgatcaaaccagggttggacttgcataaatgttttcatatataacacaccaaaattttatgatatatcattgcatattatatttatgataaaaatcaacattatattatactacttttatgtaccactctcatataatagtataaaataatatgatatttaataataaataaaaattacaactaaatatttgttttttccggcattacagctaaatatatttaaatttttcaaagtataattaatttgaaaattttctatacaagaatttcatttttaattagggctaaacccttaccagaggtagcccatataaatcggaatgggtgaatgcaaacttaagccgattatctttatttttttttattttttttatttttttctcaatgctggaggatttaatatcatcatataaaacattcttttagaaagaaaaaaaaaatcatcagaaggtttaactatcatcatcggacatgagcatgaggcataatcttcagcgacacgcaaagcgaatcctcgcttacagtaacaggcctcgatttttctgctcctacaccaacgtaacactatcgtctccggcgacgaaccaaactctgcagagtcggatcgaagcggcttcacatcagaaagcagaaatcacaacggtgcttgagcaatggctacagcaacaacaacaacaggggaagcagttaaacccttcgttattaagaggaatcgtcgagaagctcagaagttctaaccgacctcgccaagccctagaggtatcagactggatggtcgaacaaaagatgtacaatctcccggaagacttctcagctagatttcatctgactgagaaggttttaaatttggaagaagcagagaagttctttgagagcatcccggagaatatgagattcgagtcaatgtacaattctctattaagaagttacgcaagacaatccggagaaaaagctctgaagaaagccgaatctgttttcaagaagatgaagaagctagggttgctcttgagaccttcaccgtacaactcgatgacatcactctatagctctctcggaaacagagataaagtcgatgagattcttcgagagatgaaggagaacaacgttgagctcgataatgtcaccgtgaacaacgctttgcgagtatacgctgctgtatctgatgtagcgacaatggacaagtttctagctgataggaaagagattacaaggcttgatgggctcacaatgcttgcgatggcaaaggcttatgtgagagacggttctaaacaaaaggctaggaggatgcttcatgaaacagaggaatgattgggtcatgactataaggaactcatgagcctatatggtgaagcaggagagatagaagatgttcaccgtgtatgggacaagtacaaggcgacaagacagaaggataatgaagaatttcgaactttgattggttctctcttgaagcttggtgataccaaaggagcagagaagatatactacaatgagtgggagtgctccggtcttgagtttgataaccgaatccccgatatgttggtgtcgggttatcgcgaaaagggaatggtgatgaaggcagataaactggtgaacaagactttgtggatcagaggattggctacaccaatcactctgttgctggaagaaatggataaaaaggggaataaagtgagtccgccgggcttgagagacctcatcaagaatctacgtgattcaaatcagttgtccaaagcacttgaggcatcaacatggatgtgtcaaaaaaaggtgtttaatctcttttcagaagattatgcaacaaggcttcatctgactgagaaagtgttgggtttggaggaagcagagaactttttcgaaagcagcatcccggagaatatgaaagattactctgtctacgatacactcttaagctgttatgcaagatctagcaacactcaaagtaaagctgaagccgttttcgagaagatgagagagctaggtttacaatccaaactttccccattcaactcgttgatatctctctacagtgggcaagggaaactaagtgtggtcaatatacttctatgtgatatgaagcataagaatatagagcctgatattgtcacgaggaacaacgttttgagagcaaacgcatacatattggccatagactcgatggagaaagtataagagagagtgggatggttttgagagcaaacgcatacatacgtgatcatggtgattataacgtgatatcgtcatctagaatgtcgtttttgttaaccgtactgtcattcctagttctctagatctaccactttgttgatatgctggtattggaacgataccgcatgttctcgaaaatgtgcaacatcgttgaccacttaactcagtcttataattattgtatatgttccattttaataagaggatgttaagataatatttcaatttatttaacatatttctttttaagtaattttactgaaaaaaattaatgctctgttattttaaattcttcatataagatggatctaaatcttgtatatttctttgaatgtgcacagcctggaaacaggtcttgagaacaaaaaagtaatgagcatttattaaaagtaagcgaaagtataaaatagtgttacagaaatgttattactctgttattttaatcctagaactaatcttgatcttaatcttaatcttagtattttattttataatgtgcattactgcattgcacagcgtggaaacaggtcttgcgaataaagttaatgataattctatctattacaaaagtaaacgatgaccgaaatatgaaatcgtattttctggtcattcttaattataaaaacagcaagttggtcattgtctactaggacatatgtgaatgtttgtttattaatatgaacactgccatttactctactccacgataagtggaaataaattagcagaaacatacatcgatcataaccaaaggatcaaaag

SEQ ID NO: 9009 - DNA, 3000 bp, Unknown
  misc_feature (1)..( 3000): cDNA_ID_1989326_gDNA_ID_1971953_Annot_ID_58664 3000 nt of promoter + ATG
acaattattttagttgcgtgtgtaatgtatataaaataacaacatgaaataacattttgtcttttatttttgtcattcttattatttaattttggacccgacaatttcaaataatcttctccaagttgtaactaatccgttacatgcgcgtgaggagaaccgtccaatccacttagactaacgtgccctttatttcttccttttaattctatgttaaaaaaacaatttaactaaaagatgcgcacgtgtcttgacggtggaaaaaaattgtaggcgccgtcgttgatcatgctcagtcgataccaccggtggtcgcaggtagctcgaggacggtgaggctttttggcgtgaacctcgaatgtcatggtgatgccgtcgagccaccaccgcgtcctgatgtctataatgaccaacacatttactattactcaactcctcatcccatggtaaatattttttttttttacatttttgtcagattcaaatttttgcttacgtatgatataattattaaacagatgtcgtggctgtttctcgagacgagacagatgaaaattagtaattttaaaatagacctgaaagagatttttatgtttaataaattatataaaggaggaatcagagagaataatactatacacttgactgtaaaaccacatggccaatttggtttttatttgattactttgatttgttttgtttactcttttgtctctgtagcctccttttgttcattaattaatatcagccgtaagtatatagtttcctgtgaaaacagtctctattttggttttactattctaatttgttaggcaccgtcagttttttttgtgaaaccaaattattgactaataagctggaaagcaaaactgactaaaagcattacaaacttatcaatgacataagttttgaatttattaccatgttttgtaatgttcagatataatttgaaatgcttagaattatatatttgtatacttaaattaatgaaataaagtgaatactaaagatagttttatttttcatattattctatacaattcggtgtacaatttgtttttgatgataataaaaataataaaattgcgtgttggaattgtgaaacagaatatatcatttgctggggaagcattggagcaggtaggagatggacgaggttgatgactgacattcaaaaagaagtgacaactttctagatttttaactttagaatttagattatgggcccatacttggcccaattgtcatagagaaaaaatggacaagaattaatattattagtagcttcgttatgtatttagtatttaactaatttgaaaataaaaataaaagatgagattttgtttctattgtacatttgagtcagaacagaaaaaaaaagtatatgcaaaagatgtgaattagtgtgggtttatagtagttgatatttgaaggctaaaataaaaccaatgaaagctttctatagcacaaaagtcatttgagggcaggtaccccaaattggtgagctaggcctaggctaaaccttatacacatgtagcatgtatttgatgatgaaagatgaattgggaactgttgagagattcatgtgaggagattacgagaagaaaaggtgtgggcctaattacgaatgattaaagaagagagagcatattcatatatagcatgtgtgtaaatatataggttgtgttacatcgccttttatctcttttccaaagccaaagccagggaccattttatttgttgctgtgttacttacactcttcttttgattctctattttgtttttgcattacaaagacagtgtaaaaggaatatgaatcatttttacaagctatgacaaaaatgggtttaggtcccaattctttctatgcatttatgtttgtcttcgtgtttctgcatatatatgagtgtattggtaaatggtaagtggcaacacaaacgcaagtttctgtttctatatatgattaaaacattctaaaacggcaacacaaacacaagcataaacacaaacaaacaatcatgacttttagtcttctttattctctattttttttttgttttttttttaattctctaattcttgtttctcctcttctctctgttctttggtttctttagtgctcttcaaattaaagagttttcggatattaaatcatacagagtgtagtaattacctttgtcatttgaaacatttccatgtagaaaagagaagattttattacttttgatagtgttcccttgtttatataagttcacggactcgtaattaaatcaaagccatcttgtgaaggtaaagtcttcacatacttgtatgaaccttttcatattaatatgcctttttagtgtttgtttcttcactcttatagttgtttcgtcattcccattaatgctctttagtataatgattcaccaatagggatttttaaaaatattgaaattgtaaagcaaatcagcatgtgctacttgtgagtggtggtaatggatactcgaccatacccgaaaagttcggtccaatttaattaattatatctatatacactatatctgcgggctattccttatctatattaatatggtaggcgaagaaattcaacttaaatctctcatcaactatctttcatcatagaataacgattaggacaatgcattgattattatcattagattagatactcagaatcatcaaattgatgtataaggaaattagtttgctatactacagctttaatatattgggaaattaaaactcgtctcgatctaaaagatatagtagaaacgaacatgggagtaaacttctattactatacgttaataaaattatgtgggatgcatttgcattaatacttttgtctgtcacatggatgaattgatgatggatctataaattaatttattaacgaatttatttccctacagaaacatatttattaagacttttctctcgcaaaagaagatcgcagcatattcacattttcacgtctcttctatacgacatacatg

SEQ ID NO: 9010 - DNA, 3000 bp, Unknown; identical to SEQ ID NO: 8996
  misc_feature (1)..( 3000): cDNA_ID_1989325_gDNA_ID_1971953_Annot_ID_58665 3000 nt of promoter + ATG

SEQ ID NO: 9011 - DNA, 3000 bp, Unknown; identical to SEQ ID NO: 8995
  misc_feature (1)..( 3000): cDNA_ID_1989324_gDNA_ID_1971953_Annot_ID_58666 3000 nt of promoter + ATG

SEQ ID NO: 9012 - DNA, 3000 bp, Unknown; identical to SEQ ID NO: 8994
  misc_feature (1)..( 3000): cDNA_ID_2993983_gDNA_ID_1971953_Annot_ID_58668 3000 nt of promoter + ATG

SEQ ID NO: 9013 - DNA, 3000 bp, Unknown
  misc_feature (1)..( 3000): cDNA_ID_2993973_gDNA_ID_1971973_Annot_ID_58670 3000 nt of promoter + ATG
attgctcataaatctctctctctacccaatctctttatttagtaccctattcttcttgactttgtttctttccaaagcttatacaagagatattcattcttaaactaagattttcatatatattgaaaaagaaagaaaagatttctcatcattttactttttggtagagagcatttcaagtaaaaaatactttgagaaacaaaaagagaaaactagtatgagaaacaaatccttaaaaaaggaaataacagtaatgcacgtgatgatataacaaaaggttttgttttgtttgtttttttattgtttttttcttcttttatttgtctgttataataatcaaaaaacaagaagaaaaaacgagacgttcatgcatttaatctcgcaccttacgacaaagagtgagagagaggatcgctcaggtttgttcatcttcaccggacgattagcttttgcggtgggagaaagaacggcctgtcttcagctctgaaacagaggaacagagaggttaggaaggagacaatggttggacccgcgcggcctcagatcgttttgtttggatcttccattgttcagatgagctttggccatggtggttggggcgccattctttccgaggtctacgctcgtaaggtatcgtcagattcatcaatctctctctctctgtggcttctggattcgatattcatccttggttagattactagagcgttgattctacaagtagatcgcttattctaattactctgtattatttattattttccctaactatacatttgttcattgaaattcgtcttttgttttacgattgtaagcgtgtattatgcgaaccataatgttatttctccatttggatgttatgtgtataggccgacatcattctgcgaggatattatggatggaactcttctcgtgctttggaagttgtcgaccaagtgttccccaaggtactctttcaactccctttttttttgcttcttctctctttagactattagtttcttcaatactagattatgataaagattcagcgttttataggtctttatattagtccgtataggttgatgtgtgcttatcatttgacctagtaagaattctttgtgaacattattttactagttcaaaatgtaccccaaaaggattacacaagtggctattttagttgcatagtctttgatttagcatacaagactctgcatctgtttcaagggagatgtctctgtttaagcataatctgtttcatccgagttttcttgatatctcaagctgttttctcttacccattataaaaaaaatttggtagaatgagcttaactttgtagaaaaccatcatattcaaagcttctgttttcttccactttgtcgcctaaaaattgcaacttgttacggatgcaggatgctgcagtacaaccttctctggtcattgtctattttggaggaaacgactcaatggcgcctcactcgtctggactaggacctcatgtaccacttactgaatatgttgataacatgaagaagatcgctcttcatcttcaggtttatacttcctttataattgttagatttattatttatctcctgtcagtcacgtttaaaagccatttcaagtgctaatttcttcctctattttctgtttcagagcctttcagacttcacccgaatcatatttcttagttctcctccagtggatgaggctaaagttcgccagaaccaaaggtaacttccctgaatttcttcactatctctctgtttctccttattctctccggccttattaatatagatgtgcttctttttctctcacaagcccatacttgagcgaggtaatccgcacaaacgacctctgcaagacttattcagatgcttgtgtagagctgtgccaagaactcggcctagaagtagttgatctcttctctacttttcagaaagcagatgactggaaaactgtttgcttcacgtaagtattttttgagttctgaagaaatatagagagacctttgatatatatgactttctcagagtttccaaatgcgataaccgggaatggagtatcgacgatgttcattgaaatgttttaacggtatagtctggtttgttacagagacgggattcatttgtcagcacaaggaagcaaaatagtagcgggagagatactaagagtggttaaagaagcggaatggcatccatcacttcactggaaatcaatgccaacagaattcgcagatgactctccttatgatcttgtatcagcagatggcaaacagacagtaaattcttcagaatggacttatttctgggaagaacaatgggactaaacatttcaacacacacaacaacaacaacaagaccctatcttcacataattcactgtcttaatgtgataaagctttgctttagattgtttacattacaagtgtctctgctataatctgattcagtttcgctcgaaaaacgttaccattttaaagtttatacttatctaaatcttaaatcacagaaacacaccaagtttgtgttcaagtaatttctttttttcttgtttacattttacagacattaacaaatgtctgaaactcatcacataacactcctccagacaggggtttagtgttttgaaggtaaaatcacaaagtaactaaatttgggccgataacaaaaaagtcgcttaggagattggacttatttgggcctaaaacctaacacttaagggcccaactaaaatgccatttacctaaaaagcgacgcatcttcgtctactaccaaaccttttcgctgacgcaaccaaactcccaaaaataaaaataaagtttttattttctctctctctcttatttttcttctccttcttgttccgtctgcttctctccatctccttccatatctattgttctctctctcttcatgcccgaacgcatcgggtctcaaaaaccattgatacagacatcgatccttgtcaactagtactgatctataaatcttataaaaatctgtagagat

SEQ ID NO: 9014 - DNA, 3000 bp, Unknown
  misc_feature (1)..( 3000): cDNA_ID_1989357_gDNA_ID_1971973_Annot_ID_58671 3000 nt of promoter + ATG
gtgggctcgaagtccggggaaaaagggttctcattaccatccagacagtgacttgttcctccctaaagagagaaaggatgtcctcacttctactgcttgttggactgcaatggctgctctgcttgtttgtctcaacttcacaatcggtccaattcaaatgctcaaactttatggaattccttactgggtaatgcgccgctgttactcccctgtttcagcctgagcaatttgtgtattatttcctctgccttactcaaaaaggtttttatgtcaaatacagataaatgtaatgtggttggactttgtgacttacctgcatcaccatggtcatgaagataagcttccttggtaccgtggcaaggtaaaatacatattctctgcttccactgttctttgactacatcgctctttcttttaaggttaaagccaactggtgtgtaaatctcatgattctcccaaaacaggagtggagttacctgagaggaggacttacaacattggatcgtgactacggattgatcaataacatccatcatgatattggaactcatgtgatacatcatcttttcccgcagatcccacattatcatctagtagaagcagtaagtaaattgaaagtaaagactgtttgtgtttttggtgttcatgctagtttccctgactcttgctccactgttatgcagacagaagcagctaaaccagtattagggaagtattacagggagcctgataagtctggaccgttgccattacatttactggaaattctagcgaaaagtataaaagaagatcattacgtgagcgacgaaggagaagttgtatactataaagcagatccaaatctctatggagaggtcaaagtaagagcagattgaaatgaagcaggcttgagattgaagttttttctatttcagaccagctgattttttgcttactgtatcaatttattgtgtcacccaccagagagttagtatctctgaatacgatcgatcagatggaaacaacaaatttgtttgcgatactgaagctatatataccatacattgcattatcttagatacatttaaattctagcaaaaagtataaaagaagatcattacgtgagcgacgaaggagatgttgtatatatactacaaattaagcagatccaaatctctatgtttccgatactgaagctttatactaataaaatatacattgcaatatatattattttagattcatccttctgaaggtttatataccaataattttagggtataattaagaaaatagttttctacttttttcacatttaaaatcaatcatagttattcttcctaacctcactaaatttgtttgattaattaacttaaaaatgggatttaaataagtatttgttacacaatatgtagttggatagtatccacatgtgccttccaaattcagtgaaccatgtttctattattgggaagtcgtcggccttctatttagatggtcaacggaccatttactaatacaagttttgcccataatatatttaaatcgactctccttcggaatttttacatttaaattgtttaaaagctctacttgaataatccaacatacaataatcttgaactaatttttttttttaataatgtagttattagaattataaacgaaaagtgtttgattggtatgttgaatataagcgtacgcctaatttgctattgcatgacacataaataatcatcttttaacactcttgaatttttaaaaattataattgcgattctcaaatttagtcataaattcagttaactatcatcgctaagtggcataaataatgtagttagatagtcaccgtccgttgctaatacagaataaaagtcaccgtccaattacacatacgtatgtaaggaaattatacataacttaattttatagagatggaactggtgagtgctacgttttatattagtacagtactatgtctagaaatatgtctacttttgtaatattttactcaaaagagagacgattgaagaaaatagataattacaagttacagccattgttactctcttcttacaagaactatgcatacagtttatttcaccatctattgaactatataatttcatattattgcctttatagaattgtacaattccaaagagcatcctcttccttgcgtaggttatcattttgaactattaagagcactttgataactgaagtaagttagaaatcactttacatgtagtaaagtatcaataaaattagtgcaattctgagataaggaagttaaagttaaatattattttaaaatgttgaagtcgtcagattcttttagtatatatctcaaggcattaaatatttcaaggttgagtacgtcgttaagctacccaaacattctcaaacagaagaaaatcataccgatcttaatttatattgttagggttaaaacatctacgaactttcacagctaataacaaaaaaatgaactccacgtgatagctaaaattatttgtaaggaagctacaaaacttttcattgcaaaatgcttcgtagttttcacatttggaattattatcaaatacatccacgtcattttcaatcttttttaccacgtatcagaaaaaacattttttatcacgttttcttgaactaacaagcaacaaactttaatcgtatggactctattcgacttcctcatcggttacaaacttacaattacggattcctacatacgttacgattttcttcagttacttattacaaaggaagataattaatattttcgattcacgagaatagtctgaaacatgtcggtccgagtttgattttatttgtgtatgatagttaatattcacaattcatttatttatgttaatccaaatcttgttccctttctctctctctttctctccctctaaccatataaaccaactatatataacagcacttcacaacttctcatgaacaagtagaaaaaaaagagcaagactaataagccatataagagacaacatg

SEQ ID NO: 9015 - DNA, 3000 bp, Unknown
  misc_feature (1)..( 3000): cDNA_ID_1989356_gDNA_ID_1971973_Annot_ID_58672 3000 nt of promoter + ATG
atcgcacaaagaaaagaaaaaacaaaagggataatcatgaaaaaatcttcgatttacctgagcgattacggatctcagattgttgttcggtggcatgatcgaaaattagggttcgcctctgatttgtgattttcttctcctcttcaaaaaaatgggtaacattgtcgagagtaacattgacggatatctcgagagttccgtggttcaatgggcttatactattgtgccctagctgagttactctcattgtttatttcattcacaatcagtttatattcaatttaataatattaaaaaaaaaaacttgaatcccaaagtctgttccattgttactcaattaatgtcgacattcacctgaaattttatatgtacagtatgtactttgttgacaaattatccttgcactgaattacggaattgatcatgaatgtaaattgtgtgcctctagttattttctgatatgtttttttttttcattttttttttggtaaaaggttaagttttataccatttttgattttggacagaattacagagattacatgaaacagattaaaacaatctacagaagataaatacaatattactactcaaattgttttggatcgcttctaagcgttcaagaccaagttacgagatgaaacaccgattccgagctcgcaaaacttagaaatttgcgtggttgccacagagccgaagcactggaatcctcatcttagttgccacgagctaaactattcgagggccgtccacaaaacctcgatatagaagcctacaacttctccacaaaacctcgatatagaagtccacaaaaccacgagctaaactatctgatttctgatatggttttggtctgtttgatttcacacaacacaaatcaaacatcagcacaaccatagattatagtattaagtttgtttcttttcccacaacatcgaacaaaagacgaaacacaaagcaacatcacaagttcacaatcacagattataatgagcatgttcgtttagttaccgccggcggttgcgttttgccgcaggtagttgcggcaactaaacgaacataaatagctgcgtctgccgcagccgcaggtagttgcggcgacgaaacgaacaatctaattaattcattttgttcacaaaaaaaaaaaaactaattgtctgctttcttttctcgtggagtcaataaaaggacgagccaactaaacggatcctgctgtacttcctgaaagagtgaaaacactttagtttttaagaaacaaacaaaaactcataaaatctcccaaatgtttatagaaatccataccacttcgggaaaacgttctctcagatctctctccatcgttcgaagatattcgaatacctggattgtttctggtggaaacaaaaaaaaaagatcaaggatttgttttttttccaatctctaattaagaaaaaaaaaactaaaagaaattgacgaaatatctgaacattacccaacgcacagaaagcataaaatccgttcattaccgatggcacaaaattcttaaactcaacgccgacgtaaacaattctttcggctcttttcgacccttcaaaatcgaaagaagaatcacaaatcgaaaccccatgttccgagaaaattacacttgcgaattttgatagattatgatcagaagaacgttacctctgctacgacggggagaagaaaaattaccgcgtgacctcgtagagaaatttcggctctgtaaagatttcgtcttgttcaatagatcgaaaagaaaccaacacaaaaatgaaagaaaaagatataaatcttcgatttacctgagcgattatggatctcagactgttgttgagtggcatcatcggaaattagggttcgctcttcttttcttcttcgcctcttatttgtgattttcttctccccaaactgaaagaaattcatgcggaatcagagaacgttaccatggtgggatgaagatgaattgcggcactgtaaagttttagtcttgttcaatagattgcacaaagaaagtaaacaaacaacaacaaaaaaaaagactgtagaaaagaaaaaaaaaaaggataatcataacggaatctttaatttaccagcgcgattaaggacctcagattgttgttcggtgccatgatcggatattagggttcgttcgctcttcttcttctttgtctatacgcgatttgtgagaataaaaaaggtcggatcttttgagagttctgtagtttaatgggcttatactattgggccctagcccaaatgagcgacactattgttcattttgtacaaatctcttgggctaatttatttcaggctgaccaactaatttggtccaactagttgggtttggcatgtttaatttcaatttccacttggttcaatttttatgttcaccgtccatgtaacttgactagtagcatgagatttggtttgtccctattgaaacaataggtatagggtgtgaaacattgaaacgtaattgactcaaattctcaaataggtttcttcaccaaactcctcttgttttgtctaacaatcttatatagtcactaaaataatgtgtataaattttgctaccgtcatttaaaagttagtgtcatgaaacatatgcctcattatattttattattttcgttcactttatttcaaaggctttaaactatatgacatcataaccaaaacaagaattaaaacgagatcaatcaaacccgtgttgaaacctcaacttgtgtctaaattgaccgtcacaaaaaaaaatctcacatcacaccatcactaataaatttccttctcctttcaagttgtagctaacttatataagacataagcgtgcgaaccagagacagagatagaaattgagagacgataagcaaagtagaaaacacaagtttctctcacacacattatctctttctctattaccaccactcattcataacagaaacccaccaaaaaataaaaagagagacttttcactctggggagagagctcaagttctaatg

SEQ ID NO: 9016 - DNA, 3000 bp, Unknown
  misc_feature (1)..( 3000): cDNA_ID_1989355_gDNA_ID_1971973_Annot_ID_58673 3000 nt of promoter + ATG
tctcgtaacttggtcttgaacgcttagaagcgatccaaaacaatttgagtagtaatattgtatttatcttctgtagattgttttaatctgtttcatgtaatctctgtaattctgtccaaaatcaaaaatggtataaaacttaaccttttaccaaaaaaaaaatgaaaaaaaaaaacatatcagaaaataactagaggcacacaatttacattcatgatcaattccgtaattcagtgcaaggataatttgtcaacaaagtacatactgtacatataaaatttcaggtgaatgtcgacattaattgagtaacaatggaacagactttgggattcaagtttttttttttaatattattaaattgaatataaactgattgtgaatgaaataaacaatgagagtaactcagctagggcacaatagtataagcccattgaaccacggaactctcgagatatccgtcaatgttactctcgacaatgttacccatttttttgaagaggagaagaaaatcacaaatcagaggcgaaccctaattttcgatcatgccaccgaacaacaatctgagatccgtaatcgctcaggtaaatcgaagattttttcatgattatcccttttgttttttcttttctttgtgcgatctattgatcaagacgaaatccttacagtgccgcaatttctatacgtcccgcagtagcagaggtaacgttcaaatttgcaaccgtaggtttggtttcgaggtatttgtcgcaaggaaaacaaaaatcttttgaccgttttgttgatatcatttgtgattgtagagtggaagagagagatgtttttaattcgaggtccagggatggctctgggattgggcttaggtatgaatcgatgagatatattttatactttagattttctttcattctttctacgagtcgagtcgaaattagtcagcttgctatttttttttgtgtgtgtgtgaaggttatattgtggttgggggaaacgtatcggaacttgaggcagatcggcgacaggttagttagaaaggaaaaaaaaatactaataaaaagacatcgttgttgtgaccattgctattatttcatcttcttctctatgtgtgtttcagtggacgggagaccacgtcgatttaaggaagaagatgtggccagaactaaaggataaggagtggtttaggattacgtcaaggatgtggtctgagtctgatataaggaaaaagatgttgcgtatgaggtctgatctatgggagtctatgggagtcagcaggtcgtctgatctatgggaggaaaagatgtgggattatctaacgaaaaagatgtggtatgatctatggaaaagcatgtggtctgatcgatcttagggagaaggaaaaatcctaattatcttcaagctttttgtatccggtcattgtggagtatttgggatgatctaaggaaaagcatctggtctgattcctaactatcttcaagctttgtaaatgttcaacgtggagaccagaataatcatcaattaagagaatctgtttctgtcgatgattctgatgcctggtttatggattgttaataataaccacctaatcatttaaatgtcgcgcaacgagtaaatcacacacacagtttacttcgacaccggacaagtactgtttcaattcataactccaccaacggatttccattactggatccgagtatttttctcgacatcgagagcttaatttggtgctttttacttgaaagtcttgttgagttaagcaaaggctttccattgacactgctagatacagcaccgagtttgtgtgatcagaagtttgaagaaatcgtttaagaaggaaaggagagaaacgattgataattatgcaactagtctggattgataccatggtccatagacaaccatatccaaagtaagggacatttaggaataatatacgcgaaaaagttgagaatattttcgacaactaaccaaaactttacaagggaacagtgcaggaactttatatagttatatatatgcgcatgcaaataacaactatattacaaactctttgatcatgacagcattccatacactagcttgattggttatttaataggtattttttcttattaacgaaataaatcccttaagttattatttttatttacatccaaataaatgtaatattatttctattaattttccactaccaaaataggaatttcgaactatatatttgtcttgttttagtatttctctgtacacctagctagcagcatctatttatgcagatacattctcatgataagtattttatgattctaatagatacacgtacagatgaggttactcatacatggaaatacatgtttagtaaaatataatatttgtggtaatttcaaaaaagagaatcgttttcccaaatttttactatacaaaagatcttttacttagtttgtatcatattttcctcattatacacatcaacaattcaacaaatatcaattttgtataaagatgattttatcatgtttttcttgtctgttggttatatttgtgtattccttcattttgcgattctaaaatactaataaacacatataagaatatttatcggttcaaccaaaaaacaaatttccgtaattaatcattcctctatgttgttagataacaattttcttaacaaaattgctaaaatctgtaatggcaaacccacatataaataatatttgccgcctctagtttaaacaagcatgtaaaaacgtgttatcggaaaaaataacataataattgtaaaataaatatgcaaaacttatgtcattgaaagaaaaaaaacatgataaatgtacttggtgaatggtgatattgtttttaatttttacaaataagatggtagaaaattaggttatacataatcccgcacgtgtgagtaaagccttatatattccatgcgtacacgcaagttatacatatgttttcacatatacgctctgcctcttccaaagtcacatccatctttca

SEQ ID NO: 9017 - DNA, 3000 bp, Unknown
  misc_feature (1)..( 3000): cDNA_ID_1989354_gDNA_ID_1971973_Annot_ID_58674 3000 nt of promoter + ATG
tacacgcaagttatacatatgttttcacatatacgctctgcctcttccaaagtcacatccatctttcaatggctttctcttcagctcacctcaaccaccaccaacctttgatcaagcacggtggagccacggcggcgcctcctccgaccccgtcatgctcacatctcaacaccaccagcaaatcggagacagcagttgacgctctctccagtcttttccaccgtctccctcctttgctttcactccccaaccgtcgctccatcccttctcttccgatggtatctctctccgccggagatagacttgaatgggacgatcttatctccgccgtgactgatttcggctatttccaactcattaacgatgactccgatattcttttccctcctgggatcgctgaagcagccgagtctgactcactctcgctcttagagctcagtgaagagaagaaggaatcatcgtttccgaagaaatggccgctaggctacgaagccgatgctgaaacgccatcgttttgccttgacgccgactgttcaaccgactcgagcgagttaaatctgagttcgctccgtgagttcactcggactctagagaaagttggactgaagacggtagagatgctggcgaatgcacttgggtttggatatgattcaacccggtttaatactctgatgtgggttaaccaaggtgttcctgatgatgaaccggaggtaaccaacggattttatccttttgttgtttgtttacagtatcagataagggaacagaagtattgtttgctaaccgagtctggttgggtgtccgttttaccccgagttgactcggttcttgtgacgttgggtgacattgctcaggttagttctcttttgcttttgacaattgacagaacacatatatctcttttatttatctataattaattggttagttgtcttccttaaataattatcaaattatcatcctttgtaatggaactttattccactataccgttaactggctgttttaatgtattttaaacattatccaaaataaatgttttccaacgcatcgttcaaaaagagaacaagaatttggatatttccgatatttattgttgacaacaacaacaattgtggagcataaccggggaatgtgttttcacttttcgtttgaaacagatttatggcattgggaaagaaataagaatttggaaatttccgatatttaaatacttatacacatcacatcgcaattgtacttagtgtcctatagaattcaacaattcttttttttttaggtcaaaacctaacagctttctacaatatagttttcaacttttgaacagctaacaaacaacttaaaattggcaggtttggagaaatggagaggtcaaaagagtgaaatatcgaccagtgttgtgttcaggacaaaaagatggtccagtaaagtgtgtaacaatgacattgatgcttacacttcccatggacagtatggtttcatcattgaaggatatgatcagtgacggcgacaaagaagaagagtatgcagaggaggaggaagaagatggaggagcaagaagtgatgagagaagggcatttaggccttttagtttcaaggagtacgcatggagagtgtaccaagaacgtctcttcttcagggatccacttgacagatacagaatcaaatctttaaaagattgacgaaccgatgtttgatttgtttgtttctttcttgggttgaattggtactatagttcttgttgttactttttttcccccataaaatcttttgattttcagcggattgttagcattttagcattgagatatttttgtttttgttcgattcagttcagagaatgttctattttgatagtcactccatcattcaactaattttttcatatatactcatatcaaaactgtcactatttcaaaatcaaacttttaggttacaccaatgactctatcacactaaactcaactcctagattttatatagaagaatctatgactttgatgatgtactttaaaactgagtcttttgagatcataaccaaattctacttcataacttttgttttccaatgttgattatttgttataattagaaggtgacacaaacgcttatagcatcctgtttttgaaaatgaggaaatacagtgttggcttttaatctctcattgaggcagaatatcaatgaatgacttcaaatctacgtatacatgtttacttatttagtgatccatattggtgttgctctttaattttcttgtgagaatgaattatatacatcaaaattgattatatcatttaattcgagttaaaattataagtaatacaatcttcactaaacactaattaaatcgacgtaaatttcttatacgattttttcatgcaacacttaaatcgacataaatttaaatattttggtcttcataccctaattttgataagatataatagaaaatttcgtatatctttttttttttttggtaaaaagtttttttttttttgtttcatctccatatttagaaaatttatttcaaacttcgttctcgtttgtgttcatcttaatttttaaccatgattgagtcattgaccattgctcaaaacatacgcataaaattcccaaaaagtagtgtgtgtcgtgacaaaacccgacccgtcgatttacgcggtttgaaactcgacccgaatactatccgaacccgtaactttggcaaaagcacatcgtacagctcaggcacttgtagcacgtcgtctctcctttggtttctctccttatattcgacgagtgactccgattggatcgctatttcgtcatttctcactttccaaaaagaaaaaaacgaatctctctccaccatcatcacctttctccttcacttgcctcagatctggctgcgatttcaaatcttccttagtttctctcgcatcgctcggccgttgacggtcccgtcctttccgtggatctgattctggccccggattctctcgccgcgatctgaggtcaaac

SEQ ID NO: 9018 - DNA, 3000 bp, Unknown
  misc_feature (1)..( 3000): cDNA_ID_3409615_gDNA_ID_1971973_Annot_ID_58675 3000 nt of promoter + ATG
gtttcctcataactactaaaatgtcgctgaaatatttgaaaaaagagctgaggtgttttttctgtcgatcaaagtttccacgatggtcttggtgaagagctagtagaaataagcatatagttagtgatgttaacttgggcattgaatagccatttgttaaatgggtatgtgcaaaaaaaaataacccatttaaacccatttagagaaaaatatcaaatggggttaaatgggttaccccaattaaacctatttaataaatgggtttacccacaaacaaatgggtacccatttatgttttattttatattagttatttttattaaaaagtagataacttaattataactaaaataaagagcaaaatactaaatatatttaaaacaaaacgtaaaatcacgtttttccgctaaaacccataaaattacgttttcccaccaaaatcacgttttttaccaaaatcgaaaatcacattttcccaccaaaatcgtaaaccgacgtttttccgccaaaatcgtaaaatcacgttttcccgccaaaactgtaaaatgacgttttcccaccaaaattgaaaatcacgtattttcgccaaacccgtaaaatcacgtttacccgccaaaatcgtaaaatcacgttttcccgccaaaatcgtaaaatcacgttttcccgccaaaaccgtaaaatcacgttttcccgccaaaatcacaaaaagtgttttccgccaaaaccgtaaaatcacgtatttccgccaaaaccgtaaacgacattttcccgtaaaaccgtaaaatcaagttttcccgccaaaatcacaaaaaaaaatattttttgccaaatttgaaaatattattatcattatatgttattgaaatctatattttagtaaattataaatatttcagatttagctaatgtttatggactgttgttatttatctattaagtttatgaattaattaataaaaggcaatatctcacttaattggtttaaatgggttcacatggatttactaaatttaaatgggtagggttaaatgggtttcaaaaataaatggatttatatgagtttaaagttaaatggagtgggtttaaatgggatgggtttaattggggtgggttagcccatattaacatcactacatatagttttctaaactaaatatgtcattatcatcatttactggtttacatgcatcttttatacatttcaaactttcttatgaaaacgcagatgtgaaaagataaatcatgatttacaggttatcaaagtgatgtgagttggaacgtaaaacaatttagtttgtcaactgaatcttagacgcaatcgattattgttactcttaaatcactttacaataatatcaaatatcacatcctgcagccaagtaatcgagctaatccatgatcaagtataggtggtgaagcaactaaaaatgtagccaatttcgtttgtacgcataattaaacaatgctatttattttagtatgttgctacttgccagttgctaccattgggatctcgaaaacacacaaacgtacgtgcatgttgcctaatatagtctttattattgttcctaaactaattaagacaaattaaaacaatatataaagtaacaaaaaaaaatcccactttccttcaaacttgagtcttgcttgtacagacagttgtactacttgtggaagctgtttaactcaaattaatattctctttctgttattttatttaaggaaatacaatcacgtgactgagattagcactagtatactatatatatacatcacgacgctgtttttatacatactatatatcaacggccagaattaagtaagtaaccatccatcgccaaccggaaaatgacgtcatcttcaccgtctccacaagcctcgatgcttttgtactggcacgagaatcaatacgacgaccggaacttccagattcatggccggacactcttcttcgccttagctttattctccgtcgtgctcttcttcgcactactcactctctacatccaccggaactgcctcccccgggattctatcaatctccacgcgtcctctcccgatcgactcacgcgttgccgtagcggagggcttgatccggcggagattcggagcttgccggtggtgctttgccggagagaaagggcggaggaggaggaggagaaggagtgttgtatatgtctaggtggtttcgaagaaggagagaagatgaaagtgcttcctccgtgtagccattgttaccactgcgaatgtgtggatcggtggcttaaaaccgagtcgagttgtccgctctgccgagtctccatccgtgtcgactcgtcaagctaatgagacagctagagtgatagtgattaagatatgaatttgttttttttttttgtaattgtgtgggtaaagatttatacatatacttgtgtattgcatggacatggatggaggatgatgtttacacacacacgaatggttatggttttttctaaaaggatttaattttcatattctgtctttatcattgattgtgaagtttttataatcacttcatctgtattttaaacatacgatgatagacatttttgtgtagatgtttataagggtaaatggacttattaattcaggtaaataactaaatgataaaacaatgatatgttcatatttgatacagttacatgtaaaattctgtgctatatttctgtataaataacatgctatttttttctaaatccattatttcaataaaataaaagtattcgttacaatttagaaaggcacaaaacatgttacaatttagaaagtcatcggtatgggctttattgggcataaaattagtatcgatcggcccaatatttggaaaaagaggaaacgagtgtctagggttttgctgtcatataaagaagcaaaatgagtggaagcaacaaaatctttctgaattggcggccgctcattttcctgaaatttgcatagaatcagaggagtgaagagtttatcttctgtgaattcaccatg

SEQ ID NO: 9019 - DNA, 3000 bp, Unknown
  misc_feature (1)..( 3000): cDNA_ID_2781957_gDNA_ID_1971973_Annot_ID_58683 3000 nt of promoter + ATG
aagatagtattagggccagaactcactcaacagtgacctggatgatatctttgttgtcttcattgaattctaggagaggctgatgtgaagaacagaataaacacagagatcatcagatgagaggagcgacacacccagatcaggaagaacgattgtcatgttgtggcaggaaaagtttttgattcatataaaatcaaagacagtaagatggttgaacctgaagactttggcaagaaatgttgtaccatggagaatctgacagttggcgaccttcgagtgaaacatggtaaccaaagccctgaacaaaagagagaagagggtttcagaacatagctgaacataatcataaccaagaaaatcaatgcatgatctaccatggtgttagtgttacaaaataagacctgatcaatctcaccttacctgattgaaatctgagtaaaaaggcaagacttgtggataagtttggactattccccatgacttctcgacaagtgaccaccatctggagagaaaacacatgcatactaataagatccagcgtctcctttacagcaatagtaaaataaagttttaagctcacagtcacagtaatgctagttcaaactttaaagatgacaaggagattggaaaatatttaaaatattacttattctgagctgtgtgaaaattggggggttgtgcagtctcataaacccatccaggagcaaatatggcagctgacacattgtttctcttcagcaaatccagagcagcatttacctagcatgtaaaagaataggaagaaaagaaatatttaagtatagatcattgttttgtactctacaccaatagagaagcaaatattaaagagtggctgagacatacagtccattgcccaccaccaaaagagccccgcccaaaaacatcaattcccatgtagacatcgaattttctgtccccagcaacttcagctgataggtttgggtagctctcctgatacatcattactcactaatagtaaaacaagacaaatagaagaaactgagactcgagagattgatcaaacccatagacagaccttccatgtgtagttcatgaatattccatcgcataagtcaaagaaaggtttgttcagctcagtcaattgatcttgccactgaagattaccacgaacagtgacactgtcatacctgcagaaagttatcagaacaaagtggtatacaaaaagaacaaagaaaaacttctgatcaactcaccatatgactaaagccccaggtgtcgataaatgcaagactttttttagatggctgacgaattccttcatatttggaatctgttcctcatctatatcattctctatatttatctgcaagtgacagtctatatattatagaagtctttcttcaccagccacccatcaaatacagatatcttataaaaaccaagcaaaaaatgctcaccagccacccatcaaagcctagagcagtagcaagttcagccaaacgctctgcatacatttgagcagactcctttgtggcaagcatctctttgcaggtagcttttccttcatcccattctgtgatgaaagtccccaatacctttatatttccataacacacaagaaagtaaacacttttaccaataaaatcctcagcaatattcatatctctgtacacaaacaatcaaactctctaattttatcatcctaatcagcaaactcagagatatctcaataaaaatcgaaactttggatgttgaacaatcaaaaagttttgagcttacttactttaacgccatgcctatgagcagtattggtccagcaaggaggaggaatagtgaccagagaatgagagaagtaaacaaaaatgtccatcaagtaccaatgccaaatcgcaaatccggcttcgttttcacacccttgtacccacttgtcatctacataccctcctttcatgtcatggcagactaaaacccttgggcgattcggtaaacagtcggagtttcggcggaaaggtactgtggagcgattaaactggaaatgaaaggaatcaaagtaagagcgagatttcaggtcttgaagagctttgatcgggaaagatataggtaacgatggcttgacaagatcaagcaacggaacggcttcagattgtgcaacgtcgtcatcgttggatttgggcatgaggagagagaggggaaatgaagtgaggagcttacgggagagggtgaagaagagattgtaaagagatacgagagttcttcgagagaaataggcgcgaagaagttctcgcattttgcagtggtcaacgaaggaagatgatgacgatggctttttatttaatttattcttcttttggtttattcgtacgccaaattaaagaagaaaaaaaacagagcatgtgaatttatcattcttttgatgtgaatctaaacgacatgacaatttcattttttttataaagtaaacttacacgaaagcagagagataagatatttatatgggccttggcctgtgattactgattaaggcatgaaaagttggattcttctttattggatctgataaaatgcttataaggcctttgaatacaaacaaagttaaatgttattgttgatcctttaaaagttcaaacatgtgattagcaaaaagtgtagtggcttttcttgctttctttttgttttataacaccgtaatccaaattggaattcagactaatttggagatagataagttcattggatacaagcaacgaaattgttccaattttgtaagtttgaattaaaatataaacagtcgtgcttaattatgggcaagaacatgggtttggttttggatcgtgcaagtacaacaaattatagctttgtttataaacattaaaatcatatactataataattcagtatactccaaattaaagttttaatcaaaccaaattttgtcattactacaccataaaaagagaaaggcgtaaaaaggaaaaagaaaaaaaaaggtaaacgttataataaaagaaaaaaaaaaat

SEQ ID NO: 9020 - DNA, 3000 bp, Unknown
  misc_feature (1)..( 3000): cDNA_ID_1989346_gDNA_ID_1971973_Annot_ID_58686 3000 nt of promoter + ATG
gattacaaaacatctctcccacaacactcaccatttttatccaacaaaataatgaacaagtctgtctgatacaagatttctaattaaaggatcgcattgtcttgattttttctcaattttttcttttatattacttaaataaagagaagaaaagtagagcttattacttaaagttaattaacgcggttcttagattgcttgaagcagaaggaaatattattcatttactattttactcttattaaagaagtttttttcttttttcttttttgtgtggtttatgaatgcgacacgaagagaggaatacggtgttctagctagtattttatcaagcttcttggtcatgtccaaatccgaatttcttcattgactaagataaaagagggaatattttcttaagaaacagagatcattgtgtgattatcttgatgatcaatagacaatagtcttcagaagattaacttcatcagttgatgttgatgaacgaatatgtttgctaatttgttatttgattctcttatagtattatctcttccaaaattctctttcttcttgaaaaatggaaaaccaaacacaacaaaaagttcagaagttcttgcgattagaaataagattcttctcttagtatagtatgtttagatataaattaaatagaatgaaataatgtattattttactgaaatggagaacaatacataagaaaaatatatgaaataaatgatccttatgattggaacttaatagcctaaatctcaaggtgtataaaatactaaaatacttgaacaagcttaatgttctctacatggtttagatatatgtaacatcacttaccgttaagctcttccattccttggatttcaagtcttatgatcgtgttcctctcgatattgtagtagaagacgtaggaaggcataaatgtagatgggtacttgtacgaaaacacaatttcattggtgcaactgccaaccattccaagaagtcgtagcttggtctcttctccaactacattcttccacagaggaggcaacatgtatacatgcttcgaccaatcatgtttttcagcgtcttctaggacccgcaactcgaaacttttacttgttccactaacaatatcggtagactcttccgtcatcaacaaacctaatttgccattgtagtttatcatagttgttgaactaggcaaatctctatcgaaagtttccatgactttcataaagctgaacttctccgagctaatatcgaagcaaactactatagtaaccattaaagaccctttttcgacggcagtataatacaaaacactgttaatgcatatttcagtaccacgaggaacatggggtttgcaacattcaatcatcctccatgattttcttttagtttctagtgttagaacttgatactcttggcattgatactcgttagccaaaaccttgaactgtttcttagtcttacaaaagtaaaagaattgtgcaatacttgcaacctaaaaagataaacatctaatatttcacacattttataaaacaaaagaattaaaaatttaaaatatgttattttttgaatttatttttagtaaccttgctccaatttctggatttaaacaacaattataatttcagaattaaattaaaaatgatggtaacaacaaatttattaatttttgttttgtcatgatcttaaacaaacctataaaatctgtctactttattaacccagagcattgacgtgattgtcgtacaggcaactgcaacgtctctctgcattctctgatgaataatattacggaaacacccctataactttccattttagtgtcaaagcccaaaaacccaaaagggtaaactcgtctcataaatatttctttttcgcgcttcatctattttctttctctcggaaaataaattgcagtgttttctgcgatttccagtctatacctttttgttttaactctctctctctctctctctctcatactagccattatcaaatcgaagaaactctaagatttttctcttcaaattccatttctctgtgaaaatttcttcatcctaatgcgtttctcgactgttattcgcaggaatttgagtttctgaagattcggttcgcttcgtcttcttcgtctctatcgttcaggtaaggtcttctcttactctagctgttgtttttatttttgaaatttctttgagattttgtggagattgtgctctaatgttgctctgtttgcttatctctaagctcggaaaccttgaatctctcttcggtcgtctccttaaacctcaagtagctgtgcgcttaaggaatctgaggtattattgtctcaacttcgcagatttgttttcatttcgttgtttccgtttcagatttcagttttgtctcttttagaaaccttcgattttggtttgtcactgagcgtttgctgagaaagaactcatgtgggtatgagatctttcatttttctttggtttcttaattaggaactgttgttaacgttcagtgattgaagatcctctctgcttaaggtttctggaactcgtgaatttttttaggtttatgtgttgctaacattgtctcaaaatgcaagttggtcctacttagagtatctgggaacgagtacttcagataataactgcaaattgcttgatgattttaatgacagttttgtgttgacgatttactgtcacttatgcttttgttacgcttttggttttgacatgctttctagtgagaagcaatgggtgcagggaggaagacagagacctatacattggctcaggatggtcaatacatatcaggataaggaaatatgtgtgtgaggaatctgaagaagggagatctttgtggggttatatttggatgcaagttcagcactatcaaagagtgctatgctaagaatttgtttggttagttggctatacaatctttgaggcttaaagtttaatgacgaccaggattttgaaaatgatgcttgttttgtgaacaggcttaccagccccgcacatg

SEQ ID NO: 9021 - DNA, 3000 bp, Unknown
  misc_feature (1)..( 3000): cDNA_ID_1989344_gDNA_ID_1971973_Annot_ID_58688 3000 nt of promoter + ATG
ataatcagaaccagaggaacttctcactaccaaacgctgcttcaccaacttcgtatctttcggtatctggaaaataaaatagaaaatctcagaactttaaaattgttctccattgatttcgaatcaaatcttaaagcagaagactaaggatactaatacaaacctgaaagctgagattcgaggagaaattagagtgaggaaagcgaaaagatggttcggaagagataagcagagacgaaggacgagtactgcatgagcagtccatgatttatttgattagggtttcttcggaatcagaaactgagaagatgattgaacaaaagcattcgtttttgttcgaagtttattgaatgattttagggttcgcagacggaactatctaaaaggctttgttctggttcatacgtttggagcccgagaacgtagtgagagagagagaaggtgaaagagagcaagctgaaattgttatccagtggatcacgccattgatgccgttttacgttcttagtatgagacgttacgtcgttttattgaagtgaaaacaccaggaagtctgcatctgacacaaatactaacgcttaaagtaaaaactttcggatcagtgaattatggactttgttggaatgttgggtatatacaaataggaacgttaatgggccagtgaaataaactttaataggccattaattcaacatggtacattagtgggctaatatatattttttgtggtcataaataattagttcaacatggtcataaatatttaaactttttctcattgttttttttttttctcaattgttttttcttccatatttgaaatttcaatgcttttcctcaagttaaatttcatcaatatagaaacatataaatttactattgttatagattttgagatacaaatatttaaaccaattagataaaaaatccatataagattttatcatgaatttcttgaaagatctccaattattaaatgtatattcctagaaaaaactatatacagaataatgactaatttgccacaaaatacaattattcttacatatataaattgcatcaaaagggtgataagttatcaatttcaacactgatttactcttgaaatatctctttctcaatagaacttccaaaggaaatgaagtaagtctctaacattctcactttcttttgcctcatagctctcctatcccgtaagcatttcttatatctctgagattttgttcatttctgtaatctaaaactcaatcaataagacttattactatttaaaacaatattagcatacatgacttaagttagttttaacggtgtagatataacattctcaagtgttagcgtggtggaaggtagaaacacgttggagcatgaagccatgtcgcatgtgattaaccaaaagacttctccatatgttgtgcatccgcaaaaggttccatgcgctgattgcacttggccatgtgatcctgttgtagttggtgaaggttgtatatgtcgttgctaaaatttccgtttctatcataatttcgccatatataatgtgttggaccttcgataaaaattaaataacaataaaattatatttattattgattgctcggagaaagagatataatgataccatgaatctctttctcataactacatggtataggaagttgaagaaaacaatatgttgatttgcatttctccataaaagacttctccacatgttatgcatccgcaaaagcacccatgcgctgatttgcacttgcccatgtgatcttgttgtatctggagaatgtcatatatgtcgatgctaaagttttttttattttatcgaatatccgccaaaatgtatttggccttccacaaaataataattattattgattataaactctgagaaggagaccataatttctttctcatgacaacattgtcattgttaatcatccaaatcgatttcactctatgtgttgtacacgcatcacatgaacaatacaacatactatgtctcagtgatatcgcacagctgaatagctgatctactttcaagttaacatacaacacaaaaaaaaaaaaaaaactatgatagataagaagaatatggttggtagtaagaaaatgtattttccctagatcaaattccaaaacttgatacaaaaactctaaattaaccactggatggcttcgattctgtcattaacgtgcgagaatctcggtgtaatcgagatcattataaacttaatgatattttatcattctaagagctagtcttggaaggtgtgaagactttattaatcaagtatatataaattatcaaaaaacacaacccaaaaaacagtaagaacaatacacatctgtaacagcttgtcagtaaattagtagtaataattaaaatctgataaatactatatgctaaaacgttttgtgtatcttatttttgtgagtacactaatacaataatgcttttttttttccttttcatgaataaaaaaaaacgtattgggacaataatggcggcctgatcaacgctaagttaactgcaaccacgagaaaaaaagaatccgagactagttcttccccaacgaccaatcttatgttgcatcaatttcacaacagaagccttaccttttcattacacgcatattgcttcttcaaagtttccttttagataaattcttagtctgagtaacatctctttcttgtcttgggggtttctctgtaattgcagctgaatcggatcttgggcaatttttaaattccgattcaacgagtttctcaactaagggtttgattccttttctttttcatctttgtttattcaaatctgaatactttgttaggtttcaatgtgctgagaagtagaagaagcttcgttggcaagtccgaatcttttcttcttcttttttctgggttttatattctttgccaacaatgtttaagcttgcaaagcatatattcctttgagtagctgttttattcctacaaagatttgatcttcaatagagagagataatg

SEQ ID NO: 9022 - DNA, 3000 bp, Unknown
  misc_feature (1)..( 3000): cDNA_ID_2993976_gDNA_ID_1971973_Annot_ID_58692 3000 nt of promoter + ATG
gtaaattcaacccggttaatcctggttacgccgcatgcgttgaagaaattcgaaaggatctaatcgtcgccaccgtagctgcgtcactaatcggttgtgtaatcatgggattgatggcgaatcttcctctagctttagctccgggaatgggaactaacgcttatttcgcttacaccgtcgttggatttcacggatccggttcaatctcataccggaccgcactcgccgccgttttcatcgaaggactgatatttctcttcatctccgccataggtttcagagcaaaacttgcgaaactcgttcctaaaccggtcagaatcagttcctccgccggaatcggacttttcctcgctttcatcggtttacagaacaatcaaggaatcggtttagtcggttatagtccttcaacactagtcactctcgccgcttgtccagcctcatcacgaatatcgttagctcccgttataacgtcagctaacggaaccgttagtttactcgccggaggatcagtttccggcgatattatgtgtattcacggacgaatggagagtccaacgttctggttaggtatcgtcggattcgtgatcatagcttattgtttggtaaagaacgtgaaaggagcgatgatctacgggatcgtcttcgtaacggccgtttcgtggttccgtaacacagaggtaacggcgtttccgaacacatcggccggagatgcagctcatgattatttcaaaaagatcgttgatgtacacgtcattaaacataccgccggagctttaagcttctccgggataaacaaaggacatttctgggaagctctggtgacattcctctacgttgatattttggatacgacgggaacgctttactccatggctagattcgccggattcgtcgacgagaaaggagatttcgccggacagtatttcgcgtttatgtctgacgcgtctgcgattgtgatcggatcgttgcttggtacatctccggtgactgttttcatcgagtcgtcgacggggataagagaaggagggaggacgggtctaacggcgattacggtggctgtttatttcttgttagcgatgtttttcacaccgttgctagcttcgattcccgcatgggcggttggtccgccgttgatattagtcggagtgatgatgatgaaatcagtcacagagattgattgggaagatatgagagaggcgattccggcatttgtgacaatgattctgatgccgttgacttactccgtcgcgtatggattgatcggagggattgggagctatgtagtgttgcatctatgggattggggagaagaaggtttggtgaaattagggtttttgaaaaggaaagttaaagaagaggataataataatggagttgtcaaagctagtgagattgatactaccgtttaggtttttctttgatttgattttacatttttgttactattgattttttagatttctttcttaggatgaaaggacaagtgattgcattattgatttgttgctcttgtagattttttgaagagaaaagtgtaaaaatgttggggaaaaataaagaaaactgttgaaatttcgagctctattatgctttttgacattgacactagtagaggttaagcacttgaatttgactttcattgaataggaattgaaaggttcattacagaaacaaaaagggaagaccccaaaaggagtcaagagggacacttaccttctcttaagttaatctgaatcaagaaagtaacaaaagaaaaaagcctatggaaactttgtatttgatagaacaaaaatgacttctcggtgatcgccgttatgatttttacgatctagctctcggtttgctctctcaaccgcctgatggtactcctaacagtcacagcactagccgtgttcattgtgtatgcaccgcctgctttcactttcccgcaatctttgcacccccaaatgccaacaactttcctcttaacggagtactgcatcagaaatcaactaaagtcttttcacaaaatgcaaaacagagatttgcaaactgaaaacctcattgaattcaacgacaataagttacttaggagatggtaatgagagtacctttccgcagaactcacagaagtacttgttgtgttgactcacttccatcttcttgatctgcttcctaagactggcaccatatcgtgtacctttgcaaacacacaaacacaaacagattcagattgaggattcaatcattacaatagagacatttcagttctctgttcatgatctgaaactaattcttactagagaaacaaggtttaaggtttcaacctatgaatcaacagaagtctaaagttgcatactttaaactatagcccaggattgatttctgaatactcaccatattttccgacaattctagccttcttcgttctcttggtctgaaatccaaataaaacaaataagttgagaatacaaatcgaagagattcaatgcaggcacacgaaacagaagatgcactcaccattttcgccggctgagggagaaaagcagacaatgtgcaagtcccggcgaagaggaaggatctctctaggctttttactcgtttcgataagtacagggtattaggggaaattagggcatctccatccatgataaactcacaaagtttctaaaaaaaaaaaatattaatattatatttgattatttgattaaaaaagtaattttgttaaaaaattgaaccaatagtaagatgagaattgtcatgactcaagtgagaaactttctacactctctctccttcattttcattatttttatttttttaattgtgagaaactcttatgagatacctcaatagagatggttttagggttttattcaatgggctataataatctatcatttaaagcccattaaataaaaagcccaataacacaatgtcgttttcgtttgtgtgacggacgattattgtaaaacacagatatcaatgttgcatcaggtgaagaacgagagatagagaacg

SEQ ID NO: 9023 - DNA, 3000 bp, Unknown
  misc_feature (1)..( 3000): cDNA_ID_2993980_gDNA_ID_1971973_Annot_ID_58694 3000 nt of promoter + ATG
tcacaacacttgtctctcttagcttcaataagttccattagttgataacaacactccaacgttagagatccatcaaaccccatacacgagtctattttgtgtatttactatgtctatttatcagattcaaatgcttggttagaagttgctatgggtctcatatagtcagaaaatttaaggtactcgtatttaattcgtatatgtacatcagtacagataacatgtacatctatgtctaattgatcaagttgttagaataaagaataattatttaaatttagatgatggccattttaggttatactagacataaaaatgataggatatatataaaaagttgaagacataaaaagatcaatacatgataggatttatatatacaagcaaatgagtactgtatgagttgtgaaagataaacatatataccaccacgaaagagtgtgatacaagtaaaattcatttaattaatataaaatatagtaggtggacatggagatggaatactatatcatcatagaatttcattttatgtaatgaaatgatagtcgttgaaagaaaacatgataaattaaaatggaattcgtaggaatacgtaatagagtttgatcatcttcattgatatgaccatgtataatactataacaacacaagtgactacacctactcaatcatgtagtatagtcattacttgtagacttgttgtagcactgtttttcttttcctgacgtcatatttgtagcaagtccgattaaattgtgtaagtgaggttcttctgtgacgtgaacacgtgacctaacattctcagcatatgggcattaaagttgggctagtcaaatccatctgaaatgtgagtattgttctgcgccacgacgtcgtttaacgaacagcggtgttaaactttttttgtattttttcctccagtggtgttaagcttcagacgaaggcaagagttaatttagttgaacaaagaaaccatcttatattcattctggatatggcgtttagttatactacaaatggtgaataacaagaaaagctaaacaaaaacaagtaaaagcattctcagaatcaccaaagttaagctcatgaatctttatccttggataagctccatgagagtctgcttataacattttcgtctactattttgtagtggtgagacaaccgcctgtgaatcgtcccgcaacacttgtctactttgctttgatatttactgtacaaagccggtattgttacagataggatggtccctgttcacaccataaaaagtataaacttcatataagaatttggttcactgagtttaaaacaacaatgtcgcaggaactaaaacgagatcaacaagccaacgtgggggatgaaactgaaggatcaaaaaacatagaagctttttcctttcatttgcatttaaggatcaagttactaaccgatgtaaagaagagtgcagagagatatatagctaccaatggcagagagaagccacagacaaatcaccacctgctaaagaaaaatcgtcagaccaacagttcagatgcttaacggttcccatgtcatttcactcaacatcatcgtgagtttctgaatgggttagcttcataaccttgaagaagagtcgaaaatcgttgccaactgtgacatcatgagccattacaagcaagtgattgagttttatacggaaagaagctgcagcactattcaccatttcctctgatagaacaagctctggcaacgaatgcaactgtctgcttataaagagataacaggtagaaatcatcactaatcagtcacataacagcaaagaattaagaaaaagaagactagtgaaaagtagagcgcacctattcctaaaagcagaaacccgggcatgaacgaatgatatcatgatcacgatgagtaagacatccgaagaaacagataagaaaggcaacccggaaaactcgaatataagccaggctacagttgatataatgataacccccaaagaaagatgtcgcctcctccataagagcaagtcagcagctacatcaaagaacaaagccatacaaaaatcacaaacagtagctttttgctggacctatgaactcatcatgcgtatccagagatttgaatcaatcaatttctcattcaaaatcaaacctaaacctaactttcacctgccaagttttccattttctactatacccaaaatgctaaatgtacttacacacatgacgattttcacaaccaaccaaaatcagaaaccctaactattccaactatcatccccaatttgaattttctgttctgtaaatccgagaaaattctcatcacaaactaccaaaatgatgaaaaaacacaaattctggaaaaaagaactcgcctttgccaccacccatgaactgatgaaccgtaatctgccgacccaacaatcgataatccgatgacgatcctccttcatttcttccatcgaaatcaccatcgatatcacttaaactatccatcggagaattaaaaaaaaaaaaccgaatttacacaaattctccgacttccaggttcctatttcgatctcgccgactccgatttgaaatttaccttaaagatacgatctcagtacaatggtttgtgaaagcagctagattgatgggagaatgacagcgattgggtggattatcaaggaggaaccaaatagaattggctttcacatgcatccaacaaattcaacatttggaaattctccgtttctagtcaactttcttcatttctttatttttttcctgtgaacaaacaaaaaagtaacatttagccgtcacaaaatattaaaaattacgctttattatattaaggccttgggctcactaatccaatattacggcccataaataaaaatcacatgtctacgtgtcaaaacagtcacttttctctatacatgacaggcagtgatattatcataaccctccacttatacacatgttcatttttggcgaccactagaaggagaaacaaatcttcattccaacaatg

SEQ ID NO: 9024 - DNA, 3000 bp, Unknown; identical to SEQ ID NO: 9023
  misc_feature (1)..( 3000): cDNA_ID_2993980_gDNA_ID_1971973_Annot_ID_177523 3000 nt of promoter + ATG

SEQ ID NO: 9025 - DNA, 3000 bp, Unknown; identical to SEQ ID NO: 9022
  misc_feature (1)..( 3000): cDNA_ID_2993976_gDNA_ID_1971973_Annot_ID_177521 3000 nt of promoter + ATG

SEQ ID NO: 9026 - DNA, 3000 bp, Unknown
  misc_feature (1)..( 3000): cDNA_ID_2179992_gDNA_ID_1971973_Annot_ID_177512 3000 nt of promoter + ATG
gcgtcaaaccaggatcaatgttcttgatataagccatgtgcggggctggtaagcctgttcacaaaacaagcatcattttcaaaatcctggtcgtcattaaactttaagcctcaaagattgtatagccaactaaccaaacaaattcttagcatagcactctttgatagtgctgaacttgcatccaaatataaccccacaaagatctcccttcttcagattcctcacacacatatttccttatcctgatatgtattgaccatcctgagccaatgtataggtctctgtcttcctccctgcacccattgcttctcactagaaagcatgtcaaaaccaaaagcgtaacaaaagcataagtgacagtaaatcgtcaacacaaaactgtcattaaaatcatcaagcaatttgcagttattatctgaagtactcgttcccagatactctaagtaggaccaacttgcattttgagacaatgttagcaacacataaacctaaaaaaattcacgagttccagaaaccttaagcagagaggatcttcaatcactgaacgttaacaacagttcctaattaagaaaccaaagaaaaatgaaagatctcatacccacatgagttctttctcagcaaacgctcagtgacaaaccaaaatcgaaggtttctaaaagagacaaaactgaaatctgaaacggaaacaacgaaatgaaaacaaatctgcgaagttgagacaataatacctcagattccttaagcgcacagctacttgaggtttaaggagacgaccgaagagagattcaaggtttccgagcttagagataagcaaacagagcaacattagagcacaatctccacaaaatctcaaagaaatttcaaaaataaaaacaacagctagagtaagagaagaccttacctgaacgatagagacgaagaagacgaagcgaaccgaatcttcagaaactcaaattcctgcgaataacagtcgagaaacgcattaggatgaagaaattttcacagagaaatggaatttgaagagaaaaatcttagagtttcttcgatttgataatggctagtatgagagagagagagagagagagagttaaaacaaaaaggtatagactggaaatcgcagaaaacactgcaatttattttccgagagaaagaaaatagatgaagcgcgaaaaagaaatatttatgagacgagtttacccttttgggtttttgggctttgacactaaaatggaaagttataggggtgtttccgtaatattattcatcagagaatgcagagagacgttgcagttgcctgtacgacaatcacgtcaatgctctgggttaataaagtagacagattttataggtttgtttaagatcatgacaaaacaaaaattaataaatttgttgttaccatcatttttaatttaattctgaaattataattgttgtttaaatccagaaattggagcaaggttactaaaaataaattcaaaaaataacatattttaaatttttaattcttttgttttataaaatgtgtgaaatattagatgtttatctttttaggttgcaagtattgcacaattcttttacttttgtaagactaagaaacagttcaaggttttggctaacgagtatcaatgccaagagtatcaagttctaacactagaaactaaaagaaaatcatggaggatgattgaatgttgcaaaccccatgttcctcgtggtactgaaatatgcattaacagtgttttgtattatactgccgtcgaaaaagggtctttaatggttactatagtagtttgcttcgatattagctcggagaagttcagctttatgaaagtcatggaaactttcgatagagatttgcctagttcaacaactatgataaactacaatggcaaattaggtttgttgatgacggaagagtctaccgatattgttagtggaacaagtaaaagtttcgagttgcgggtcctagaagacgctgaaaaacatgattggtcgaagcatgtatacatgttgcctcctctgtggaagaatgtagttggagaagagaccaagctacgacttcttggaatggttggcagttgcaccaatgaaattgtgttttcgtacaagtacccatctacatttatgccttcctacgtcttctactacaatatcgagaggaacacgatcataagacttgaaatccaaggaatggaagagcttaacggtaagtgatgttacatatatctaaaccatgtagagaacattaagcttgttcaagtattttagtattttatacaccttgagatttaggctattaagttccaatcataaggatcatttatttcatatatttttcttatgtattgttctccatttcagtaaaataatacattatttcattctatttaatttatatctaaacatactatactaagagaagaatcttatttctaatcgcaagaacttctgaactttttgttgtgtttggttttccatttttcaagaagaaagagaattttggaagagataatactataagagaatcaaataacaaattagcaaacatattcgttcatcaacatcaactgatgaagttaatcttctgaagactattgtctattgatcatcaagataatcacacaatgatctctgtttcttaagaaaatattccctcttttatcttagtcaatgaagaaattcggatttggacatgaccaagaagcttgataaaatactagctagaacaccgtattcctctcttcgtgtcgcattcataaaccacacaaaaaagaaaaaagaaaaaaacttctttaataagagtaaaatagtaaatgaataatatttccttctgcttcaagcaatctaagaaccgcgttaattaactttaagtaataagctctacttttcttctctttatttaagtaatataaaagaaaaaattgagaaaaaatcaagacaatgcgatcctttaattagaaatcttgtatcagacagacttgttcattattttgttggataaaa

SEQ ID NO: 9027 - DNA, 3000 bp, Unknown
  misc_feature (1)..( 3000): cDNA_ID_2179988_gDNA_ID_1971973_Annot_ID_177511 3000 nt of promoter + ATG
caatacaaactgaaactgaagcataccaaatcaaggattgacaacaaaagaagagagtattcccttagagccagtttcgaacgttgagtcaaatcatttccatattcttcttccttttagcgcatttgttcaaaagaaagaaagtagctagttaccatatgcttaaaaacttccattgctcccttttagccgaagtatatcccttcttgtttcaagctgcaaagaacccaaacaaaagataagaaagtttgcatttgaagctaggtaagaaaaaaacaaaagaaaaagtatcaatttacgagttttgcaaagtgtttttaccagctccatctccaaagtaatcatcctctcagcttgtttcagctgagtatgcttcaactccttgacttccgccaatagctagcagagaaaaacatattcataatgtttcattagagggtcacaagcaaaactgttttttatagttcagagaacgatggatgaccttaaacttacctcagtcaatatatccacaacagtgggagatccaatttccatcttgaaattatccatacgtccgatgtcatcaaccacgtctcctgtaccggcagaaacatacgatgatccacaaggcgatttagctatacttctttcctcaaagtcatcctcccaactgttaggcaccatagatgaagaagcttgtcctgtgttacccactaagctcttgaaacattccttatccttaggatcctccaaaatcttgttcagtccatcgagatggacttgaaaggaagatgttgcatcccaatcgatgaatgaatatgtatcctcagcaggctcttccttgctaatgctaggtactattctattgttagctgtagtagaggttcccttttgtgttggatggagattttgctgatgatgataagcattcactttgacatcttcaccttccattgcagcatttctgaatcctccactgtcttggtgtataggtggaactcgagcagcagatgtccaaggattttcaacacctttacatgcttgagatgaaccttcatttgttatagaatttttcttctcctgagttgaagaagcggtcatgtgactcagagctgatgagtaagatgtaccagactgtgacactgatggttgagttcttcgctcatctgcattattggaagctgtttcccattctttagtttttccaagattgactaatctcgaacctgctccgagtgcaccttctttcgagtctttctctttgtttttggtagactcatcggaagatttgaacagattgctccacttatcaatacgcgttgctcccgagtcacctatctgtgcaagagaagatgccggaataggctttctgggtggtggtacagcatctctggatatcgttggtggcctaacagatggggatggtttaaacaaacggagcagcttgtttgtctgacctcgatctagttcaaaccaaaacatcttgtcgtcattgtaattctcaacaattactgggctgaacttttcttcaggcaagggctcacaccgcactcggactcgtacctttacctgtggcaaagatttgcagaacgagatacatttctgtttagaggacatttgggtgactcaactaaagaagacgttctgtactaagcaaaggtacctgagcaggatatggacttggatctgtcccatttggagaccaagctttggaatcaatgttcagttttccttcactagcagcttcaaagatgccgtgaagtgttctgtcactgtagttgaacaggaacagcgtcaaaccaggatcaatgttcttgatataagccatgtgcggggctggtaagcctgttcacaaaacaagcatcattttcaaaatcctggtcgtcattaaactttaagcctcaaagattgtatagccaactaaccaaacaaattcttagcatagcactctttgatagtgctgaacttgcatccaaatataaccccacaaagatctcccttcttcagattcctcacacacatatttccttatcctgatatgtattgaccatcctgagccaatgtataggtctctgtcttcctccctgcacccattgcttctcactagaaagcatgtcaaaaccaaaagcgtaacaaaagcataagtgacagtaaatcgtcaacacaaaactgtcattaaaatcatcaagcaatttgcagttattatctgaagtactcgttcccagatactctaagtaggaccaacttgcattttgagacaatgttagcaacacataaacctaaaaaaattcacgagttccagaaaccttaagcagagaggatcttcaatcactgaacgttaacaacagttcctaattaagaaaccaaagaaaaatgaaagatctcatacccacatgagttctttctcagcaaacgctcagtgacaaaccaaaatcgaaggtttctaaaagagacaaaactgaaatctgaaacggaaacaacgaaatgaaaacaaatctgcgaagttgagacaataatacctcagattccttaagcgcacagctacttgaggtttaaggagacgaccgaagagagattcaaggtttccgagcttagagataagcaaacagagcaacattagagcacaatctccacaaaatctcaaagaaatttcaaaaataaaaacaacagctagagtaagagaagaccttacctgaacgatagagacgaagaagacgaagcgaaccgaatcttcagaaactcaaattcctgcgaataacagtcgagaaacgcattaggatgaagaaattttcacagagaaatggaatttgaagagaaaaatcttagagtttcttcgatttgataatggctagtatgagagagagagagagagagagagttaaaacaaaaaggtatagactggaaatcgcagaaaacactgcaatttattttccgagagaaagaaaatagatgaagcgcgaaaaagaaatatttatgagacgagtttacccttttgggtttttgggctttgacactaaa

SEQ ID NO: 9028 - DNA, 3000 bp, Unknown; identical to SEQ ID NO: 9019
  misc_feature (1)..( 3000): cDNA_ID_2781957_gDNA_ID_1971973_Annot_ID_177507 3000 nt of promoter + ATG

SEQ ID NO: 9029 - DNA, 3000 bp, Unknown
  misc_feature (1)..( 3000): cDNA_ID_2179976_gDNA_ID_1971973_Annot_ID_177505 3000 nt of promoter + ATG
agatatgaatattgctgaggattttattggtaaaagtgtttactttcttgtgtgttatggaaatataaaggtattggggactttcatcacagaatgggatgaaggaaaagctacctgcaaagagatgcttgccacaaaggagtctgctcaaatgtatgcagagcgtttggctgaacttgctactgctctaggctttgatgggtggctggtgagcattttttgcttggtttttataagatatctgtatttgatgggtggctggtgaagaaagacttctataatatatagactgtcacttgcagataaatatagagaatgatatagatgaggaacagattccaaatatgaaggaattcgtcagccatctaaaaaaagtcttgcatttatcgacacctggggctttagtcatatggtgagttgatcagaagtttttctttgttctttttgtataccactttgttctgataactttctgcaggtatgacagtgtcactgttcgtggtaatcttcagtggcaagatcaattgactgagctgaacaaacctttctttgacttatgcgatggaatattcatgaactacacatggaaggtctgtctatgggtttgatcaatctctcgagtctcagtttcttctatttgtcttgttttactattagtgagtaatgatgtatcaggagagctacccaaacctatcagctgaagttgctggggacagaaaattcgatgtctacatgggaattgatgtttttgggcggggctcttttggtggtgggcaatggactgtatgtctcagccactctttaatatttgcttctctattggtgtagagtacaaaacaatgatctatacttaaatatttcttttcttcctattcttttacatgctaggtaaatgctgctctggatttgctgaagagaaacaatgtgtcagctgccatatttgctcctggatgggtttatgagactgcacaaccccccaattttcacacagctcagaataagtaatattttaaatattttccaatctccttgtcatctttaaagtttgaactagcattactgtgactgtgagcttaaaactttattttactattgctgtaaaggagacgctggatcttattagtatgcatgtgttttctctccagatggtggtcacttgtcgagaagtcatggggaatagtccaaacttatccacaagtcttgcctttttactcagatttcaatcaggtaaggtgagattgatcaggtcttattttgtaacactaacaccatggtagatcatgcattgattttcttggttatgattatgttcagctatgttctgaaaccctcttctctcttttgttcagggctttggttaccatgtttcactcgaaggtcgccaactgtcagattctccatggtacaacatttcttgccaaagtcttcaggttcaaccatcttactgtctttgattttatatgaatcaaaaacttttcctgccacaacatgacaatcgttcttcctgatctgggtgtgtcgctcctctcatctgatgatctctgtgtttattctgttcttcacatcagcctctcctagaattcaatgaagacaacaaagatatcatccaggtcactgttgagtgagttctggccctaatactatcttcatattcatttcggtaaagccaagaagggaaaaatgtttttgacttttctgagcaacatttaaacaattactatgaatatgatagtgctcgagaggcatcttttaacggaggagggaacatcgtttttagaggaaaactcaagggagatgcgtatttcacaacaaggctcttcaaaccccatcttcagctttcatcttcccccatcacaatctcctactctgtaagtctctgcttctagatacatcacattatgagatcttcttgtttttactaatgggggtttttgagctggtgcaggtgaaatcagatgaaacctctaatcttggaatcctgctttctttctcgtctccatcactagagactaaatccatactcgtggcgccagaggatcccatccgcagatttgacgacatgtccttacagtgtctcaccacatcagtgcagactgtatccgagtggacggtacacgaggcaagtcttgtcatggatggtcacacactgactgaaatctctgccttttgctacagaccagagaattcgacaaagagtgcagaatttgttgcattgctcggacacatctcagtcaaagatcatgttcaaaaccagcagaaccccgagattttacttccagcttcatcgtgggtcatcgaggctcataacgtagagcttgtaccaggcaattccagttccaagatcctcagggttaagctagaatggagacagaaagacctcgaagattccgcattcacaaggtacaatgtatatgcagagaatgtgaagtcgactgatctaagaccgaggaaggttctagagaaaccgaaaagcgagacagtgctccttggaattgctcacgtaccagcctattatgtagcggaactggtggtagaatcagacgtgaaggcagtccgtttcatggttcaagcttgtggcgaagatgcttcattggggaagctggatgaagctcttaaccttcttgtggacctagaaggtctctcagtaaatcacgattgaaaacaatctatatatatttttacagggtatctttggcctaaattctcttgacccggctttaattcatttgggtcgggttttgatccggtttcgtagcaattttatcatcttacgttagatgtacacgacgcttaatttgctcaaggcttattctagagacaccacacgtatgccacaagccttttctcctctttccacgtgtccaacaaacagacaaccacgtcattcccatccctgaaccatcgccgttcccttaaacctctcaccgttcgcttttactccgacgtttacagagactatgctcttcgttcctttctctctctagatcttaagcccaaatg

SEQ ID NO: 9030 - DNA, 3000 bp, Unknown
  misc_feature (1)..( 3000): cDNA_ID_3044392_gDNA_ID_1971973_Annot_ID_177497 3000 nt of promoter + ATG
gagctcagtgaagagaagaaggaatcatcgtttccgaagaaatggccgctaggctacgaagccgatgctgaaacgccatcgttttgccttgacgccgactgttcaaccgactcgagcgagttaaatctgagttcgctccgtgagttcactcggactctagagaaagttggactgaagacggtagagatgctggcgaatgcacttgggtttggatatgattcaacccggtttaatactctgatgtgggttaaccaaggtgttcctgatgatgaaccggaggtaaccaacggattttatccttttgttgtttgtttacagtatcagataagggaacagaagtattgtttgctaaccgagtctggttgggtgtccgttttaccccgagttgactcggttcttgtgacgttgggtgacattgctcaggttagttctcttttgcttttgacaattgacagaacacatatatctcttttatttatctataattaattggttagttgtcttccttaaataattatcaaattatcatcctttgtaatggaactttattccactataccgttaactggctgttttaatgtattttaaacattatccaaaataaatgttttccaacgcatcgttcaaaaagagaacaagaatttggatatttccgatatttattgttgacaacaacaacaattgtggagcataaccggggaatgtgttttcacttttcgtttgaaacagatttatggcattgggaaagaaataagaatttggaaatttccgatatttaaatacttatacacatcacatcgcaattgtacttagtgtcctatagaattcaacaattcttttttttttaggtcaaaacctaacagctttctacaatatagttttcaacttttgaacagctaacaaacaacttaaaattggcaggtttggagaaatggagaggtcaaaagagtgaaatatcgaccagtgttgtgttcaggacaaaaagatggtccagtaaagtgtgtaacaatgacattgatgcttacacttcccatggacagtatggtttcatcattgaaggatatgatcagtgacggcgacaaagaagaagagtatgcagaggaggaggaagaagatggaggagcaagaagtgatgagagaagggcatttaggccttttagtttcaaggagtacgcatggagagtgtaccaagaacgtctcttcttcagggatccacttgacagatacagaatcaaatctttaaaagattgacgaaccgatgtttgatttgtttgtttctttcttgggttgaattggtactatagttcttgttgttactttttttcccccataaaatcttttgattttcagcggattgttagcattttagcattgagatatttttgtttttgttcgattcagttcagagaatgttctattttgatagtcactccatcattcaactaattttttcatatatactcatatcaaaactgtcactatttcaaaatcaaacttttaggttacaccaatgactctatcacactaaactcaactcctagattttatatagaagaatctatgactttgatgatgtactttaaaactgagtcttttgagatcataaccaaattctacttcataacttttgttttccaatgttgattatttgttataattagaaggtgacacaaacgcttatagcatcctgtttttgaaaatgaggaaatacagtgttggcttttaatctctcattgaggcagaatatcaatgaatgacttcaaatctacgtatacatgtttacttatttagtgatccatattggtgttgctctttaattttcttgtgagaatgaattatatacatcaaaattgattatatcatttaattcgagttaaaattataagtaatacaatcttcactaaacactaattaaatcgacgtaaatttcttatacgattttttcatgcaacacttaaatcgacataaatttaaatattttggtcttcataccctaattttgataagatataatagaaaatttcgtatatctttttttttttttggtaaaaagtttttttttttttgtttcatctccatatttagaaaatttatttcaaacttcgttctcgtttgtgttcatcttaatttttaaccatgattgagtcattgaccattgctcaaaacatacgcataaaattcccaaaaagtagtgtgtgtcgtgacaaaacccgacccgtcgatttacgcggtttgaaactcgacccgaatactatccgaacccgtaactttggcaaaagcacatcgtacagctcaggcacttgtagcacgtcgtctctcctttggtttctctccttatattcgacgagtgactccgattggatcgctatttcgtcatttctcactttccaaaaagaaaaaaacgaatctctctccaccatcatcacctttctccttcacttgcctcagatctggctgcgatttcaaatcttccttagtttctctcgcatcgctcggccgttgacggtcccgtcctttccgtggatctgattctggccccggattctctcgccgcgatctgaggtcaaacatggcggctgctaacgcgcccatcattatgaaggaggtcctaacggtgagttctctgtttttaaatctccgggaatcgagctaaaattttggacgattaacatgtttctatagttgtagtctctgatttctatcgatttggttctgctcacactgttatatgattgattcaagtttcattctgttctcaattctacccgatcgttgagatcaagttctctgatcagattttctctgcggacgctcagatctgtgttatctgaatgtatatagtccttagttttaagttattgtgttgcgcaatgtgcttatctactcggatcttgtaactaagttaatgaactatgccaattgattacttttgttttggaaattttccagcttccgagcgttgggatcggtcaacagttcatcacctttacaaatgttact

SEQ ID NO: 9031 - DNA, 3000 bp, Unknown; identical to SEQ ID NO: 9015
  misc_feature (1)..( 3000): cDNA_ID_1989356_gDNA_ID_1971973_Annot_ID_177492 3000 nt of promoter + ATG

SEQ ID NO: 9032 - DNA, 3000 bp, Unknown; identical to SEQ ID NO: 9014
  misc_feature (1)..( 3000): cDNA_ID_1989357_gDNA_ID_1971973_Annot_ID_177490 3000 nt of promoter + ATG

SEQ ID NO: 9033 - DNA, 3000 bp, Unknown; identical to SEQ ID NO: 9013
  misc_feature (1)..( 3000): cDNA_ID_2993973_gDNA_ID_1971973_Annot_ID_177489 3000 nt of promoter + ATG

SEQ ID NO: 9034 - DNA, 49 bp, Unknown
  misc_feature (1)..( 49): cDNA_ID_2687323_gDNA_ID_1971974_Annot_ID_58695 3000 nt of promoter + ATG
gaattccagtgataatgatgatgacgggctcctgggatcacctgcaatg

SEQ ID NO: 9035 - DNA, 3000 bp, Unknown
  misc_feature (1)..( 3000): cDNA_ID_1989378_gDNA_ID_1971974_Annot_ID_58696 3000 nt of promoter + ATG
accatttttccatattaaaattttatcgacgcctcagtttttgctgaaatgaacaacattaaatcatccatagacgacgatccacaactgcaaaactatttcttcaaatataatccgtttttgtaacccggtgtttctttaatccataattttgtactttaatgctttaaacatgaactatttgtgccaatcatcttttttggtaaagcaaataatagaggtataaagaaaaaaagtcccctatttttggaaaaataaaaaggaaaacctctgaagacactatccaatgaaaaagatgccaccattttcaaggcctcgtagcttagttgtgaagaaaaattataacaaaaggaaaaacatggattcttttttgtgttgctatatatcttaataagatgaagatatttttccttcgatttgagatttttctaaatgaacacaaaaactagtcaaggttttcctctataagaaattagggctaagttgagaaattaatgaaaacaatatacattcaattataagctatacgtgtacctatcaaagattattttctaaaaaaacatttcgagatcataggatttaaggagtcaacttactagttatctaatgacaatttaagatattatatatgtagaattagagcttgtgaattgtgataatagaaaaaaaattggaatctatttagaagacagagaggtttaaatttggaattgggttacatatcaatcatataatgattatgaattttattctctcttttatttgtgtgtgtgtgtaagtctgtaagattgttatcttttggggataagtgaaaaaaaaaaactcattcgtagaacggcaaatttctttttatcttttaatttttcttcagtacgtactactactattttattttatttttaaatcaaatgtttttttacctcttttattcttatatggatgctgaaagatattcctttattggaaaggtccatagatatccaactggctaacacatggaatgaaaggagacaatatcataattaagcatattttcacatctgtatatcttatatataaaacatcattcttattaatatatttaccgttgaatcgaaaaataggaatacgaggattttgaataattaactgcagcggaagaaatacggtggaatgaggaagtgttatgcacaaaaatgttatattatgatggttaagtaatttaggaaattcttataactaaagtgtaattattaatatttagaggccaatcatatttagttatatgtacgtatatcatggatgacagtttgttaccgatctcatattgcattaatctagctatcaaattaaagtggaatgctttttcttgatcaacaatatatacatatccatagtatgtgtgtaagcatatattgataaagtcgtataaagatgcatacccatgtatgtattgtgtactaatatataaagagtatttgcagtttgggtagctgaagagtcatgaagaaatgaaaaacgaacaaggaatatttttataaaataaatttatgaatgccgtatatcactgaaaacatgatcatgaaaatggtaactgagaaaatagctgaatgtgtaagaaaaacaaaaaaaaaagacaggacgaagctacgtggggacttgtgtaaacaacatgataagttaatataactaaattagtgcggcgataagcaattccatgcacctggtctgttttctttttctccgtaaggtgacatgaaatcgatattcaccaaattttggttgtatactagtatatttttttttcataaatagcaatagtaaaacaaagttactaaccatataaatgtgatttttaaagagtaattttgctgtaacagtcacgcaatacgtataatttgaaattaatattgtgtgcaaagacgtcaaggtgcattaaaataagaaacaaatactaaaagataggaatgacgtgaatttgattttaatgaattttttaatgacatggtgatacagtgacagggctgtgcaaaataggaagtaacaggatgaggaggaccgttagatgaatgaggatcaagcgtagatccgacactgacccgaccgtcgagtatgcaaccctatttaacacactctggccgaaccaccacagctgaataaaactattttttttaataataataaataactttagagaaaaggtataattcaaatccaacggatgagatctgtttccaagtccactcgctaaagaaagtggaccccagagagctcagaaaagtccacttccgatttgtaaacaagccaatcactttcgatttaccacaattgccccttttcaagatttcgttgaaaaacttttgttagtttttaagtagtacttattatataagaaaataagtaaattcaaccatcatgtcatttttaaaatttttaagcaaagtacgatttcttacatatttgatagaaatttgtagcctagttattctcgatagtatttgctcttctgtgacacactacacaaatatttaatccagttgattgcaaagtgtgagatgtaggaaaaaaaagagagggtataagagtcatttaacgaggattgctggttggtataaaagacggcgcttgttgaaggaaatgagtttagctgagacgctcacattgcaaaaacaaaaccaacaaggaacttgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatg

SEQ ID NO: 9036 - DNA, 3000 bp, Unknown
  misc_feature (1)..( 3000): cDNA_ID_4255155_gDNA_ID_1971974_Annot_ID_58697 3000 nt of promoter + ATG
ctgcaaatactctttatatattagtacacaatacatacatgggtatgcatctttatacgactttatcaatatatgcttacacacatactatggatatgtatatattgttgatcaagaaaaagcattccactttaatttgatagctagattaatgcaatatgagatcggtaacaaactgtcatccatgatatacgtacatataactaaatatgattggcctctaaatattaataattacactttagttataagaatttcctaaattacttaaccatcataatataacatttttgtgcataacacttcctcattccaccgtatttcttccgctgcagttaattattcaaaatcctcgtattcctatttttcgattcaacggtaaatatattaataagaatgatgttttatatataagatatacagatgtgaaaatatgcttaattatgatattgtctcctttcattccatgtgttagccagttggatatctatggacctttccaataaaggaatatctttcagcatccatataagaataaaagaggtaaaaaaacatttgatttaaaaataaaataaaatagtagtagtacgtactgaagaaaaattaaaagataaaaagaaatttgccgttctacgaatgagtttttttttttcacttatccccaaaagataacaatcttacagacttacacacacacacaaataaaagagagaataaaattcataatcattatatgattgatatgtaacccaattccaaatttaaacctctctgtcttctaaatagattccaattttttttctattatcacaattcacaagctctaattctacatatataatatcttaaattgtcattagataactagtaagttgactccttaaatcctatgatctcgaaatgtttttttagaaaataatctttgataggtacacgtatagcttataattgaatgtatattgttttcattaatttctcaacttagccctaatttcttatagaggaaaaccttgactagtttttgtgttcatttagaaaaatctcaaatcgaaggaaaaatatcttcatcttattaagatatatagcaacacaaaaaagaatccatgtttttccttttgttataatttttcttcacaactaagctacgaggccttgaaaatggtggcatctttttcattggatagtgtcttcagaggttttcctttttatttttccaaaaataggggactttttttctttatacctctattatttgctttaccaaaaaagatgattggcacaaatagttcatgtttaaagcattaaagtacaaaattatggattaaagaaacaccgggttacaaaaacggattatatttgaagaaatagttttgcagttgtggatcgtcgtctatggatgatttaatgttgttcatttcagcaaaaactgaggcgtcgataaaattttaatatggaaaaatggtgtttaagaagaaaggaaagaaaagaaaagaaaagaagcagaacacctgagaggaacaatgactttaggacgtgttggtagtggactgtgtcgccatgtgtgtggttctctgaaaagaagatcaatctataaaggtgtgagcaccattcttagtttaatagttttccccactatcttttttttccttcttctatatatttcttaatacgaaaatactaacttaaaattcaaaaatacaaggaaacctttttttttgtaataaagggaaactttcactggaatcgtaagtcgtaactatctgtcatgatataatcatattttagcttctttatattaattttttttcagggccacgatgtcattttcagaaagatgaaaaggatataactattaaaatttatatataaacaaaagtatattcagtcttttcgtttgagaaggtccattcattatggtatgggttttcaattctcactgtacgcgaacagtgatattcaacttcatcatctcaagccacacacgtatacacatttaactttacagatacttacatttatagaattgtacaacagttcttgttacgcgtatgtacattcgtcacgtaaccctttactaaagcatatacagtgtcagtattagtatatatatcatgtcgaaactatttttgatttctagcaatttcttttgaaagtgataaattctatatcgtcaagcaatatttaataatgaacttgcgtttcctttttaaccttatacgtatttatattaggaaagaaagtacatgagcaattgagcatacatctttaagtaatcaactaatcaaaaaaataccttattaaagactggattatttatagcatgaataaagtaccagctacaatattagccccctccccccactatatttatatgtaaattacgtttgtgttgacttcatttaaagatgtcagtatgtcactaatattggacgtaaggtgataatgcaagactctaatgaagtccacttccaaacaaatgaagaaaatgaaattaacattttcatcacaaagaaattacatatatgtgttgtgttagttttttttctttcagaaaagtcgaaaccgaaatcacataacggattcactatgattctataactaacagataatacaaacaaagcccaactaacgacccatcatagtaaatcacagaaaaagatgataactaaacagatcgtgcaaagaaagcccaactaacggcccatcataataaattacaaaaagaaagaatccggaagaaaattgaaatcttatccagagtgtagagagaaagaagcggagtcacaaaaaccccttatcctcttcttcttcatcatcatctctaattcaaatatccgacgcagacattttagacaaagttactctctttctttctcatgttcttttcggacagaacaaaactccctaatccaaatgtcaattcctttggtctctctctgaataatcatctctcttcaaaccctattcaattttaactatcgatcttcggctaagtctcca

SEQ ID NO: 9037 - DNA, 3000 bp, Unknown
  misc_feature (1)..( 3000): cDNA_ID_1988791_gDNA_ID_1971974_Annot_ID_58698 3000 nt of promoter + ATG
aaccaaccctgctttgtacggtgagctcgcaaagggtcaaagtcctaaggtaaattaaaaataaaactaatactatgtgtatatcatggttgcttataaattaaaaatgaaacattaagaaaaagtaattaacaaaggtgtgtgaatggtggtgcagtacatggtgtttgcttgttcagactcacgtgtgtgtccatcacacgttctggactttcagccaggagatgccttcgtggtccgtaacatagccaacatggttcctcctttcgacaaggttaataatttaacacgtctgtctctctatagatataaactcttctatcttaaaccttctgcctcttgagtcttgacttttgtcttgagaagtcgtgacattcactttctattttcatttttgggttgctaaattggcaggtcaaatacggtggcgttggagcagccattgaatacgcggtcttacaccttaaggtgaaaataaaataaaataattaacaccttaaccaaaaaaaattatttatcaaagtacatgtaattaatttttgaatgaatttattactgtaggtggagaacattgtggtgataggacacagtgcatgtggtgggatcaaagggcttatgtctttccccttagatggaaacaactccacgtaaaatatctctatatccattttattaaaatttaatcaattttaataacaggatttattaaatgagattagtaaaaaatatatacgttaattgcagtgacttcatagaggactgggtcaaaatctgtttaccagccaagtcaaaggttatatcagaacttggagattcagcctttgaagatcaatgtggccgatgtgaaagggtatacaaacacatgttagatcgatgagctgatcatatataacaatataaatgtattgataaatgcaggaggcggtgaatgtttcactagcaaacctattgacatatccatttgtgagagaaggacttgtgaagggaacacttgctttgaagggaggctactatgacttcgtcaagggtgcttttgagctttggggacttgaatttggcctctccgaaactagctctgtatgaaccaatccatcatcatcatcatcatcatgaccatccatcatcatcatcattattatcatcgtatataatatatatctaccccatatgtaatttgtaatgtgcctttgactgtgatgagttatctctccctctctaccaactttcttcatatatataaaacaaaaaggaaaagcagatgatatagatctttcgtggtttaattatgaacaattgtctttattatttgtgtatcaaatcggttgtatttatggtttgattttattttctatgttgtttggtaggttaaagatgtggctaccatactacattggaagctgtaggaaactctttgaagccttacccgatttcacattgtcaattcaataacaccaagttgttgtttacatgcagatcttgatgaaactggtttttgattttacagaattaaaatcttgggggacagaaatttgaataaaaactaaaaaaaaaaaaatcaaaaaaaaatcattgaatcgtaaataaggatatccgggacgggcggatccggataatgaaaaaaatgaacccggatatccggatccggtaccattaactacatgaaataaaaaggcttggaaacccatttagctaaaagcccatatatttaacaaaccaaatatttttgatacccaagcccaattaattatcacttgccgacacaaacacaaaatcattctttgaaggtcacaaaatcatttcgatctcttctcgatatctcacaaaccctagaactctggatcttttaatttctgggttcgatacccaaatccttaaaactgtcgaattctggtacccggaacccggatatcccagtctaacagatccggatgcggatagtgaaactgtagatttgtagcttcgtagttttttggtcatataaaatataaacatctgaaatttgtctgtgtatgttgctgtttaaatttgtccgcctacacattatgggcctaggcccaagtttgcaattctttattgtggcaattaaatggtcaggttcggtttaggttttacatatccatcatgaaaaagcaccgttgaacgggcttaaatctttgtccaaggacgacgtttatgaatccggtataaatcgatcgaagaagattaaacccacaaaacgaaaaggctaaagcttgaggaaaaagtagcaaagtgaccaagagtcccatgatttcatgaagacatgaactatatatatctactcattgatttgataaatacattatatttgatgttacatatttttatttgagatttctaatatatattttcagaatgataaattttatttttatatttatcttgaactgatttttaagagaaaaatacaccgaaagaaagcgaagagttaattgcctaccaaaaaaaaagagaagagttaaaactttttccttaaaaaatcttaaataaattgaaaaataaaatcagaaaaaaataaatgataacagtatatcagaccattgttttggacttttgggtccggatacaaattattatccaaaagagagttgtgagaagtggagccgacacacgtcgacccctagcaccttaaggacaccccatgtggtcacgtgtaaacgtttgtttgtcataaaagaaaggttttttgagtatgaagaaatctgagaagtctaatcacagagaagagagaagcgagagttagcctcttctttagttgtttgttgcaataaacacaaacacaacttccctattttctgcttctttttgttcaactcctacacactccaatcacacaattcacaacccattgagaaaccaataaaataacctcaatcaaaaaaaaaaaaaaaaaaaaaaaaaagatgaaaatctcaatttagtaaaggagaaaaaagccatttcgaataacttgaaaaggttttggttttgcagaagaaaatg

SEQ ID NO: 9038 - DNA, 3000 bp, Unknown
  misc_feature (1)..( 3000): cDNA_ID_2990544_gDNA_ID_1971974_Annot_ID_58699 3000 nt of promoter + ATG
caaaaacctcttatcatcgaatctcagagcatcatcacaaggcagtggtaactctggctatgctgcgttttcctccaaattctttactcctcagggatggaaacttttgaatagacagagcaattcctttcagtcagggactaagaagaacattctttctccacctatcagtccactggtctctgtcttttcagaagatgttcctggagatggggaatggggttatgggaatttccctttagaggaatacatcaaagcccttgaccgttctaaaggagagctttcttataaccatgctcttggaatgcgctacagtaaggtctgaaatttgtctctttttcccgattactcttgtttcatgattctctctgtctcttcaatctctcaaacaccattcttctcttgttgccttttttcagattacagagcaaatatatgttggctcttgcatacaaacagaagaggatgtggaaaacttgtcggaagctgtgagtcttttatatgacttatattacctacctatggtatgcaaatgatagaattgaaagtatggttttaactggccatacttttctttctacagggaattactgccatactaaatttccaaggtggaactgaagctcaaaactgggggatcgattcacaaagtatcaatgatgcatgccagaaatctgaagtcttaatgatcaactaccctataaagtatgcaaagtcatatcgccttgaggcacattatgtgcgttcatgctttcatttcctaccgctctaatcagttttgatattttggtgccagggatgcagattcctttgatcttaggaagaagctaccactttgtgttgggctcttactacggttactgaaaaagaaccatcgtgtctttgtaacttgtaccactggttttgaccggtcatccgcttgtgtgattgcttatctgcactggatgactgatacctctcttcatgctgcttatagtttcgttactggattgcacgcttgcaaacctgacaggtttttatccatcttatctctgtcttgaccattaacctgcagaccatggatagcttttctgttttaatgaaaacatcagacaagttatatgtattttttcacagacctgcaattgcttgggcaacatgggatcttatcgctatggtggacgatggcaaacatgatgggactccaacacactctgtaacctttgtgtggaatggacatgaggtgactgttgcttcacatgcttttattactttgctgcaattctttatggaactcgtgatctgtagggttgagcaactagcctctgtgttttaagttacaccttggtttacagggggaggaggtattgttggttggggatttcacaggaaattggaaagaaccgataaaagcaacgcacaaaggcggtccacgttttgaaactgaagttagacttacacagggaaagtaagtcatgcttcttttacctttcccgttgatgctttttttaaggttcaacagtaaaacgtctcataatcttccctgcatgttaattgtgacttttgagggattgcaaactgcaaagaaacttatgaaaatgcatttgtgtcatataacttggtgattattgacaatgtggcagatactactacaagtacataatcaacggtgattggaggcattcagcaacttcaccaacggaaagagatgaccgaggaaacacgaacaatataattgtagttggtgatgttgctaacgtcaggcctacaattcaacaaccaagaaaggttactcctactatgcagtagtctcttcttcatacaataggaaaagcttgaataagatgttccacgttatatttgcctgattggttcaagacataaacctgaagcaacttgtacaatgttttgcaggatgcaaatatcataaaggtgatcgagagagtgttaacagagagcgaaagatttaggctggcgaaagcagctcggtgtatcgcattctcagtttgtccaataagactatgcccaaagtcgtagaagttttgttttggcataagttaaaatgttacatccattcttctgtctctatccattcctcgaggtacttaaccctaatatcgttgtgaacaacattgccacattcgcgcactctatgacaagagaatgttgacattatgttgtgtgtttgcatgaaaaaatgtcgacatagtttcgccgttgcccactttacatataagtcccaaaaccaaccctaatgcgttactggtctctgtatttcttcttcattttctctctctctctcgctctctcctaacatgttgaagaaaatagaaactctgttatctaatgttgcctatatgatgatttatggccatggaaggtctgagaggagagacccttcttctctattttttttatttcctcttcattttcatgctaagagttttcactgagtctgttgtttcgtagagtagaacagtccatgatcgatgttaatcctttgcatcttctagattgtgtatacaatagcaatctctggtctagagagagcctagagaagtatggatctttctatatgtataccacaaacaaatggcctaacatctaaagtgggtggtgattatttaagatgagagcctgagagggtaagtgaaagaggctgatccttgttttcatgataagggaccttatcctctaaacctttctgagaccttttatttttttataaaaaaaagaattgaaagaagaaaagagcacgtaaaagttttgaaatcttgagctaatattcctcatccacaagaaaagaagaaagtttgttattcaccgcagctatcgctttcgttatcctcgttcccacaacctcaccatgaccatgagactccgttcttttaaactcccaaatctttcaaccaatcccattattcacttaagtatatagtagcttccataagagtcttagttctaactataaatacacatatctcactctctctgatctccgcttctcttcgccaacaaatg

SEQ ID NO: 9039 - DNA, 3000 bp, Unknown
  misc_feature (1)..( 3000): cDNA_ID_1989377_gDNA_ID_1971974_Annot_ID_58700 3000 nt of promoter + ATG
cctactcaaaagccacagatcctgtattcctttttgaaactcttctctgcatggagagaacaacaacaaaaacccagatttgttatcgtggtctatagtaaaagtttctgttttaaattgatgttctaatgagcttgagaagagaaagagaagaagaagctcgtaacaaccaaaaagatcaagaaagaagaagaagaagaagaagaagaaagatgtgatctgatctataaatacacattatattatatcttcgattaattagagcttctcttttctatgtttatcttttgaaaatcatttctctctctctctctctggtctcatgagcatacactatacagactaatatgtataatggtctgacatgaatattttaatccagttagagcagctacaaaagctctcttaaagcatcaatattctacacatatgaacatatacctatatatcatgtgaatttagtagataaatatcctccgaaagataaaaattattatttttttaagtacaactaatgagtagtaattttatgaaatttacagttaaaatttcttaaacaattcagattaaaatcctcaagtgggtaccgggtataaaacaatacaaaattacataatacagtaattagttggaaacgggtttacaggaaatatcgtaactttgtgtttgatgagtcccgaagacagagagaatcaacttatgggaactcggcccctgatcatgtgcattcctatgcaattcgttctttattcttttttttttttttttctatataaacaattgataaacgaactaaaagaccccctcttttgaacaatttacaatttatagtaacatgacactccaaattactctctttaaattagtctcatatatagtaaaaactgaactttatgtgagccacttggatatttttatatgtagaatgatcatatatgtcaacgagattagtaggagtatttaggagttctaaaaatttaatatggattttatgtacttgcgcataactttacgtagactaaataaacagtttctcaaattaactgtattatttgtcgtggttttcaaaatctgtaataagcagcggcgttgacgcctttttccctcttatgtttgctgcctttagaagcactttgcttgagcccatgcacgtgcgatgctgcgaagaatcacgtgcgccgggctcaaaggccgccacgtcgatgctcctctttaattctttaggtaacaaagttttcaccgtccaactgtcagtatgtcagtgacacgtacgcacacacccaacggtcttcttgcaacaagagtcgcgttctcattctgctgcgtttgcgtcactgaccgcaatatcttcttccgttttggacacagagtatgtaatgtaatgacacgttctccttttttggttgactttaagaagtcaacggcgttagctgtacgtgtgttgtggaccgcatttggataacccgtaatacaagtaattttattaatcacggacaatatactataatgcaactagtcgatctttgtcaaattactggttttgatatgtgtgacactaatatgttcataacttcatatatacgcgttccacggccggtgacggactccattatgaatattcttcttaaatttaaacttatatgcattggaccagaagatgcatgttgacaaaagaaagtgatcagaaagcatagaagagaccaaataagttggtttagtcgaatacgtattcaattcatgttaaaaaaaaaaatcaaatatacaaatataatcattgtcatgattaatcacacatgagaaaattgatatttgatagcacaaaacatccccatttctgcatttctggtttttgttggttcttctgttaaactcttaatgcttaaagcaaatatggagatgttgatctgatttaattagtagtaacccgaaactgcgaagaattagctccggagaaggccggccctgaatttgggcaaatttgggcttgattaggctacaaatagtatgttcaaactcgaactgaaaacattaattagactctattaaaaaatgactatggttaagctgccaactcattgctccacatgaaattgagaaatgtaacatggagatcgatctttatataatatttagtgataattaaaagaagcaatctttggattattcttcgaagaatatgacagattacaattccaacagcaatgtttaatttatatggcagaacatgccaatatggacttcaatgttgctattcgttgggaaatggatattggcatgtggtacaattatttaatcatgcttgtttctatgcctaattttatcaaataagaatgttaatttggccttgagtcatttgtcagggagattttagtgccgacgggttcaaaagacaatatgtttattgcaaagttgttatagcaaggttcggaaaagtcatttataaattcgctaaaagttgcgtttgattaaattatgcttattttgtttaatcttagaggataacaactattggactcctagtgaaagtgaaacatatgataactaatttattttagttattttgactaatcatttgtttgtaactgttaaacttggaaattattcagcaaaaaaacatttcttgtatttgcaaagtcacagaatatgatgaataggttttattataatagaataaatcacgagttcacacaattctttaaagaattacagaaatcgtaaaatgattatgccaaatctgatttcacgtctaacatatttggttggttgataagaataaaatcatactttaggttaccccctcatcgtcagcattgacgtttataatttcaatattctcataaacaaatacctcgaaagcgaccacgttttatcgcctagtattgacgaacaagctaactaaaccactcccacatgttacatgtaatgacattatatatacagacacatagacacagcaagtttacagggacgcgaatcgtaaacaagacgtaaaaaacaatg

SEQ ID NO: 9040 - DNA, 3000 bp, Unknown
  misc_feature (1)..( 3000): cDNA_ID_1989376_gDNA_ID_1971974_Annot_ID_58701 3000 nt of promoter + ATG
agaccgttgggtgtgtgcgtacgtgtcactgacatactgacagttggacggtgaaaactttgttacctaaagaattaaagaggagcatcgacgtggcggcctttgagcccggcgcacgtgattcttcgcagcatcgcacgtgcatgggctcaagcaaagtgcttctaaaggcagcaaacataagagggaaaaaggcgtcaacgccgctgcttattacagattttgaaaaccacgacaaataatacagttaatttgagaaactgtttatttagtctacgtaaagttatgcgcaagtacataaaatccatattaaatttttagaactcctaaatactcctactaatctcgttgacatatatgatcattctacatataaaaatatccaagtggctcacataaagttcagtttttactatatatgagactaatttaaagagagtaatttggagtgtcatgttactataaattgtaaattgttcaaaagagggggtcttttagttcgtttatcaattgtttatatagaaaaaaaaaaaaaaaagaataaagaacgaattgcataggaatgcacatgatcaggggccgagttcccataagttgattctctctgtcttcgggactcatcaaacacaaagttacgatatttcctgtaaacccgtttccaactaattactgtattatgtaattttgtattgttttatacccggtacccacttgaggattttaatctgaattgtttaagaaattttaactgtaaatttcataaaattactactcattagttgtacttaaaaaaataataatttttatctttcggaggatatttatctactaaattcacatgatatataggtatatgttcatatgtgtagaatattgatgctttaagagagcttttgtagctgctctaactggattaaaatattcatgtcagaccattatacatattagtctgtatagtgtatgctcatgagaccagagagagagagagagaaatgattttcaaaagataaacatagaaaagagaagctctaattaatcgaagatataatataatgtgtatttatagatcagatcacatctttcttcttcttcttcttcttcttctttcttgatctttttggttgttacgagcttcttcttctctttctcttctcaagctcattagaacatcaatttaaaacagaaacttttactatagaccacgataacaaatctgggtttttgttgttgttctctccatgcagagaagagtttcaaaaaggaatacaggatctgtggcttttgagtaggttaattaattagtcgacaagaaaacaaaggtatgtaaccatttgatcattctccattgcttgttgtctcgcttagatccttatcatatttaaatgctaaaatggatgattttttttgagacttttttatatatatatatatatttataactaaactttgatagataatctagtttagttagtagttgcacaaaatacattttgaattctccgttaaataggcgtttcaatttataagaataagatttatgataattttcgggttcaaacttacatattacacgttttgttatatgttacacctagttaaacatatagtgtttcatctagctatgcataagagtgtctcaccataaatcaaatgggcagtttgtgtttttttttctttatatagactacacagaatatatagtgtgcactatcttacgtttgtccggtgtgtcaatgttgatttttgcatcaagttctccttcgacaaaacaaaatgacgatatatatctatctatatatatatatacaaactgtattggcttcgtactatatacatacgtcagtcttattaattctacaacgcagatcaaaatttgaattttgactaggctttaatgtgtacgattaccttatacaagtgaaaaagggtcaatcgtacgtttacccttaaatttctttttgttagtaacatatcgaaaaataaaccgttttatatatattttcaaaatacttattcttcttgttaatgctgtcacatattataaatcattacaatgttttgacaaataaaagaaaaatcattattacaaatctaatcgttttaaaatcctagggaatcctactagattattattactattgtagaccttgtttcttttgtcacattaattaataacaataaaataatatatatttttaaaaatatttttgttttgttttgcattgtatattatttagctgtagatttgtaatgggccacgtaattgggccatgctaagacccggcaaacccatgtgagatatatgatctcccgcactatagtccacgttatctcactgatatctcattattttaacaataagaccgtctcttaattttattacaagttttcttttactcttgtagccttaaattttaggctgaaaattaaagttttgaaaaaagctatagggagggactatgtaaaataaaaaaatgtacgttaccatcagattttaccataaagagccaaaaataaaatatgcaaaactccactaaaaataatattaattcccctagccaacaaaaaagattcagattcatatcccacgcgctcgttcaaatcctctcattcgccacctgatcaaaccaatctcaatttgaaaattgaaatagacaaaatcgtgacattgggacataaaaaagcactaggacaaaattctagtcgacgcaaaaaaaattcgaaaaacgtgagtcagcgtatgtggtttacacgcgccaaagtgggagcgtgagtggggtttgaatgcacctgaaactgtctggtcaataagttaaagtgcatgggaaaaatcttggttgctgtttcctatatatctctctttttaccatcaacatgttacatatatatatggacaaaaatctgtatatgtgaatgcatataggagtgtgatgtatttatataagttagtaagctttgttctctttctctatttttttggcaggtatataaaattttaaa

SEQ ID NO: 9041 - DNA, 3000 bp, Unknown
  misc_feature (1)..( 3000): cDNA_ID_2687055_gDNA_ID_1971974_Annot_ID_58702 3000 nt of promoter + ATG
agctgacttgcttgttaaccctgctcaagtcaacattggcaatgttgacgagcttgtggctaacaagtcaatcacacaggtattgcttgaactgattctattggttctgctgactgtttcaggagaatctgattgttgtgcttttttggaaacagcatattgaagtggtagcaccaatggagaaacagaggaggttagagcagatcttgcggtctcaggaaccaggctcaaaggtgataatattctgctcaaccaaaaggatgtgtgatcaactaacacgcaatctaacccgccaatttggagctgctgctatacatggagacaagtcccagcctgagagagacaatgttcttaatcaattccgcagtggcagaactccggttcttgtagcaaccgatgttgctgctcgtggtctggacgttaaggacatcaggtatttatataatccaaatcctcccagtcctgtaaaacaaatgattaaattatgtgacttgatgattatattagctaatacgatttgagatcacagggcggtcgtaaactatgatttccccaatggagtggaagactatgttcatagaatcggaagaacaggaagagctggagcgactggtcaggcattcacattctttggtgatcaagattcgaaacatgcttcggatctgatcaagattttggaaggagcaaaccagcgagttcctcctcagatccgcgaaatggctacacgtggtggtgggggaatgaacaaattcagtcgttggggacctccttccggcggccgtggtcgtggtggcgactctggttatggtggcagaggtagctttgcttcccgtgacaggtaaaattaacataggacctcatcttcgtaaatttatctctgtatgccactgaaaatatgattgtgagtttgagattgtataaatttttgatgtaaagtagaagcagcaatggatggggaagagagcgagaaaggagccgtagccctgagagattcaacagagctccaccaccgtcttccaccggatctcctcctcgcagcttccacgagacgatgatgatgaaacacagatgaaaagagagatacaaagctctgataaagccaagtgacagaagattgtgttgtgggggatttcccttatcattgtgacattatatattttttggccgatgaagaaacaaaagaaaaaaaaacaagaccaagaagactgttccctcccattggaaatttacgctcaaaactacaattgatatcttacagtttgtatttcatcttatttattattgcagctcagagattggtaagaatgtttcattagatacgaacgactttcttctaatactgtgggattctctagcatttaaattacaaatcaaagtggtaatattatgatttcggtttagtattgttagatttggtttagtgtagttcgatttgataaactgattctacccaatcgaaataatcaaattaaaaacccaagtaatatcttaatccaaatacgagctgaacaaaatcacaactatctaaaagcattaaaaaaaaaaaaaaaacttggattatttatgtgtatttcattttcaaaagtgtcatattataaaaattaagaaataaaaatgaacattagaaaaagaagtttggtgagtctatggcttagatgaaagtgtatgtcttgtgtactttgatgataatataattgaggacagcctattaatctccaaatagactcttgttttttgtggttacaaattaattttccttttacaactaaacgaatcatgaactcctacaatctaaaatcaaagctcacactacatgttcacacatggcttatcttcactatcaatattaatctttcattgattgttaggagattactcttttaggagtttatccttaataaatcatcatcaaccaaagtacaaactaacattataaaatcattatacatagaatgacagttcaaggtttttttttacgaattatagtaaaccaactattatttagttttaaacttcagttagtgtatgtgttggttaaatcatcaaactcaaaatatacgataagtagttggttaaattattcttgaaaaagaatattaataacccaatttttatactctcttacaataatttaattgaattgtaagctgacacatcatttagatttccagccacaaaacctcacttactaaatttggcatatgaattacaccaaaccttctcaattaattgcccaaaagcaaacgctattacaactttcatttcattttctctatctatactacttatattttctttgtataaaatgtaaactcgttaacacacacaaacaaaaaaagataacgttgaaaaaaataaaacacatatttcagactgtagtttagatgtggtaaaatatagcaagaatataaaaatatcaatataagtttcaaaatttagagaagaaagaacttcattgattgtgagttctaaataaataatggttagtatatattagtgatagagggttaggaagaagtcgttatatacataaactcagtgtaatgtttctgtcaagctttgctttgatttaagattgtactttcttccttctcactgtttacaattcgtgtggtcgtgaactaatcacgccaagttctctcgtttaattattaatttgatgtttagtttttcttggcaactttagagttatatatatgattaagttttgtaatcaaatacttcatattttcattgattttgcatattaatgcatatgttttcataaaaaaagaaaaacgagtgtaaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatg

SEQ ID NO: 9042 - DNA, 3000 bp, Unknown
  misc_feature (1)..( 3000): cDNA_ID_1989375_gDNA_ID_1971974_Annot_ID_58703 3000 nt of promoter + ATG
tatttttatcatactcaaaaacattcagatagtagaacgagagaaaagtcacataataaagacaactcttctaaataatactaatatcaagtttgcagtatatccaaaaacaaaacaaacttttttcttcttacatgaaaatgaggaggtagactcatgtaacataactcttaccaatagaggaagaagaaaaagttagcaagagtcggttacttgtgagaaattccaacaaatgccggaggatttatgcacatcttggagcatctgataagaggaaaaaattatgttcgctctcacatttctaaatccaaatccaagacttccatctccattgttccttgccaagtctactcctgaatcagcgttgagcagaagaagcagagctttttcatcttctaactcttatccttggagaccgaaccttagatttaatggcttcaagctcaagtcagctacagttccggagaatgtggaaggaggagatttggaatctggaagtttggttaaagggttgaagctaggaggcatgtttggagtttggtaccttctcaatatctactacaacattttcaacaaacaggttccttctttgcttcatttaattaaacagtccatttcaatgcaagaagcagtactcgaacctattatcagtcttcatacaagtatgaaacttgttcattcatcgatccaggtacttagggtttatccatatccagcgactgtaacagcatttcaattagggtgtggaacgttgatgattgctataatgtggctccttaaactccatccacgccccaaattttctccttctcaggtaaatcaaatattgattccgtcaaaccctaaaaacagagagattcattcaattgtaatcctctccagtttacggtgatcgtacaactagcagtagctcacacgttagggaacttgttaacaaatgtgagcttaggaagagtaaatgtctctttcacccacactatcaaagcaatggagcctttcttcaccgtcttgctttctgttctcttgctcggtgaggtaagcaaaacaaagatacgctctgtttcagacttaatctataaccttagattatacaagagagttatattttcagacataatctttgaaattttgattaatgtccagtggccgagtctgtggattgtttgttcgttgttacctattgtcgctggagtctctttagcatctttcacagaagcttctttcaattggtatgaacaacaagaacaagaacaaaaaaaatagtattcttgataaacttttgatgaagttttaattgatttgattaattcatggtattgggataaaccaggattggtttctgcagtgcaatggcttctaatgtgacgaatcaatcacgcaatgtcctcagtaaaaaattcatggttggaaaggtaaaagagtttgaatataagttatccttatgatctcaagaaagaaactagtaatcgaaatctattaatgtttgtatattgaaacaggacgctttggacaacatcaaccttttctctataataaccattatctcctttatcttactggttcctttagcaatcctcatcgatgggttcaaggttactccttcgcatttacaagtagcagtaagtggaaaagcataaaccgatatagctagatgatctaaaagagaaagaactaatgtgtgtttgtatgtggttgcttgacagacaagccagggtttgtcggtaaaagagttttgcatcatgtctctacttgctggtgtttgcttgcatagctaccaacaggttggtccgtctagttcctccgtttcagaaaaactgtactgaattttgtaaagtcggttagtgttaggcttctaatcaacacataaaaattggggttgttgttgtaggtatcgtatatgatattggagatggtgtctccagtaacacactctgtagggaactgcgtgaagcgtgtggtggttattacatcatccattcttttcttcaaaactccagtctcacctcttaactctataggtaaacaactactagtagtatatattagtaaaggatttgttacacttgttcattttattgaagcaatatataatcacttgttaaataaacaggtaccgcgactgcactagctggagtatatttgtacagcagagccaaacgagtccaagtcaaaccaaatccaaaaatgtcttgaattttgtatatagaagctcttagtttattatttatgcgaaaaatgttgatatttttgttcatccatgtcgtttttacatgacactattaacttttgttaaattcaactaatctcattaaataattctattctttacatggaaattatataatgggcctaggaataaaattggagtggcccaaaagggcccaaaagaaggaggcggctcattaaggtgcagatatttttgttgcgacgatggatggttttataaacctaactaacagagacggtctaaagttggacatccttgcttttggtctaactttctctctcttgcttctacgcttcttcttgtggcgtagattgttatagagagggaaaccaaaaaagggaatctcaaaagctcgagttcacagatttgacccgagtctttaatccaatctgctggttcgttttccacattcaaactcgactcttgaatatcaaatcaggtacgcgtttatctgttgacaaaattcctcaatcctgacttagattcctagaatttggtatttaagctctctgtttcaatttctagtttctctctaagattgcgtcggtttggtcgtgtttaattctgatttctgatcgaatccttttattacgtgttagtttttttttttattgttcgatttgaatccagatctgtgactcgattgcagttggatgcttttctcatttatggttgaattaattgaaacctaagtcgagtttggtgatgatttctgtggattaccgatttggtttactgaatcgctttgacatgttgcagaagtctttgctatg

SEQ ID NO: 9043 - DNA, 3000 bp, Unknown
  misc_feature (1)..( 3000): cDNA_ID_1989374_gDNA_ID_1971974_Annot_ID_58704 3000 nt of promoter + ATG
ctagaattacgcatcaaactgatatcatatatgaagtcgcaatgggttacaacttacaagctcttgaaatcgatatttggtcacaaaggtgatccttaaatcgataactgatataaagtactgtacagagttggctaaaccgatggctaccgaccaccaaaaaaacctccaggtggagctcctccttcgttcatcaacttatccagaaccacgttgaggtcaacagcttggccgttttcagtcagttttctcactgttgctctgacttggtcccttgggaatcccatggttgtcaccctgtcgattacatcatcgattggggctctgctttctgatctaggggaactagagccaccaccgctgctgacggctgaaaccattggcaaagcgtgtggcaatggacgtgaatttgagagctgtgggtaaccagttccattgctacttatatgtggcggtttcgctgaggacattggtgaaccactgtatgtgtaaggttcagacaagtagccggacggaaaacctgaattagatctaccacccgctccatcgtacattgatggttgtggttgaggagggttgtagaactgttgagaaggggtagaaccagcaggtggctgttgacgaggagggtttggcgggtaagattgcatctgatatggtggttgttcttcggggttgtagcctgatgatggtggtggctgttgggggtactgtggctgctgaggcggtgactggtaagatggttgatgcggcgtttgggtctgaggagcttggtaaggaggcgggtttgatggaggtggttgaggatgactaggcggaggacaatacggctcttgttgagaagaaaactgcgtaggtagctgaggtggtagttgcgaggaaggtggctgggaaggagcagcagtggaagatggtggctgtgggaaagaagtaagaggaaactgctgcatagggactggagcgggcgattgagcagtgggatcaacgtgtaaagagtgtgttttggcatgctggttggatacctgatgctttgaaagctgagcttcgagaatctcttgtttgtccttcaatagttgcacaccactctgcacctgcacaccattcgcataaagaaggaactgaagtatcaacagaaagtactataagcctggttcaagaaaagacatgttcataaatgagaaaatttctgtataaaaaagatcaatagttgccaggaaaagctataaattctagtttcgaaaagcaatcagcaaagttacctctacaaggatatttttaagctgtctcattttcccatcagtgctgccgtgactattgtcaacagaaactttgagatcatccaccaggttctcgaggttgtgggttctggtctccagctgtgaaagacgtgcactaacaccttccattacatgaagcaaggtatcggtatgtttcttcattgtcctatctataatctcggacataatagtcgtgttaaacacattttgacccttgtcaggaaccaacttggaaggttcaatagaatcgagagatccaaaattctggccgaataaaaaaaaacaaatcaatcagaaatagacaagtcctcttataggcttatgatgtagaatcatgtacaaaaaaaaaaaagagaggaagattcgagaagtagtagtaagtacagtgttaggcgaagtagtggaaacgggtttataatcagaggcggaccaattaaccctagtcgtggatccggcgagatctaaagccgagtgagacaatcgtgcggcggtggtgggacgtatgggatggaaatcatagctaggaacgatcacttctttcttagagtccaatccattatcgccgatcacctgcttcttctggtgatcatcgccgtcatgattgttcatcagatcgatgaaatcagtggaaggtagagatgaagaagaagatagatccattatctgcttatccataaactgacaagtattcatcgatccacccgacaatttctccgactcccgaatttcttcttttctttctaaaacccctcagatcgatttttatttttttatttttattttatttatgtcataaaattgaccaagttgctcatgtcgacgtaccttctgattggcgtagaaggttatggaccctaaatgggccgaaatgtatttagaattcagtttccatcctctccgtttaaagcccaaattgtgatcaatgacctgtaccaacactgacataataagtaaatggtataatcaataatgtgatcaaagcaatgggaccaaccttatttgtaatagtatgaaataacacggaaagaaaagggtggactcaggagcatacaatacaacatccacatgtttcaacgcggcccctttcatatcatccatacaattctcccctgacattttcaaattccacactaaaaatcaattggtgttgtggtcagtaatttgtcatgttcgtacgtaaactttattttaaataattatttatagcgttaccaactttttgatattattataaacgaagaaaaccacggcccctttgtaaagaaatgagtgaccaagtatgtcaaatcatttccataacattatttacagaacacacatggaatggagaacatgagaagaaacaataccggcaaataccactggctcttatgaggaaagataaataaaatcgagccaatgttatattgaaaaaaatgtcggcatcggcatgtgagttatttttatcatactcaaaaacattcagatagtagaacgagagaaaagtcacataataaagacaactcttctaaataatactaatatcaagtttgcagtatatccaaaaacaaaacaaacttttttcttcttacatgaaaatgaggaggtagactcatgtaacataactcttaccaatagaggaagaagaaaaagttagcaagagtcggttacttgtgagaaattccaacaaatgccggaggatttatgcacatcttggagcatctgataagaggaaaaaattatg

SEQ ID NO: 9044 - DNA, 3000 bp, Unknown
  misc_feature (1)..( 3000): cDNA_ID_1989373_gDNA_ID_1971974_Annot_ID_58705 3000 nt of promoter + ATG
gatgaacaaaaatatcaacatttttcgcataaataataaactaagagcttctatatacaaaattcaagacatttttggatttggtttgacttggactcgtttggctctgctgtacaaatatactccagctagtgcagtcgcggtacctgtttatttaacaagtgattatatattgcttcaataaaatgaacaagtgtaacaaatcctttactaatatatactactagtagttgtttacctatagagttaagaggtgagactggagttttgaagaaaagaatggatgatgtaataaccaccacacgcttcacgcagttccctacagagtgtgttactggagacaccatctccaatatcatatacgatacctacaacaacaaccccaatttttatgtgttgattagaagcctaacactaaccgactttacaaaattcagtacagtttttctgaaacggaggaactagacggaccaacctgttggtagctatgcaagcaaacaccagcaagtagagacatgatgcaaaactcttttaccgacaaaccctggcttgtctgtcaagcaaccacatacaaacacacattagttctttctcttttagatcatctagctatatcggtttatgcttttccacttactgctacttgtaaatgcgaaggagtaaccttgaacccatcgatgaggattgctaaaggaaccagtaagataaaggagataatggttattatagagaaaaggttgatgttgtccaaagcgtcctgtttcaatatacaaacattaatagatttcgattactagtttctttcttgagatcataaggataacttatattcaaactcttttacctttccaaccatgaattttttactgaggacattgcgtgattgattcgtcacattagaagccattgcactgcagaaaccaatcctggtttatcccaataccatgaattaatcaaatcaattaaaacttcatcaaaagtttatcaagaatactattttttttgttcttgttcttgttgttcataccaattgaaagaagcttctgtgaaagatgctaaagagactccagcgacaataggtaacaacgaacaaacaatccacagactcggccactggacattaatcaaaatttcaaagattatgtctgaaaatataactctcttgtataatctaaggttatagattaagtctgaaacagagcgtatctttgttttgcttacctcaccgagcaagagaacagaaagcaagacggtgaagaaaggctccattgctttgatagtgtgggtgaaagagacatttactcttcctaagctcacatttgttaacaagttccctaacgtgtgagctactgctagttgtacgatcaccgtaaactggagaggattacaattgaatgaatctctctgtttttagggtttgacggaatcaatatttgatttacctgagaaggagaaaatttggggcgtggatggagtttaaggagccacattatagcaatcatcaacgttccacaccctaattgaaatgctgttacagtcgctggatatggataaaccctaagtacctggatcgatgaatgaacaagtttcatacttgtatgaagactgataataggttcgagtactgcttcttgcattgaaatggactgtttaattaaatgaagcaaagaaggaacctgtttgttgaaaatgttgtagtagatattgagaaggtaccaaactccaaacatgcctcctagcttcaaccctttaaccaaacttccagattccaaatctcctccttccacattctccggaactgtagctgacttgagcttgaagccattaaatctaaggttcggtctccaaggataagagttagaagatgaaaaagctctgcttcttctgctcaacgctgattcaggagtagacttggcaaggaacaatggagatggaagtcttggatttggatttagaaatgtgagagcgaacataattttttcctcttatcagatgctccaagatgtgcataaatcctccggcatttgttggaatttctcacaagtaaccgactcttgctaactttttcttcttcctctattggtaagagttatgttacatgagtctacctcctcattttcatgtaagaagaaaaaagtttgttttgtttttggatatactgcaaacttgatattagtattatttagaagagttgtctttattatgtgacttttctctcgttctactatctgaatgtttttgagtatgataaaaataactcacatgccgatgccgacatttttttcaatataacattggctcgattttatttatctttcctcataagagccagtggtatttgccggtattgtttcttctcatgttctccattccatgtgtgttctgtaaataatgttatggaaatgatttgacatacttggtcactcatttctttacaaaggggccgtggttttcttcgtttataataatatcaaaaagttggtaacgctataaataattatttaaaataaagtttacgtacgaacatgacaaattactgaccacaacaccaattgatttttagtgtggaatttgaaaatgtcaggggagaattgtatggatgatatgaaaggggccgcgttgaaacatgtggatgttgtattgtatgctcctgagtccacccttttctttccgtgttatttcatactattacaaataaggttggtcccattgctttgatcacattattgattataccatttacttattatgtcagtgttggtacaggtcattgatcacaatttgggctttaaacggagaggatggaaactgaattctaaatacatttcggcccatttagggtccataaccttctacgccaatcagaaggtacgtcgacatgagcaacttggtcaattttatgacataaataaaataaaaataaaaaaataaaaatcgatctgaggggttttagaaagaaaagaagaaattcgggagtcggagaaattgtcgggtggatcg

SEQ ID NO: 9045 - DNA, 3000 bp, Unknown
  misc_feature (1)..( 3000): cDNA_ID_1012219_gDNA_ID_1971974_Annot_ID_58708 3000 nt of promoter + ATG
tccgccacaaatctatgtacttttcttctaatctcaatcaaactctctgccagtcctttcttaattcctctctgcttcaccgaatttctcaacttctccacattctcccattctcccttaaccccatacacattcgacattaacatgtaatagccagcatgattagattccaattcgaaaagcttctttgcaacagtttctgccatctcaccattctgatgaatcctacacgcgcctaaaagagtacccaagatttgaggtgtcggtgaaaaaggcatccgctttgtgatttcaatggcagtatctagatctcctacacgaccaagaagatcaactaatacagcatagtgttctaagttgggagcaagtctatagtcattcaccatcaatttaaatattctcaacccctcatgtatcaaacctgcgtgactacaagcagataatattgagagaaatgtcacttcattaggcttaacttctgagctcttgaccatgtgattaaatgtttccagtgctttagtgccctttccatggatgccataaccagtgatcaaagatgtccaaaccacagtgtcctttaaagcaatcccattgaatactttagaagcattgcctagactcccacacctcgagtaaagctctacaagagaagctccgatgaatgggttactgtcaaatccatatttgataacataactatgaaagcatttagcttgttcgagaaagcctaactccgaacatgacccaagaaccttcaccataagaatagcatcaggcctggtattattttccagcaacatgatggaaaattcctcaattgatctgtgagccattccatttaatgtaaagccacttatcagcgcaacccaagagactacatcttttcttggtatcctggagaatacagcataagcttcttcaggggagaaacacttcatatacatatcaactagagcagtagagactttcacttctgtctctaaacctttcctaatggccaattcatgagtcttcctaccttgctctaaatcatgagcagctgcacaagcttgtaaaacacagagcacggtagctacattaggttctgttccatcatccatcatatcattgaagacaagcaacgcttcagcggcagctccattttgaacgtagcaagcaatcactgtgctccaagatataacatctttctctgctatcatcttgaacaaattaaccgcttccttgaaagctcttgactttgcataacaattcaatagcgaatttaccaaagacaagtcatttgaaaatcctctcctaatcacaaaaccatgcacacatcttccaagccttgaattcgaaagctttgtacaagcagaaactagtgtgattaaagttacccgatcaggagtaacatcggaagccatcaccattctcctgaaaaactctacggcctgatagggagacccgtttttctcaaacccagaaaccatagaagaccatgtcactatatcaggcttctccaattcatcgaacatcctcaaagcttcgatcattcttccacatttgatatacatatatatcagagaagatccaacataaaggtcagacccaagagtgacatccttcttcacgaacccatgaatcatttcaccataattaacttcccgcagctccccgcaggccttgagagcaactggaagcgtgaaattatcaggcttttcttcatcgcgaaacatatgactaaagtgatacaagacttcttcccattgtttctctctggataaactcttaagaagagtattccactggtacaagcttctcttcgtcatttcgccgaacatttggcgtgcatccacggaagaagagaacttccggcaaaaacccatccaaatcccctgaaattgaaaattatctcacattcaaaccttctgtttccgaaaaacttccatcaaaattttctcgcttctacattgcttgagcaacccaaatttccttcttgcagtaaactttgcgagggagagaagagaagagaaggatggattcaacttcaaagcaaaaacatgaagcgcgaatacgtttagcaaaaacgtttgggcctgggctgtatgagttgggctaataatggtccactactcgcttacttacttgtagcttttctattggtcaacatttttctttattatgtgctgtagtgtattaaatgttatttaaatactagcatctctccaggataaacataaccaattagagaacaataaataaagattgattaaggaaataaaagaaaagaaggacgtggcagtatcggagctagtgcctgttattgagaattggaaacagctacaaatagtacgcacaagcccttcttcttcttcttcttcttcgtcgtcgtcctcaacaagctcttctttctgactcataacccaaatttctgagaatcagagccttattcaagagaacaccaaggtcagcattttcttctactctctcgatctcaatttctctctttatccttgtgatctatttctctctcgtctacaatttgagctacttttcttgttattatcgtcacgttgtgtgtcgcgtagtggatttgagtgattggttgattgattgatggattttttcacgaaacgcgtagagtttggtggaagttgttgaaattcgaagccgatcgcggactcgtttgctcttgattacgtcgcaatccgtacgattttccgatcaaacgtaagcttgaatctctttcccttttgttttgttcgcaagcgtgtttgatttctgttaatatttcttgatttcccctttttgcggaattgattccggtttttatattcccatattatttttttattctcatgtactgagaatcatgattctagtttggtaaacggttggtgttcttataaaatgcttgatagatttccatctgggttttggttgttgctgtagttaagagtgaaggagatagatttgtagaaaaaggaagagaataagagtgagcttgtggccaaaaaaggg

SEQ ID NO: 9046 - DNA, 3000 bp, Unknown
  misc_feature (1)..( 3000): cDNA_ID_1989371_gDNA_ID_1971974_Annot_ID_58709 3000 nt of promoter + ATG
aatctctttcccttttgttttgttcgcaagcgtgtttgatttctgttaatatttcttgatttcccctttttgcggaattgattccggtttttatattcccatattatttttttattctcatgtactgagaatcatgattctagtttggtaaacggttggtgttcttataaaatgcttgatagatttccatctgggttttggttgttgctgtagttaagagtgaaggagatagatttgtagaaaaaggaagagaataagagtgagcttgtggccaaaaaagggatgcctttgaacttaggcaacgatggcgatgggtcttcccggattattttgactgagcctcgcggatctactgctgaggttttactccttcatctctcttctcttcatcattcctcaatgtttagaccatagcatctcagtggttagttgtttgagcctactactattgtatgtctatacaagatgttgtttatcttggagacgactatgaaatgaaagatgttgttcaactgttctggaacttggattgtgttaagaatactctgttaggggttgtagagttacatattctcggattgaaatctttcaggtgcttctatttggaggacaagtcatttcttggaaaaatgaaaggagggaagaactgctttatatgagcagcaaggtatatctctaatcaaatatcgtctttagttttcatgttttaactagtattttgtttggtacgactcatttaggctcaatataagccacccaaggcgatcagaggaggaatacctgtttgctttccacaggtttggcatctcagatcattttaatatagttgaataaccctttgctctagtttcgtactgccattaagtatactgtgtcatatttgcagtttggaaactttggtggacttgagcgacatggatttgcccggaacaaattctggtcacatgatgaagatccttcgcctctacctcctgctaacaaacaatcatctgttgatctgatattgaagtccacagaagatgacttgaagacctggccgcataggtgtgttttaacttatactctggatctatgatatggatgtcttgtctgtgcctttttttattatcatctctttgtctaactttataattactcggtgctattggcgcagttttgaactccgtattcgcatttctattagccctgggaagcttactttgatccctcgtgtgaggaacattgactcaaaggcattctcctttatgtttgcactgcgaaactacttatatgtatctgacataaggtgtgtgtgccttacaaatttcttccgatctgatttcgtgtacttatgctgcttccttcctctgagtgataaatcatgtggtcaccgaacttgcagtgaagttcgagttgagggtttggagacactggattatctagacaacttgattggtaaagaaagattcactgagcaagcagacgcgattacctttgacggggaggtgagtaatgtcagccattgttttccccttaatagtttcaaagaagagaaaaaaaaccaaagattgatatagagtcagtgtgctgtgcaggtcgatagagtgtacttgaacacaccaacaaagattgcggtcatagatcatgagcgaaagaggaccatcgagttgcgaaaggaaggcatgcccaatgcaggtaaaggataccatttgttcttcgtatttttttttatgaatgaaaccttttgagagttggtttctaatggattgagttggaaacgagcagttgtgtggaacccctgggacaaaaaggcaaagaccatagctgatatgggagatgaagattacaaaacaatgctttgtgtagattctggagtaatcgaacctctggtattgttaaagcctcgtgaagagtggaaaggcagacaagaactatccatcgtctcatcaagttactgcagcggacagcttgatccacgcaaggttctttacggagatatctgatccttttgggggtttatcttacttagtaaaaaaacagtaataagccatgatctcattatcactaccacccagaaacaactctctaagagtcttgtcttgaacttggagattttatccttttgacttgtgttttgagtgagttctgattgttgttgttacacagagaggtcacggtaatattttgtaacgttgactctgtgtttgaccgtcaaacagtgtatcggtttctttgttcggaaatttagtagaatatatcatcaatttagtagaaattttgtgaagtatttctagtcttctctactttcttctttagtattgctactttttaaaagtaataatacttttagatttgttaatttgtaattaacaaatcattattttacactttatagcacttgttttttttgttttttaataacaaaatgcatatagagagcttttttcgtttactgcagatttagtatgacaaatactagagatcatgagtttcttcatttgccaaaggataaagataaaaatgaaaaagggttttacaacgtatagatcataaatagatttgataaaagattccataatgtgaagtctccattatccaacggtaagtggtcttgtctcaactatagttttttaatcattagttaaagacgaaactactgtatctggcttggggagcaaggttagcgggccccacataatctatttattaacaaaattgccactaatcccgatttcccaagctcccaagtgcttcggtgttccgaaccaatttcacagcgaaggtcaataaacacgagtgttcaccgaagctaaggttcgtcaattgtgttccagagaagctttcctcgaagcttagggtcggaacgtacgaccctatggattagctccagtttcccgctcacatagtcttctcggttttgtttttgtcttcacgcgttcactccatttttacttagcctagtgaacaagctcaacaacgctctctctctctctctctccccctctctctgttttgggaatc

SEQ ID NO: 9047 - DNA, 3000 bp, Unknown
  misc_feature (1)..( 3000): cDNA_ID_2687327_gDNA_ID_1971974_Annot_ID_58710 3000 nt of promoter + ATG
gagtgttcaccgaagctaaggttcgtcaattgtgttccagagaagctttcctcgaagcttagggtcggaacgtacgaccctatggattagctccagtttcccgctcacatagtcttctcggttttgtttttgtcttcacgcgttcactccatttttacttagcctagtgaacaagctcaacaacgctctctctctctctctctccccctctctctgttttgggaatcatggcgaggtaagctttgaaccctaattgatataaagccccagactttcgttgattttttcacacaaatcctgaatcggttttcgtaacgcgattcctcttccatttcgttcactgttcctcgaaagggataaaatttatttttgagtgggttacgattcagcttttcctgggaagcaaaatgtgaaatttcccttacaagtttgagttacaaagattggatttttagagatatttcgtctgatttaggcatttactgtatccgcttgaatctctagtgtgtctctaactcagtagctgcttatgaacggatgatcttatcctcttttgttcttgtcacaaatatacagggcttggattgtcgatggtcgaggaattgcagccaaagttaaaaatgcctctctttcttcagctttgcagatccaagactgtggagctcatataaaatgccccaactgcacttaccgcattgacaatagcaatgtgagtgattatatccacacttctctctcttgtcttaaacttacacacactcacctgtgtttcgttggtttcaggtactgattccatggcctggccttcctaaaggtgtcaagtttgagccaactgatgaggacattatcgaatttttggaagctaaatgtgggattggtggctctgaacctcatgtgcttatcgaagagttcattcgtcctgtcactgaagatgttggaatcaattacactcaccctcaaaaccttcctggtaaatgatcaataaagacctttaaataagctcataattgttgttcttcaactgaaactgtaaatcttgtatcttgaatctctgagtctctccaggtttattgattcctgctgagctttactgtttcaggtgcaaacaaagatggagtgagtgtcttcttctttcacaagacagtgcaggcatatggaacaggacagaggaaacgcagaaagatcacaccgacacttgtgaacgatgaaccagttcgttggcacaagacaggcagaaccaaacctgtgatgctcagtggagtccaaaggggttgcaagaagatcatggtgctctacaagagcgctagaaagggaacgaagcccgagaaatcaaactgggttctgcatcaataccatctaggaacagaaggaaaggagataggagactatgttgtttccaagatcacatatcagcagcagaagcttggggaaaatcctgatgaaggtgagagtagttccggggttagaggtggcccaacaacaccaaagacgaatactcctacaccacctagccttgtagatggtgtcgctggagatgaagaagcttttgatgatttaaagatgtttgatccattttttgaggttggttccacaaaatcattggggaatagtaacttcgttttctagagactaataaagtcggaatttttgttgttggttaaccaggaactggacagcattcctgaagctgctttagggaagatgtggtccaaaaaagctcgaatggatgaggaatttgttgtgaacctaagtgaagataacttaatatgcgacgaaagcatggaagcttcgtctctttgggaaaatcaggttctccccaatcctagccttggaactgttggggacttcgatggtttttcgatatcagatctggagaatgcagatttggggactccccctgatttcctcactgtaagatcctgcttgaaaaaaaccttgtttactttcggaaaattcaatggaacataagattctaaattagttgtcatggaggttttgcagttggcttctcaggagagcttgctgaattggattggatggttgtgattggattcttgctgctacacaaagaagctcttctagtacggcgttttcgctgaagaaggaaaaagctggaatatgtcataaataagaaaactttaaagtctccgcaactgaagtcatatctctgtgataattttacttcaggagaccagttttctctcggattcccggaaagctgcttaaatattccgggaataatcattttcaatctctgaatctgcacttcatcattgtaattcaaatagatattttgacctttgtactctttgctgtcttatgatggttactctgtttttgtttggctcagggtccaacggttataactatttatttttgggtattttactattttcaccttatattctcaaaagttctcattatcaccccaaagaaattaattaatccgatttaacctctttaacattactagacagttcacacaccctctgtctagacggaattagggttttcttaagctattccgcagcagtctacggttgttgtgtcggtggtgggcgcctccaaaatttaccctttagtataaataagttttggaaaattcagactttggttattgaaacgccatctcagctctaattcagtacgatggggaggagaggtcgcggcggcggcggtggtatgggcggaggaatcaatcgtagatatctgagtcaagttatggatacgtgcggcaaggatttatctacggcggaggacatcgttgatgatcttcgttccaggtacggcaattttgcgaggttgactcggcaagtgcttctactcaatgtcaggcaagtccttaatgttagaaacaacaagagggttaaagacgaagatgaagatgacaacattggagatgaggaaggttctgcttctcagaggaagaaacagagacgggttgatgagaaagaggagaaattgcagcgagcggagcagtcgcatttaaggaagaggaat

SEQ ID NO: 9048 - DNA, 3000 bp, Unknown
  misc_feature (1)..( 3000): cDNA_ID_1989367_gDNA_ID_1971974_Annot_ID_58714 3000 nt of promoter + ATG
gtttggatgcattttcaatattaatattatgatttcactgaatttcaggctcatcttttttcattagattccaaatcatttgtttattagtttgaattgtgtaaaacatttttcacgcttcatggctctaattctgagattttgtgtagctgaatcgtttgcaaaatgaaggatactacggtggggtaaggttgctaatggcgatatgtaaagtattccgtaactattgcaaagagaatgacattcaacttcaccaagccaacttctctctttcttatgataccaatatccctaggcaggtactgatcattttccttcccctttctctctatgtttttttcttttctctgccaccaacgcttatcttttcaactttgatgctccttccagacagggctttcgggttctagtgccatcgtatccgctgcccttaactgccttctcgacttctacaatgtcaggcatttgatcaaagtacaagtccgccctaacattgttctcagtgctgagaaagaacttggcattgttgctggtcttcaggacagggttgctcaggtctatggtggtcttgttcacatggtcagtgtctcccctcctatctcatacattgccgttggttccatcggttttatgactttttatcatcttcttcactttgcaggattttagcaaggagcacatggataaattggggcatgggatttacactcctatggatatcagtctcctccctcctctgcatctcatctatgctgagaatccgagcgactcagggaaggtacttacacttattcaatgattctggtttatgcatcaatcaagtgaaattcctcaaaaagcatttatgacactagaactcagatctttggggcataactcagtagaatttagaagtatctctctgttagatgtttcataatattagcattgccttctaatgcaggtacatagtatggttcggcaaagatggttagacggtgatgagtttataatctcatcaatgaaagaagtcggaagtctagcagaagaaggtcgaactgcattactcaacaaggaccattccaaacttgtggaactcatgaaccttaatttcgacattcggaggtaaatataattccagacaaaactcgaacctatacacaacttaagattaaactccaagctcacatgatgttgaaatagatgggaatacacacatataatagtgatgtctttttttcccgataggcggatgtttggggatgaatgcttaggagcaatgaacatagagatggtggaagtagcaaggagggttggtgcagcctcaaagttcactggaagtggaggagcagtggtggttttctgccctgaaggtccatctcaggtgaaacttctggaagaagaatgcaggaaagcgggatttacgcttcagccggtaaaaattgcgccttcatgtttgaatgattctgacattcagaccttatgaaagccttgatcaagtcttcttattcacacgatagagccattttccagagaaataaacatgtgagctttaattgggtggttgttctgtttctttttcttgcccatttttgttgtttgttccttggcttatactaatatgtttgttttgtttctttttccacattaaggtccaattttttatattatattaaaagaactaaagaacagatgatcaaaattgaagtagtaatgatatttatttgccatatttgtgctcttttttgttttgttgaaactgtatatacagaagttggcagatatagtgtggagaaaaaaaaagaaatatagaattcagagatcattatttggcagaaaatgaagagaaatcgtgccagacatgttcaatttctaatctatactattactagtaccctacttgatgaaatctgaacaaaacatgtgtgtgtttcagaatcacgaattcgaattgctactagtgttttttacaatcttaatggaaataaaatggttatttgatcgagtaataaatattaaaattttgaaatcggtctggacttggacttggacttggacatggtgggccaataataaacaaatccaactaatcttttccagatttcatgattgaaacgtaaagtgaaagattaaacaagagaaaaaaggttagatagctttctgaacaaaaggagagaatttggggatatagatagaatccgccatttaagatcccttccctttgacctgttgagtgttgacaacctgaaaagaaacaaaaaaagaagaagaccgcttcatcttctcaacaccacctctgtcttattgctctcttttcttcttcgtcgacttctctcacacatacaaaaggtttgggattttttttggtagaatctttttaagttatctatcgaaatcagtttgatctgttttgtttttccctcttctcttctgggttgttggtgaataaatctacttttcatcttaattaggacaaatctctctaattaaaacgcctcagattttgtcttcagttgttttgttttaaaccctaagttacttgtaagttaaatgaaatctacaattcttaatttcttgtttccaaaattgtgaaaaaatccaaacatatatagaatagacacgtaacggctcaaagtcggtaattggaggtaacgtgattgaatcttcttcatcaatcataaatcttctctcttaagaattaagacgccgcctcattacacctgttccataatcatcgtcaatatattcattctgcaaaactattcttcttcttctttcaaagtcgtaattgctctctctcacccctaggttcttaagtcatacccattttcaaggacaccttagaaagtttcgagttttctattaggtaattgcatgttgaatctgttacgttcttcttgtgattccccttttttctggcccaaagaggataagattctaaaaatctgaatctttgtatgcaggtgtattgatcttgaagccttaaagtttgtgtctttttgttaatttgaataaagtttg

SEQ ID NO: 9049 - DNA, 49 bp, Unknown; identical to SEQ ID NO: 9034
  misc_feature (1)..( 49): cDNA_ID_2687323_gDNA_ID_1971974_Annot_ID_177545 3000 nt of promoter + ATG

SEQ ID NO: 9050 - DNA, 3000 bp, Unknown
  misc_feature (1)..( 3000): cDNA_ID_1989366_gDNA_ID_1971974_Annot_ID_58715 3000 nt of promoter + ATG
atacccattttcaaggacaccttagaaagtttcgagttttctattaggtaattgcatgttgaatctgttacgttcttcttgtgattccccttttttctggcccaaagaggataagattctaaaaatctgaatctttgtatgcaggtgtattgatcttgaagccttaaagtttgtgtctttttgttaatttgaataaagtttgatgggaggagggaattccaaagaagagtcgtcatcaccatcttcatcatcatgggcttctcatcaaagttatcctcaatatggacctgatagctacaactatcctcctccacccacttatgctcccgctccatctcctgctcctgctcctgctccggtgcctgctccatctccggcttccagttatggccctcagtatagtcaagagggttatgcatcacagcctaataatcctccaccacccacttatgctcccgctccatctccggcttccagttatggccatcagtatagtcaagagggctatgcatcagcagcatcacagcctaattatcctccacctccttcacagagtcaagttgctgacaggaagaaatttgatcggaggtattccaaaatatcggataactactcttctttactgcaggttagtttaagacaatgcatatgctatacacttggattttcccctcaaaggttctttggaaactgaatctagcatgtgtctgaattgattccaggtgtccgaggctctaggccgtgcaggtcttgaatcttctaatctaatcgttggtattgatttcaccaagagcaatgaatggacaggtttgttatattattcttattcttacgttttgaatgtaaaggagaagccaaactaattggttttggtactgcaggggccaagtccttcaataggaaaagcttgcatcacttgagcaataccccgaatccatacgagcaagcaattactatcattggaagaaccttagccgcctttgacgaggataacttaattccttgttatggttttggagacggtatgcactgttttctctcttctcgattctcataagaatgtatatcaatcggatcatcattgacttgctttcatctctttgcagcatcaactcatgatcaagacgtgtttagtttctatccagagggaagattctgtaatggatttgaggaagtattggctcgttatagagaaattgtacctcagcttaagctcgcaggtttatttcctgctctgacctgcactggccaattctatatctccttgtgaaacgcaagttataaacttaaaactgtgtttttttttcctgcgaacttatgtatttcaggaccaacttcttttgccccgatcattgaaatggcaatgacagtggttgagcagagtagtggccaatatcatgtgttagtgattatagctgatggccaggtactgattaatattttgactgcctaagctgtgtatgatcttctggttttgtgtctagggatatcaaagtggacccattttgttgtttcaggtcacaagaagtgtcgataccgaacacgggcggctaagtccgcaagaacagaagacagtagatgcaattgtgaaagcaaggtgcgaatatttcaatcttttgactaatgtttcttccattttaaagttctttactttgagtgtaatgttataaagtgttatggtatgtaatcagtttcatcctctctattacagtacccttcctttgtcaatagtcttagttggggtcggggatggaccatgggacatgatgcaggaatttgatgataacatacctgcccgagctttcgataacttccaggtaagcttctttttttcatatcatgacattgaagattgcttcttttcttcagtttggaaccatttttctaacatgtttgctctgtttctagtttgtgaacttcacagagatcatgtcaaagaacaaagaccagtctcggaaggagacagagtttgcgctgtctgctctcatggagatccctccacagtacaaagcaacgatagagcttaaccttttagggtaagggacccaaatcaaaactctgataggtgtagctgcgagaaactgctatattgttaaacaaaatgctcacctttctctttcccttacatttttgcagggtaagaaatggaaatatcccacagagaatcccacttccgccaccggtgcagagtggatcatcattctctagttcccggataccgaattttgaaccgagtgtacctccttatccatttgagagcaagcaaatgagtagtgcagacgatattcaggtaattagtagaaacttaggaatctgtttgaaatgttaagtgaaataagagctttggaactttttgttgttaaactcgtttgtgttattttccccttgaacagctatgtccgatatgtctgagcaacccgaaaaacatggcgtttggttgtggccatcagacttgttgtgaatgcggaccagatcttaaagtgtgtcctatttgtcgtgcgccgatccagaccagaatcaagctttactaacaacaccattgacatgcagctttgaccagcccaaatcccatttcttccagagattttcagatctttctgtagaaaattaaagtgttcttttgttctttgattgaattcctaaactttatcttgttcataaaatttctttgattggattgtaagaattatgtatttgtctgttggctttctttgatttttcaagattcgattaaaccaaagttgattgcttaaacactttaattttgatttgttttgtcgacataagcaatgagaaataaatggatgaatagcccaatagaagcccattagcctgaaattgggctacaagcaaacataccaaataaatagtagggaagagcagaaataatcacaccactcatcagttatccattcctttctttttacataaattttgtcactttttctacaaacgattcttcgcttctgtgaaatttgataaagcgaaagtttttttctt

SEQ ID NO: 9051 - DNA, 3000 bp, Unknown
  misc_feature (1)..( 3000): cDNA_ID_1989365_gDNA_ID_1971974_Annot_ID_58716 3000 nt of promoter + ATG
taatcagtttcatcctctctattacagtacccttcctttgtcaatagtcttagttggggtcggggatggaccatgggacatgatgcaggaatttgatgataacatacctgcccgagctttcgataacttccaggtaagcttctttttttcatatcatgacattgaagattgcttcttttcttcagtttggaaccatttttctaacatgtttgctctgtttctagtttgtgaacttcacagagatcatgtcaaagaacaaagaccagtctcggaaggagacagagtttgcgctgtctgctctcatggagatccctccacagtacaaagcaacgatagagcttaaccttttagggtaagggacccaaatcaaaactctgataggtgtagctgcgagaaactgctatattgttaaacaaaatgctcacctttctctttcccttacatttttgcagggtaagaaatggaaatatcccacagagaatcccacttccgccaccggtgcagagtggatcatcattctctagttcccggataccgaattttgaaccgagtgtacctccttatccatttgagagcaagcaaatgagtagtgcagacgatattcaggtaattagtagaaacttaggaatctgtttgaaatgttaagtgaaataagagctttggaactttttgttgttaaactcgtttgtgttattttccccttgaacagctatgtccgatatgtctgagcaacccgaaaaacatggcgtttggttgtggccatcagacttgttgtgaatgcggaccagatcttaaagtgtgtcctatttgtcgtgcgccgatccagaccagaatcaagctttactaacaacaccattgacatgcagctttgaccagcccaaatcccatttcttccagagattttcagatctttctgtagaaaattaaagtgttcttttgttctttgattgaattcctaaactttatcttgttcataaaatttctttgattggattgtaagaattatgtatttgtctgttggctttctttgatttttcaagattcgattaaaccaaagttgattgcttaaacactttaattttgatttgttttgtcgacataagcaatgagaaataaatggatgaatagcccaatagaagcccattagcctgaaattgggctacaagcaaacataccaaataaatagtagggaagagcagaaataatcacaccactcatcagttatccattcctttctttttacataaattttgtcactttttctacaaacgattcttcgcttctgtgaaatttgataaagcgaaagtttttttcttatggattctcttcgattcaacctccaacaatctccatttcaattgaaacctagaattctccgaccaagaatcaccaacatatcaaaccgaatcgatgaaaccgatcctcgaccatcatcctcggccggtaggatccaaaggttagtacttaacaacgaaggtcggaccaaactaaacgccgatcctgaccgtgaattctattcatatccacggttcgtgaaccacgtagatgatagtttcatatcctccttaaccgaactatacagaaaccggttgagacccggttcgactgtacttgacttgatgagctcatgggtcagccatcttccagaagaagtgaagtacgagaaagtagtagggcatggtcttaacgcacaggagcttgctcgtaaccctagactcgattacttcttcgtcaaggatcttaatgaagatcagaagttcgagttcgaagacaagtatttcgacgctgttttgtgttctgttggtgtacagtatctacaacaacccgaaaaggtacgttaccgtaaaccaaaaccgatttcggttatgtcaagaagattcctaaaccgggtctttattatataaaccgcaggtgtttgcagaagtgtatagagtgttgaaaccgggaggagtgttgatagtgagttttagcaaccggatgttttatgagaaagcaattagggtttggcgtgatggaaccgaatacagtcggatccaattggtggttcagtactttcagtctattgaagggtttactcagccggagatcatccggcaacagcctggagctcagatatcggttttgactcggcttatgggttttatcggtttagcttctacgcccgatccttttaatgctgtcattgcttataaaaatttcaaacctatttatgagtaacacgcacataaaaaaaagtgtataagaattggatgggaagtttttgaagaaaaggaaaaaacctctcaaccaagtccagctggagaaacttacaatacaaatttttaaaaagtggagaatgaaattacagatttcaatcaaattggaagaacctgtattacacaagaaataattgacagaaagattacacactttggaaaatataattaatatatagttttcaattagcatgcattgtatgtgattcgttttgttcgaagattcatggacaatatccaagcaaggtagccttgtccctcttcaaacgagtatcacgagttgcttactttatggtttagattctataataacagtatatatattagaaggaagtcttttatattaaaacaaaaatccattgtatatgtacactatctatgttccatgcatgtgtcttcttaaatagctatgaagtcccttattttactatgtacatactaaatttagttatgtttatcaggataactcgttgtaccatcagtatataaactttgaaatattaaatgtttctcactactagtattagactgttgcagttgcgttagagacgtttcatatttagaaataatattatccaagacctgaaattcttattattatgaaaattatgaaatatcgataagggaaaaactgtatggaagtgtaaaagacaccaaaacagatattgaaccaaaggtgaagcaaagaagttgattcaaagttgccactttatttaaccttttgcaccagtatatatacacacac

SEQ ID NO: 9052 - DNA, 3000 bp, Unknown
  misc_feature (1)..( 3000): cDNA_ID_1989364_gDNA_ID_1971974_Annot_ID_58717 3000 nt of promoter + ATG
acattaaccaggtcgggatcaacgtgctcacccaaaagcacgttctgcttctgatatcagacctagaaaacatcgaaaaagagctctacatcctggaatcgctctacacagaagcatggcagcagtcattcgagattctttgggttccagttcaagatttctggacagaagctgacgatgccaagttcgaggcccttcacatgaacatgaggtggtacgttcttggagagcctcggaaattaagacgagccgcgataaggtttgtgagggaatggtggggtttcaagaacaggcctatactcgttgcacttgatcccaaaggtcaagttatgtcaaccaacgcctttcctatggtctggatctggcaaccctttgctcacccttttaccaccgcaagggaacgtgatctatggagcgaacaggagtggaatcttgagttcttgattgatggcactgatcctcattccttaaaccaggtttcttgattgaataaaaaaacagagtactaataaatttttctttctcttgtgttacacgtaacctgaaaatctgtgtgtgtttcaaatgttttttatcagcttgttgatggaaaatacatatgtctctacggaggagaagatatgcaatggatcaaaaacttcacgagtctctggcgtaatgtagcgaaggccgcaaacattcaacttgagatggtttatgtcgggaaaagaaaccctaagaatggaatccagccgataatcaacacaatccgggaggaaaatctcagccatactttgccggacttgttccagatctggtttttctggaccagggtcgagagcatgtgggaatcgaagcagaggatgctgaaagcccacggaatcaaggggagagaagggtttaaagaagaggaaaaggaccttgttctgcaagaagtggttgctatgttaggttatggaggagaaggagatggatggggactggtgagtaaagcatcggacatgatggttcgagccaaagggaacttgttttctaggggtttggctgaatttaacgaatgggaagtcaacatccccacaaagggttttcttacagcgctcaatgatcatctcttaatgcgtctcccaccacatcactgcacaaggttcatgcttcctgagactgctggaattatacctaatgaggttgagtgcaccgagtgccgtaggactatggaaaagtattacttgtaccaatgctgccttgagtaagatcccataatactggggaacaagttgatttggaagccaacaacttgttcctataaaaccaaataagtttgcgtcttttttttcctccttgttgtgagtttctctactcttcatgttgttgttgttgttctgctctactaaaagcagagagtctttgtaataaaatttgtgtgtttgagatttcgaaataataaaggtttatttatcggaagcttctagaacaatgaactgattgaacattgcttctttgttgatttcttgatccttaagctcctagaacactagtgaactaatacacaagtaacacaagtgaccgtgacatttttttaatgtgacagtaatatcttttgacatttagccttttgaaatgaaattacttaatgctagtaaaatataggcaaagtaaaaggatggatcaatcaatcaaaagatgaacagtcttttgagtccaaatcacatatcgtaatatatctaatagaaagttaaaagtgttagtctacattattgaaaaaataaaccatgagactgattgctgtattacaaagggggaatacaactttaaacgacaaatcagcggttcctagcctgtagttaatgtaaaagttaaatcttccaaaccatcaaatactttttaaatattgcatatatcggattcgatttcgaagaagctcttatacgtatttctaatgatgagatattaaaatttgttgcgtatagaaacaacaaatttaatcctacctataaacgttatgctaaagttaatagaaaaaaaaaaaaacatgcatagaataaacccaaagcataacaatcttatttttagaaaagtgattgtctttagataaatatatccttggttactcttttattgctttttttagccttatccaagatatatcattgagcttaagaaattctttagttttacccaaaagagagcaaagaatcttaacttcacacccttttgttcacttcactcttgatgctattttctgaggcatgcatgagataaaatcaatgtaaagtaacttaaagtaaatgacagaagccataaattataatattctatggcatgaggtgaagtaacataagaatataagcaaagtagcaaacaaaatgtgtcttatcttttaatgtcctttagtaacataaaaatgcgagaattaattagtagtccagtgatcatcattatgatggagaaaagtgaggaattcgtctccaaacctcccaagaaaatgacaaaaatctgtatattttaggatctaaatttctagttggcaatgaagttaatatcattagtagcaatattaaaatagtgtagtttttgatccacttttagtcttatatgaatttgaattcagtaatacacacataaagaaagagtactagctctaaagatttacgagtaaaactcgcaacatttcagtgaaccattttcttcccattatgatttagttcttatttactatatatattcgtgtaaagtaggcctatactttattgtgctaacgatattcacgtggacgggaactatatatctcattaaaacttctataataagccaccaaaaaaagaaaagcaaaaaagaaacaagattatataattgatattctttgtatgtttaatttaattgttgcagaagcaaagaagtcgattctcaatttccaaccgtaactaagggggagaaacgagtatttaaggctaacctcacatagcaaaactacaaaccaataaagacagcctcttcttctaacaaaagcaaactgaaccaaga

SEQ ID NO: 9053 - DNA, 3000 bp, Unknown
  misc_feature (1)..( 3000): cDNA_ID_2993228_gDNA_ID_1971974_Annot_ID_58718 3000 nt of promoter + ATG
tgttgaggaggaagacagtgttgctgctcatctctgatctcaacatactacaagatgagctatcgattttcgagcaaatctacacagagtcaaggaggaacttggttggggtcgatggtaagagtcatatgccttacgaggttgtgtgggttccagtagtggatcctattgaagattttgaaagatctccgattttacagaagaaatttgaggatctccgtgaccctatgccatggtatctaacacatttatttcaaaacacacattctagtagttgtaaagaaagatggagaaatataattggaagttatttttttttgtgggggtcaggtattcagtggatagcccgaagctgatagagagacatgtggtggagtttatgagagggagatggcattttatgaacaagccgatacttgtggtgattgatccacaaggcaacgaggctagcctcaatgcgcttcatatgatctggatttggggcactgaagctttccctttcactagatctcgtgaggaagagctctggaggagagagaccttttcccttaacctcatcgtcgacggcatcgactctgtcattttcaactgggtatttcaaaagtctcatccttttttctttttatgattggcctggaaactctagaaacagagcaggcagggtttgacctaaattacattcattcaagaacgaggcgtgattaatgaacaatgatgggtctgatttgcagataaaaccggataattacattttcctgtacggaggagatgacttggactggataaggagattcacaatggcggccaaagcaacggccaaagattccaacgtgaaccttgagatggcttacgtcggaaaacgaaaccatagccacagggaacagatcaggcgtatcagtgaagtaatcaggtctgaaaacctgagccatagctgggccgaacctgccttgatgtggttcttctggactaggctcgagagcatgttgtactccaagattcaactcggtaaagccgatgatcacgacgatgtaagagttgactagctagggttttcaattatttcggttcggttcggttcaattggttaatgaatgattttgtgtgtttgaaaacgttgattaggtgatgcaaggaatcaaaaagatactaagctacgacaagcttggaggatgggcactactgagcaaaggacctgagatagtgatgatcgctcacggtgccatagagaggactatgagtgtttacgaccggacctggaaaacccacgtcccgaccaaaggctacaccaaagcaatgtccgaccaccaccacgatgaggtcctccgtgaaaccggaaaaccttgcggccactttgatttccacatcactgctcggagcggtcggattccggagaagatgaattgcttcgagtgtcagcgtccgatggagaagtacatgagcttctcttgttgtcacgatgaaaagctccacgaagacgagaactacaacttctaaatgatgcaataagctcacgtctcttcccgctgctttttctttttgttttacgtaatttgaattctctatatagtttttcataaataatttctgaatttcaatatctttgtatgagagagaattggtcattccatgtgtgtggtttggcctttgtgggacatgttcgattgaagtattcctaataattttcaataattaacaatttcttctcttaatagcatagataaatgttgaatttattttgttaataaaattaaccctgatgaatacaacaattttgaatatgtcaaattagaccaattcaaaatataactatttgctttctttcttctcataatgtttatatatcccactttagtaaatggacccccacgaagcacaccacagcatactcttttttattctttccagtttctaatggtttacttatatactcttatcattttctaattgatcaatttgtcatttattggcttatcttcttataaatgttttttgtgttagttgttgatatctcattttcttgtccagtgaattatagcatttcaatgtgtccctcatgtcgtcaatataatgttttattttccttgttatgatccatatcttcatgtgtggtccatcttcaaataaagaatggattgttactactcttatcgtttgggctagtttttataattagacacaaaatttgtaactttcattctttttttagtatttaacacaaagtaatttgatggattagtctaaataataaaggcaaaaagttaagtaaatgtcaaaagagatatggcatatgtctaatcataaccaatgaattgcatggttctatctaaatagcaaccatatcatcccacatgccattgtccaccttgtctatcttaggaaaacactttgtttgtaactctattgtactctttgaattatgaaatctatgtaaacccttcttattgtgggggacaaaggctaattttaatggtctgtccacttctgcttgactttgatacataaattaggggtggctcatgtcatatctatgagaattaggtacaaaagagttttcaaatgagcaagttgtatttttattcgattagccgtcgtattatgtcaaatataagttaaaaatatgtaaaagtacaaaatgtagattatgatattagggatgaattgagataaaattacctataatttattactacgcataataaataatttgttacgttaattctcatagatacgttatagccaataccgaacccctatttaagtcaaaagtacttctaagtattttttagcgtaaatcaatttttatgaaaagcaacaattaagattaatgtagtaatctagtaatcgttaaaaaagccactttgttagtattgcttaatactctctctctctctctgttcccaaggagatgaaaagcttcaatctcaaaacatagcagctctctcaataaaccaaacccaaatgcaagctgtgtagagagaaacggagtgaggaaggaaggag

SEQ ID NO: 9054 - DNA, 3000 bp, Unknown
  misc_feature (1)..( 3000): cDNA_ID_1989740_gDNA_ID_1971974_Annot_ID_58721 3000 nt of promoter + ATG
cgccttggaaatgtaatctaactggaagaatctacttattagcaagcatagttcccacatacaaagaaaacagcaacagtgagagagttgaaaacatcttacatctctcagtttttggccttgatggagttgttctccttgattttaccccgtgtgtcgagcttgacaaaacgtttgagatcatcgtagggaagagtctcgacgttcttcctcctaagctcactgagagctggtcgcttatcgaggagatgccagagccaatcagggtaatcagaatcaggcaagatcttgggatcagatccgtctttgagagtattggcaccaacaacagtggtggatttgatctctttggtcaagctggaacctttaggagcatcgctggctccacctcctttgccacctttcttggctttactagctgctgctgcaaacgttctccggactacatccttggatgatgatccccttatcaatccaatacggttcatctcctacacaaattttagataccaaaaacagagcaactttttaaatcacaaatcgccatttcgttgaatatcattgtttccagacgaaattagggttagccaaatccagaaaaataaaattaaaattgccacaagagcgaggaaacttaggattgtcaatcgagagagaaacctttgagaaggaaagagagaaaacttacgtcgaagaagagcacaagtgaagaagaagcttactagcggcgagtttcagagaggcggagcgaaaaaaactctaacagtcaacaataatactaacatagtaacattccctttttctcactagtttctaatccggcccaaatatgttttgggttgggcccgataatataccatatacgagagcccaatattgatagtaataattactcgtcagttttaaatagaagtcaacgagggataatgagtgcactttgcgaacatgttgacgtgtctgaatctgtttcggtgaccaaaaacccatgaatgttctgtcacagctgtgaataatagaaacagcgacatgtacttttgcatattcagacgaccaagtagaaattctttaacacaacttattattaacgggcgttgatctcgatcgttggatcatcacggtaatagaaaccgttgatatttgattaatcataagaaccaaaaggtgataaatttattatgaataatatacgtataactttttattcatcttttaccaaaaaaaaaacattttattcattatcaattaattttgagtttggaatctcatattttcaaaatagtattagaacgagttccgatttctcattttaggaccacaattagattttcattcccacgcaacttcgtgtttatatgttctgccctgatcgcaaaaagaaatgtaatgtttcagagtaatatgtagtatatgatcaatgctaatttgttttaatttagaaattaatctacgattcttaaatgtaaccaaacaataattatccaaacaataattttttgctaattaaagtctataatactatgagaataaaagacaacaaattaaatggggatagtgtactagtttcgtttatcagtacatcgcaaaatttatctgatcgttgtgaatactcgtagtcgaaggttagttggagatcagtatacacgagttgaacttgaaaacaaaacaaggaaataaattcaaaacaaagtaaagaagaagaaaaacacgtcttatattagaagacgaaagccaaggcactaatcaatgttgaggtgattaacagcgggcaagtggtgaaagtggcggcgtttggaggtggtagaagcgtcttgggttcaccaaagtgaccgccgtcagtaccagttggtgacggtgaaggagccatcggaggaggaggagtgagtgtctcgtcgttcccactataggaagacttagactcggccaccataatcaacgttgccaagacgagaacacatatcattaagctgaaagctctcattgctacaatatttgatctcctctctttcttttaatttctctttctgtatttttagttagttgatacagtcggatcatcgcaaaggaaatagtacttatatataaaggtcaacgagggagaatgattctaattcgagggaaatgtgattatacggtcttagatcttgttacgttagtggctaaccatctattttgagtaccataacgtgatgtccttcatcttttttggatcgacacagtaataaaagatatatatcaaaaaggcaaagcgataattacttataagttccaatccaagaacaagtgataattgatcttaaaccaaataataaaaaatgataattgatgaactgatctatgttgtctgtatattattattctacgtttctattagttcatgcgagattcccaacagaaaaaatggagtatactcctccgaaaagaagaaagacataatcaaaaagccatttatataccaaatgtatagtacctaatgacagaaataaatgtatattattgtattaaaaataaaatggatatatagaaaatttggattggtctaatactctatagtatgtttttttgtttgggtgcaaaatagactaatcatgtttagactaataattcttgtaagaaaattgttattgtatttgtttggttattaaaaaaaatatttgtgagaataaaaaaaaaaacacaggcaagtcgccgagttttggacgtatgtgtatgtaaaatggttgccggagtccatggcagccaaaacttgggcgattcaaagagagaatctttgatttattattcaaatgccaaagatctcaactttttttatttattaattagtcacaagtggcagttcttcgtggtcgccactacctaatcataaccatcgacaggtttatagagaagaactaggcaacgcatcgccatggatcaatcatcctccatgcattgactttttttagatcggaggaaaaaagtatgcaaatttagttagggttttgaaattcgaaaatcgagatg

SEQ ID NO: 9055 - DNA, 3000 bp, Unknown
  misc_feature (1)..( 3000): cDNA_ID_1989361_gDNA_ID_1971974_Annot_ID_58724 3000 nt of promoter + ATG
attcatgggtttttggtcaccgaaacagattcagacacgtcaacatgttcgcaaagtgcactcattatccctcgttgacttctatttaaaactgacgagtaattattactatcaatattgggctctcgtatatggtatattatcgggcccaacccaaaacatatttgggccggattagaaactagtgagaaaaagggaatgttactatgttagtattattgttgactgttagagtttttttcgctccgcctctctgaaactcgccgctagtaagcttcttcttcacttgtgctcttcttcgacgtaagttttctctctttccttctcaaaggtttctctctcgattgacaatcctaagtttcctcgctcttgtggcaattttaattttatttttctggatttggctaaccctaatttcgtctggaaacaatgatattcaacgaaatggcgatttgtgatttaaaaagttgctctgtttttggtatctaaaatttgtgtaggagatgaaccgtattggattgataaggggatcatcatccaaggatgtagtccggagaacgtttgcagcagcagctagtaaagccaagaaaggtggcaaaggaggtggagccagcgatgctcctaaaggttccagcttgaccaaagagatcaaatccaccactgttgttggtgccaatactctcaaagacggatctgatcccaagatcttgcctgattctgattaccctgattggctctggcatctcctcgataagcgaccagctctcagtgagcttaggaggaagaacgtcgagactcttccctacgatgatctcaaacgttttgtcaagctcgacacacggggtaaaatcaaggagaacaactccatcaaggccaaaaactgagagatgtaagatgttttcaactctctcactgttgctgttttctttgtatgtgggaactatgcttgctaataagtagattcttccagttagattacatttccaaggcgttattatgctcttgtatgttctcagacactcttagtatatccaagaaattgctgcttcatcttttctctgcatgattctctttgaaaagttggaataggtttattcttacttgctctaagtatattctttcagttatcttacttttccgagtcagtaacattatgcccttgtaagttcttgatccttaagactctttattagtgaatccaagaaattgctgcttgtgtgagtgaaactcttggctcttgtttaatctaccgaatgatatgtccagcaagtgtgtaatacaaatccttctccggatagaggagatgagttggtcggttcttaaagacactgcaggtgtaactgatccatttaacaatcagatttattgtttactgtatgggacctggctcattgatattgcatcactattctgttggtggataccaactcttgttgtctatctctttgtggggtttgataccttcaaaagaaaggtaaagcaaatgttgcatcattatctcccctttgtcttccattattgctcttctttgctttgattgttacttgtctcctgtgatttgcccagttacaatttcatattgctttgtgttaatactagttaggataagtttcaatttaaatcggttttgatttaggtcttattggtctgatattatggcttttctctctctctctctatggtattgtatctgacaagtgctgctacttatttgctttatggttatatcctcccatgcccatgaaaggtttaagagtttgaaaaggagacaccactcatcacatgcttttgtgggtataacaaaaaataaagctaacttttttctctgctcacatgcttattttcctcttttgacaccttaacaatatcttgctttgtttttgtttcgttttttgcatgttccttcttaactatatgtactaaatgtatgatttagatatgttatggatataattatccaaatctgtggtcatgattgatagaggccacgagggcggacattttaaatcgctgatccgaatttgttcttatagtctctctactataatgtaatgggacataggttgggtgtagttgcccatccttatttgttgtctgaataaactcttacctatatttatttatttatatataagtgcaacggtactactatttccagaaagaaattttgatggttcatgtttccttctactcttttattttgctcttaagaggctttatcgacatataatataaattcaaacactgctgcaattctaacggatataaatcatccaataaaatctcagaaataaaaacgagtaacgaattttgagatttgcaagaatctcaaaagatgtcatattaaaaaattcttcgatatccaattaaagactcgattatacggacttgctttggagaatccacaccaacactcaattcgattacctcgaaaacaaaagtagttcaacttttgataccatctcaaataatactaaacaagttcttgatatacatttattcccgatgggtgaaaaaggccacttttctccatgtgtctctatcattactatcaagtatcaaccctttttcactttatagaattaggcatttctcacgatcagttcctccttccaattattattctgtaacttttgaagtcatttctactccctaatgttacgcgttaaacatttatttataaaaaaagatctaagattttttccaattattccttcaaatttggtatttaattcgtgtaatgaagacaccagatttttccaagtacggttacatatataaactggggagttttctttgtttaggctgattaaagagacccaagtgcctcctacgctattcttcattttctccggtgaccaatccttttctttttcttctcctctccgtccttaaatagttatataggagcaggcattgttccttgatcaccaagaaatcgctttgacccctatctccttcttctgcaactctttttcagttttcctcaacacaatttct

SEQ ID NO: 9056 - DNA, 3000 bp, Unknown
  misc_feature (1)..( 3000): cDNA_ID_1989359_gDNA_ID_1971974_Annot_ID_58726 3000 nt of promoter + ATG
ctgggcgcataataagactgcctgaacatcttgtagcctattcgatgtagtagcagcggcatccaagttgaagagaaccttatgtatgtttgctatgataatattcaatggatcatcggggtcatcagctaaaagtggatctagaccttctagatcaatatgttctgcgattgtccatataagacgcccgaggattcttggggtatttacctgccaaattgagatcaagatttttataagacattgaccacgtttcagtccacaagcaatagttctcctccacatttagtattaaatagtacttaagaaagcctaactaaaattcttcgaggaaaattgccaagggttacttctaactttcagctgaggcttaattacctcttggagatccttaacaagctcacgttgcaagttctgcaatcgtgtctcatttaatatttgatcctgggaagcaccatctttcagcctcttcactcctccacgggtatcatagatatggcacagcctaacaagcaatttcaaatagcaatctacagcgtacgtcctgccatcacaatcccatttgacacaaggcctacaaacttccacaacctcaagggctggttctgtccagttcagagcaccataaccagtaccatatgctaacgcaccaatcactctgctctccatacccgagtttttttgttcaggcaaaggtagagacaactggaagcagctttccacaagcattgccaccagctcttcccgaaataagctcttactggtaacactattgagatcatctttaatccttgcatcttcaaagagagaaataatatctgtcccaggcagaggcttctgacctcttcgggcactttctctggcaaaaaggtgaacacagagagctgtccgacagatacaggctaatgcgtgcatcctgtccgattctgctctcaagtttctcaccataagcagcagtcttctaaacaacgaaaccttcgtaacaaattccaaaaagaatgattcagaaatcataggccacagcttcaagacaaaggtacacaactaaccgagcttaaatgaagtaaaaaacgacatacctgcatatgcagatcaagcaagtgcaggttcgtaacaacggccctgactatactctctctagcagaggaaaattcttggcggtcccagagtgttaaaattgcaataatggactgtgaagcccactctggcttgcctccggcaacatctgccaggtagagcatgttaattcccacttcaaaaatcaaagctggatccaaagaggaagccaagaatggcgccaaatgggtaaccaaatctgagacgccaaccagcttctcggcgttggagtccacaacggtggcattagctgcagcagcagcagaggaagccttggaaagctgtctaatcacttcgacactaccggaagcaacagctttgacagcaaagacaagagggaaaacagtggctctgaaggtttcgacaggaaggactaaagacctagccatcaaagcgctcctctttctccatacaatgtcaaccatggaagagacccacttggacctgatggcgagggagttctcgctgtcaacgagcttatcgccagcaagacggctcatccgcttggagtcgaactcctggaagagtctgccgacggactcaaaggcaaccttggagacggcgtcggatttgtcgagcatgttctggccgatccgagcccaccagttggagaccttgtcgaggagacccacattgttctcgcacaaagtaacgagatcatcacgcgcgaggatgcagccaagtgtctcggtgatggaaaaacgaaggttgtcagatggagaatcgaagcaggaagcaatctcagagctgcaatcagagatgagtttaggaagcgagaaggcagggagagccgcaaggatggagacggcagcggcggtaacatccgggtccggaaaatgaagatccgttttgacacctgagcaaacggtgtcccaaagatccggagtgaggcgggtagatcggatgagatcgaatgccagcttcttacaaacagctgaagccggagaagcaacaatctcctccacagcagacttagcgatcacagagatatctcttccggcggcggattgctgcagcgcctgaagaagcgccgatgactggcgaagcgcgtcatttgaacggaggtccgcctggatctgagcaaaaagaatgtccataaccggatcgaattaactgaaattcgagatccaaaatctgagctaactagcttcgctgtcaatctgtgtacgtatgcgacatggaactggaagaagaaggatgtgtaaatcaaaccatcaattgaagaagaaggagaagaaattgttttcgaaggaaaaaagcgcgtgccgttcctgcgattcgagctttcacagcgtgccgtgttgagtcatccgtagacccaataaaggcacattaaaaagttcattgggctttacattataagcccaggatattatttttatgcaccgaagtatttgcattcgattttaattcgagggatcagatccgacggtccagattgagtcctgcccagtagcaaaacggcgttagacgcagcattcgttagggacgggacactagagaagggagggcagagagcgattttgttctctctctacttctcggtcgtcttcttcgtctccactctagggttttactctatcttcttcttcatcatcatcttctacaccaatctctagcgttaatctgtttctgctggagaagatttacgcttgttcctcggttctcttacttctgctccggttcgatcgcttgctaagtgtttcgagttggttagttccgaatttccttttttatgcatattgagtgttcactgctctcctccagcaatactatagggctctaagaattgaattgctttcaggttttcatagttagggtttctcaaaactgacttaaatattttgatttgtgcaggttcgcacttcggtgggcgatatcatg

SEQ ID NO: 9057 - DNA, 3000 bp, Unknown; identical to SEQ ID NO: 9051
  misc_feature (1)..( 3000): cDNA_ID_1989365_gDNA_ID_1971974_Annot_ID_177573 3000 nt of promoter + ATG

SEQ ID NO: 9058 - DNA, 3000 bp, Unknown
  misc_feature (1)..( 3000): cDNA_ID_1989366_gDNA_ID_1971974_Annot_ID_177572 3000 nt of promoter + ATG
tcctcctccacccacttatgctcccgctccatctcctgctcctgctcctgctccggtgcctgctccatctccggcttccagttatggccctcagtatagtcaagagggttatgcatcacagcctaataatcctccaccacccacttatgctcccgctccatctccggcttccagttatggccatcagtatagtcaagagggctatgcatcagcagcatcacagcctaattatcctccacctccttcacagagtcaagttgctgacaggaagaaatttgatcggaggtattccaaaatatcggataactactcttctttactgcaggttagtttaagacaatgcatatgctatacacttggattttcccctcaaaggttctttggaaactgaatctagcatgtgtctgaattgattccaggtgtccgaggctctaggccgtgcaggtcttgaatcttctaatctaatcgttggtattgatttcaccaagagcaatgaatggacaggtttgttatattattcttattcttacgttttgaatgtaaaggagaagccaaactaattggttttggtactgcaggggccaagtccttcaataggaaaagcttgcatcacttgagcaataccccgaatccatacgagcaagcaattactatcattggaagaaccttagccgcctttgacgaggataacttaattccttgttatggttttggagacggtatgcactgttttctctcttctcgattctcataagaatgtatatcaatcggatcatcattgacttgctttcatctctttgcagcatcaactcatgatcaagacgtgtttagtttctatccagagggaagattctgtaatggatttgaggaagtattggctcgttatagagaaattgtacctcagcttaagctcgcaggtttatttcctgctctgacctgcactggccaattctatatctccttgtgaaacgcaagttataaacttaaaactgtgtttttttttcctgcgaacttatgtatttcaggaccaacttcttttgccccgatcattgaaatggcaatgacagtggttgagcagagtagtggccaatatcatgtgttagtgattatagctgatggccaggtactgattaatattttgactgcctaagctgtgtatgatcttctggttttgtgtctagggatatcaaagtggacccattttgttgtttcaggtcacaagaagtgtcgataccgaacacgggcggctaagtccgcaagaacagaagacagtagatgcaattgtgaaagcaaggtgcgaatatttcaatcttttgactaatgtttcttccattttaaagttctttactttgagtgtaatgttataaagtgttatggtatgtaatcagtttcatcctctctattacagtacccttcctttgtcaatagtcttagttggggtcggggatggaccatgggacatgatgcaggaatttgatgataacatacctgcccgagctttcgataacttccaggtaagcttctttttttcatatcatgacattgaagattgcttcttttcttcagtttggaaccatttttctaacatgtttgctctgtttctagtttgtgaacttcacagagatcatgtcaaagaacaaagaccagtctcggaaggagacagagtttgcgctgtctgctctcatggagatccctccacagtacaaagcaacgatagagcttaaccttttagggtaagggacccaaatcaaaactctgataggtgtagctgcgagaaactgctatattgttaaacaaaatgctcacctttctctttcccttacatttttgcagggtaagaaatggaaatatcccacagagaatcccacttccgccaccggtgcagagtggatcatcattctctagttcccggataccgaattttgaaccgagtgtacctccttatccatttgagagcaagcaaatgagtagtgcagacgatattcaggtaattagtagaaacttaggaatctgtttgaaatgttaagtgaaataagagctttggaactttttgttgttaaactcgtttgtgttattttccccttgaacagctatgtccgatatgtctgagcaacccgaaaaacatggcgtttggttgtggccatcagacttgttgtgaatgcggaccagatcttaaagtgtgtcctatttgtcgtgcgccgatccagaccagaatcaagctttactaacaacaccattgacatgcagctttgaccagcccaaatcccatttcttccagagattttcagatctttctgtagaaaattaaagtgttcttttgttctttgattgaattcctaaactttatcttgttcataaaatttctttgattggattgtaagaattatgtatttgtctgttggctttctttgatttttcaagattcgattaaaccaaagttgattgcttaaacactttaattttgatttgttttgtcgacataagcaatgagaaataaatggatgaatagcccaatagaagcccattagcctgaaattgggctacaagcaaacataccaaataaatagtagggaagagcagaaataatcacaccactcatcagttatccattcctttctttttacataaattttgtcactttttctacaaacgattcttcgcttctgtgaaatttgataaagcgaaagtttttttcttatggattctcttcgattcaacctccaacaatctccatttcaattgaaacctagaattctccgaccaagaatcaccaacatatcaaaccgaatcgatgaaaccgatcctcgaccatcatcctcggccggtaggatccaaaggttagtacttaacaacgaaggtcggaccaaactaaacgccgatcctgaccgtgaattctattcatatccacggttcgtgaaccacgtagatgatagtttcatatcctccttaaccgaactatacagaaaccggttgagacccggttcgactgtacttgacttg

SEQ ID NO: 9059 - DNA, 3000 bp, Unknown; identical to SEQ ID NO: 9048
  misc_feature (1)..( 3000): cDNA_ID_1989367_gDNA_ID_1971974_Annot_ID_177571 3000 nt of promoter + ATG

SEQ ID NO: 9060 - DNA, 3000 bp, Unknown
  misc_feature (1)..( 3000): cDNA_ID_2038015_gDNA_ID_1971974_Annot_ID_177569 3000 nt of promoter + ATG
ctcgagaaccttcctgtaacatatatataacaaaagaagagattccattagcaaaagagttgatattactcaagtcactcgaagcccggtgaatatgcaagacttcatataaaacaaaatgcagaaatcatccagtctggtcttaagtgataaacactctttagtaggattaagaatgataagacatcctaagccttgaatcaaaaccagaataggatcagatgaaaaataaagaaacaaaagccaaacctgtccacaaacatcttcgcagatagtatccgtcttcttagaactacgataaccatcggacatgatgatgatgattagttctcaggaaagtcaaattttggacgaaaaaaataagtttttgaataaacagaaaatctacagaaaaagaaaaacaagagagagtggtctagttctcggaggaggatcaaatccgagaatttctgtcttgaaatcgatccttctcctttcaccaaaactgtaacgccaattatagccgtttggtgctttttagcttccatctctacaattatatctgcattcttcaattggccaaataaataaattacattgttcaattcttcttcttctttatagagtaaataatttcatccgtcagatctcgtagaggcggtatgatcttacggctttaaattaaactgttattttctctatttgccaaaatcagaaattcctttttttaacctagttctagttaaaatagtaaaaggaattttgaaccgaacgttaaaaaaagaagtctcgtaactctctcaattatgagacggcgaaatgaaacccccaaagacgttaacgacgacgacggcggaggaggaagaaacaaccatgcggaaacagccgccttcgcctccaaagccaccacgtgtcaattctatgctccaatggtggcggagatggacggtgttggtggccgctatctggattcaagcattcaccggcacgaacttcgatttctctgcctactcttccgacatgaagtcttccatgggggtttctcaatctcggcttaactacatggcggttgcttcagatttgggtaaagcattgggttggtcttctggtttcgccattgcctatttccctgtctccggcgtgcttttcgctgccgccgcaatgggactcgtcggttacggtgtccagtggttatccatcgccgatgtgatcgatctaccttactctctggttctggtttgctgctccttagccgggttaagcatctgctggttcaacaccgtcagcttcatcctctgcattcgacatttcaaagcgaaccactcgttggccctgtctctcgttgtgagtttcaacggaatcagtgccgcgttgtacacgcttggccatgaagccattagtgggaaatcatcggcaagctctgatatttaccttctccttaactctctcatccctctgatcgtctctgttttagccctttggccggttcttactaaccctaattcctctgaaaccgatactacgcgaacgcatgacgaaaccagaatcttcgtagtcttcaatgtcttagccttagttacatgcttttaccttctcttgccttcctcaggcacctacttagcctcatcacctcgttggcatttcctcggagctattttccttctccttttcccattgtgcgtcccgtttctcgactatattcaccgtgctctcgagtcctgtttccaccaccacagctctggctatgcagcggttaacattgaggagcccaagatcctcaaaatcaaaagtcagaagagtaatgcggaggaggaaagtgatcaagtgagactaggagatgaacattctctcggaatgcttgttcgtaagcttgagttttggttatactacgtagcttatttctgcggcggcacgatcggtcttgtttatagcaacaacttaggacagatcgctcagtctctaggacaaagcagctcaaacgctaaatccttagttacactcttctctgccttctcctttctcggaagattgctctcctctgcacctgacttcacacgcaagaagctaaaatacttgacaagaacaggctggttcacgatttcgctactgccaacacctttggcattcttcatcctcgcgtattcacccaagaccaaccagaccgcgctactagaagttgcgacagcacttatcgggttaagctcggggtttgtgtttgcggctgcagtttccataacttccgaactctttggacgcaacagtgtcggtgtcaaccagaacatcctcatcacaaacattcccataggatctctcttctacggctacatggctgggtctgtctatgacacaaatgccagcctcggcaggaaatctgtggtggctgactcggttgtttgcgtaggaagaaagtgttatttcgtaacgtttttgttttggggttgtttgtctgttttggggtttgtatgtagcttgtttctgtttattagaaccagaccggtttatcaccggttaaaattgaacagaatgtaaaactgtgtagagtattatcagctgcctgcttataatggtatagattggtaggatccaagaaaagagtgaccattgccttcacacgactcagccaattatcaaaagtgttgtacaaaacattaatgcttagctctgttccaacttcatatataagaattaacatatactaatacatagttggtcattttaaaacttgctcgtgattcgtaaatttcccatcttaaatgaattagacaaattagccatcattatgaaagagaaaggttaaattagatgattagcgggcaataaaaggttagaattgatattatcatgtcattcgatagtgacacatgtgactagtttgacctttaggagcgccaacgtgtcatatatcagcgtaaattccaaaacaaaacaatctagtgtgggacccaaatactgttataaaaaaggatcattaaaatggatatgttaaaaaaagaaagtaaaaaacgcgtcagggaagagaag

SEQ ID NO: 9061 - DNA, 3000 bp, Unknown
  misc_feature (1)..( 3000): cDNA_ID_2687327_gDNA_ID_1971974_Annot_ID_177566 3000 nt of promoter + ATG
ctaattgatataaagccccagactttcgttgattttttcacacaaatcctgaatcggttttcgtaacgcgattcctcttccatttcgttcactgttcctcgaaagggataaaatttatttttgagtgggttacgattcagcttttcctgggaagcaaaatgtgaaatttcccttacaagtttgagttacaaagattggatttttagagatatttcgtctgatttaggcatttactgtatccgcttgaatctctagtgtgtctctaactcagtagctgcttatgaacggatgatcttatcctcttttgttcttgtcacaaatatacagggcttggattgtcgatggtcgaggaattgcagccaaagttaaaaatgcctctctttcttcagctttgcagatccaagactgtggagctcatataaaatgccccaactgcacttaccgcattgacaatagcaatgtgagtgattatatccacacttctctctcttgtcttaaacttacacacactcacctgtgtttcgttggtttcaggtactgattccatggcctggccttcctaaaggtgtcaagtttgagccaactgatgaggacattatcgaatttttggaagctaaatgtgggattggtggctctgaacctcatgtgcttatcgaagagttcattcgtcctgtcactgaagatgttggaatcaattacactcaccctcaaaaccttcctggtaaatgatcaataaagacctttaaataagctcataattgttgttcttcaactgaaactgtaaatcttgtatcttgaatctctgagtctctccaggtttattgattcctgctgagctttactgtttcaggtgcaaacaaagatggagtgagtgtcttcttctttcacaagacagtgcaggcatatggaacaggacagaggaaacgcagaaagatcacaccgacacttgtgaacgatgaaccagttcgttggcacaagacaggcagaaccaaacctgtgatgctcagtggagtccaaaggggttgcaagaagatcatggtgctctacaagagcgctagaaagggaacgaagcccgagaaatcaaactgggttctgcatcaataccatctaggaacagaaggaaaggagataggagactatgttgtttccaagatcacatatcagcagcagaagcttggggaaaatcctgatgaaggtgagagtagttccggggttagaggtggcccaacaacaccaaagacgaatactcctacaccacctagccttgtagatggtgtcgctggagatgaagaagcttttgatgatttaaagatgtttgatccattttttgaggttggttccacaaaatcattggggaatagtaacttcgttttctagagactaataaagtcggaatttttgttgttggttaaccaggaactggacagcattcctgaagctgctttagggaagatgtggtccaaaaaagctcgaatggatgaggaatttgttgtgaacctaagtgaagataacttaatatgcgacgaaagcatggaagcttcgtctctttgggaaaatcaggttctccccaatcctagccttggaactgttggggacttcgatggtttttcgatatcagatctggagaatgcagatttggggactccccctgatttcctcactgtaagatcctgcttgaaaaaaaccttgtttactttcggaaaattcaatggaacataagattctaaattagttgtcatggaggttttgcagttggcttctcaggagagcttgctgaattggattggatggttgtgattggattcttgctgctacacaaagaagctcttctagtacggcgttttcgctgaagaaggaaaaagctggaatatgtcataaataagaaaactttaaagtctccgcaactgaagtcatatctctgtgataattttacttcaggagaccagttttctctcggattcccggaaagctgcttaaatattccgggaataatcattttcaatctctgaatctgcacttcatcattgtaattcaaatagatattttgacctttgtactctttgctgtcttatgatggttactctgtttttgtttggctcagggtccaacggttataactatttatttttgggtattttactattttcaccttatattctcaaaagttctcattatcaccccaaagaaattaattaatccgatttaacctctttaacattactagacagttcacacaccctctgtctagacggaattagggttttcttaagctattccgcagcagtctacggttgttgtgtcggtggtgggcgcctccaaaatttaccctttagtataaataagttttggaaaattcagactttggttattgaaacgccatctcagctctaattcagtacgatggggaggagaggtcgcggcggcggcggtggtatgggcggaggaatcaatcgtagatatctgagtcaagttatggatacgtgcggcaaggatttatctacggcggaggacatcgttgatgatcttcgttccaggtacggcaattttgcgaggttgactcggcaagtgcttctactcaatgtcaggcaagtccttaatgttagaaacaacaagagggttaaagacgaagatgaagatgacaacattggagatgaggaaggttctgcttctcagaggaagaaacagagacgggttgatgagaaagaggagaaattgcagcgagcggagcagtcgcatttaaggaagaggaatatggaacgttcagtgtcttcttctccgtcttcttcttcttcttcggaagacagtggtgatgtgtcgacttctgaggacgcggtttatggcgagaagctgagtccgccgcggtttgatctgatcaatgacagtctaagagataactacgctaagttgaacagctcctcgaagaaaccaattgggtcgcctgcggaaaagaatgtggaagttgagactgtgagcaacaaaggtagaagcaagttggctaca

SEQ ID NO: 9062 - DNA, 3000 bp, Unknown; identical to SEQ ID NO: 9045
  misc_feature (1)..( 3000): cDNA_ID_1012219_gDNA_ID_1971974_Annot_ID_177563 3000 nt of promoter + ATG

SEQ ID NO: 9063 - DNA, 3000 bp, Unknown
  misc_feature (1)..( 3000): cDNA_ID_2038032_gDNA_ID_1971974_Annot_ID_177561 3000 nt of promoter + ATG
accgatacactgtttgacggtcaaacacagagtcaacgttacaaaatattaccgtgacctctctgtgtaacaacaacaatcagaactcactcaaaacacaagtcaaaaggataaaatctccaagttcaagacaagactcttagagagttgtttctgggtggtagtgataatgagatcatggcttattactgtttttttactaagtaagataaacccccaaaaggatcagatatctccgtaaagaaccttgcgtggatcaagctgtccgctgcagtaacttgatgagacgatggatagttcttgtctgcctttccactcttcacgaggctttaacaataccagaggttcgattactccagaatctacacaaagcattgttttgtaatcttcatctcccatatcagctatggtctttgcctttttgtcccaggggttccacacaactgctcgtttccaactcaatccattagaaaccaactctcaaaaggtttcattcataaaaaaaaatacgaagaacaaatggtatcctttacctgcattgggcatgccttcctttcgcaactcgatggtcctctttcgctcatgatctatgaccgcaatctttgttggtgtgttcaagtacactctatcgacctgcacagcacactgactctatatcaatctttggttttttttctcttctttgaaactattaaggggaaaacaatggctgacattactcacctccccgtcaaaggtaatcgcgtctgcttgctcagtgaatctttctttaccaatcaagttgtctagataatccagtgtctccaaaccctcaactcgaacttcactgcaagttcggtgaccacatgatttatcactcagaggaaggaagcagcataagtacacgaaatcagatcggaagaaatttgtaaggcacacacaccttatgtcagatacatataagtagtttcgcagtgcaaacataaaggagaatgcctttgagtcaatgttcctcacacgagggatcaaagtaagcttcccagggctaatagaaatgcgaatacggagttcaaaactgcgccaatagcaccgagtaattataaagttagacaaagagatgataataaaaaaaggcacagacaagacatccatatcatagatccagagtataagttaaaacacacctatgcggccaggtcttcaagtcatcttctgtggacttcaatatcagatcaacagatgattgtttgttagcaggaggtagaggcgaaggatcttcatcatgtgaccagaatttgttccgggcaaatccatgtcgctcaagtccaccaaagtttccaaactgcaaatatgacacagtatacttaatggcagtacgaaactagagcaaagggttattcaactatattaaaatgatctgagatgccaaacctgtggaaagcaaacaggtattcctcctctgatcgccttgggtggcttatattgagcctaaatgagtcgtaccaaacaaaatactagttaaaacatgaaaactaaagacgatatttgattagagatataccttgctgctcatataaagcagttcttccctcctttcatttttccaagaaatgacttgtcctccaaatagaagcacctgaaagatttcaatccgagaatatgtaactctacaacccctaacagagtattcttaacacaatccaagttccagaacagttgaacaacatctttcatttcatagtcgtctccaagataaacaacatcttgtatagacatacaatagtagtaggctcaaacaactaaccactgagatgctatggtctaaacattgaggaatgatgaagagaagagagatgaaggagtaaaacctcagcagtagatccgcgaggctcagtcaaaataatccgggaagacccatcgccatcgttgcctaagttcaaaggcatcccttttttggccacaagctcactcttattctcttcctttttctacaaatctatctccttcactcttaactacagcaacaaccaaaacccagatggaaatctatcaagcattttataagaacaccaaccgtttaccaaactagaatcatgattctcagtacatgagaataaaaaaataatatgggaatataaaaaccggaatcaattccgcaaaaaggggaaatcaagaaatattaacagaaatcaaacacgcttgcgaacaaaacaaaagggaaagagattcaagcttacgtttgatcggaaaatcgtacggattgcgacgtaatcaagagcaaacgagtccgcgatcggcttcgaatttcaacaacttccaccaaactctacgcgtttcgtgaaaaaatccatcaatcaatcaaccaatcactcaaatccactacgcgacacacaacgtgacgataataacaagaaaagtagctcaaattgtagacgagagagaaatagatcacaaggataaagagagaaattgagatcgagagagtagaagaaaatgctgaccttggtgttctcttgaataaggctctgattctcagaaatttgggttatgagtcagaaagaagagcttgttgaggacgacgacgaagaagaagaagaagaagaagggcttgtgcgtactatttgtagctgtttccaattctcaataacaggcactagctccgatactgccacgtccttcttttcttttatttccttaatcaatctttatttattgttctctaattggttatgtttatcctggagagatgctagtatttaaataacatttaatacactacagcacataataaagaaaaatgttgaccaatagaaaagctacaagtaagtaagcgagtagtggaccattattagcccaactcatacagcccaggcccaaacgtttttgctaaacgtattcgcgcttcatgtttttgctttgaagttgaatccatccttctcttctcttctctccctcgcaaagtttactgcaagaaggaaatttgggttgctcaagcaatgtagaagcgagaaaattttgatg

SEQ ID NO: 9064 - DNA, 3000 bp, Unknown
  misc_feature (1)..( 3000): cDNA_ID_2037157_gDNA_ID_1971974_Annot_ID_177559 3000 nt of promoter + ATG
taataaactaagagcttctatatacaaaattcaagacatttttggatttggtttgacttggactcgtttggctctgctgtacaaatatactccagctagtgcagtcgcggtacctgtttatttaacaagtgattatatattgcttcaataaaatgaacaagtgtaacaaatcctttactaatatatactactagtagttgtttacctatagagttaagaggtgagactggagttttgaagaaaagaatggatgatgtaataaccaccacacgcttcacgcagttccctacagagtgtgttactggagacaccatctccaatatcatatacgatacctacaacaacaaccccaatttttatgtgttgattagaagcctaacactaaccgactttacaaaattcagtacagtttttctgaaacggaggaactagacggaccaacctgttggtagctatgcaagcaaacaccagcaagtagagacatgatgcaaaactcttttaccgacaaaccctggcttgtctgtcaagcaaccacatacaaacacacattagttctttctcttttagatcatctagctatatcggtttatgcttttccacttactgctacttgtaaatgcgaaggagtaaccttgaacccatcgatgaggattgctaaaggaaccagtaagataaaggagataatggttattatagagaaaaggttgatgttgtccaaagcgtcctgtttcaatatacaaacattaatagatttcgattactagtttctttcttgagatcataaggataacttatattcaaactcttttacctttccaaccatgaattttttactgaggacattgcgtgattgattcgtcacattagaagccattgcactgcagaaaccaatcctggtttatcccaataccatgaattaatcaaatcaattaaaacttcatcaaaagtttatcaagaatactattttttttgttcttgttcttgttgttcataccaattgaaagaagcttctgtgaaagatgctaaagagactccagcgacaataggtaacaacgaacaaacaatccacagactcggccactggacattaatcaaaatttcaaagattatgtctgaaaatataactctcttgtataatctaaggttatagattaagtctgaaacagagcgtatctttgttttgcttacctcaccgagcaagagaacagaaagcaagacggtgaagaaaggctccattgctttgatagtgtgggtgaaagagacatttactcttcctaagctcacatttgttaacaagttccctaacgtgtgagctactgctagttgtacgatcaccgtaaactggagaggattacaattgaatgaatctctctgtttttagggtttgacggaatcaatatttgatttacctgagaaggagaaaatttggggcgtggatggagtttaaggagccacattatagcaatcatcaacgttccacaccctaattgaaatgctgttacagtcgctggatatggataaaccctaagtacctggatcgatgaatgaacaagtttcatacttgtatgaagactgataataggttcgagtactgcttcttgcattgaaatggactgtttaattaaatgaagcaaagaaggaacctgtttgttgaaaatgttgtagtagatattgagaaggtaccaaactccaaacatgcctcctagcttcaaccctttaaccaaacttccagattccaaatctcctccttccacattctccggaactgtagctgacttgagcttgaagccattaaatctaaggttcggtctccaaggataagagttagaagatgaaaaagctctgcttcttctgctcaacgctgattcaggagtagacttggcaaggaacaatggagatggaagtcttggatttggatttagaaatgtgagagcgaacataattttttcctcttatcagatgctccaagatgtgcataaatcctccggcatttgttggaatttctcacaagtaaccgactcttgctaactttttcttcttcctctattggtaagagttatgttacatgagtctacctcctcattttcatgtaagaagaaaaaagtttgttttgtttttggatatactgcaaacttgatattagtattatttagaagagttgtctttattatgtgacttttctctcgttctactatctgaatgtttttgagtatgataaaaataactcacatgccgatgccgacatttttttcaatataacattggctcgattttatttatctttcctcataagagccagtggtatttgccggtattgtttcttctcatgttctccattccatgtgtgttctgtaaataatgttatggaaatgatttgacatacttggtcactcatttctttacaaaggggccgtggttttcttcgtttataataatatcaaaaagttggtaacgctataaataattatttaaaataaagtttacgtacgaacatgacaaattactgaccacaacaccaattgatttttagtgtggaatttgaaaatgtcaggggagaattgtatggatgatatgaaaggggccgcgttgaaacatgtggatgttgtattgtatgctcctgagtccacccttttctttccgtgttatttcatactattacaaataaggttggtcccattgctttgatcacattattgattataccatttacttattatgtcagtgttggtacaggtcattgatcacaatttgggctttaaacggagaggatggaaactgaattctaaatacatttcggcccatttagggtccataaccttctacgccaatcagaaggtacgtcgacatgagcaacttggtcaattttatgacataaataaaataaaaataaaaaaataaaaatcgatctgaggggttttagaaagaaaagaagaaattcgggagtcggagaaattgtcgggtggatcgatgaatacttgtcagtttatggataagcagata

SEQ ID NO: 9065 - DNA, 3000 bp, Unknown
  misc_feature (1)..( 3000): cDNA_ID_2037583_gDNA_ID_1971974_Annot_ID_177584 3000 nt of promoter + ATG
cagttcttccttctcacgttgcagtgtctctgggtctcgtttctcattctgatctcacaaatataattttgaaagtcaaagagggagggctaaccagatataacagctcacacctccacaaacacagctaacctgattaagagttatctcttgagccttcaagattatatccgcaaatcgatttttcaatagagcagccctgtaacgcttttctggaggtagttccttctcttttggagcactatttcctaaattattaatgggtcaagagtgagatgccaccctcagatattagagcacagatatttttctgctacacttctgagcttaccatcttgatgaccatctgccccctcaataagacttagcttccctctggatgcatcttccatctgattcaatccaccgacggaatctgcttttagaaagggaataagaaaaccaaggtttattaattaatatcaacaaaacttaacatcttttgcaccaaaagaggagtaatcactgattagagataatatgatcactatagaaaatagcaaacagcgacctgggagtaaaacaagcagaaaatgtaacaggtctatcactatcatactaggtgtgtaatatgagttgctatcagtaaggtcagtaagtttcactccaaaaaaactacagaagtaacattgagtattctagatggacggccacttctgacaagagggaagtaaaatggttccgagggttaagtacatataagaattgcaaacatcaaacgtctgcaaaagctccatagagaaaaagacaaatacaatgtagcaagattaaacaaaccactgtagttctctaacgccatacctttttctgttctgacagttgagatgtgagatatagggtgctcataattaccaatgtcaacatcctcgtcctccaattcactccctgcaagtaacgaggaggaaatgacagcttaatcatagagtaggacatgcgaattagctcaaacaacaaaaccagtgtatgctaaccatcacagtgttgcgtcaatgaatttcctggccctgacccatgtaaaagctacatcaagaaagttttcgctgtttatcagtcatgttaacaaatggatcaagaatgagatatagaaaggtgattacctctaacacacagggttcaccgtttgaatctttcttttgattttctcgcagaaactcatcaaagagatcccgcaactggaacaaggcatcatgactgagatcattgatgtcaatctctatctcatcatctccagatctctcttccttggagctgtgatctctcaggaaatttattatctgtacagggaattctgtcaaggaccccaaatctctgccaagctttactctatcctcatctgtcataacccgcttagcaggctctaagaggctgttacgtttcacagcattcatctttctcttcttagccacaggctcaggtatcgcaatatctttgtgagcaagagtagccaagttacttggttcagatttggttccggatgacttcttctcgatagttttccatctcacttcaaaaaacttgctgagagtatcagcgaagcgatacacattattatctgacgggttataagtcatagcattgcggaaagtaagacggacatcagcagaaaactctgaagggcttgaatacgtgccggaagttaacttgcttttaacagttcctaaatccataggatgtttgataatggtgaaataatcaggaatgttgagcttgacgacgtccacaggggtattaaagagccaacaatgctgctgcgacatcaatcgtttaaggaggctctcacattgcttcatccgaagcatagtggaagtggtgactggctctggtttggttgctgtgaaggggagcaccctttttccagggccagtagagcatcgtgacattccaaaactcttggggcgagacacattacttgcaggtgtactagtaacaatcttagatataggaagaaggtccccaacactcttctgaaaggaccgtagttgttccagctcctgacgaagcgtatgaatccactttctcctttctgatgatgacaagtcagacaagggtaaaactattctcgggacaccaaaagtttcatcatccttggaagcattggggctatcatcacagccgccgggagagtcaaaactgttacgattataatctcctgggaaaccaccgttcctcacagtcatgatatcgcccaccgaagtgcgaacctgcacaaatcaaaatatttaagtcagttttgagaaaccctaactatgaaaacctgaaagcaattcaattcttagagccctatagtattgctggaggagagcagtgaacactcaatatgcataaaaaaggaaattcggaactaaccaactcgaaacacttagcaagcgatcgaaccggagcagaagtaagagaaccgaggaacaagcgtaaatcttctccagcagaaacagattaacgctagagattggtgtagaagatgatgatgaagaagaagatagagtaaaaccctagagtggagacgaagaagacgaccgagaagtagagagagaacaaaatcgctctctgccctcccttctctagtgtcccgtccctaacgaatgctgcgtctaacgccgttttgctactgggcaggactcaatctggaccgtcggatctgatccctcgaattaaaatcgaatgcaaatacttcggtgcataaaaataatatcctgggcttataatgtaaagcccaatgaactttttaatgtgcctttattgggtctacggatgactcaacacggcacgctgtgaaagctcgaatcgcaggaacggcacgcgcttttttccttcgaaaacaatttcttctccttcttcttcaattgatggtttgatttacacatccttcttcttccagttccatgtcgcatacgtacacagattgacagcgaagctagttagctcagattttggatctcgaatttcagttaattcgatccggtt

SEQ ID NO: 9066 - DNA, 3000 bp, Unknown; identical to SEQ ID NO: 9056
  misc_feature (1)..( 3000): cDNA_ID_2026743_gDNA_ID_1971974_Annot_ID_177583 3000 nt of promoter + ATG

SEQ ID NO: 9067 - DNA, 3000 bp, Unknown; identical to SEQ ID NO: 9054
  misc_feature (1)..( 3000): cDNA_ID_3044430_gDNA_ID_1971974_Annot_ID_177578 3000 nt of promoter + ATG

SEQ ID NO: 9068 - DNA, 3000 bp, Unknown; identical to SEQ ID NO: 9052
  misc_feature (1)..( 3000): cDNA_ID_3044438_gDNA_ID_1971974_Annot_ID_177574 3000 nt of promoter + ATG

SEQ ID NO: 9069 - DNA, 3000 bp, Unknown; identical to SEQ ID NO: 9043
  misc_feature (1)..( 3000): cDNA_ID_3044444_gDNA_ID_1971974_Annot_ID_177558 3000 nt of promoter + ATG

SEQ ID NO: 9070 - DNA, 3000 bp, Unknown; identical to SEQ ID NO: 9042
  misc_feature (1)..( 3000): cDNA_ID_1989375_gDNA_ID_1971974_Annot_ID_177557 3000 nt of promoter + ATG

SEQ ID NO: 9071 - DNA, 3000 bp, Unknown; identical to SEQ ID NO: 9041
  misc_feature (1)..( 3000): cDNA_ID_2687055_gDNA_ID_1971974_Annot_ID_177556 3000 nt of promoter + ATG

SEQ ID NO: 9072 - DNA, 3000 bp, Unknown
  misc_feature (1)..( 3000): cDNA_ID_1440865_gDNA_ID_1971974_Annot_ID_177555 3000 nt of promoter + ATG
ttcttcttcttcttcttcttcttctttcttgatctttttggttgttacgagcttcttcttctctttctcttctcaagctcattagaacatcaatttaaaacagaaacttttactatagaccacgataacaaatctgggtttttgttgttgttctctccatgcagagaagagtttcaaaaaggaatacaggatctgtggcttttgagtaggttaattaattagtcgacaagaaaacaaaggtatgtaaccatttgatcattctccattgcttgttgtctcgcttagatccttatcatatttaaatgctaaaatggatgattttttttgagacttttttatatatatatatatatttataactaaactttgatagataatctagtttagttagtagttgcacaaaatacattttgaattctccgttaaataggcgtttcaatttataagaataagatttatgataattttcgggttcaaacttacatattacacgttttgttatatgttacacctagttaaacatatagtgtttcatctagctatgcataagagtgtctcaccataaatcaaatgggcagtttgtgtttttttttctttatatagactacacagaatatatagtgtgcactatcttacgtttgtccggtgtgtcaatgttgatttttgcatcaagttctccttcgacaaaacaaaatgacgatatatatctatctatatatatatatacaaactgtattggcttcgtactatatacatacgtcagtcttattaattctacaacgcagatcaaaatttgaattttgactaggctttaatgtgtacgattaccttatacaagtgaaaaagggtcaatcgtacgtttacccttaaatttctttttgttagtaacatatcgaaaaataaaccgttttatatatattttcaaaatacttattcttcttgttaatgctgtcacatattataaatcattacaatgttttgacaaataaaagaaaaatcattattacaaatctaatcgttttaaaatcctagggaatcctactagattattattactattgtagaccttgtttcttttgtcacattaattaataacaataaaataatatatatttttaaaaatatttttgttttgttttgcattgtatattatttagctgtagatttgtaatgggccacgtaattgggccatgctaagacccggcaaacccatgtgagatatatgatctcccgcactatagtccacgttatctcactgatatctcattattttaacaataagaccgtctcttaattttattacaagttttcttttactcttgtagccttaaattttaggctgaaaattaaagttttgaaaaaagctatagggagggactatgtaaaataaaaaaatgtacgttaccatcagattttaccataaagagccaaaaataaaatatgcaaaactccactaaaaataatattaattcccctagccaacaaaaaagattcagattcatatcccacgcgctcgttcaaatcctctcattcgccacctgatcaaaccaatctcaatttgaaaattgaaatagacaaaatcgtgacattgggacataaaaaagcactaggacaaaattctagtcgacgcaaaaaaaattcgaaaaacgtgagtcagcgtatgtggtttacacgcgccaaagtgggagcgtgagtggggtttgaatgcacctgaaactgtctggtcaataagttaaagtgcatgggaaaaatcttggttgctgtttcctatatatctctctttttaccatcaacatgttacatatatatatggacaaaaatctgtatatgtgaatgcatataggagtgtgatgtatttatataagttagtaagctttgttctctttctctatttttttggcaggtatataaaattttaaaatggaggaggaaaaccaaaagtcgcatcgagtttcacgtaaagaccagagtggatcccactggagtcaaggagccgatgaagagccgagagccagatgctccgggaaaaggtgccggtcttgggcggcggcggcgatcgctgactgcgtggcgctctgctgttgtccctgcgccgtggtgaacatcttcactctcgcctttgttaaggtcccgtggatgataggccggaaatgtatcggccgtggtggcccgagtaagaagcggatgaagaaaatcaaccgtgaggatcggtttcatcaccatcaccaccacaggaggtcggccgagatggtgagtggtggatgttgcggtggcggagatggagatggagagttcgatgaccatcggtttgtggtggaaagagacgggagtttgaccaaagaggaagccaaaacggcgtcgttaaaagaagaggaagagacgagaataagtgcgagagtggaagcagagagagtttggttagagttgtatcagattgggcatcttggctttggtagagtctccttcactggcattcatcaatgataatagatgaacttttaattattaggcgtatatgattaccaaaactaaaaatagattttgtgaaattctttagtgcagcaagtaagattccacaagtatgcatagaaaaaaaaaaaaagattacacaagtattaatttatagaggttttagtgcaacatgtaactcataaggattaaggaaacaaaaagtatttgtgaaataagagagtacattatattatagaaatgggctaatatacatttgggcccttgttaaagggctttcacatgaaccgcattaaagggtagtttaggacatttacgatagaacttggtaggcgtagctagctgtcctgtaacagaaaaaacctgcgcattttagcatgcttatgaaattcatttgctaaaagacgcatagacacgtcgtgggcgaagggttctttgtcttcttcccccaactgagcaagattgttttccttaagagcttcatcgtcatcatccgagaattggagcagagatacgaagatttggcgaaaa

SEQ ID NO: 9073 - DNA, 3000 bp, Unknown
  misc_feature (1)..( 3000): cDNA_ID_3044454_gDNA_ID_1971974_Annot_ID_177550 3000 nt of promoter + ATG
tggacgatggcaaacatgatgggactccaacacactctgtaacctttgtgtggaatggacatgaggtgactgttgcttcacatgcttttattactttgctgcaattctttatggaactcgtgatctgtagggttgagcaactagcctctgtgttttaagttacaccttggtttacagggggaggaggtattgttggttggggatttcacaggaaattggaaagaaccgataaaagcaacgcacaaaggcggtccacgttttgaaactgaagttagacttacacagggaaagtaagtcatgcttcttttacctttcccgttgatgctttttttaaggttcaacagtaaaacgtctcataatcttccctgcatgttaattgtgacttttgagggattgcaaactgcaaagaaacttatgaaaatgcatttgtgtcatataacttggtgattattgacaatgtggcagatactactacaagtacataatcaacggtgattggaggcattcagcaacttcaccaacggaaagagatgaccgaggaaacacgaacaatataattgtagttggtgatgttgctaacgtcaggcctacaattcaacaaccaagaaaggttactcctactatgcagtagtctcttcttcatacaataggaaaagcttgaataagatgttccacgttatatttgcctgattggttcaagacataaacctgaagcaacttgtacaatgttttgcaggatgcaaatatcataaaggtgatcgagagagtgttaacagagagcgaaagatttaggctggcgaaagcagctcggtgtatcgcattctcagtttgtccaataagactatgcccaaagtcgtagaagttttgttttggcataagttaaaatgttacatccattcttctgtctctatccattcctcgaggtacttaaccctaatatcgttgtgaacaacattgccacattcgcgcactctatgacaagagaatgttgacattatgttgtgtgtttgcatgaaaaaatgtcgacatagtttcgccgttgcccactttacatataagtcccaaaaccaaccctaatgcgttactggtctctgtatttcttcttcattttctctctctctctcgctctctcctaacatgttgaagaaaatagaaactctgttatctaatgttgcctatatgatgatttatggccatggaaggtctgagaggagagacccttcttctctattttttttatttcctcttcattttcatgctaagagttttcactgagtctgttgtttcgtagagtagaacagtccatgatcgatgttaatcctttgcatcttctagattgtgtatacaatagcaatctctggtctagagagagcctagagaagtatggatctttctatatgtataccacaaacaaatggcctaacatctaaagtgggtggtgattatttaagatgagagcctgagagggtaagtgaaagaggctgatccttgttttcatgataagggaccttatcctctaaacctttctgagaccttttatttttttataaaaaaaagaattgaaagaagaaaagagcacgtaaaagttttgaaatcttgagctaatattcctcatccacaagaaaagaagaaagtttgttattcaccgcagctatcgctttcgttatcctcgttcccacaacctcaccatgaccatgagactccgttcttttaaactcccaaatctttcaaccaatcccattattcacttaagtatatagtagcttccataagagtcttagttctaactataaatacacatatctcactctctctgatctccgcttctcttcgccaacaaatgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattgggtatacatttttacattcatcactgtttcttaacctacattatttcttacataacttacattgctgtttacgtataataggggtacattacatagatagcaaactaaagttacagaattttaaaatttgtaaagattttacgaaattattatatagattctgcaattgccattttagtgataggaacaaaaatcttctatagaaactagcttacgaaacttccacaaatcttggaaactgtcacatgtgtttcacatttcagtttttttttcccttggtatttccttatattatccttactattatcatccgtgtttgacttttggtctttagcgtggtactgaaagaattacccaaattaacaagaatcaaactaaagttgcttaattagtgaatcacaagcaagggaagagttcattttcaatccttattctatacagatcttcaaactacttgcttcgacatctagtgaagttaaaaacaaatcacctcgaaatattaaaagcgttgtctcattcctacccaagatccgacatttttgaaattttgagagttagaacgtacgtaggatccacgtgataaaagaaaagttgctagtagtagcttcaacaaaaacgattcatgaaactgagacgtgtgtgtatgcacatgtaccatatgagagcgtgtggagcatagtggtgattaagtcgccatctatatttattcattcaacctaccgatttggttcctactagcgaaaataaaatcataatataaaagactataaaattgtactttatcgtataatgaagttctgaacaggttgattgtagtttcaacatttaaaacacgtcatgactcgctctctacttaattacgttcacgacaataaaatatactagtactcattttcttctaattttatttggtcaaccaacttgcagagtgaagagatg

SEQ ID NO: 9074 - DNA, 3000 bp, Unknown; identical to SEQ ID NO: 9037
  misc_feature (1)..( 3000): cDNA_ID_1988791_gDNA_ID_1971974_Annot_ID_177549 3000 nt of promoter + ATG

SEQ ID NO: 9075 - DNA, 3000 bp, Unknown; identical to SEQ ID NO: 9036
  misc_feature (1)..( 3000): cDNA_ID_3044458_gDNA_ID_1971974_Annot_ID_177548 3000 nt of promoter + ATG

SEQ ID NO: 9076 - DNA, 3000 bp, Unknown; identical to SEQ ID NO: 9035
  misc_feature (1)..( 3000): cDNA_ID_1989378_gDNA_ID_1971974_Annot_ID_177546 3000 nt of promoter + ATG

SEQ ID NO: 9077 - DNA, 3000 bp, Unknown; identical to SEQ ID NO: 9065
  misc_feature (1)..( 3000): cDNA_ID_1989358_gDNA_ID_1971974_Annot_ID_58727 3000 nt of promoter + ATG

SEQ ID NO: 9078 - DNA, 3000 bp, Unknown
  misc_feature (1)..( 3000): cDNA_ID_2038130_gDNA_ID_1971978_Annot_ID_177607 3000 nt of promoter + ATG
atgagcacataatacgagacgagcaagatcattagatatgggtgacaaaaacaaaacaaaaatctagatctagcaacgccggcaagagctgaccccgtcggaacatgactcctcgaaggttgtgctagagagagaaatagctagggcgaacttttttaaaaaaaattgcgactttcaaatagcttttcaaacattttagattagatttctttcgaatgaatattgatttcttcatgattagttttaatgaaattttctgtttgggcttctacaaatttcttcttcgctattgtttgatttggatcacaaatatactttcaactattttagattagatgaatatatatttaatcacgattgaatactaatatcatgtgaaccaaaaacatcacgcttatcttcttccaccatgaaatagattgaatgcagaaggattaaaatcgataataaatttacatatatacatgaataaacaaacgagttttcttcctagaccatatagctacatttttaacgactaagaacagaatgcgatttaataaacaatgtagctaatgtgttacaacccgtagcaaattagctacatattgcgagacaaatttttctgtaacaaatttgttaccaaatgtgtttaaaattttgttgcaaagttccacaaaacaaaattcgtcgccgattttgtaaaaatagttgaatagaatatcaattaacgttttacgactattatcaactagtcaatttgtagctattagcgacgattgatgacaataaaggatatcaacaaagttgattagtatcaaaattgttgttgtaatttttcacaaaaataggtttcgccacaagcttttgtgacaaaataagattattactattgtttaaactttgtaacaattgtgtcggtcgcaactagaaacgaagtggagactcacaatttctttcgtagcaattatgacaacttgtgactgaccctatctctgaccaaaggccactctttctgcggtagcaaattggtcaccaaaaccactactgttgtgacagtgtaattgtagcaagttgattacaaggccacatcttttgtggcagtcttattctagcaaattgataggtgtcttgtcgatcttccaccaagttgttgcttaatttttggcttccttctttgccttccacctaagctgcgcaggaaaagcccaaagccaatcccaaagccaatcccagggacagtgaagcttcagagggtctttctgtccaggtgctggtagtccgcatcttcacagacatgtctatttcaccgagcctctctccgagacagtgcccagatcgttacgctgcctcattctttctttgttatatattcattcgaatctttggcttcgttttctctcttcttcatatctagcaaaaaataaaaaattctttcatattcattctaaaattttgcatttgagtaaaccatctctttttttcctttaattctattctattatcttcttctttgtaacaaaaaatgtcttcaagcaataatatataaatcgtaagaaagtggatatataatcgtattaatccacgcactagacgtgtatccgacgaatatgaagccgggttaagtcaattcatggaatttgcaaactatcgattatatgatgggggtcgaatatggtgtccatgtcgaaaatgtacaaatagagaacttatttctatagctaccgtatctaaacattcgtataatagagggtttcaacccaacttttatgtttggacagctcacaatgaggagtttgagcattgacactatgggttctgaaattcacactagagatttgtaatagagattacgagaaaggagcgctagttcttcacagaaaccttgagagttatattgctaagaacgaatggactttttgtattgataatgacaaagattttacaatgtgaaaggagattacaagtgtaagagtatgtgtgtgaatataaacagaattgaatgaatcttccaagtcgtccttgttcccttatataggtctacgcacgtggtacctccgtccgggatctgcggagatcgtcctggatattcggcaggtcagttccgagatatcaggtccgctccgtgaatatctcctcatcagttcctaggttgttattcgcttatctcccttcatcaggtgactgggcttatctggcccaagtacccattcgcgtatgtgagctcattagctgcgtaggtcctctacttggtgggcttggtgggcttttgtgggttggcttggtatttttgcaggtggattcctggagggaaatccagctccaacatttgccccccagcccattgagtgagtaggcgaactcgatgagcggacatataggtcaggtaagattgcgaaaatattcttgatgagatgatagatgtgataagatcagtcggttttgaggataaactcaacaaaacgatttgatttcagattccttaaccgaaagatttcgaggagatacgcgagataagtcgttgctgatgtgaacgactgagatggagcgtctcttcagcgcaccgcatttgacggtctagatcaggcgcggagaagagatctctgcaatctcgaaaatcatggtgatgacggctttaaataacttcccatctctccacttgacgtcacaacaactcacacgactgtcaaggtaacttctctcctcctttattatttactgtgtttcgttttgtaaagatagaaaaatctcgtcttttttcttttgctatctccttcgtttctctactagtactcccctctttctcgatctgccctcttttgctcttttctttcatctctctcgtccttttctgtcgaaacccaacgatgagcgacttcgaagattcccagaataaaagcaaccacagtacaaagacgtgtcataaccctaggcgaaatgggtccaattcgtccgccatcaaccagagccgattagccgaagaagaaaaaggctgccaagcaaggaggaggcacgccgatg

SEQ ID NO: 9079 - DNA, 3000 bp, Unknown
  misc_feature (1)..( 3000): cDNA_ID_2038053_gDNA_ID_1971978_Annot_ID_177628 3000 nt of promoter + ATG
ttccgcttggttctctgagtaaaccgtctgcgggtctccggactcatatcgttctttgagaatttgctgggaagattttttttttcttcgtcttggtgtttcgtcttcgtcagaactattcattaagcatttttcacaatcacaaatatcgaagaatttgtgacctgtctcataagcgaacgagtagacgggatctccgagtgaataaaaaaattctattggaatgccgggtagatgctttgctaactccttttgttctttttggttgttatcaattggagagattgtattgatttccgtatagaaagctgcaggtcttggcttttcttcttgttgtttaaaagcaatttccatcgctccatcttttcttctatgaatagaggaatccattgattgaattagggtacttctatcatggagtttttcgtaatttgtcacccatgactctggaaatagtttgaccagttcatctctaggtatttgtcttaggatgtggacgcatgatggactgtgttgtgactccagttggacaagtagggcatcttctgtgtctcttggtagacttagatccataacatgattttggactcgatacgccacctcgtggtgaagtgttgttgcataagtatttccaatttgtggggcacccgtgatttgtatgttgatttgcatgttctgatatttctggggatcttctagtaccacaataaagtttggaaataatgtaaaaaatattgttccagcgtttaaggttgtttggattgttgcgatgcatgcatgttgatattctttgtatctggtgtcgagaagggcgacccttgccacaacacgtagacctttccgtccatgaagagttagtgctagtcgtattgctccatagtaaagatgggtgtaaccatggactctccattgatgcaacattccttcattgagtcggaggggaatcatttgttctgtcttaattgccggattaagatgttgttctagttgagaggctagaagaatttcttttgccgcatgtttcttaggaccgaatccatgccttatgaattttgggaaagtggagtttggttttgtgaaggctttgtagggcttgagtaaagggagttgggtaatagggactttgctctcacatattctacttcacatagataatttacgttactagcattggattttctgaaagaagaggatgatataaaagaagatgtactttccatagtgtatgtggaagtcagaaaccataacaaaatactttgcttcttatctctcttgaagtaataacaaaccttgaattgtttttcttattataaataagtgctaagattaagaaattaatcaagaggtacttagctacgcaaactaaggcaaaacacttatcaaccttaaaagtctcaaggtacttcgagctctaagacctcattgatttctttttttatgttctctttttcttgctaaaacggatttctgatgtagaggatccattaatatggcaaccatagagcatactttccataatagcatatggtagaaaacagttataagatgtatcacgacttgagaagttaagagccaaagtttagactgccatagctctgataccaaaattacaaacacatagtaggtacaatcatgaaggaggttttataagatcgagatatataaactagtatatgaaagggatgaagtgtttatggaagagattagagtgggataagtatttttacaagagaaagcttttattatacaagaacactctcaagagaatacaaaggactcttaggattttagacactcacgcttgtgttcaactctcttcaccaagcttggtatctatagtaaatggcttaaggaatattacaaagcatattcctttcacacatatttacacacatactacacactatacatcaagtcttcacaccacatattttacatcatatcttcacaccacacatttcacatcaatgttttatttcacatcaatacttcatttcatactttcacttcatgtctttatttatattacatcaattcttcatttcacttcatactttatttaaattacaaacaaatagtaggtacaaccacgtaggatgttttataggatcgagatatataaactactatatgaaagggattaagtgtttatgaaagagtctagagtgagataagtatttttataagagagagcttttattatacaagaacactctcaagagaatacaatggaatcttaggattttagacactcaaacttgtgttcaactctcttcacctagcttactatttatagtaaatagcttaaggaatattacaaagcaattcttttcacacatacttacacacataccacacactttacatcaagtcttcacaccatatattttacatcatatcttcacaccacacatttcacatcaatgctatatttcacatcaatacttcatttcatactttcacttcatctctgttatgattatgatccaattccggtttaatgttggtctagtgatattcggtttagcagcagattggagttggttattgaagcggttagctttggtttacagaagaaggaagtttgattggaagactctcattcagaaagaggcttcgagactcgaagtcaaacacatataaatagaagtctgttatcttcttcttcttcattccgttagaaaagtgttgacgatctctcttaaacccagaaaattagggttcttagttgatcttgtattgagctcagagaagcttgtaaacatctcatatagtggattgccggatctatctggccccagacgtagatctaatcacaccgattagattgaactaggtaacaaattcttgtgtgttgttctctgtttcttctttgattcacacaaacaaacttcaattgagagtttgagagcaaacagagtgaggctcgtgttcgtattgggatctgttttacaacaagtggtatcagagcgaggcttactcgtttcttgattctgatcg

SEQ ID NO: 9080 - DNA, 3000 bp, Unknown
  misc_feature (1)..( 3000): cDNA_ID_3051510_gDNA_ID_1971978_Annot_ID_177620 3000 nt of promoter + ATG
ataagaggaggccacaaaacacttgaacacaaaaaaggaagtgggagagaaaagagagggacgaggcaccaaaaacaaaaccgttgttgctcagatccgttgagagaagaagaacagtctctagtgctccaaacaaaataagacacctgactagagacaagacgaagatccacatcatgaggcataagcgagaacatcgactatatttttaccatctactttaagggttgttgatttcagttttttagaaccaagcttttttacaacccaatctacctcgtcaaaatcagcacgtttcacaatcgtaaaaaacaaagataataaaacaagagaagggaccggcgctataagaaccgttacacgccggtcagatctagtcaaggcaataggttggaaaaaaacggcgattaaatttttttttaaaaaggtttaaaaataaaataaaaatctataatccataaattattttgaactactttgatatatataatacaatctggccaacatctattcattaatatgcgagagttttttgtgattattagatatgcgagagttataaagtagaaataggtgtttaaagagtgctgaattgccatttgtggcaataaacaattttcgcttttatgttacgcaaatattgtcaaagtttgattataattaatgttgagattggaggattaatgacgttatgacaacaagtcaacaactacgagctaaataatcaagttaggcgatcaattgaggtaaaatatctcacaagtttgacgactcattttttaatgactttattaaaaaggagaataatagtttggaaaatgacaaaccaccaaaaatgataaaacaatgtaaagaataaacaaacgaccgcttttagaaacgtcgtaaatataatttcttcatatcactcgtccctaattccctatattaactatactatatatattgtattgattatcttatttgtaaagttaggtatataaaaatcatatatattgaaactgctatatgcaagtagtcttatttaagaaattgtgctatgaaatagaaattgttgtatggatagtaatagtcttcgcaacaaatttagttttcattgtttgacactttaacatgaaaggttagcataaaaaaaaataaagtggaaacttgaaatcaactaaattttcatgttcctttttaaagtataaaacttaaacataatataaatagtaccatatgatttaaacttaaactgtcttttttacttttttttctttcacagatttaatcttcatctcacatctcaaaagataaatttttattctgcagtaaaaaattcattagcaaactctctttaattaaatatcaaaatatgttttttaatgtaaaaatattaattaatatcttaaactttgtctttttagtgaaatatcttatatattataacagaagaagtatatatatatatatatatataaaaaaaataaagatgtatattggttacccaaaattagaagttcacaagaaaatcaatattcaatatttactcaatgaaattttcaacaaaaaaaagtcttaaataaagaaagatttacccactgaatctgctgaacccgtggctccgtcggttttgattagtcaccgccattctttccgaagaaaaacaataataacagtaatactaatatataggtggctgtaatgttgcatcttgatcaaaaagagaaataattttgtagttattttaaggaaaaagatgaacgtgatcattttccatcattcagtttttttttttttttcattttccaacattcatacataggtattttaaacttttagatgattcaaggaactattttaggttataataatgtatacaaaaaattagattactcaataattaatatctcatcaatattgctgaaaatcacatctgttaattttatcaaaaaaaaatattactaaaaaacagtttaataagaaaatattactgaaaataacgtttaataagaaaataaatattgtatgattattagattttttctgataatatgtttaattgatttatcaaatctcaagaataaaaggaacgttgttcctatgtttaactgaaggatataagaacattgataaacttctaaactagaaccaggggtaaaaggattatcaaatctcaataataaaaggaacgttcttcctatgttaacacattgataattctttaatttactggtaaaaaatatacggtttacaaaatatatatatatatatatatatatatatatatatatatatatatatatacggttttaatagttaccgatcacaaaaactattaaaattaatagtatgaaaatattatcaccacgatttttgtattactaattttattgctcttaattattttgtcatcttttatcgttatttttccattaaaaataaatacggctttgtgtcacgaataagaaaacatattttttagtaaaacaaattcgactaaaataaaaaggaaaatgttttgatcacatttttatattgtattacaggaaataaccaatgatagataataatatattattcaattgtcatcatttcttagttgacaaaaaaaaatctatacatgtttccgagacgttaaaagtatttacaaaactactccaacaattcacatttgttttataacaaatagggacaaaaatgatcattttaagcttattgaataactatgatcgtttatttttgtcaaacaaatggatggtttatttaattaagtcaagtcataagaaaaaattaatagtaagtgtgtaagaaaaaaattaaaaagtcacaaatggtcccatacgtgtgattcggcacgatacttcctaaaagcataccactaggctctctcctatataacttcatctccaccaacgatgcattttcgtcctcagatctcatctcactcacaagagagagatagagagagaaaaaggctctgctttctacattatttacgattatacactttccaacatg

SEQ ID NO: 9081 - DNA, 3000 bp, Unknown
  misc_feature (1)..( 3000): cDNA_ID_3044505_gDNA_ID_1971978_Annot_ID_177615 3000 nt of promoter + ATG
gaagcctattctgtaagggaccatctttgtctcacgaccttttaccttagccaaatgagttcattgatgatgcattgcttgattcacgttccagaagtaatgaatgttaaagggattggtagatttgaaaacttgtgtaggtcgagcatatgagtcggattgattgatgatgaggcatggctaacgtttttaagtagaattcgatcttgcagcttagaactttcaacttggacattgatttcatctggtttatctggtgctttggctctgagtccctgctttcaaacctcacctccagcttgttcttgattgtttgcttgagggcaagcaaagactaagtttgggggagttgataagtgtgtattttgcatgttttgagcatccatttgtcatcactttagcatcatatcatcactgtttaataccatttctcatcatttgtcatcactttacatgtttaggatagatttgcatgcatgttgcatatttgcgttgatttcaggtgatttggagctgttaacgagctatctggaagaagcgggcctgatcatgtcaaaccactcgaccccgaggtcgagtaggagcttcaagatctcaacagatgactcgaccccctggtcgagtagaggacatcattacttcaccacatcactcgaccccgaggtcgagtgtcttcatcccatcacctgaccatcactcgatcacatcactcgaccccgaggtcgagtgtcttcaccttcattgccagaccactactcgacctcatcactctacctggaagtcgagtatcaccatcaccaccactcgactgcatactcgatgacaagcttcagagccttcttcattccgcactcaaccagacactcgagcacaaggaagaaaagaagactccagctattcttaattcgtcccaatactgcgtcgttttaagtattagggtttcggaatatttggctataagtagcatgtacttcacattttcgcaaacaagttttatatctagttttattccgcagacactgtgttctagacctttgtaatctggatttctctttatctattcagtattcagcattcgttcttgatttcttttactgttgttcattctgttatcatcctgctgttacactgttgttatcatgtttttaatttgttcaacgtttatgctttctgttatgatgtctgagtagtgaataggtttctgaggatgggttagagtagtgtagaattctcagtatgctaggtgattgagtattgattgatagatcccttctggattagttgttcttaatgtctattgctttctgatcaactggaatttgagcctagacatttccgcgcccaaaaggtgttcgatgaaatgtctgaaccactaattccagagattcgtgactctataccaaggtattggttgcagagagcgttttggctttaacttgttgattcgtaatgcctgttaggctagctctcgtcaatggtgattgagtctgggactaggttaacttgagagtctctgttgcggtggcacttagatttggttaatgaacttgttgtctagggttaatttattgagcatgtcaattacctgtaaactgaggaaacgaagctactcaattaccccattctcgggaattctttatctgattactgcatcttgtcatctgttgtttaatttctgcaattctttcttgttactcgacctcatactcgaccacccagttgtctggcaacagattgtgcagtcgagtatctgtgttgtaattcctgtctgtaactcgacctgtcactcgacctcacccagtgctctgcaaagagctatgttggtcgagtattttattgcttgaatttctattttctgcatgttcacttaggactgctagaacacaccaaaacctgttattgtttggcttgacttagtgacttctgatcacatcttgattattagcatcacacccatttggattgataacctaaaatactacaacgacgtgagtggtgttttaggataattgattaaaaacctattatcagtaatcttgaatgtgataaatgcatgcaggtgattgaaaatctttaataggagctgccattgtgtgttgattgggtatcaagtactttttctaagtgatccaaatccttctctttttcgcagttccaactctttggaaagattgtaggaaaaatctatttgctctatatgttaagtcttgttgtgagtaattgttctctctgcggttttaggttaacttgctttaaatccaaataattgttctgtgttcgtgttaccttgagatgtatgatatgtttcagtttgtatttgcagtacttttattcctctgttgttttgattctctagggttcattgttgctctctgcctctcttgttcttccacaatagccaagatcaactctttggttcaatcgatcgctttgtctaaggtactatcatcattcatcaaagctatgttagtactcaattggtattttttatatattgaaaacagagcttgatcaattgctgaaaatagagcttgaaacttcctttgctttatttgattcaaatcttaagctctctgaattgggactgtatatatgtgtttggttgtgattatttgtgaattggaattttcagggacttagttctagttattcttgggaaaacctgttaaagtaaaaaaaattgcaccaagtctcattagtcattagacgtgaatctacttcagttttttctttatcttgtatacctcctaacagaaaatgatagatgatttcatacaaaaacttagtttaccaattcgttattgaacagtttcgtggtcatgctctcttttcacttgtcgccgttgtttcactttcaggcaagtcagagattcggtgagaaaaaggtaagctttttaaataatctttgcccatttctaataaacccttcttgttaaagattgggaattttattgcttgattaaattttgaaactttttcgtgttttgttttgatttagcc

SEQ ID NO: 9082 - DNA, 3000 bp, Unknown
  misc_feature (1)..( 3000): cDNA_ID_2180117_gDNA_ID_1971979_Annot_ID_177645 3000 nt of promoter + ATG
tacaaccacaatgttcgaaaccttaatcacgaaataaaatttcagagagacagagattggaactaatcattgttggatcgatgaaactctaaaaatccacaaagtctcaaaataaaagtgtctgctcaaaagacaaacaacttaacttaaacaccaaataaataggtagcgcagcctataactctaaaactttttttatgatattgtgatatttatttgaccgttagaaaaatatgaatggaaaagccattcaaattggtctaactatattaatggggtgatttattgtttcattcatttttatatagttatgaaaattgtattaatgggctaagttattatctattatgtgtgttcttttgacattgctaacacacaaaaaaaataaaacgttttgaaaacaatataaacatttgtaacatggctttccgtttcttacatttattcagtataactaatggactattaatgtaacattatatagcataatatttgtacgtttatttagtatacatggacaaaaaaaaaatatcagttggataaaatgtagtgttaacaatgattttaaatatttataagctatatataatggaagaaaacttattcagtttatttcaattgaaatggcattacataataatgtaataatcatgttgtgtgaattatttattttaaagtgaagagaaaaaataagattatattggagaatatgccaaatgtaataaacataaaaggaaaaattgaacaccaaacaattattccaataagattattggaataaaatataactctttagttccatatgcaattttccatttttctatataatataccatttggattaaatatgtaagcaagatttataaaattgtattgttgtccccattattagtgtgggtctaaatgtattcaacttaatgtatttctaatttgtaaccactagaatgttcaaaccaaaaaacattactatggtttttacttttttatttacaatagtcaactggtcttcttaaccttaatcattattcattaattacattgatggatttttcttttttaaaaaatacagatattattggaaatgtaaaataataaaaatacagatttgatttaatcatctattatattacattttacaaagttaaaagggtaaatgtaataaaatatagatattgttagaaggggaatagggcattcctcaaacaaccgcatttatatatatatatatatatatatatatatattataataaatcttatggaaaaacgaattcaaaaagcttagtgtaaatgataaattatatggaaaaacaaattctaagattttttatagtactatatatatttttgtatttaaacttcttatgtatttaattggttaaatgttgagatattagtgtatatattaaatgtcatactaataaagttttgtagagaataaatatttaattattgtatatgccacatgtcgtaaaaagagattgccaaatgtcatgataatagagctccattatataataaatcttatgaaaaaactaattcaaaaagcttagtgtaaatgataaattatatggaaaaacaaattctaagattttttatagtactatatatatttttgtatttaaacttcttatgtatttaattggttaaatgttgagatattagtgtatatattaaatgtcatactaataaagttttgtagaagataaatatttaattattgtatatgccacatgtcgtaaaaagatattgccaaatatcatgataatagagctctttacaaaaaaaacttgtcttataatataagattcacactaacttaccagagaattaaatggtatatttattcgttaaaagaaacaattttcacgatacaaatatggatttaaaacaatctttggacctccacatatagatctatacaaagcgtatatgcatatttaagaagcgtagatgggcgatacaaggctcatgcattcattttggataagcatgtcccatttagttaatgaattaatagttaactataaatttagctacatgtcgatacgctttcatagagttatatatcgatttatagagtactacatttagtaatagatatctacgcaactaggttagtggtttagattttgtaatttccgcccatacgtttttgttacttttttcaaattaaaaccggtcgcatttaactgtcactagtttttgtttgttgcttcgtaaaggtcaattcaaccgggagaaattaaatctaatttgaacaaaaatactcttattttatatattaagtatttttgaaaaagtttaattttgataacatgtagatctagaagaatatagttgatttaaatttgaattaaaatacccctatttttgtatatattaaggtgatattttgaaagatacaattttttctaaaattttttagaaaacgatttctagtgatatacttattttagaatttctattctaattttttgtacatattctacgatatttagactattttcgctctaacaatcttagaaaataggaaattcaatatctaaaaattttagaacatgtcttctaagatttcctgcatgttctaaattatgtgcgaaattgttttctacgaatttctatagtttctgaaaacagtagaaaacgttttctctcttttagaattaatatttaaaacatatttaaaattttgtttctaaattacttagaattcctaaatatagaaagcgaatctttgaaaaaagaaattaaatatttattaaatattacgttttaatgatatattttctgttaagattacgatttttactgggtttagaaaacaaattctaattatttttagaatacagaaagaaaaaaacaccaaaaaaatttgtaaacaaacgatttgtgccctagtcaatttgtgccctattattgatcttttcttcttcacgttcttctttttccatctcgtgttctgtttttcattatacatatctatgtgaggagtggcatg

SEQ ID NO: 9083 - DNA, 3000 bp, Unknown
  misc_feature (1)..( 3000): cDNA_ID_2180137_gDNA_ID_1971979_Annot_ID_177650 3000 nt of promoter + ATG
atcactaatcaggctttttcaatttgggcttgtttgtttactttatgcctaaactcatatcttgtttagtaacaagtttaactctgcaaccaaacagcatctttaaggtcttatctcacatataaaccaaccccacacacgaagaactcaggattggctaacaatggcgaagaagaaggaactgttatcaaaagcaccgtggagaggcgacgacgaagatgattccgataagtttagcaacgcaaagcttaaagtcacaaaggattctgatggtatgtcgaagatgcacgtccctagccgcggaaccaaaaaaggaagtctcgctgatgatgatgatgattcacttgagattgatcctcagcttcgttacagcttcaatcgcaactatcaggtctacccttctctcattactgtaattctaggtttcatatagtgaatttgctcctctctgctctgttcttaggaaattgtgaaattactagtaaattgtggcaatctttcttctgtcatttgttcacacatctttagattattgggtattggagaaatgtgaaaaagattttatcttttatgtttctgcaccactttggtactgttctgtgtcttaagatattgaaagcttatgtgaagcttgagaagaagtaattttagctgcaaagaatggatttttagctctctctgttacataaagctttgatttttaacacattgtatccagttttagttttgaatgaattggaaaattctgcaatggttgatacacttgcttggtgtctatacatcattcaaattcgaaatcttgagccttttgcacattggatagaatctcagatagcagattcacatttgttaaagaactataccgtaactgtaaaactggtttaaagggatctttgtattttcacatgtattggtttcgttattgggtggtatactttcctgtaaacactctgtgtagttcgatgtagacctacttccccttcgactatagtatatttattagttctggaaatcgtatgaatagttggttagtcagttatgtaaattcctctactattgttcatggtcacattggccatagactacttagtgatttagtatcttggttaaggaggtactttatagcctctgctttgttatatagtcatgttgttataatccttgggtatggaacaacttgaatcatgacacattgcatgcatctcgaaccgtctttacacagaaacatgttttatgcattcacaaagtgttcacatacaagcgatttttgaataccattgatttcctttcgatagattgtaacatgtgtttatatttttatattgttaaaacgcttttcctaagctgtaaagtctgcttctctattacagttcctgcaaagtgtattcactatagacactttggtgaagcctcttcctccttcaatggcattcaatgtctctcgcaacttgagcttcttcacccgcattttcactcaattctttggtgagcattatttttcgaataccttgttaatgcaacggattatatagtcaaatgttttcttgtcgtacggtaaaagttgtgatgacatcctcagtgttttaaaaccttatactcctcaatgacccttgatttattgtcttggtatgcggttttaacggttgatatggttaatgcagatcctgaaggcattgcaaatgcacagaagtctctagggttggggcaggaagagaaagctcgccgtgttcgttgaaatatgaccatatttcaatcttgtgaatggacccagcactgttagattgattaaaatatgtcctcaaagagatgttttgtatgaattttcctaagtacaatgaaatttccaagttccattttagcactaggcttccctgtttccatcaacataaactacttactttgattcaaacccaaacttggttccatatgtgatgcctcacctgtttaaagatacatctgttaactctggatgagagttcacgctcttacaccaaaccaacctttaaatcttagttgccattctctttaacctcttctaggtatgaaaaagtaatgtggtatttagaacttattagttggagaacaatttttctgttcttgtaagtatgtaatattgtgattttacacgacaatttttaaagctaaaaactaagagccaagaaaaatactatgttttcttcagaaaataaaataaaaaatgctatgtctttgtctaggataatgatcttgggatggaactaaagaaattttgtgaaatgctagttcagtttttatagttgtacaaagaagtagagtaattggtgattagttatatgtttcttaacttctactcatatctatgttttactactatacatatgagttcggagtatgctatatctactcgataactaggcttatgcgaggacttcacatcaccaaaaaattgggtccttcttagtggcaaacatctagtttacatttaattgcttcatatcaccaagaaagcagtaaaaaaaaatgctcgatcataatcttccacaattgcagatatgaataaaaatactatttttccagtgtgggaaagttttggaattctaaaacttgaaactttacaattaataacaattacatacgtatcttagtttttgcctagaatagtttttactgtcctcgagtactgttccaactgttacaaaaatagcctttgtgacttgtgacacaaacaactggaaagcaacacattagactctgagaccctcacgagactgcatgcatgagacacttgtgaatatagccgcagctaaaaagaagtttggtaagagagagaaagatagagaattaaaatagaaaaaccaactgtcacaaaattatcaacacatgaaaccaattataacataccgaaccaaaccaaccaactacatttcctcattatataactatgaactccactcaaatcaattttcaatctcattcttcttaaaaaccattacaattatttcactaaattataacttaatg

SEQ ID NO: 9084 - DNA, 3000 bp, Unknown
  misc_feature (1)..( 3000): cDNA_ID_2180154_gDNA_ID_1971979_Annot_ID_177657 3000 nt of promoter + ATG
cacatgtttgtaaatatcaaagtgtcaaaattttacagaatctgtcgaagccttactctaagttaaactcgataagttatggttgttgcttcaaggccaagtacgtaactccataatccgtcatgattctatgcgaagtagtttgctagtttgctaatttcacttttatgttttaggaacgtaaatcaaagcaagatgattatcaaagaaagatttgatgcataatataattacttgtgcgagcacaaagtgttccactatggattaataagtttgataacggagtcatgtggagccattccagctctaccttcaagacagtacgacgaagcgaatgtggtggagatgattttagagacattgctagggtttttcttaattcgaaggtcgtcgatgttgctaatgtaaccttagcatgatccaacatgactagtactactcaaagttcaagatttcttaagaaagttttatattattttatttttttttttgttattttaaaagttaaataacataattgttagataaggttttttaaatatttttcaactatgttagatgtggagtttttatgttaattaatttggttgttaaatatatatccggacgtaccccggacttaatccctagtagtaatagaaaagcaataaaagtataacatagattatacgagtaaccgagattcatatcaatcccaagctcttcacgcaggtccggcttagtacatgtgctagagcacatagttctaaggtccaaaatatttttaatttttttttttcatacaaaaatcccaactattttttacaaaataaccactaattcaagaattataccttaaaaatccctaattttattataaaaaaaaacaatatgaaaagatccaaacttttaaaataatatttctataacgaaaaaccacaattatttgaaaacaaattggtatttattttttaaatataacaatataccaaaaaaatttttgtctaaaatgtccttagctattatggatcgggtcttccaccgggtctcgccaatatttgagtcgggtctgtctccactcatgagaccatctagcatttccttgatgtgggcaattgatgcaccaagctcattcatgatatcatgaacaccagttaacaagggtatttgatatatccttgcattaacatactcatacaatttattatttaaataatttattagattgaaaaagaaacaaatttaattaattacttatatcagtaggtgagggtgtcccccgtaaagctcacaatgaatctcgtagagttacatcatatattcgtcagggtccaagtgtgtcacgatcatcttacttgagagtatcgaagttggtctcattacggaccaaccatggcaaaatacaacgacctaaaattttcaaaaaaaaaatatctaatatatcttaagaaatcaagaactactcgcaatttccaaaaactacctttatatactcgaactcattctaaaaatgttgtcactcttttttattaaaataatatatacatatatatatatatatatatatatatacttcatatgagtttttttaatccaaaatgtacataatactacccaaccttatactctaaattagcaagtctaatatattgtataaagcaattatatttaattttaatacatatttttaaatcaaagttacataatatacgtgtatatattcttcttacacgatattttatagaactcagtcactcaaaggaactaaatttaaatgagatgaaaataaaatagaaaccatcaaattaaagctaaccataactcatgatattttggtgaatgatttgattcagtttctagtaagataaacaagagaaatgcaagcacttagaagaagatgagctttctctcatttcattcaaacgttttttgcacatttaatgctccgaaagtaacatattgtcagtcattagtttttatttttgtacaagtttatcatacttcttgttttatttgctccacacaattttccttttatgtttttcgtagacgtcacaatgaattagaaaaaaataatcttaaattattcaaatgaatatatatatatatatagtatatactaaaaaatagttaaagatatagtatacctctttcaaaacaaagcacaaagtaacatatacttattatacatcaatttgataaaatacctagtggacatgactaatcactaataccataaaaaagaacaaaatctggataatggatccaaatgatccatctaaatgtatccattgtatgttgtttgtttttgaatttggcaatccatctagttgaagcatttgaataaagctttgttagtttgagtaaatttgcatatgcatcacgatttatgttgtattaaaatgacttagaaaaaaaaaatatcttcatcttcttcttaatcatagtttaatgatttaaaattacatttacaactaaataaattttaatactttttttgttacacctataaccttttataaaatagtaaaattagcatctcattttcagagcagtctaaaaccacctaaaactaaatcatagaatctgatattattgtactgatgtttctcttctacttaatttcaaaaccatatacagtacctgggctgtttaaccgaaccaaaccgagattttcggatttggttcatgatcggttagtagtctaaaaccgatcggaaataattatgggcttagcccactaacattggtgggattattaatctgtaaccaatcaaaatccaagaatttcgctataaataaaaagcatattcctttttttaattttttttttcctatcgttgtcttcttttgctttcttattttgtcttctcacaatctgttcctatcaatcacacagataataatcctcagcttctctctcgctggatttcaacattcttccactcatcgcttctctttaccaaatcaaactcaacacttcactcaactcttatcggaccttccaaactatatccttca

SEQ ID NO: 9085 - DNA, 3000 bp, Unknown
  misc_feature (1)..( 3000): cDNA_ID_2180145_gDNA_ID_1971979_Annot_ID_177654 3000 nt of promoter + ATG
aagatctgtagtcagtttccatctatgaacagtgagaaaccaagtagatttacatgatctttagtgatttgaaagacattttatgacacaagaaattgggatatgaaagacattttttgctatgggatgatgatctttagtctatttcatatgtggacaatgaagtaacaagtagattaagagaaactaaagtgacatttagaacacccgaaattggattgaagttatctcaaagttaattaacttctccatctttctttgactacctttctatgagtctgttttgttaatacactaaacacatattacaccacagctttctttgactacctttctataagtctgttttgttaatacactaaacacatattacaccaattactttatctcaatacacttaatccaaactttattttcaaacaaaattataagtgaacccctcatgtttctaccattgaacacgtttcttaacaactcttcaaaagtttctcaatattgaaatatcaaaaaatttaaagtaaaaaattggtgagagcccatggactatcaatggatatgttaaaatctcatcaaaacaaacatcgaacatacgttaacattgaatttctgataaaattatcgatgttctccaaatatcttagtgatagtagacactttagatttcaagtacccgttaaaaggatagagtaacgtactcaatagaaaactaattaattagtactatatttggataattttttgtccatccagccatatcccttacgtggaatcaatgctcacaactgtttcgttagaagataacaccgacattgactaatgatgttggatttagtgtacgagctatggaagtggaaagcagcacgaagttcgcagaaccttgttctttattattattgtgaatccaagatccgaccttgtacgtcgacccttttttcttactttatactagtaataatgtttttgatgcataaatcatcacaacaagacaaacctttctcagattttgtgaactgcaagagacaacctttgttcgctatatgggagaccatagcagagatatactcacatatttatatattatcttttgttttttctttcccattatcgatgccagagataaatgagcagataaagtcatatttctacacggtccgcatcaatagtccaaatcacacatttccataatccattatcttttcatagaattttcttcaactctttatgtcaaaacaataataaatattatagagttgaaagaaagtatctaaatacattgcttatttttctaataatccatatttctatcaataaaatactatcgtatcaagtaataaataaatacaaaaacttagaatctatattatttataaaggatagtaataccttgcttacatatcattaggaaatgcattaacttaaaaacgatcgtaaaaaaaggtaatacaaaaatatgtaaactataactcaccaagcaaaaaaaaaaatatttgggtttatctttaggggtgaacctttatattctcctccttaagagaaggcgaatgaaaaaggttcatccctaaagatcaaaatggactatccaacacttctgcgtaataattctacaagaggtaatattattaccggaatagcatcaaatacatatgttacaatttttactgcccaataaggcaataacctatttgatcctaatgtaaagaataacttgttacaccaaaagatgcggtcaatacacccaaaaccacatcagtaaccgaaattaattcgtgaggtttactaaaatcttactaaaatcttatttaaagtttttagtaagatttttccaagagcattttatgaatgagtatgaaacgatatattgcatacggcataatacccaacattgcatgagtatgatgcaatttaaaagtacatctcttcatatcaaacttggactgacgactaatgaatgatggatgactctctttgtcttaacttaactcataaacagttaaacttactaataattaactttattacttgaaaagtaccaaacatgccattttcattttgttttcgtttttttgtttatcacaatttctcgctttataacataaattcggaaccacaaccaactgtattaagttttttttttgtttttatcggtttctgtttggttacatttctactcttaccagtaggacattatatgtaatctctcattaaatgttatttttatcgtattatcattttactatttcttaggaaaactctccttgggatatgaggctaccctcaacaggaaatgatttcagttaagatcataatagcttgaatcgtcaaccaacaaaaagttgattgtggcaagggaaaaatcaaaaggttccgtaatataggatggtgatttatgaaataatgagtagtttttaaaaaaaaaagactctagtggtgagtggtttaaaatagattgagatggtggacaaaaagtatggctgatttttgtaatggttagttttagagtctttctttattcattggttaacaaattatattgcatcttgcaaaaaccacgaggggttctatataccaaaatgacaagtgggttgctttatatgattacacaccgtccaccaaatgcaaattaaaaaaattatttgttctatataaattcagtatttccaaagacaacggtgtctaaatctcagcttcgtttcccatcttttaatcaccatctctatcttctttctccagcatcatcagagaggaaagtttccttcaacattcatcagaggttagatctttcttcaacactactaacttccgtcagacttgctttatatatattatataaatcaccttagaaacgttatataagcatattgttttaacattgttgtcatcctacaacaaaagaaaaaaaatatatctaaaggataaggtaatggttttaatggtatgacaatggaagttaaactatatacacttatttcagttcatagagaatcaaatcagtttgcgatg

SEQ ID NO: 9086 - DNA, 3000 bp, Unknown
  misc_feature (1)..( 3000): cDNA_ID_3044527_gDNA_ID_1971979_Annot_ID_177668 3000 nt of promoter + ATG
taagaaattcttaagtattacaacccttaccttcattctaacgagaacacaaagcaataacgaacacaataacaattagatgattcattttttggatctagaatatttcttaaagtacaatgaatccaaaagcttaatgttcataagccaacaaataaatttgaacaaaaatataaaccaaaaatgaacctatggcgggaggagcatttcctgtcgaaaactaaggttaatcagtaatataatgatcaatcctttctctctctcaaactaagattcaaaaagctccaatggagtaacctgaaagacaagaagcgcataagaaaattggttgaggaaatgaatcataagaagtaaatcgattagacagaccattatagagattctgcgactatctcttaaacaaaccaacgtcttaaatctctaaactcacacttaaacaatatgaaaacaacctctccaatactctgataacaaaccatgcctcaaaatcgtgttgcttgtattctacggaacaggcattatactattataagatcaaaatatattgaacaaaatctcgcagcttaatttaatacttaaaaaatcacaggtcaataagatatacaagagggattaccaatatcacgcttaccattccaatgacatgtggtcaagtcttaagatcgagattcacattgatatcagatctctttattttgttaattaaggtctatatcatggagtatctcttttaccgacagagagttgattaagcctgtcatgggaatataaaatgataattgtcatgctgtaattacggacaccactaactatgcaagaaaaaacacgtttgaaaatgaatagaaatgaaatcagacctcgagtcgacgacacttcagtcacttctctcattcaacaaaacaccatgaactcttgttccttccctctcttcctctttgttatctttctccggtgtttaagttccacgggagctgccacatgtcatcctgatgacaaagcgggtcttttagctttcaaatcgggtataacccaagatccttcgggtattctcagctcatggcagaaagatattgactgctgctcctggtacggtatcttttgcctccctacgattcatggcgaccgcgtcaccatgatggcattagacggaaatacggatgttggtgaaacctttctctccggcactatctcaccgttgctcgccaaactccatcacctcaacgagattcgcctcaccaatcttcgaaagatcactggatcttttccccacttcctcttcaaattaccaaagctaaggactgtttacttagagaataaccgtctctctggtccccttcctgccaacatcggtgcactaagtaatttggaaattttgagtgtggcgggaaaccggttcagcggttcgatcccaagttcgatgtctaagttaactagcttactccaactcaagctcaacggtaaccgcctttctggcatcttcccagacatattcaaatccatgcggcaacttcgatttcttgatctctccagcaacagattctctggaaaccttccttcatcgattgcatctcttgcaccgactctttctacccttgaggtgggccataacaagctatcggggactatcccggactatttatcgagattcgagcttctctccgcattaaatctctctaggaatgggtacacaggggtcgtgccgatgagttttgccaatctgaccaacattatctttcttgatctctcccacaatctgcttaccggtccattccctgtcttgaactcattaggcatcgaatatctacatctttcgtacaaccgatttcaccttgaaacaatccccgaatgggtgaccttgtcgaagttcatctactcattgaagcttgcaaaatgtgggatcaaaatgagcttagaccattggatgccagcagacacctctttctaccatcacattgatttttcggaaaacgagatctcagggagtccaataaggttttttaaccagatggattttatggtggagttccatgcaccggggaacaaactccagttcgacttggggaagctaaagtttggaatcttcttgaaaaccctggatttgtcaaggaacttggtatttgggaaggtaccggtgacggtgaccagactgcagacactaaacttgagtcaaaaccatctttgcggaaagcttccatcgacaaagttcccggctagtgcttttgtcgataacaagtgtctttgcggctttccactttctccttgtaaagcttagggacaagaaaagcacagttttgtatttggatttattatgacacgtagctccaaataaaatttgtgtgactataataaagtgatttaaagatcccaatgccaataagctccattacaactatagtgaatgttagtgaaagtatgatttcaacccttatgcactatttccatgcagtcgttatgttggtacaaaattgaggatctgaaggcatttgaaaggtcaccaaacagtctctctgagaaacatgaagcgaagaaattcatatttagtcaatagaaccactgagccggacaatgattacctcaacatgatacgaaatgattaaatttaatgagtagtagtagtattctaatacaaatgttccgatttatgtaacgttggcttgtattaatgatgcatatgttatgcttgagtgttcttataaatttggtcgaacacttgaaatgtaaacggatcagatcttgtatttaattgtgcatgggctaaattaaatacttctcttttaccttttttgccaatgaaaagttgaataatagtaaggtccgataggcccattaaaaagcccacaaaccctttaatcagctatattcccattccactgctcccaagtcgtcaccaccacttcccgtcctctctccagtcactgtttccgaagccctaaagttttcaaggtcgccgattaaatcaccaaaggaggcgtttttatactattcccggttcaacacatg

SEQ ID NO: 9087 - DNA, 3000 bp, Unknown
  misc_feature (1)..( 3000): cDNA_ID_2180167_gDNA_ID_1971979_Annot_ID_177660 3000 nt of promoter + ATG
ggtatgtgtgtgagtaattggtttaaatgttatataaatagttgagatatttttaaaaatcgaattgattatgtgctgattttttggtaagatttcaatatcattaaaaaacctataacgcaataaatcatgaggaaagatttacacataattcaaattaggaatatgcttgaatatcattagtctatactcgtaaatctgtttctatatttggatttttatttgatacgggggtgcaaaaatatcggagaatatataatcaaataattctagatatggttagttaggattgattttcgaattttgctaattaggaaataagcattcattaattcggtagagttttaggaattgatttgtgcaatttatgagggtagtacttaacaatttatatgtttaggcaagtaattagtgcaatatgttaattgttaagcaaaaatttggtgattgttctaaagaaaatatcttgtctgattgattttgtagagactaaacatacaatatcgaaattgaaaaatgatttttcgacacaaatcgtccccaaaaatgtatatgtagattatgtcatatttgtcattatttatatatgcgattcgcatatatgacaaattcatataattgttttctgacaatttcatggcatcatctaggattcgagatcctcaaattctaaccaacaatgatttagcatcgtttaaaaacaaccaaataagccacacatctagctttttcaacacacgaacatctttcctctttgtggagtcgaacctagggttcgtttgggaggcgccatgaaacgcaagaacgatgagaaaggcacaaccctaagtaaaacttagattcgctccctctggatctaaaggatggctatatttactatattacctatcaagtcttcttttcttctttggtatacccaattttgagatgctgtccttctgtgagctttagtttccattcagggtcttgcgcttatttccatggcattctcgttattgaagctgaaggtcggttgatgatgtataaccctagaaccgagcaattcattaagttacctagaaccgctacttttgttggttacgatccgattgatgatcagtacaaaggataatggggatgatcgtagtggtcatctaaagcacaaggtgttaacattaggaggtgttcaaggatggagacacattaaaaatacctatttaccttagagaaggatataaccgaatgtatgcatcaacggttttctctactatggtattttaatacaaccaaatgttagatctgagaaactaagttttatcaatgcacctgctgttgtcctgcaatgggggaaggacgaaatattcatagaaatatagaatagaaagggaacctagcttccattgtgagaaacccttatggagctgtctctagttgtaatttatggagtagaagacgtcaagaaacacatgaatggtcaaaacaaaaatgtgtgtttcccaaatctgtgtgggattcttatgagtctggtcgaatatcttttccaggtaccaacaaggctggtgagatcattatagctccacgtttgttgtcacgcaatgttggaccacataatctactacaatgttgaaacaaaaaacttaagaagagttagggtcctagggattggagacgataaaaaggcgctcttatgtatttggaagaagcttgattgttttgtgacttttgtccataccggccgcacatcaacacgccgagagtattaccgtttttaaggatcctataatttaacttgattccaaggatcctagtgtgcgaaagcatgtaaaactctgcggtatatttatttgtacttttattttcaatatgtaagtgacaaattttaccgctggattgcattgacaagacacaccgacttttattgacaagaataaagacaatgagtcgttctttaggatatttaataaattttagtcaccaaattaaatttcctacaagtgctactttgccaaatagattgatatattaactagtacaaaaacagttttcgtagaaatttggaagctaatttcctatgagaattgatgtaagaacatcgtaggaaattaagtttgttgtaaaaaactggtagaaaaaggaaaggaaaaagtctcgtaagaatttcactggaaatcgctgtttttctgtagtgtactaagactttgtcctctatattttgggtagccaaaaaggagttgtagagccgttcccatgcgcttatgaaacataggaacgatcttgcgaaggtcatcaccaacatcgtcgcaggcggtgccaccaggttcatcaccgaactcagcagaacaaccatttcttcttctagctcttcccgctactctgatctttcttttgaaaataaaatttcaccttctttttttcttgttgcatagataaaaaattcagagatatataggatgagataatcaaagcgttgaagaaagtaagagggttttagtagaaaaacgtaaaaatgatacatagtatctgtctttacgaaggaaaacaaaatgcgtttagttttgtcgtataaatgctccaaaccatgtttgcatgcatagtagtgttcagaaccacgtgtttgtgtttctctttgtttgaaattttttaattcaaacatcgagattctacttaaattgggagaatcaatcccattaattctacgtaattaatttcacatggttaatttttctgaaaaacaatttttctataagtaaattgttagctgcacactgggataaagcaatcaggagtaacgtgattgtgtagattccctataggtaaatgaaccttatcattttccctcgcatttttttcggatctcatgtgcacgacgatgccatttaattttttgaccacttttaaatccgtcaataaatgttacatgactgggattccaatgatgtgtatttaaagcgtgaccacaaggtacagatgagaaagctttaggaaaaaaaaaatcaaatacagaagagaaacaaaaaaatg

SEQ ID NO: 9088 - DNA, 3000 bp, Unknown
  misc_feature (1)..( 3000): cDNA_ID_1989400_gDNA_ID_1971984_Annot_ID_58728 3000 nt of promoter + ATG
tagcaaacaatctcactaattctccctgcataatcaaaagaacatcttttgagacaactgactcattaaagctatagatacccgagaaatcccggtattttacctgacgaccttgatcatccattggaatacactcaacagcaatcagtttatctacatcatccgcagttacaatatactctggatgggtggctcctgcatatgtttaaaccatagtccagtttttaaatagctgaaaaaagctggtaagacaaataaatcaaatcttaccctcgatgtattgtcttgtgccatcttcaagatgccgaacccacttttcaagaagaaacaacaaaccgggaattttttaaaatttttcatccactaagtttgttttcaaaaactcttactaccaaaagatttacaaagattatacctgaaacatacagagagtggttcctcgcactggaaacccacaaccaagaactttttctccaggtatagcatctccaataatctgaaatccatcgattccaggtccctctgtttaagattccaacgtcagattaagatttctaacgtatagccactaggctctaagaaaacgaacaaacacttctcaaccttcataaacatgagaagcaaactcttcattcccattataagcatcaaacatggaagaattctcagctttttcttctctttcttgaatcatttccttccccgccacactactaagaggatatccaaaattttccctacaagtgagcataatgaagcaggcattcatcaccgtgaaagaacttcatcggtaaaaactgaaatcaatgaaaagtttgggaggattgagaaacgataccgtaccttttcggctgcgggaaaattccttgagatccaccaccaatctgattattaaatctcaaactttcagtgtcttgcataatgttatgatacgggtttctcgtaacattttccattggtggcaagagttgttcattggtctgataatcattaccacgatcctgtatcaagggtagcatatgaaaacagaaagtaagatttcttctgaaaagatgtcacacattttgtaaaaggtcttaaagagcaaatgataattaatttagcaaattacttgctgagactaccgtggatccataagaagcttgagtttttgaatttctgggatcatggttgtctttactaataaaatctgttcccggttggttttccacaatagatgataactctctaatcctatcctgtgatttaaaaatttcgtcacaacatgttcgaaaggaatccatgaagagtattcacattccagcagaggtctaataaggccaaaggacatatgcagacaacagtaatccaaggaaatgtgtataaacactaaaattaagaatttctagcggttgttcgattgggaaactacaggatagagagcttacattgcaagctttagtcttccattgcaactgatcatgcaagtgctgcatacaaagaaatatggtatatatgttgagattgtttagagtataaatttgaagaaagatgaagtgaaaaacaaatacctttatgccgctggatatagcggtagcattagcaacacgaggccaaacaccatactcagctaataaaccaagtaaggacgtcatgaatatatacctctcgtcttctgtaacctaaagatagaaagtgagagaaataaagacggaaaggtaaaaggcaatcaaatatttgaggttactacataatttgaggcaagacaattcacctttaaatcatgtgccaacttcaaattttcttcaagatcaccttttctacgagccaactcattcaacgcagacgtaacagattcattttgtttctcatcaattgcctaaggaaataagaaactgttagtcaaacaaacccagaagccaaagatgaagactttcaattccatgaatcaatctttatagaaaagcaaaagacaaaccactcgaagatcagcacattttctctctagtccatacttctcattcagcagctgcatatcctgtaaccaaaagatgcaatttcactctcaagttgattagaaagattcatatgagcgagcatcatgttctcataatagtatataccttcaaacaagcagcagcaattcgttcctggagactatgaatctcctcttcttgtgatctcactttcgcataaagtgcctgaattttcaaaagctaatctaagtttgattcaagaactagaaatcataagattcttaaatcagcaccagtaccatttcttcaggatcttgtattaacttagtattagtatcttctagcttcctcgacgcaatagtatctttctcaatctcatgcctataagagagacagatcgaagaacaagccactaaatattcaacaacactgcttcaaaatcaaacgctttgtttgtgggtttaaggcaaaacagcgataccttttgattgattcagaactccgattatcatccatcgtgtttaagtcgtaaaacgaagctcgactttaaggtcatcggatttccaaagtctatgatttttgtttttttttgtttctctatttcatctatgagaaaactttaatcagcagtcaattttcatctccacgaaacaaagtgaatatttctataaagcccctaaacttaactattgttttcacgatagaccatcaactaccaaaattacaaaatagtcttccatctaactcaaacctcaatattgttgactttgatctaaaatacttataacaatcagattaatgacaaatcaaaattttcgacccaaaacataatttatactcctaatttgtaaattacaccaaaaaagtttaattataaaaaaaccagaatcaattagacaaatttcgttggtaaaccgtccggtacaagatttttagtcatccaaaaggtcgattcgccgatctagaagacgacgacgacgactaccaaacactccgatcaacggtcctccgattctctctcgctttcgtggcgacctcaaaaatg

SEQ ID NO: 9089 - DNA, 3000 bp, Unknown
  misc_feature (1)..( 3000): cDNA_ID_1989399_gDNA_ID_1971984_Annot_ID_58729 3000 nt of promoter + ATG
gaagagaaagaagtatcaagcaagtgatgaagctttatctctacctaccgtttccatatcagaggcggaaatctcacttaacaagcaaaacgcttggactggtgacgtgagaaaaatggtgaaaaggctaccactaggttgacgagagaaatcagcagagataagcggaggagtatgtgatggagacagaagtaacgcggctggttctcctttctccgctccacaaatattcttcacagttcaaggaaagaaatattcatatcttctcaatttactaaacataggtatcaaatgaattttaacataagaatgatggaatcaggtgtacttactttaaaaactgtgctgctatcactgtcaatgattatgaaaagaggtttccttgtaaatggaactaaatcagagggatatatgtagcttgatcctgagggaaagacagttcagagagacttcaggaaatagcaaattctagataaactataatgacaaaagtatatgttgccattagttgtttatgaatgtctggaaatttcggtgttgttttccttcagatgtgaaacatatttagttggattatttacagaggtccaattttaacaaagatttttctcttacaagtatcctccctctgccctctagaagataacaaggtttgatactacttagtggatcctatctctacatgcatatagccaaatatgatagtcttagatggatttttacataaaagtttcaagaactctagagtggatacctgtgagcccatgactgccaaaagacaaaccacatggggtactgactgcgtcctcactgatttgcctcaaagactgaccagatggcgtaatttgaagtgatggttctgtctcttgtttgattgtgtgagattcaaagtctctcaagatattctcctcaacactggttgcacttctagcactcaagggagatgatgaaatctgtccaatcttgcctgaataaaaatgtaaatgtttgaagcgaaggaactcaatattccaaagagaagaagcataataccagacttaaactacacacattaccagaagcagacagatataataaaagaatgccatgagaaggaagctcctcacaaatggtggccaaaacctaccaaataaaaacagggttaacagaatgaagttccatagagccaataattccagttagacaagtaaaaaaccaaaaatcgacttacagccaaaaaatgtgttatggatggacgataaaggacagctttgcgagggttaggtggcaaagtaggatcattcatgctctgggagttaatacgagcaactccaacgggagcattctgacccattttagcaccagttgattgatatagtgaaccactcggttcccactctaagcattgaagcatcctaaaagaatcgagcgtgagctccgaatacttgacctggtggaaatcatacagcaagttttcaaatttcagagggtaagatattaaatatgcgttcatactaaacatgaacaagtaaaaaattacctcgttacagtaataactgctcaagatagcatccgtcaaccttaaagacctacttgcacgcggagtaccagcatccagattaggatccaatacaagactgtatcttagaggtctaatgttcatgaatgcagtgtccgatttcagaaatctaactatttcctgcgccaccaccttccattccttaaaatcggtttcctgataacatgaaaagttgtttatgtaacaccgaaaaaaaaaaaatagatagagacgggatctcttgtaaggcaggcaacctaattgttatcattgttccactaaaacagttacacctaaagatggagagaatagggtatcagaagaaaacctggaatgtcctcttgcattcatcaatcaaccgtttaaactgatcaacgagttgatgcaccatctcacggcggccaagaaccaaacacaccataagaaaccttgcaagaaaccgaagctgcttgtttgcaatattgagatcctgaaacaatccatctttgaagtactccctagtgagtattgcttcgtagaatacataggactcggataagtaaccagcatcacttgttcgcatataatgtccatagtaaagctgggcaatgcgagaagcgatctctccaatctcccatctcttaagtccagcttcaacaagcttctgcctattctcttgctgaaacttccatagttgtgtgtatactttgaataccttgaagaaatagttctcatacctatgaacaattccatcaacaacaatcggaatcaatatctaccaactctctaatcaacaattctaggtacggttatctcaggggaatgggaagaggtacctggagcgttcatagaagggcaagtctctgatcttggagaatttcttatcggctttgttaacgagagaccagtaaacttcactcagcgggatattattattaccgctgatttgctgcgacatttttgaggtcgccacgaaagcgagagagaatcggaggaccgttgatcggagtgtttggtagtcgtcgtcgtcgtcttctagatcggcgaatcgaccttttggatgactaaaaatcttgtaccggacggtttaccaacgaaatttgtctaattgattctggtttttttataattaaacttttttggtgtaatttacaaattaggagtataaattatgttttgggtcgaaaattttgatttgtcattaatctgattgttataagtattttagatcaaagtcaacaatattgaggtttgagttagatggaagactattttgtaattttggtagttgatggtctatcgtgaaaacaatagttaagtttaggggctttatagaaatattcactttgtttcgtggagatgaaaattgactgctgattaaagttttctcatagatgaaatagagaaacaaaaaaaaacaaaaatcatagactttggaaatccgatgaccttaaagtcgagcttcgttttacgacttaaacacg

SEQ ID NO: 9090 - DNA, 3000 bp, Unknown
  misc_feature (1)..( 3000): cDNA_ID_1989396_gDNA_ID_1971984_Annot_ID_58733 3000 nt of promoter + ATG
agtttaaccggctcggtgttagggttccgactttcttcatctctccttggattgagcctggcacaggtgaacataattactagtcataggcattaatcaaatttagtggtcttatattttctaatcaagatattaatgtttaaatcaaagtaaatgacaattttggtaaaatgtgtagttattcatgggccaaatgggccgtacccaaggtcacaatatgagcattcgtcaattcccgcaacggtcaagacaattttcaaactcaaagatttcttgtcaaagagagattcatgggctggcacttttgaatctgttattacgagagactcaccaagacaagattgccctggtaattacatttttttctttcatcttctctatcaatttaggtaggataatatcgactaaaacttcagttttttttctttaaatagaaacattatcaactccgattaaactaagagggacaatggcaaaagaaaatgcacaattaagcgaatttcaagaagatctcgttataatggctgcgggattaaaaggagactacaaaaacgaagaattaatccacaagctatgtaaagaaacttgcgttgcagatgcatccaaatacgttacaaatgcgtttgagaagtttctggaagagtcaagaaaggcaagagatagaggatgtgatgagaacgacatcgtttattgcgttgatgatgatgatgatcatgttgtgataccaccacaatcacattcagaagcatcaaatgctgctgctcaaccaaaaacgcaaacgtcttttttcaataagttattctcttgctttattcgccatgattgaaagagactaagagaataaatgttataataataatttgtagtcacttctcttgtgtgtgggtggaatttatttaagacaaaaaaaaagaaaaccttactagtctcttgcatatttaatttcgttgtataagaacttccacaattatttgcacatttgatattcttgtataaaaattatatgttagatgagatctactctaactagttatttgtttttcattttttcttgtcaacagctatattaaattgactaaaatgaactaataatgagagatattatttacatatgtaattatatgcgattagattcaaatttttcataccatgactgaaataaacatttaaagatttcgtgtgttcctttccactatcgttcttaccccgactcatcatgtacaattattgaatttgaattttcaagcataactcccataagacttttgatcaattctaagtctctgattcattgtagcatcacaaccctgtcacgattcaggttgagaagaaagtgcagttgtcacccctcctagagtccatattacgttaagaaacttgtgttgcagatgcttcctattacattacaaatgcgtttgagaagtttctagaggagtctagaaagcaagtgaaagaggatatgataaggacgacatcgttttttgcgtgtatgatgatgatgatgatcatgtcatactagcacaatcacattcgaacaacttgtagtaatttgtctgtgtatgtggaaattatttttgtcgtagaagaacttacacgattatttgtatatttaatcgtctttttttgttgttgttgtaaaagttgtatatttaatcttcttgtgtataaaagcaattatatcttagatgagatctactttaattattcgattggtgagtagattataccaaaagactaaaaactaattaaagtcactaaaggcaaccaatctagctactgggtcccaaattttaattgtaatgattataagaaatactgtactaactaacaccgtatgtatgcaacattctgtcataataccacatattattagttacgctatttaaacattagttagtacacagtaatcaacgaatgtatggttagttttttccctgaggaaaaactctatttaaaacgactcatgcggagacgtgctatagactatggttttagcaataataattggtcaacacctaattcaatctactccattgttattttcatagatagagagattaataagtaataatattcaatgtatatcgccaataaccttattaattttcttataataatggactaatggtagaaccgtagaaatagttatgagaagcacttgtatctatataaactttcattttggagaacgtttttcatatgcactaaataaaagatgagtaatttcttctgccacctcaccgaacgtgagagtaaacaaatgtgacgatatccaaaattcaccgtctatgttttatttatatgcaaagatcactgagttgattcgaatgtatatgattgatagtatatagaaaaatagttttttaatcttgaggcagagtttttaaggtgacaacaaaaaatgaaacaaggtgtattcaatcaaatatttaagtgtttttgtgttaaaataatagatctaatgttattaattatagatttttaaaagttttatgaaatctaatgttattaaatttgtgattttaaaatctacattaatttttttttattaaaaatattttaaaaattagatttaataattttaagagacttaaatgaattttagtgaatttccttaattaaaaaatacagaattttaagtctcatgattttaggtaaattttgagaaaattttataataaatcataacaacttccttaaattcacccaaattcttcaaaattatataaaaatttaaaataacttaaatcattcaaaatagaagattgaatacactcccgggcccaagagttttgcaaacaatcatatacatgtaaaagtttaagactataccatttatgtgatttactaatcatataaaataaattaaatacacatcgtttagttaccagtatataataaggctaccatttagacggacacagctaattatgagagatagacagagagggaaaacaactacacaagtcaaaatttctgttctaaaaaagtaaaagaagt

SEQ ID NO: 9091 - DNA, 3000 bp, Unknown
  misc_feature (1)..( 3000): cDNA_ID_1989394_gDNA_ID_1971984_Annot_ID_58735 3000 nt of promoter + ATG
gtagttatatagtattgcacattttacgtgtgttagtttggtattatactattatgagatttcttttgtctcgactctagaatgtattaaccttaaacaatagatataggtaaacacatcaatactccatgtagacacgattttttttttttccactaatcaaaataaaaggtgcaaaggaacgctttggcttaacttatttttaaagatgtgtattcagttgggaagaatgatattgtgtgattggctattatcatcgtaaggctttttgtgtgtgtgaaattccaatcataattgaaacagagcttttgagttttataacacaagagaaaaacaaacgacatataattcttgaagctgtttggccccatcacatgatacagcaatttggcgaggactccagcatctctggggatctgtagataaaataaacatgaaacattggttcattttcaggtaagggagatccaaacccaattgagaaaatgagatacagaggaggaaagaggaactcacatttggccaagacttgcgaaatcaaacccgggatcaatctctttaactatatcactcgggggttgtccacattcctgcatcttttgcatgatctccattatcttagatgaattgttaggttcattctcgtacactgcattgagttcttctattagtttgtactgttgtgaatatcgtttgtagtcttctttgcttagactggcttcattctcttttagccatttcggatatcttgcgccaagctccttcattggttcgtggagaatatccttcgacaatagctgttgcatcatcgtctcgactattgattccaagtcctagtatgcaaaaacaagatgagagtcaacagagcgacaaataccaagtagataatgagctctatataaccttaacatagcataaagaacaaattctaatcaatcagcgaccagttctatgaactcataaccttgaagatacaatagaagaactcacagatcggttccgcaatgaaacatcatccagcagaatgttctactaaaatctacttgtagtacagtaaaagacagcataatattttcaactgatgatcgaaagactaaactttcgagtttcaattcaattaagtagagacagattcagtttcacggtatattaccttagatccagcaagatcctcgaattgtttgagaaaatcctcaaccattccatcatcatcagaagcaggcagctgcttagaagaaatggattccaatcctttgacagtttccctagtttgttccctaagcttatcaagagcttcagcaacatgatcctctttggaaaccttttgttttcctctcttcttgcttctcatatctggtaatcccattccaagaccttgaactccactcggtaataaaaccgtctcttctttcctcttcttttcctcctcctcttgagcttccctttgatttctacaacaacacatcccaaaaacgattcagagctaaaacacagaaatctctaacttgggaattgaaagtctctaaactcaaatccaaaaaagtttgagactatggaggtaaacacataggaaaaaggagtaacctttgatgagaaagattgagatctttgaaatcatccaatgcacctgagacagacaaaaccacagaagataaaccccaaaattctcagagaatcaataaaaaccctaaaagacaaaacctttaaacaaacatgataaatgggcaggaacacaatttagatagaattcgagaaaacgccgatcaaattgtagagaagacttactatcgagaagctcgtccaagtcatcggtgtgactgttcgccattttccttaggcggttctcttcctctctatatctctgtgtaaacaattcgcagatgggacgacgaagaatatcagagagagagaggagagaaagatttgacagaagaagaaacctcttttgggtttgccttgtttcgacacagacggtgcgattgatttatatgatgacgcttcttttagttgcggtgaagccaaagtacacgatccaacggctgagatcactttatttttagccaaagtactcgacccaacggctgagatcactttgtttttattttatttatttttccaaaaggaaaaaaaaagatttttcaaaaaaaattgatcaaattttgcaacagaaacagaagagaagaacaagctaaccaaactataaatcagaattctgatgcagcattaaggtggtatcagcggcgttcaaggggaaatcatcagtgaacagtcgaaggatgatgtataaagaagccatatgggaggagcttcagaatgtggttcatgcccttgctcagatgaaaacagaacaaagcttacacaagtgtgactaaagcgattcgaatctttatttggtcgaaacttcaatgccaacaatgtgttacttcaatcttgcttccaattattctggagtaactgaagaaaatgtcagctaagaagatgtttctgccttcattgactctgtcttcagacaggtaacacttctattatcttgtacacatttcatctatttttggtcttcaggtggtctagaaaccaagacatgcctgcctttgtatgtgcgtttgacaaaacatatgacttgtactctttgttcttaataatatcacagatagagataactcttatttttattccttactctaatctgacacaagttaggttaatacgaaaagtatttgtttactgtagataatctattaaacacaaaggttagtcattttactcttcaagttcaagtaaatccagatcagagttttgtagcgtctcttaaacctcaaactatctcaaaagtcaactctttgtgttgatcatatgatcaaaccatatctttagggttaagctataaacacaggtacataacctatctatatatatatatctccatatactttaagaacctcaaagagaagaaagaagtcacagggatctgttagaaccaagaacctcacggtgaaaatg

SEQ ID NO: 9092 - DNA, 3000 bp, Unknown
  misc_feature (1)..( 3000): cDNA_ID_3044555_gDNA_ID_1971984_Annot_ID_58736 3000 nt of promoter + ATG
aagaaggtgaatagagacttatgatttctcaagaatgaagaagaagattgtagagtgttagtgtttagttctgttcttctggtaatctgtgttttttttaatgtaaattacacaagtatgcaaaacttttgtaaggggctactgttatatgatgtaatgggatttataagaaaaaatgtaaaaatcaaacatcataactgggtttacacaagacaataagaagaagatacaatgtatctgatacatagttacaacttctaccaagtaagcaacagaaacaacataattttggtattgaatgagtttttcttttgcaagtattaacacacaacagcagaaacagaagatgattgttcttttgtctctttgatcagagatgatggtacaattctgttgagagacaccatttttactggtctgtaagcaatttggaacctggataagaaaacaacctcacagaattcacataacttaactccgcaagctcttccttcttcatgtttgacaggttcgcaacataatctagtacctattcatcacggaaaagattagacaagtaatgagctgaaataagcaaaaagtcagatgatgataagaacatacagcaagaatgtttgcaggctcattgagagttggttttggatccgaagaactctcatctgattttggtaacccgtcaggtgaatccgtctccaataagagcctatcggaaggaatctttaccagaccaggtaaaaagaattcaatacattcgttttccagaagtttgtataattacagaggaaaaaagcaaaccgatttcaaagtcttcttggcaattttctcatcaatgtaagtgaaccagccagaaaaagagaagtatgcaccaagctcagcgagtttaggaacaacttcagctgaaccattgaatgaatgaagaatcaccccagcaggaaaaggccctatggatctgcgtgtatttattttgagaaacttagtgctatatctttgtaaatgcaacatgtagatatacatacctcattatctctaggagatcatcaaatgcatcgatgcaatgaactgctactggtttgttcagttcttttgcaagttcaagctgtgggcgaaacacgactagctggtctgagtaatcaattcctcctgctaagggacctttgtctaaaccaatctgcaaaacacacattaaattttatgaagatgttaatctaatgagatctcagccaaaaggggtttcattacaacatatcattttgcagtttacactaaatcttgaaccaacaaagcaaacatttcagaattcaaaaagaaattgaagacaaagattttagtttagatgaataagtgataaagacacaaacttctccaacagcagcagtaggagtggtctcaaagaacttcttcaatgttttaaaccaatgagggcttctatcagcaataaacctgcaaaccaaaacagagaaaagaaaaagaagaaactttgatctgaaacttttgtgcatcaattgcaaaaaggatcgtctgtacataaaacccatatataccaaggatggagtccaaagcaaggaacaacagaaggatacgtctctcccatctctttcaccaagttccaatctttctggctccattaacaaaacctcttaaaaatatgtatacgtttgtgtaatatagatgacagtgaccaagcgatcatgaaaatttgggaacaaacctcggaggttccattgactgcgaaattggtaacaccgacagctaaagcagcagatatgagctgcgaggctttgtcgatgaccctcttgtcttggaggtgacaatgagcatcaaacaacttcattttcaccgtgaggttcttggttctaacagatccctgtgacttctttcttctctttgaggttcttaaagtatatggagatatatatatatagataggttatgtacctgtgtttatagcttaaccctaaagatatggtttgatcatatgatcaacacaaagagttgacttttgagatagtttgaggtttaagagacgctacaaaactctgatctggatttacttgaacttgaagagtaaaatgactaacctttgtgtttaatagattatctacagtaaacaaatacttttcgtattaacctaacttgtgtcagattagagtaaggaataaaaataagagttatctctatctgtgatattattaagaacaaagagtacaagtcatatgttttgtcaaacgcacatacaaaggcaggcatgtcttggtttctagaccacctgaagaccaaaaatagatgaaatgtgtacaagataatagaagtgttacctgtctgaagacagagtcaatgaaggcagaaacatcttcttagctgacattttcttcagttactccagaataattggaagcaagattgaagtaacacattgttggcattgaagtttcgaccaaataaagattcgaatcgctttagtcacacttgtgtaagctttgttctgttttcatctgagcaagggcatgaaccacattctgaagctcctcccatatggcttctttatacatcatccttcgactgttcactgatgatttccccttgaacgccgctgataccaccttaatgctgcatcagaattctgatttatagtttggttagcttgttcttctcttctgtttctgttgcaaaatttgatcaattttttttgaaaaatctttttttttccttttggaaaaataaataaaataaaaacaaagtgatctcagccgttgggtcgagtactttggctaaaaataaagtgatctcagccgttggatcgtgtactttggcttcaccgcaactaaaagaagcgtcatcatataaatcaatcgcaccgtctgtgtcgaaacaaggcaaacccaaaagaggtttcttcttctgtcaaatctttctctcctctctctctctgatattcttcgtcgtcccatctgcgaattgtttacacagagatatagagaggaagagaaccgcctaaggaaa

SEQ ID NO: 9093 - DNA, 3000 bp, Unknown
  misc_feature (1)..( 3000): cDNA_ID_2180069_gDNA_ID_1971984_Annot_ID_58738 3000 nt of promoter + ATG
ttagagaagaatgaaacagagtttagtttgatgtaaaaggagttacgtgtaggtcacgcgattgaaatgctgtggatttatcttcgcactccgcttcaaccataccatgaccgatggagccggcctgtcgctctttctgaaatcactatgcgagttggcgtgtgggcttcacgcaccctcggttccacccgtatggaaccgacacttgttgactgtgagtgcttcggaggcgcgtgtgacccacacacaccgtgagtacgatgatcaggtgggaatcgatgtggtcgccactggacaccctttggttagccggtctttctttttcagagcagaagagatctccgctataaggaaactccttccgcctgatctacacaatacctcatttgaagctttgtcgtcatttttgtggcgttgtcggactattgcgttgaatcctgaccccaacactgagatgcgtctaacttgcatcatcaactcgcgttccaagcttagaaacccaccgctagagcctggttactacggaaatgtgtttgtcattcccgcggcaatagcgacagcaagagatctaatagagaaaccgcttgagtttgctttgaggttgatacaagaaacgaagtcaagtgtaaccgaggactacgtccgttcagtgaccgccctaatggcgactagaggccggcctatgtttgtggcatcagggaactacataatatcggacttgagacattttgatttaggaaaaattgattttggaccgtggggtaagccagtgtacggtggaaccgctaaggccggtatcgcgcttttcccgggagtgagcttctacgtgccgtttaagaataaaaaaggtgagacaggtacagttgtggcgattagcttgccggtacgggcgatggagacgttcgtagcagagctaaatggagtgctaaatgtgtctaaaggatgagagcttagtcgagactcgagacgttattagtaatgtagtaaatagttccttttcttattcgacatcatagtgtagtaactaatatttatatcattgcatctttcaacgattttttgtttttctgaaaaaatgcatatatcaatgaccaatcaaactctttagctcttttgaatattttttatgttttggtagacggaggtgaattttgtagagctttcacgatcgtagaaaacctacaaaatttcttcactatcacgtggcgacttcagtgacaagtttcattagtttgaatttttcatatttatcaatactaacttgttcgtatatttacgcaaatactttccatacctaaatttttttatagacacacatattttggtcataaaatcaaataaaaatcttatgatataatataattgatttgcgggtaaaaataatctctaaattaagggtgatatttttacgaagcttgtaacaataactttttccataagtgtgtttatttttagttttttatcgatcatgctcaaaattattccagcctataatataatttttgaggataaatgactagaagaggtttattctcacaagtcacaatccactgattgtcaattggttttcaaagacacatagaatttaaaggttaaataattgcataccaccaagacagtcttcttagcggctccaattggttttgatctcatggataggatcgtgacaatcacaagaacttatcatctattaatagtcctcccaatacatttgggaaatttcttggatctgaatacgctcatggaaaaatattagtggctttgtgccacaagatagacgactatctaaaccaaattatggaacattgttatcaacgacgataaaaataaatgaaaacaatgaaaaagcatgccaaaaaaattgaacgaagacacttaagctacaaacttacaaagtaactgaaattgttaagctctggatttattacacgattaaaagaaaacaaaactagaagcagcaacgtacacgatactacttttatattttctgtcacttgtcaatttccttacactcccattcgagtatttttttgtgtggataatatatttatttttgttaacgtgaaactaaaaatttaatactagatttataacaaattacacgatagctagctaatcaaaactcacaactagtaaaaaaaaataaaaataataataataataataataataataataataataataataatgagagttaaattgttcatttttcattttaaaaaagatacgcttatacgaaacagagtgtgcataaggctatatacatcggttgattgaataaatattgtatattttaattgaattcagataaagtattaaattttaatttaaaaaaataaaatcaaccatttctggaaaaacacatggtcagaaacgtctatcagagtttttgaaaatatggacgattctgacttttctctattctttttaattactttgtattattttaataataagtatcttactgatgaaggtgccctaaacacatcgaacagttctgaaaaccattatcggtcggctgccaacaaaaacgttaagtaatttatagattatagacctacgacataatgtttgtttagcttgtttttttaccgtgttcgtatatatgcgtatttctcttcttcttttaaatgtttttttcgatttttgtttgatgatgacaccacaactcgttgcgtggaccaaaataaacaagtgtacagagatatctacatcaaagtcatgcgatattagatcaatggtctagaaaatatcaattaaaaaagtttccaaacatcatagtactacttgacgtttaactatcaaacgaatccaaatctagatagctccgtaaaaaagaaagaaaaaaaacgttctctcgtttctttctattattcaaaatattttcaccaactaaaaaaagatacatcgaaacaaatctctctaatcatatctaagttataacttttctttataaacaataaacaatagctttgatttgaagcaagaggagcaaca

SEQ ID NO: 9094 - DNA, 3000 bp, Unknown
  misc_feature (1)..( 3000): cDNA_ID_1989391_gDNA_ID_1971984_Annot_ID_58741 3000 nt of promoter + ATG
tgattagctcactctgtaatttgagatattcatggaaaaagttttaattatttcgtgtaatctagggtttagggttttggaatcacttgagggtttaaggagtttaggatgttaaatcacttgtttgatttgctttggttatattggtctgactttgaatgttgtttgattagacccaatagtgaagtttctgatggagcaaatggagaaatctgggtgtagagttggtgataatttcgttaaggctgttgtttgtactggacctgtagctggaggttacactaaaggaagaggggtaaaaccatttccatgtttccttttttcgagctctttgatgattgtcccttgatgctgaaatcttgctttgtttccttttgttttctatgtttcaagataactgtctgcagtaactatctgaccattcaagatgaagtgaaccaagtagttatacatgagttgattcatgcttatgacgagtgccgagccaagaatttggattggactaattgtgctcatcatgcttgcagcgaggtgattacaatattagatcaaacctttgatatactcttgtcaaagtacttgataggttttggtgtgtgtgttttctttaacagattcgtgcaggtcatctaagcggtgattgccatttcaagagagaacttttgcgcggtttcattaaattaagagggcatgaacaagtaagtctctttaaggataagagttgtgttagctagttcattttgtagaatcatggatgattcttgttaataataacctgattctcggtttttcaaaaaggaatgtataaaaagaagagtgttgaaatcacttcgtggcaacccgtattgctcggaagtagctgctaaagacgcgatggaagcagtgtgggatacttgttacaatgacactaagccttttgatagagctccttgaaggtaataagtctatttacactctcaaaagacttatgtttgcttcaaagttatgagttcaacttcatctttgaagatcgacataaagccagaaaaaaaactgttggattcagccgttgattatccccccatgtatttctctcaatccaacctttttggccaagtcaaacgatagagtatttgtttagattctttacattgttgtttgaaacaaaggaaaaggtctaatacacaatcttgatttcaagtggattttgcttgaaagtataattttgatttatggatttgtattttacatcacactctggagtctggagggataagtagctctgaatctaacagtgtaatagaaagttgatactttagggacagagtaaaatcatatcatatttgaagaaaatttattgatcgacttatgcattactatattgttatgaataaacttcttttaagcagaaaagttaacaatgttttaccaattgattatcacaatcagttttagaatccaagttgatttcagttatgcataataaaataaaatatgggtttgagctgaaaatgatagaaaggtaaaaaaatgttaacttatatcgtcaaatattgatcaacttctttcactattttgttcttgttgtaacaacaaccaccaaaaaaacaagtttgtattgacagttaatgaaagaccaagtcaaattctaattttggtaattcggttttctcattaaatcgcctaatttaaagcatagcctcaacttcttcacattcaaatctctttatataacacttatgatcatctgatctctccgacaaaaagaacaaaactacaaagtacaaacaatggctgacgcaacagaaaaagctgagcatgaccgtattttcaagaaatttgatgctaatggagatggaaaaatctcagcggccgagcttggagatgctctcaagaaccttggctcggtcacacacgaggacattaagcgtatgatggcagagattgataccgatggcgatggatacatctcgtaccaagaattcattgatttcgcaagtgccaatcgtggtcttatgaaagacgttgccaagattttctaaagtaaaatgaacagatctaatctatatttatatgaaagggtttgagaattaatcgtgttcaatttgttttgtaatgacaatcatttgatgaagtatgtttttttttctttatgtctttattttcatgtaatggaagatcttggattattcttgaagtggattgtaacgatgtattgaagaattctccattctttagcttttttttttttttttttttttttgcggttttggctgatctaattttatgctttagcgtggttaaaagctcaagagcttaaaaccaaaaacaaaaaatgctcaagagcttctttggttctatacaagaatgtgttgaccaagaccattagggatgaatacgaataactaaagtgtagtcattgacataaatcaaaatataggaaactcttataaagaaaatcaaaattgtatttagctctttaagtttacacgcttttagcatttaaattatttagctaaaagatctcccccatattattgtttctaaatatagctacacataagataaagaccctataacaaagaatggttggtaattgatcttgatatcgaggaccaaacatatattacttaaataatcgaataaaatctctcaaatagctttgggccatcttacatcatttcttcaaaaaaaaatatctttttacaactaaaagttaaaaacaagagaaattgaagccatccccttaaaaagtctttcaacccaaattctcttgttgatttgtattgttttcatacaatttgctctatacaattataaccaaaaagcatatgaaaaaagacttcctaaataaaatatattttttagtcacaaatacataagtacatatattgccactcgtgtgtagtataaatatacacgtactatgtaaccgttggccaacgccttaatcctacgtctctctctctctctttctctttctctttctcaagcagatcttttcttctttctcctgaaatg

SEQ ID NO: 9095 - DNA, 3000 bp, Unknown
  misc_feature (1)..( 3000): cDNA_ID_2180096_gDNA_ID_1971984_Annot_ID_177700 3000 nt of promoter + ATG
atcacaagtgaaaatttacagctactcctgagttttaataagcttcatatgttgattcgctatgttttttcatttacattttattgttgaaaatagcacaatcaattacaaaaactaacagttagtttacaatcatctgtgcatggtttcagttctgtcagaagggaatcaaggttaccgtcgtttgtcctggtccaatagaaacctggaatggtacaggaacatcaacttcggaagacagcaagtctcctgaggttggtacttattatgattgtgattatttgattaagttgtgagcagcaagtacttctcccattgcttgattcattatttccttgtagatacacgtagaatcatattctttgtcaacatttggagattctaacttcagctccttgctcaacttgatttctctcaagcatctattctctttgctacgcagaaacgtgtgtcatctgaacgatgtgcagagctgactataatcgctgcatctcataacttgaaggaagcttggatttcatatcaggtacatctttataaatattgcatatgtgatactcggtttagatgtctgatatataagtttctttttcactgtttttcagccagtactactcgtgatgtatctagtgcagtacatgccttcccttggcttctggctcatggacaaggtactttgctcatccattaattttcttcaaaagttaccggtatgagatgtcgttttgtttccattataatgtgacaaacacatctgacaaagagaaaacaggggcagttattactctgttgaaagcagtcttttgattaaaatgaacggcttgcaggttggaggaaagcgtgtggaggtcgcggaaaagaaaggcaacacatactcgtgggatttactgttcgggaagaagactaaaacaaactgaagctgattctctagaagatacacatagatgtggttggttgagccttagtccgtaaatgtggttggtgtttgtttgctagtttgattgttaaataactaccaaagcgtcgaaaaatgttttgttgccttgtgaggtgctcaataagtaagaaaagatgtgatcttctgtgatttagctactcgtacacacaaacaaacacaaatttaacatcatccgagtgtagagaaatcaaaacccttcaaattgagtagtttctctgcgcacaaaggttttcagatgcagctacgaggtaaccccagctgtgtattcatccaacaggcttttgatcccactggacttcagttcctacaaaagaagaaccgaaaagaaagctatatgatgcatacattgaagactaacgaaagcttctggagtttgacttgctgccagaaactcacagacaatactcctgccaaagctgcagaaggctgattagctggttttgcaacacgaatagctacaacaccgttcattctttccttctcttcagaataaaagtttcggtaaacttgaacacctgcagatagaacatcatttcaggttagaacaaagtccacatagcaaaagagacgctttccaaacgttctatgttatggtaaagatcttcaaaccttcttctatactttcaactccaggaagaactttggcaagaccctccactttcagcatttctgagaatgaagtataacggtgaacgtcctgccctcatcaaaatggttagtaacaagaggtatagtgtttgcctcacaaggaagaattgacagagatacaagattgatgactacctgaacttcaagcagcaagcatttattgaacaaaagaaaatctcctgaactaattctgtgagtaaaccaattttgaagtcaataagacaatctaaagctattggaatcagcaaaacagaaaacccggaaaagcaagcacaagagatgaatgtgaattaacatttgcacaaagataaaaacatcagacctcatgtagtctcccactgcgcatcttccttcaacagttttcaaaccatctgacaaattgagaggcacccggaaataaaagtgagattgagcaaatataattgtaatactacaatcaagtaaccagaaaatgtacctttcaattgggtgaagtaaggctcttggacatgaagctcaaagttcacctccttcaacatctgaaacaaagaaccttttctgtgtaaaaattccaaaaactaacttttcccactctgttttgatgcaataatagttgagaactaaagttttcatatagacttacatttattaagtcatatcccaagccatgaatcagtttgctgtatttttccaagttagaatttttatcaccctcggaagctagacattcagacaaagccgttgctagaagcttgtacaccgcagatttttctgttaattgaaacatttatgagaaaatttcagttatttctctccagcattcaagtttcataatttgcttcctaattagcaaaacgtacctgttgaatctgtagcttccccaaggagatgaagacaaaaatctctggtcaggtcaagatcgaaacttggaacagattcgtttaaatgagatctcagactaaaacggagaagtgattccatgcattctcggagatccaccgacttcgttcccggcgacattggttgctccattttcgtcaaaaacgccaacgttaagcctcttaattaagaaatattcgtgtaaaacaccctcaagtttgtagatattacaagatgttctaacccaatctgaaattggacagtaacaccttgatgtcgttttaaaacggaagatcagagatcagacgttgtcgtttgaagacggaagatcagagcgataagtcaggtatctagaaggtgacacgtgaggagcacgtgaagcttgcgtgtagacagtcacagtcacagatggcatattctcagaaatcctcattgttgactaatgtacctctgataagtcccacttaccattttctcctgaactctgtagaaagatccgaattgaatatttcggacccgaaacctgacccgctttg

SEQ ID NO: 9096 - DNA, 3000 bp, Unknown
  misc_feature (1)..( 3000): cDNA_ID_1008855_gDNA_ID_1971984_Annot_ID_177696 3000 nt of promoter + ATG
ctggctgaaaaacagtgaaaaagaaacttatatatcagacatctaaaccgagtatcacatatgcaatatttataaagatgtacctgatatgaaatccaagcttccttcaagttatgagatgcagcgattatagtcagctctgcacatcgttcagatgacacacgtttctgcgtagcaaagagaatagatgcttgagagaaatcaagttgagcaaggagctgaagttagaatctccaaatgttgacaaagaatatgattctacgtgtatctacaaggaaataatgaatcaagcaatgggagaagtacttgctgctcacaacttaatcaaataatcacaatcataataagtaccaacctcaggagacttgctgtcttccgaagttgatgttcctgtaccattccaggtttctattggaccaggacaaacgacggtaaccttgattcccttctgacagaactgaaaccatgcacagatgattgtaaactaactgttagtttttgtaattgattgtgctattttcaacaataaaatgtaaatgaaaaaacatagcgaatcaacatatgaagcttattaaaactcaggagtagctgtaaattttcacttgtgatttcaataagtcaatttctgccaactaattagcaagcacaacagtttctttacttctaacatacctcagaacgcaagctgtggaagtagccatgaagagcatgttttgaagcagaatatatagcctgtccaggtgatggtacctttcctgcagcactgcttatctgagcataattgacgtgaattattactcatgacatttaacccaataaaatggacaattagtgcatgatcatagcctgagttccataacattcaagctatggtaaatactaacctgaacgaaaccttaaattgtctatataccctagtatcctcagatttaacatatatagtcaagattcaatactgtgattacaacaattaactaacatataaaacgcaatgttatccacatatataaactatgatatgaagctcaatccttaaatataattccacaaaattaacaaaaactatcccccagtagtctccacgtaccacaacaaaatgaccccctccttgttttagcatatgaggagctaccaactttgtcagagatatcgtcccaaagacattaacatcgaatgtagtctgcacacaaaatcatagattaaccatatgtcagaaagaaatatcaaaatcacccatgtcctaattgttacaggctaactatggcaatagaaacaaaaaataccttgagagtttcctcaagaattaataatcttgcctacgaattttacgcaattaattttagtaccttgagagtttcctcacttgcatccgatgccttggatttctgcaaggaaaagagtatgatgatgacacccgcttgagtaaacatatctaaagcctaagactctctattgagtagatacaaaactttagcaaggaaattacttaccggacgctcaaaggcagcattgtgaaccaaataatcaacaccagctccagggaaaagcgacactgcttgctctacaacatgtttgagtgactcttcgccgctagctaaatctaaaggcaaaaccttgacatcttctggtgcaaatttacctagaagaagaatacagagtcagttacatcacgtgtcaacaaaaagctcacaattgtaaactggagagctttctttgattcattgtgtaagaaagtacctttaagctcactcttaacccgatccagttcagctttattcctagcagagagaataagcttggcatctaaacttgcaaactgtttagcaagaatttcacctgaatccaatcataaacatgaagagtaagcagccacaataaaagttatctcttcacagatatataatcctaagaaaacattcgttaccaattccacggctagcccctgtgatccagacgacctgagcaaaaccaagaaatctgaattaatgctcagagattgaaataatcgaaaactcaaatcaatcccactaaattccattttttcctctatcaatccagtaccttgccttgtatggcctcacgcttcacatgcttcttcgaaatcaaggtaaaatctcctacacaaagcaaagatcaatccttttatacataaaagaagttaaacattgcattagaaatcgtcagagttattaccatcggcgaatgcaaatttgaagagcagaacgataagaagaagcgctccgagagagaagaagagtagagtcagcattttctcggattgaagcaaccagcgagagaccaagtcttcttacccgtgggcaaaatatgttgacagaaataaatgtaggagtagaacataaattattaatatatagggacctgtatgcaattaatcttatataccaaaatcttattacatccgaatgccattgttcctatcattgtgttgtctttcgatcaaaaaaccccaaatctctgtttgcagagaggacgaggaaagagagagagagagagagagagagagagagagagagagagagagagagagagagaacgactatggacgctataaggaagcagcttgatgtgctcatgggagctaaccgaaacggcgacgttcaggaggtgaatcgcaaatactacgaccgtgatgtgtgtcgtctttacttgtctggtctctgccctcacgatctcttccaattgacggtgcttacctttatattttttcagtttattacttagttgtctctttgaataaaaaaaccctaatttcacttttgagctaatcttttgtgtttctgctttagctcgaattgataactggtatttggttacttgatacagtgtgcagttttgtatcttatagagtatatctgaattctgaaacttgtatcgcttcactgttttctatgagtatctgtctagtaatttagtgcatggctactttggtttgcctaataactgatgctccttttacatttctgttgttatcagaaaatg

SEQ ID NO: 9097 - DNA, 3000 bp, Unknown
  misc_feature (1)..( 3000): cDNA_ID_3044595_gDNA_ID_1971984_Annot_ID_177694 3000 nt of promoter + ATG
tagtatacatgttgctagctccatattagtttttcgtcttcttctctcaatctgatgaaagttgttgtttttaggtacaattcattctattcaaaacaattttgacgtctctcaatcccattttagatacaattgattctatttcaggttttggggttatttctcaaatcgattcctgtcaccaaaatcaaaatctgaaagcaaatggttgatgaggatcacttggaagattttgtctgtgtttgactatggagttgcacataaatggttagggatcagaggaataagttgactcaggaagtttcttctgctttcagcggcaagctcaacatccttgtaagttcccttctcatgctaaagacatttgttgttttctatgctttttttattgaattttctacacattggaatcttcaccaatcttgaaattctacatatcacattagctcgtatccttgcaagtttcttatccgatagaacaatcttcgaaccattctgccacacttttatcaggtttctatatatgtttggtcttaggattgaatggtttagacttttggtggttttgcctcgaatgatcagctatctgtctattccatacatgtaatgtgaaggcttacggttttttgttgaaccatatagtgatgcttgttgatctcatgtaagttttccatctattaggcaagatctgttatatgttaacatagttaagattaccagcaccggaggaaatcgcgtcactggttgcttttctttgccttcctgcagcctcctacactacaagacaggaagagctaaaagcatgcttaaatgattgcaaatccagtggtttagtggtgtctggttcggttagagatcagagggataagttgattcagtggcaagctcaacattcttgtaagttcccttcttctgcaaaatgcttgttaaaactgactctctagttttttctcagcattgtgatcagaatcgtcattgatcttgaaatagtttattgcattagctctgcatccttataagttccttctccatcaaaacatcctcatacaaatctatttgctggctacgcttttgtcaggtttcttcattaggtttgtcttagccttgaacggttgagatttgtgttggttttgccttaaatgctctgtaccttagttttatgtcgtttcatcatcatattttttttcttgcagaaatccaaggcatcggatgcaagtgaggaaactatcaatgtactaaattaattgcataaaatccgtaggccatacaatggtttgcttggtgacatatgattattcaatgactttgtgtgcagactacattcgatatcaatgtctttgggacgataactcttataaagttggtcactcctcatatgctaaaacaaggaggcggtcattttgttgtggtacgtggagactaacgagggatagtttttgttaagtgccctaattttgtggatttgttgaaggattgagcttcatatcatagtttatggatatggatatacattgcgttttttatatgttaaatctaaggcttttaagctatgtatagatagtttaaggtttcttttgtatttttgtcttctgcttgctaaattccaaatcatgttaccgtatacacatcttgagaagtcaaactacggttagctattcttgtatgtgttaattttccatttccttgggttaaatgtcatgattaataattcacgtcagtctatagataagcagtgctgcaggaaaggtaccatcacctggacaggctatatattctgcttcaaaacatgctctgcacggctacttccacagcttgcgttctgaggtatgttaaaagttaaagaaactgtggtgcttgctaattatttggcagctaatgacttattgaaagtcacaatagaaaactcacagctacctcagagttttctgatttgattttttcttttacattccttttcactaattgctgagaatagcaccataaagtaacaattcacagttggttcacaatctgcctatggtttcagttctgtcaggagggaatcaaagtgaccgtcgttattcctggtccaatagaaacgttgaatggtacaggaacatcaacttcggaagacaagaagtctcatgaggttggttaactgattgtgatttgttgattaagttgtcagttttttgtacttgtacctttcctttaagcaactaatcagtcttgtagacacatagaatcctcttccttttcaacattaggatcttctatctccggcttctttctctttttatttccactcaaagatcttttcttttgctacacagaagcgtgtgtcatctgaatgatatgcagaactgactataatcgccgcgtctcatagcttgaaggaagcttggatttcatatcaggtacttgtttgtcaaaatcgcatatgtttcactcagtttagatgctgatatacgatcttctttttgctatttatcagccagtactgcttgtgatgtatctagtgcagtacatgccttcccttggcttttgctatttagtttctttgcgctcaagaggttttcagatgcagctacgagataaatcggactactgtatatagtaatccaacaggcttttgagcccagtggacttgagttcctagaaaagaaaaaccgaaaagaaagttatgtgatgcgtatattgaagactaatgaaaagcttttggggattcacttgctgccagaaactcacagacaacactcctgccaaagctgtcacaaggctgatcactgttcattctttccttctctgcagatatgtgccggcagtaatttaatttttggtaactgctttctccttcttctcctttactcatttcccctatatttccttccttttatcatcattatatacaaattggtaaatatcatttttagattgtgatcttcgaaaatttattatagatgtcaatagatctaaaagtttatacaagaagaaaaggtgaactcggaaaccgaaaagatg

SEQ ID NO: 9098 - DNA, 3000 bp, Unknown
  misc_feature (1)..( 3000): cDNA_ID_2180086_gDNA_ID_1971984_Annot_ID_177692 3000 nt of promoter + ATG
gtcaaagcaagtggcttcgtttctgcaacttgtgcttaaaaccatatcaacattagagttgattgtcgcaaggttggaaggttatatcaaaggaagacgttttgtagagttgcgtcagatggttccaatgcttcctcgcaacaacgatgtctccattgtgctcagctcaagaagaaaacgattcagagtgacttaagtcattttacatttaagtagtacactagatgaaaatctcttgtttgtttttcttactgaaataatcgaattctgttaaattgattttaagttgtgaaattgtttttacgttttaccatttccaatctactggctaacctcggaaaaacggtctagtgagcgagcattgccttgagaaacagtacccgccaaatccagctctcatgtacacagtttgatattatttctttccagtacttttgattcagcaacagagagttcttttcgggctatgtaagaatcaatttgcattgtctgcagcctatccggtggggagctgagccaaggagcaagatttgctccatatccattttcttcaattctagttatgcatgccttgagatccacgtacctaagataaacaaagaatcagtcagaggtgacaaacctaggacaaaagaagttgcggaatcgaacaaattttggcctaaggaacagaagcaaggcatatcaaatatcacaagtctcaaggtcttggatctctctgagaacaatcttgatggatctctcccttcatctcctgggatacaggcatgaaagaatctctcgtaagttcatcttcgcttttgcgtttcatatacagcttcactatcgtaatacataacttagcagtgaactggaagaattcaaagcaaggtcttgccaacaataacgtctgcctctacactctgatagacctctccataacaagctattcggagaaatcccatattctttaggcaatctcaaaagcttaaagcttttaaacctctcatacaacgacatctctggattgatcccacaaagttttggaaatcttgagaaggtagacctttcacacaataacctctcaggcgaaatcccgcagaaactatccaagctcagtgagctgaatgtatggagttgagcaacaacaaacttataggtagaatccatgagagtcctcagctagacagattgaacgatccgaacatttacgcaaacaacaacaaaatatgtggaatgcaaatccaagaaccatgctcgacacagaccaagcagccagagaagcaatgttttcatggaaagctgcagtcataggttgtccttgtggaattctaatggcagttgtctaaatgtatatggttggctatttcagagactcatcaccaccaccaaggcgatctctcaagaacagatgactgaagaaatcaaaatctctgttttttttaaaacgaaatggaagattattcagatgctgtaacattgaaaaataaaacagtctgttagcaatccctatgaagtgatgttatcaagagagttaaacaaagtaaattgtcaaatcactttccaaaaagttgtattttgatcctctgttttttactcgatgaaaacagaatcgtttaatgtaaacattggcagcatataacaaattcacaaaaatctgtgtctttttggtgacatcaaggattttaagataacagcagagatttgttaagcaaaaagattgtttaaacaagaaatatcaccttcttgcgatgacgatcagtgtgagacatatattccaatggaacacgagcacccctagaaagctttgaaagaacagatactaaatctccaagaccggaaatgtcctcattagcaaccttctttatgatacaaaaatggttgcagatacaatttccatcttacttatcctcactcctaaacttaacaactgcatacaagtagccaatgcacaaagtaatatctagctactttactatacccaagagggatctagaatgtcaattgcatagagtccatggtcatcatcagggaccaatacttcaatattatcatccaacggctctgtataacctgccaacaaaataacattcaagttcaagatctgcttcataactcacttttctaaaagtccatagtcaaacacagacaaaatcttctaagtgatcctcatcaaccatttgctttcagattttgattttggtgacaggaatcgatttgagaaataaccccaaaacctgaaatagaatcaattgtatctaaaatgggattgagagacgtcaaaattgttttgaatagaatgaattgtacctaaaaacaacaactttcatcagattgagagaagaagacgaaaaactaatatggagctagcaacatgtatactatttcactttttttagagtttttcaaccaatcagaaggctgtatttcacccccactctcacaaagtgagcgttgagcgcgtgagagcacttctgtgggtgtacccctttggaaatcatgccttttttaatctacgcactcctctctgaaatccccatcgcgtgcaattgtttttgttttcttctcttaaccagtgtaaaccgaaaccaaaatcaattctaatttaaacctaaccgaaaaatcaatttcaatttcatataagaactccactatcaaattaacaaatcatataaacgtaagtctttaagtataatatttttattaaatcgcggtacaagcctagtcagaatatactgttttattttttccaaaacataaattatactataatttcattttgtcttaacagatatttaatttcattctatgtgctatactctaatacttaacaactaatcggagcactaagaatatactaataaaaatcgcttagaaaggcaaaacaaattactatcatcagatttcttccccaatcttcttcttcatatccttgaaggagagagtatagagaatccgatccaaaaaccctaaaccccatttcccgcggattttctcccaagctgatacggagatcaaatg

SEQ ID NO: 9099 - DNA, 3000 bp, Unknown
  misc_feature (1)..( 3000): cDNA_ID_1989389_gDNA_ID_1971984_Annot_ID_177688 3000 nt of promoter + ATG
ttattagaaaagttaataaatcaccttcacaaagagccagaggaattatgatgtatcatcatcaattcaatatgtataaagtattcacaacatagcttcgggggcttactaatgtgtacataagaatataagataaaagagatagatttcattgttgttctgttttctttttaaatatctttcagtagacctcttcatattgcatgagatgggagaaaccaaattaataataaagagtaaatcttgtacaaagaataagagtaaatgaaacacataaatatttaggctttgtgaaatgagactaactatctcgtttaatttcctccttttgcatcttaatgtagattacttattgattcgcttatcaagtgcgacaagtctcagcgctctgctttgtagtttccttttgcctcctgctggttgcttgagttgcactaaacttggaacataagagcacgcttgtgtccaacagtttgtgtagatagattctcctagatccaattctcttaagtatccattctctccaagaatgtaagatattcggtgtttaaaaccctcactaaccatgacgactttcttctcttcgtcaatgatgaaactctcaagtactaatgaaacttcaggtcccgtattcactttcaagaacttgctccaagacaccttttcggtgtctagtttcaatggttgcagaacaaaataaaaatgaaatttttagtatctcaaaatctagatttcatacaatctaaagttgtctcttccgttgtaaagtgtgtcatcatctaaaaacctcaagattttgtggctacgacaagattttttattcttctccaagcatccgaaagcgtaactgcacgtgtcccatcccttcacgagtttgatcgaccttgtttgcccgatataaggattccaaaccacaagcctagtattgtctccctttaagatgcataacaataaaaccctcacaatggaaaacttcagatatcttgactttatttgaatcgtttaagaaagtaagttgacctagagtctctatcgatggatctccattgacgtcttcaacgacgttcattaagtaaagtttataatccatcataaaaatcatccgaggcttccctttcctccaaggtgcatctttataaagctccgacttttatataaacagttccattttttgcaagtaactcgaactgctctcatcaatttcgtaggaaccccagagataatctcctctaccaattcctttggaagatctgagatcgtcgtcattgtctcagtttgcaactggtttttttttccctgtgatttcttgcggataaaggtagaggctgggaataaactcaataataatgagatacataaaccctaaatgatgctgggccactcttgggcctatgaatctatttgggccctctcgaaaatttgttttgtggacattttcttaattctatatgtttgctttgatatatactcgtcgttgataaccaagaattaagagtttaatcaatacatacacaccgttagtttttgcttatttttataagaaaaacaacaaattttactattatttcagatttcaatatactttataagaccagtacatatggctaatgacccaaaacatttgtcttgttgtatacgttattcaacaacaacatgcaccttcaatttatttaaactttttatatataaacggtcgagagaaacctctaaaaccgaagaaactaaacatgaataaacctttcttattcatagaacaatgtataagcgataaaagacacttagtaaacaagcaatttatatgtcaccaataaccaaagccataaactcgtcaaagttcaaatagccatcaccatcgacatccgccgctcggaccttttcggcagaagtctcctcggtgaatttctttccgaggctagtcatagtcacataggactcgctggctggtatcttcccgtcaccgtcaacatcacagaaaacaaacacttccttcaacattttctcaatgcacgaagtaaactcgtcggcgtttagctcgccgttaccgtccacgtcgatctcttcgaaaaactttacgatatcttcctgagtaaagtaaggagagaacgcaagagccacttcacgaaactcgtctaatgatagtttaccgtctttgttcttatcgaacttctcgaagacacgttttgcagacatagttgcttaagtgttttatatatgttatgtttgatactacttgttcctttgttttttttttttaaaaaaaatagtgtgaatatttatagggtttggaaacaattaattataaaaattgatagatagtccaattaacgattaattaaaaataaagtatgcatagaaaaatttagtgattcaaaaaataaaggaggatatatatatatatatatatatgtatgtagattttatcctagaaattggatttgttcaaatctgtatattattaatagttcttcacttacttgtatctcacagtagctcatattatgttaaaatggatttggctatctggaatagtattaacctctaaagttttgaaaattttgtcaacaattagatgggattcagtttgacacatgtaagtaagtaagtaaggggaaaaaaaaacaagaaatgtaagtaaatcaagtttatttatagattaatattaaaaatgatagtttctaaataactaaagtgtatttgttatacaaacttaattagatatgttccactatctatttattttatttttaccaacgttcaccacaacactgacgtcacctgtgcctaccaaaaaaaacactgacgtcacctattacgtaaattggcaaaatagaaaaatattagtacaaaattaatgtaattttacacatttaccctttcactcattttctctccgtcctcactcgctgaccatcgatcttaggccactcccgaaggatttctccggcttatacaaatcctactgccgtcaaaatcgattcaaagcgaaccagagattgaatg

SEQ ID NO: 9100 - DNA, 3000 bp, Unknown; identical to SEQ ID NO: 9093
  misc_feature (1)..( 3000): cDNA_ID_2180069_gDNA_ID_1971984_Annot_ID_177683 3000 nt of promoter + ATG

SEQ ID NO: 9101 - DNA, 3000 bp, Unknown; identical to SEQ ID NO: 9092
  misc_feature (1)..( 3000): cDNA_ID_3044555_gDNA_ID_1971984_Annot_ID_177681 3000 nt of promoter + ATG

SEQ ID NO: 9102 - DNA, 3000 bp, Unknown; identical to SEQ ID NO: 9090
  misc_feature (1)..( 3000): cDNA_ID_1989396_gDNA_ID_1971984_Annot_ID_177679 3000 nt of promoter + ATG

SEQ ID NO: 9103 - DNA, 3000 bp, Unknown; identical to SEQ ID NO: 9099
  misc_feature (1)..( 3000): cDNA_ID_1989389_gDNA_ID_1971984_Annot_ID_58743 3000 nt of promoter + ATG

SEQ ID NO: 9104 - DNA, 3000 bp, Unknown
  misc_feature (1)..( 3000): cDNA_ID_2180086_gDNA_ID_1971984_Annot_ID_58746 3000 nt of promoter + ATG
tgttcttgttcgggtgaatggaacagtaagttgtcttgattgcatcttcttagtgagaatttaaattttttttgcctcaagtaatcgagaattgtgatatcttttgcggcaacattagtaaagaaacgtattgtttagagattggttattacctggccacagaacgtattaatcagtgcacttagattgtctagttcctttttcctcagtttgctaaatcttcctttatgcgtttgattgttattacaggtgctcacacaatttttgaacttggagaatctgcttgatgacggtgttggccagatacttgaattggagattgaaaggggtggacaaccactatctgttagtgtatcagtgagttccattcttctatttctaactttggttttatgttcctcgtagtcttctaggatcttgtgtttagtttctgccctgtcacatactgactagaaaagcaggagactatgcaaagactagaagtaaaatatatgtagccgtctcttctcttttattttggtcattaaatttgttcttgtagctcttttcgtttcccctgatagatggagttcctcaatacttaatttgcatttagaattctgccttaatgtgatttatacttcctatctatcataaaaatcaagagccttatgtgtttgtgtatttcctgccacaggtacaagatttacactcaatcactccagatcacttcctggaagtaagcggtgctgtaattcatccgttgtcttatcagcaggtaacttaactatgacttgaaaagatattatctggaaatttctgtgcctgcatgcatgatattcttgtgtcgtacaggtggaactgttgtgtttaattatggcttgtaactatttaatgttctattagttggagaatcatatcaacatgctagatattttattcataataaatgctgtggatccactttatcccccacactgtcttgctagatctgattatggaagcataactaagtgaaatagtgatgtgactacactacctcctgctaataaagaagcttacacgtatttcactgacactttcttattggcattagctgatcttaaaatattgtgatttaacaggctcgcaattttcgttttccttgtggcctggcttatgttgcggaccctgggtaattccctctacttccgccatcaaaattttcacgttttcttgatttatttttgactgatgtgtcaatattctgacatgtgagcttattgttaatgtaaatgattacgtgtctctgtatttctggatttactttgaagagctcttttctattcagatacatgctatttagagctggggtccctcgacatgctatcataaagaaggttgctaatgaggatatttccagtcttggagacttagtatctgttctttcaaagctttctaggggtgctcgtgttccattggaatatatgtctcacactgatcgtcatcgcaagaaggtgatatttcttgtttaaacaatctttttgcttaacttcctaacccactgtaagcatatacttgtcaaaatttgatgctagcatttatatatgatattttcttaggctactccatatcagcatcttcattcttgcaaacagtttgttgattctgtgataatattacctctctactcggtgttcctagtgtgtgaaattttgtgctactgcagtgctgctagatctctgtgatcactttttacggaaaaccgttatctttaagactataattttcacaactgtggatctttttgcgttagcaacgttcctgttattaacatgcttgcttgtccacgtttcgttttgaactctatgttaatactcaaacgagaagtacttattgtcgggttccattcctgcagtctgtgttagtcacgattgatcatcatgaatggtacgctcctcctcagttgtatacccgtaatgacagttccggtttatgggatgcgaaacctgcaattgaacctgcttctgtttcaccatctattggtaataatggctttcctataagccaagatatttctctatgccatcacgatacggaacccatgcatgaagtgaatgttcgtggggttactgatattgcagcgattatggaaacttctagtggggatggttctcagaatgattttggctcagaagcaaagaaacaaagagttgacgaggattcttcagatgggattgctgcaaacggttccttatatggcagtgaatttaaatctgatgatgcaatggaaacagatactacagttttaagagacttcgaaggtgcaacagcactgtctgctaatgcttcattggctgagcgtgctattgagcctgcacttgtcatgtttgaggtaaagacgaaaacttctctcaaagttatcagtttcaccagctgttgaaatttaatactttttatgtggtgtgctatttctcactgtttcttttttgattcttagtagtcaattgatttttcattcacaacatttgataatacttgagtaagtttgggtgtatcagttgattcaataatttgcacagaagatgggtgtgtcactgaacgtacctgtataaaatagtatacaatgttgacttcaaggttcagagttcctacatcatcaaagagtacaatttgataacacaaagtagttacttagattatttctcaagaacatgttagatttggtaactacttttacaagtctgatagataacaatctatggaggctacaagaaaaccatagatgtatgacctggtgaactgaattactatcttggttaaatatgtttctggtatatgcaattttaactatttctttatatcgtttttttggtaaaaagtaattatacagtagttcttattgtgattcaaggcaacttgcatctgttgaatctaagttctcttatacaggttcatgtgccaccatcgtgcagtcttgatggtgtacactcacaacatttctttgggactggcatcattatatatcattcttctaacatg

SEQ ID NO: 9105 - DNA, 3000 bp, Unknown
  misc_feature (1)..( 3000): cDNA_ID_1989814_gDNA_ID_1971984_Annot_ID_58747 3000 nt of promoter + ATG
aaccatatcaacattagagttgattgtcgcaaggttggaaggttatatcaaaggaagacgttttgtagagttgcgtcagatggttccaatgcttcctcgcaacaacgatgtctccattgtgctcagctcaagaagaaaacgattcagagtgacttaagtcattttacatttaagtagtacactagatgaaaatctcttgtttgtttttcttactgaaataatcgaattctgttaaattgattttaagttgtgaaattgtttttacgttttaccatttccaatctactggctaacctcggaaaaacggtctagtgagcgagcattgccttgagaaacagtacccgccaaatccagctctcatgtacacagtttgatattatttctttccagtacttttgattcagcaacagagagttcttttcgggctatgtaagaatcaatttgcattgtctgcagcctatccggtggggagctgagccaaggagcaagatttgctccatatccattttcttcaattctagttatgcatgccttgagatccacgtacctaagataaacaaagaatcagtcagaggtgacaaacctaggacaaaagaagttgcggaatcgaacaaattttggcctaaggaacagaagcaaggcatatcaaatatcacaagtctcaaggtcttggatctctctgagaacaatcttgatggatctctcccttcatctcctgggatacaggcatgaaagaatctctcgtaagttcatcttcgcttttgcgtttcatatacagcttcactatcgtaatacataacttagcagtgaactggaagaattcaaagcaaggtcttgccaacaataacgtctgcctctacactctgatagacctctccataacaagctattcggagaaatcccatattctttaggcaatctcaaaagcttaaagcttttaaacctctcatacaacgacatctctggattgatcccacaaagttttggaaatcttgagaaggtagacctttcacacaataacctctcaggcgaaatcccgcagaaactatccaagctcagtgagctgaatgtatggagttgagcaacaacaaacttataggtagaatccatgagagtcctcagctagacagattgaacgatccgaacatttacgcaaacaacaacaaaatatgtggaatgcaaatccaagaaccatgctcgacacagaccaagcagccagagaagcaatgttttcatggaaagctgcagtcataggttgtccttgtggaattctaatggcagttgtctaaatgtatatggttggctatttcagagactcatcaccaccaccaaggcgatctctcaagaacagatgactgaagaaatcaaaatctctgttttttttaaaacgaaatggaagattattcagatgctgtaacattgaaaaataaaacagtctgttagcaatccctatgaagtgatgttatcaagagagttaaacaaagtaaattgtcaaatcactttccaaaaagttgtattttgatcctctgttttttactcgatgaaaacagaatcgtttaatgtaaacattggcagcatataacaaattcacaaaaatctgtgtctttttggtgacatcaaggattttaagataacagcagagatttgttaagcaaaaagattgtttaaacaagaaatatcaccttcttgcgatgacgatcagtgtgagacatatattccaatggaacacgagcacccctagaaagctttgaaagaacagatactaaatctccaagaccggaaatgtcctcattagcaaccttctttatgatacaaaaatggttgcagatacaatttccatcttacttatcctcactcctaaacttaacaactgcatacaagtagccaatgcacaaagtaatatctagctactttactatacccaagagggatctagaatgtcaattgcatagagtccatggtcatcatcagggaccaatacttcaatattatcatccaacggctctgtataacctgccaacaaaataacattcaagttcaagatctgcttcataactcacttttctaaaagtccatagtcaaacacagacaaaatcttctaagtgatcctcatcaaccatttgctttcagattttgattttggtgacaggaatcgatttgagaaataaccccaaaacctgaaatagaatcaattgtatctaaaatgggattgagagacgtcaaaattgttttgaatagaatgaattgtacctaaaaacaacaactttcatcagattgagagaagaagacgaaaaactaatatggagctagcaacatgtatactatttcactttttttagagtttttcaaccaatcagaaggctgtatttcacccccactctcacaaagtgagcgttgagcgcgtgagagcacttctgtgggtgtacccctttggaaatcatgccttttttaatctacgcactcctctctgaaatccccatcgcgtgcaattgtttttgttttcttctcttaaccagtgtaaaccgaaaccaaaatcaattctaatttaaacctaaccgaaaaatcaatttcaatttcatataagaactccactatcaaattaacaaatcatataaacgtaagtctttaagtataatatttttattaaatcgcggtacaagcctagtcagaatatactgttttattttttccaaaacataaattatactataatttcattttgtcttaacagatatttaatttcattctatgtgctatactctaatacttaacaactaatcggagcactaagaatatactaataaaaatcgcttagaaaggcaaaacaaattactatcatcagatttcttccccaatcttcttcttcatatccttgaaggagagagtatagagaatccgatccaaaaaccctaaaccccatttcccgcggattttctcccaagctgatacggagatcaaatgggagatccgttggagaggttgggttctcaggcatcaatg

SEQ ID NO: 9106 - DNA, 3000 bp, Unknown; identical to SEQ ID NO: 9097
  misc_feature (1)..( 3000): cDNA_ID_1989384_gDNA_ID_1971984_Annot_ID_58749 3000 nt of promoter + ATG

SEQ ID NO: 9107 - DNA, 3000 bp, Unknown
  misc_feature (1)..( 3000): cDNA_ID_1989382_gDNA_ID_1971984_Annot_ID_58751 3000 nt of promoter + ATG
acaaggcaacaaaacatttttcgacgctttggtagttatttaacaatcaaactagcaaacaaacaccaaccacatttacggactaaggctcaaccaaccacatctatgtgtatcttctagagaatcagcttcagtttgttttagtcttcttcccgaacagtaaatcccacgagtatgtgttgcctttcttttccgcgacctccacacgctttcctccaacctgcaagccgttcattttaatcaaaagactgctttcaacagagtaataactgcccctgttttctctttgtcagatgtgtttgtcacattataatggaaacaaaacgacatctcataccggtaacttttgaagaaaattaatggatgagcaaagtaccttgtccatgagccagaagccaagggaaggcatgtactgcactagatacatcacgagtagtactggctgaaaaacagtgaaaaagaaacttatatatcagacatctaaaccgagtatcacatatgcaatatttataaagatgtacctgatatgaaatccaagcttccttcaagttatgagatgcagcgattatagtcagctctgcacatcgttcagatgacacacgtttctgcgtagcaaagagaatagatgcttgagagaaatcaagttgagcaaggagctgaagttagaatctccaaatgttgacaaagaatatgattctacgtgtatctacaaggaaataatgaatcaagcaatgggagaagtacttgctgctcacaacttaatcaaataatcacaatcataataagtaccaacctcaggagacttgctgtcttccgaagttgatgttcctgtaccattccaggtttctattggaccaggacaaacgacggtaaccttgattcccttctgacagaactgaaaccatgcacagatgattgtaaactaactgttagtttttgtaattgattgtgctattttcaacaataaaatgtaaatgaaaaaacatagcgaatcaacatatgaagcttattaaaactcaggagtagctgtaaattttcacttgtgatttcaataagtcaatttctgccaactaattagcaagcacaacagtttctttacttctaacatacctcagaacgcaagctgtggaagtagccatgaagagcatgttttgaagcagaatatatagcctgtccaggtgatggtacctttcctgcagcactgcttatctgagcataattgacgtgaattattactcatgacatttaacccaataaaatggacaattagtgcatgatcatagcctgagttccataacattcaagctatggtaaatactaacctgaacgaaaccttaaattgtctatataccctagtatcctcagatttaacatatatagtcaagattcaatactgtgattacaacaattaactaacatataaaacgcaatgttatccacatatataaactatgatatgaagctcaatccttaaatataattccacaaaattaacaaaaactatcccccagtagtctccacgtaccacaacaaaatgaccccctccttgttttagcatatgaggagctaccaactttgtcagagatatcgtcccaaagacattaacatcgaatgtagtctgcacacaaaatcatagattaaccatatgtcagaaagaaatatcaaaatcacccatgtcctaattgttacaggctaactatggcaatagaaacaaaaaataccttgagagtttcctcaagaattaataatcttgcctacgaattttacgcaattaattttagtaccttgagagtttcctcacttgcatccgatgccttggatttctgcaaggaaaagagtatgatgatgacacccgcttgagtaaacatatctaaagcctaagactctctattgagtagatacaaaactttagcaaggaaattacttaccggacgctcaaaggcagcattgtgaaccaaataatcaacaccagctccagggaaaagcgacactgcttgctctacaacatgtttgagtgactcttcgccgctagctaaatctaaaggcaaaaccttgacatcttctggtgcaaatttacctagaagaagaatacagagtcagttacatcacgtgtcaacaaaaagctcacaattgtaaactggagagctttctttgattcattgtgtaagaaagtacctttaagctcactcttaacccgatccagttcagctttattcctagcagagagaataagcttggcatctaaacttgcaaactgtttagcaagaatttcacctgaatccaatcataaacatgaagagtaagcagccacaataaaagttatctcttcacagatatataatcctaagaaaacattcgttaccaattccacggctagcccctgtgatccagacgacctgagcaaaaccaagaaatctgaattaatgctcagagattgaaataatcgaaaactcaaatcaatcccactaaattccattttttcctctatcaatccagtaccttgccttgtatggcctcacgcttcacatgcttcttcgaaatcaaggtaaaatctcctacacaaagcaaagatcaatccttttatacataaaagaagttaaacattgcattagaaatcgtcagagttattaccatcggcgaatgcaaatttgaagagcagaacgataagaagaagcgctccgagagagaagaagagtagagtcagcattttctcggattgaagcaaccagcgagagaccaagtcttcttacccgtgggcaaaatatgttgacagaaataaatgtaggagtagaacataaattattaatatatagggacctgtatgcaattaatcttatataccaaaatcttattacatccgaatgccattgttcctatcattgtgttgtctttcgatcaaaaaaccccaaatctctgtttgcagagaggacgaggaaagagagagagagagagagagagagagagagagagagagagagagagagagagagaacgactatg

SEQ ID NO: 9108 - DNA, 3000 bp, Unknown; identical to SEQ ID NO: 9095
  misc_feature (1)..( 3000): cDNA_ID_1989380_gDNA_ID_1971984_Annot_ID_58754 3000 nt of promoter + ATG

SEQ ID NO: 9109 - DNA, 1831 bp, Unknown
  misc_feature (1)..( 1831): cDNA_ID_3044640_gDNA_ID_1971986_Annot_ID_177713 3000 nt of promoter + ATG
gaattcctcctcttgtttaaacgttccccataccaaaaaatagcaccacacttgtctgaaattgttggcgagttggagaatcgagtagagctctggatatttattctgtatggatgagttgttgatcgatatagtcctgtcgccttagtcactgaaaattcctcgatgattgtccagtgtcctatcttcacatacctctgtagtttgagtagatgttccttttttattcctgcttgaattttatttccctgaaaatagcataagaaaacgtgaatgcgagagttaaaaacaattaaagacaaccattaagattatagacaaattgtaaagcctaaaatacttacatcctcatctgctaacatcatttcataagacatcccagaacctttggtataatgattccacgcatggagaattttaacttgaatacaccaagaggttttgaacggtttcaagtttttgatagctgtgtatggactcacttcatccattttgtttggttttgcagtgagtaatgaattggtttatgagagaaggcacatagatatcgtgaaggtattcttactcacgtttatttataataagtgctgggtggattagatagatagagattttcgatttagatagagatcttcgatttgataagtgtgtttcgatttgttatatagaatattatttgttaagaggaagatataccaaaagaaataattgcaaacgtatctttgcgagaaatgcgtttaccataaattgttcaaaacaacaaaagatacgttttgcattttctcaaataacaatatattgttttgagtcgtcgagtgttttaattaatattcgtgataatatcctaacctttgcaacttctcaaacaacaatatattgttttgaagtcgacgagtgttttaattaatattcgtgatatctaatatagtatagtaagattatgcagattttgtgcaaaataaatatctctaaatattaattgataagtaaaactcaaaaataacattccttttgtcccaatatataaaatgttttaggctttttcttttgttacatgttgttctttcttttcaatttttatccataaatgcgacagagagaatatttcatttacaaataatttacagcttattaacatttactaaatctttacatatttttatgtgttattatattatttaaattacacaaatattaaatcaaaaatggaaaatagagactaagaaagaaatacgctaatcgattttaatgtcagatcattttctttaatttagtgacattgattttttttttttaaactttaaaactttttatcattattattatgatgtaagaaaaaagagtatgattgttgatttgttatttattatacataacacattatactgatttaaattaaaataaaaatgcaagcttcaatctttgggggtgtagctcatatggtagagcgctcgcttcgcatgcgagaggcacggggttcgattccccgcacctccattccatttaaataataaattttgtgacaatattttatatcagaaagttcaaccgtccgattgttttttttttctgttttcgggtgaaaaatcgaaaacagaaagttcagaaagttcaatattttatatcaaaaacatttactaaatctttacatatttttatgtgttattaaattaaccgaagcaatagatagaaccaaaaaaaatactatcattagagaccgttggtttcttcttccctctttcttagcctctcgtttctcatctccgagaaccaccaccgatgctcctccgtcttcttcgccggtgattttgtcttccgattgttatcaatg

SEQ ID NO: 9110 - DNA, 3000 bp, Unknown
  misc_feature (1)..( 3000): cDNA_ID_2180329_gDNA_ID_1971986_Annot_ID_177736 3000 nt of promoter + ATG
taaaataaataaatgactagaataatttgttaaatatggatcgcagaaacatgagcaatttacttactattcttattctacaatataaagcatgacttattgacccaaatgtccaaccaaaaccttctgtctttgttgttgttcttaaataaaatgatttacgtattggtgattttcaaatggtaagattgtgtaatatggaactgatttacgtcaacccccgagaatatagggcgacccatcgttgagaattggaccacacatcagttggacaattggttagttatcatccagttcatcgtcctataaaatgaaattggtactgttgtagggtcagtgcaaatagggtagaaataaagacctagtggtagggttttgaccgcatagtcttccaaccttagcatatgaaatcaataataaaattctctaatgcataatttgttgggtttcaaacttatttttttgttaaattttggttttcaaacttaatttcagagttagtttgaatgcaataatttgttttcttttgaaaaagtagtttgaatttaataaacttacttaattcataaacaacttgtcaaacaaaaagtctaaccttataagttgttttcaaacgtccaatatagaatttaacaaacatcttcgaaatgattactattttcggtgcatctcaaaccaaatcccttaactatatttcgaccattttatttggatcagtgaatcaaaactttaatattgtattaagttttatgggtttttaattatcacaattgacgacaaatagatgaattacgtatatatcagttgttacttcatgtcacttgtgaaattgctaatgtggaatcctaacatgtggtcttggctcatgttcatctccttggttggttaaatggttagaaattctcaaattagaatgattcagttggtaacataactccgcttgctcgaaataaattagtatacacaggttttttgttgggtttcttcacaactgagctacgaggctacctagtgagagcccatttaagagttttcacgagtggctgactttttggaatttagaaagcccaacaattatttagctccttttaagaaaagcaaaagctcaaacaacgttcttttcacgtctgtctctccgcaccacgagaaacgtgatatcatgtggagagtgaggaacctcaacacccacggccacgaggattgaacacacgactgactcttcttctatgactcctctcaccaattcctttttgtttttattcttcattttttgcacattttatttccctcaacgattagtctatgattttattttctccaactaatttaacaatactttctccgtacggcattttatgaattaatttattagttgggtgagtgagtggtagggcttggaatatttttattttcatggacgaactattgtcaacaaaatacaattagaaaaacacgtaaagttacgtgtgctgaataattttttttatttatatttggtacacgaaaatggaaatgtagagacgagtctagtctactacatatacgcttattaatatctatttaaagctaattaaaagatagggatttgtagtagaaaaaatggatgcaccagtttttttaataattaaggttatatacggatggaatatccaaattttatgataattggatttcgaaaaatatttatttgaattcatatccgtaaaaatacacatatatctagctaaaaaattggtgtgttgtaatagtttagtttttcgattgtgtttaagaaaagagataagatggatatgagaccttttttaaaagtcttttggtgtgagaagactaagaagtgtagtggatgataatgatataatcatcatttgctttttcttaataacatattgaaatttgtggtaaaataacgaaaatactagcaaaacccatgtaaccatataatcctacctaattctcatcaattcaattttttacttttctgttaccatcttgttaaatattcatcctcggacgttattgaactaattcttacttacatgtattttttttgctttttctaatagagttgatcaaagaaagcaatgaaaaaagtttttttgtaggtgtttagaaagcaaaagtttattttgaaaaagaagtaaataaatgagtaaaaaaaaaagagaataatgagagtgcatatatataaattgaagttagtcagtgaaagtggttgacaattaaaaaatgaaaattggaaaaatcaaaagataagagaaagagagaacaaaacgacatgcaatttttgtttgtttggttcgtttgtatttgtaccctatttccttgaacctttcttcgtaccaccgaagaaaaatcccatctttataaaaaaaaattgattaagaagagagtctccctcccttccgttaatctcgctaataataatcgcgagtgacgactctcttaaaccctttcaaagaactaaacgctaccaaagggtttcaattgaaagaagtgccaatccaaccgacagatactttcatacccgttcgttcggtttttaataacccttccttctccgagaacaaagttttgctttttttagaaagatcacgcacggactcgattcatcaactattgtgtttggtgagactggtaagcaaaatcctctgtctgagcaattgtttattagacgaatttcgttgtttatagtttacttgtaagcaatctcttccacgttatttatttagttaggtcgtctactattaaactatgtacaattcctccatttttgtggcgaaatttcagatttttctattttggtctttgggtttgactctgcatttctctgttagccttttcaaaatttgtctacttttttagtaaatcacgagtctttctacagtgtatatgaattgactaccacgaaagcatgagacttttttgttttggtagccaaagttgaactctttctcacggctttcctttttgtttcctttacggaatagagagtgtgtgatg

SEQ ID NO: 9111 - DNA, 3000 bp, Unknown
  misc_feature (1)..( 3000): cDNA_ID_2180325_gDNA_ID_1971986_Annot_ID_177735 3000 nt of promoter + ATG
ctgcacttttcaatagagtgtgtgactaggtctgggagatagagtttccttcacttcttatgatgattataaaagtataggagggggaccatatttaaaatgtaaagattcggaggataataccattagaaagttggacatcattagtaaatagtgagtgttacccaaaacaaggcactatctatgcattgtttctgcttttatattacagtttttctttatatattttggacgattatggtttgtattcacataaatttcaattataattttgctatatgattcatcttcctctatcattcctcttagtcaaatagagttggctaactaaaccttttattttaatcaaattactccgttttaacttgttttggtgccaatcaaaaccaaattttatacactaattatttttactcgtttttttttacaaaaacattaagaatgatacaacataaaaaaatgttgtctccctttatccgcatttgttcctcaaagatgtagcactataaatagtctcatcaccctaagaccaaaaccccaacactcaaactcaactgctctcccataaccgaaaccgagagaaaatatagaaaaagatgattgagacggttaaacacctgatcggctccggtggtcccagcggattcgggtcaagatccaccgccgatcatgtcacttgtaattctgatctccgttctctaactgccatcatcactggttagtcataaacttaaagttacttcttctttttcaacttaaccgagtcgcaaaatgagtttcctaactaatagtctctctgtttcttttctactaggcgcgacgtcggggataggagctgagacggcgcgtgttcttgctaagcgtggcgcaagacttgtgcttccggctagaagcgtcaaaaccgccgaggaaacaaaggctcgtatactgtcggagtttcctgatgcggagatcatcgttatgcatcttgatctcagctcacttacctctgttcgtcgattcgtggacgatttcgaatctctcaatctcccactcaacatcctcatgtaatttaaactctatcttcataatcatatagcgaaaatgtttttatctgattttttctaaccttttgtaaacttttttggtttgtgtttgtaacagaaacaatgctgggaaatatgcgcataagcatgccctctctgaggacggtgtggagatgaccttcgctactaattatctcggtaattaagttttcataaatccatcattgacttataatatatcattcattgatttatatgttctctaatagtaattcatggtgtgtttaggccattttctgctgactaaactgctgttaaagaagatgattgaaacggcggcacaaaccggcgtgcaaggccgtatcgtcaacgtcacgtccgtcgtccatagctggttttccggtgatatgttgcaatatctcgccgatatctcacgaaacaataggtaatttttaattagtataagctagaaaatatcattccaatcatatagcgaataattaatcattgtttaataataagtacaacaaaaaggtgatgcgacgacaaaaataaacgccgtcgtcctctcgtctttttcctttatttaaaatcatattttcagagagaataataatagtttatactttgtgacttgagtttgacccactaattatagctttaactttgcgttttacagaaattacgacgcgactcgagcctacgctctctccaagctcgccaacgtgctccacactgttgagctatcacggcttctccatgtacgttattatacaaatttaactatttggtaggaagtaacaatttatctcctcatttctaataataaactacaatatatatgcagaaaatggatgcgaatgtgacggccaattgtgttcatcctggtatcgtgaaaacccgtctcacaagagatcgagaaggcgtcgtcactgatttagtgtttttcttgacatccaagctattgaagtctgttcctcaggcagcagctacgacatgttacgtggcaacaagtccaagattgaggaacgtgtgtggcaagtacttctccgactgcaacgaagctaggtcatctaaatccgggtcatgcaatctcaaagctcagagactctggactgcttctgacttgttggtttctccacctaattccactaccaatctttctcatacctccttttaaccaacaaaccatcctagctattttctacgtgtaaatcttaagccctatatatagtaatataattagctttataatatatatagttatagaaatatatactatagatgaaatgggatgtgtgtgtgtagttgtgttacgtgtgcatatagcaagcctccctatatttaatatgtggttatggtttgacattattgctaatatatatatatatatatattacttagcttgtagggttttgtaatcctagctagctaggtccttgttatgtaatatatacatatatcaatcaaaaacatcacagaatttcataatcttgatcttgatactcttataaaaatttgtttatttctgttgatcactgaaatgaaatcatatccatccacacaatccaaatatggttcctttgcaatattagcaaccactcttcaaatgggccaataatgctagtcactgctataataaagggcttttaggcccattaaataatcatttggtctttcaaaggcccatcacgctaagccctagaccctcctccaaagaatgaaatgaaatcctatccacaagcctaatttggttccttttcaaaatacataccaaatttcgatttgtcaacaactcgtcaaatggatctcgaataatcactaatcactgctataataaaggcctcattaggcccattatagaaacatttggctctttgaaaggcccataacgctaagccctagaccctcctcggaggctaaaacctctcggctcctcctgcaacttccatttcagttcaagctccggctgaaa

SEQ ID NO: 9112 - DNA, 3000 bp, Unknown; identical to SEQ ID NO: 5433
  misc_feature (1)..( 3000): cDNA_ID_1828706_gDNA_ID_1971986_Annot_ID_177751 3000 nt of promoter + ATG

SEQ ID NO: 9113 - DNA, 3000 bp, Unknown
  misc_feature (1)..( 3000): cDNA_ID_3044612_gDNA_ID_1971986_Annot_ID_177747 3000 nt of promoter + ATG
gtgagtaatgtctttttagttgacggtgatctcttcttggactcatcacagcatttaacaacatctttcttgaagcacttcaccagcttagtgagcttggtgaggagtgaagggcgagagtagagtgtgtcggagatctcatccagatagatctttgtccttgtgagtgagaccaccttcgagtagtctcctgatctttccgacactatcatcttaccgcctctgttccctccagccgagattggtttggcctcgggcggcggacagcagtagcagggtttccactcggactcgaagaagaaatcaagagtcttgtaggtaaagcaaagcaggaaatcaacaatgtcgaggatgaagaagacgaagacgcccacggtgcggttgagcgaccgtgagaatcccatgctgtggagtttgagtcttgtggaagacgtgtatgtatgtaagttgtatgtatgtatggtggtgatgttgcaaagacaaaatgcgtgagagagagaaattaagttaatgaagagagagaggaaaacagatggcagctgcatgaatttattgatcgcatttaacatacattgttggctaaaatgatgaaatttggtggccgttgaatcttcttcctttttttttgcaacactagaccacgcatatccagcacataccgtaatatcttttttaacttcaaaacaggaatcaatactaaggaacatgtgatgtcgattggtccggtgatgatccaaaatgccgctatagctacatacacacaaagtcagtcaagtcattatggatgtgcggttccttccttagggttacaagaaattatgtttaataatgtgaaaataatatgctaagaaggcatgtaattttgtatttgaaaacaatcaaaaccctagatagtcccaataattaatgatactcatatatgctctgtttggtaaggccactattgaggattttggccggttgatgacttttggggtctaaaactacaaggagggcaactaaactatatggatataaatgtgttttttttttgggctatggatacaaatgtgattacgtaccgtgaaagtgaaactaatacagacatcaaataattgaagtaatggcacagagtagtaaatgtaaatgttgatagcgaaataagataaagaatggacaagtgatatgatggcatgtggccacaacttatatccatcactctgaatgcccagcagcccatctaaacagcctagctgacctgtttttagacaattctataatatgtatacacattttggtaaaacaggagttaaaagagttagtctgtcagtatccatatatagatagtagtattggtaatatttcatgaggacaaggacgtgtgcgtggcatcaagcaacagctaatcgcatctctttactcaacataccattctctctaatctgttagggtgaaaatattaatgaagtagaaatattcgagtgtgcttttatgagaaaagagtgatatacatatatagtagtatggtaaggaacgtgagaccatgtgctatgtttaataggttttcaaaagtcttgcgtcacacaatcttaaagagggcctgagagcttatttttaataatacttaaccaaacgagtggcttgattctaactagatcccggtatgtagtatagatacgacaagctactgatggagacagatatatatagtccccctcaagtcaagccttctatattcattttctgtcattgtatgtactcttcttgcaaccttttcatatgtatcactataatttgttttttcctcttgaagacttgaacaatctggtggagcaccagaagattcactaacagccaagtatttttttgatatcattcataagttttagggtaatggagtgaaattagctagaggaatttagtctaaagctcaaactgcgaccacccgatggagttgttttggtagagcagaaaaataagttgaaatgtaagaaagagaattagttacaactgtaagttacaagtaatgacacaattgtaatgcagaggtcaacgacgactgacatacatataagtgcactccattccaacatgtagtagcattcgaattggttttggactgacaaaattgagtaactacaacaaataataataataataataaaagtatgtgaaggaaaaataaaaaagtcaaaagaccttaaatgcgtagttgatggaggttggtagggagtgtctttaatttatagttttacatattttgaaacttgaaaagtgctcctctcctctttgatttatccctacttgctaattattttactcatccacgttaccatatcaatgtaatgacactcggtatatgattggccatcgacatgtatacatattgaaaaaatgtcaaaaacaagtttcacctatcaaagttggataagaaaaaaccccgtttaacagctcgatgcactacaatatcaagtgatttaacgacatggctaagttaggtttagtcaaatgaaacttcgttattacatatttacattgacaagtcaacgaaaatttaagagtttaggttcttagccgaaagttggtgattatttttattttaactaactttgaaaggtaatctttttttttttgtgatatttttcccataactttaagaatcagtatatgttttacacataattgatatatataacttaaaacataagcttatttgggcaaagttaaattaaataaaaattcgaaataacttgtaatctaacacatattaaataattgaataaatatttgaaaaaaatattctcaatgaaagataggcctcagtgaaacgggccaatgttttttgtgtgggcttatatagtccacccaaaactttacttgtttaagaggcaaacaaagtggacacttgtaagtggtaaggttgtggtcacgtttgtgtggcccttaatgcagtaaaagcagagtatgagatgatggtggtagggaagaagagcaacgagggcgagagatatcttcttatcc

SEQ ID NO: 9114 - DNA, 3000 bp, Unknown
  misc_feature (1)..( 3000): cDNA_ID_2106396_gDNA_ID_1971986_Annot_ID_177744 3000 nt of promoter + ATG
ggcagcttgggtgccttcgagagcagccatctggcggctgaggttgagcacggtggggttgaagtgtcggctgtatacgtagaagtcgttgtccggtcccagttctccggtgaacatccgcctcatggtatccggttccatgacggtgaaggtggcggaggcttcgatggacatgtttactcccccgtgctccccaaactcatgtcggatattcgctatggccgctgcagggtcggcatcacacaccgccagtgctgatttcttcgcaaccaaggcgtcaccgtcttcgtcatcgcgatcgtttcgtttcttcccggagaatacgaggggctcctgtgtctcgaggaaatgagccatagtagttaactaaagaaaaagtagagcctttgttaggaaacaagaacctaggtgttaacgaaatgtaaagaggaaaggcttcaatttatagaaaaattaatcaagatttttttatcttatcaaatcaattacagacgttacttacacattttttttttttgttgtttacacatttgaattgatagtactattatttttttaaaaaaagtgggagtcattcacgtgtaccctgtctaaatgtttggaacgtaacgcttttttgggggttattttttctgttaggtaagcttaactagagttttcgctttgccaaagcatgaaagctacatattttgcccttgtggccttgttgctttaggattagcatcccacgtacgtatcatgtgtttttgtgagtcactttttgatcatgtgtttttatttgaaaactattttgtaatgaatattgctgtgatctctatcggattacttttgctctccttatcatacacggcatcttaatctattgaatataaacaaaagtagaagttaataatcacgaaccttatgatgaactactttcattattccaatttattattatatatcccttgggtaattgattgacaaagagtgccaatgcttgaccaaacaaaaaaaagactgctttttttattggttggtaaaagaggaatgggcaatacaaatacacaaaagtgaagaaaatacgaaagtgtgtctacatacagattcataaagctgagaaataaacatgcgtttagtgactgtggaatattcaaagtcatcagctcatgataactagataagatcatcatttctatggatagtttctcacatggttccaattagtatcagaaacccttttgatagaaattagggtgacatgtaagctttctcaatgcaaaatcttatattacttagtcgtcatctaaagtttctcaatgcaatttatttttgtatggatttctctaactaaatccacgatagttcatttttattttatttgtctatatttttgtaaaatactaggttttaacctgcgggactattttgttcttttaaaaataaaagtataatttgtttagtcgattaaaaatatatatgatttaatattttgtattttctgaatgtacaactcttatatctatatattatttagtatacaattactatgtttaacttttactgtttaaaatataagaacaataacgttcagttcattaaattaaaatctagattataactaaataatttaaaatttaattatatttttattttataattgttttgtttagtatttaagataatataattatattttgattgttatatctagaacttcacacgtggtataccgtttcgtattactatcgactcaaacccgtcctaccatctaatcccgttcagtgaaactaaacatatctaatggatttcacccgtgctataccgtctcgtattaaatagttgtcgaaatctaattcaaatattggagaaataagatttagtgaactgataagaaatgtatttaggtgcgttttgctcattttaagggattgcaattgtattttggtttgtcaaatattttttgttttaaataatttccgaaatctagttcaaattttggagaaatctgcatgatatatgagattggaatatatttggaatattttttgtttgttaatcaatttattgccaaaagaaaatcaataattaaaagccagttacaaccattgtaaataagttccaactctaagatttattttacaaaatagatgcaaaaatgtatatatagatatttgagaaacttcacatgaagataagtaataagcattacatttcatcctaatttctacgctttcttatctttttttttttcttttttttcttattttcctactcctttttttattcagttatttgcgtaactttcattcatatatatagtcaaacaaatacaagattgtaacaacatttctctatggttgtgaattctgtttcacttactaaaaaatctagacgcatctctatacaatttttggtacgttaaacgctcggttgtattcttaggaaataagaatgttaggtttgcttatctctccttagtccttatgattatgagaattattttctattttaggtgttccatgagatatttataaaaaaaacatgataatgaaactacagttttttttttttaattcataattttccattaaaaagacatattacaaggcccaaacagaaaatacaacacatgcctcagggccaaacagaaaataccaaaaaaccaacaacggagcataaagcccaaaggggaaccatggaaacaagacccaaaatacaacgttatgtgtttcggctgcatcattaaaatcacaaatctagtccgtttgtaagcccatttgggtaaattttagttttgaaaaaaaaaaaaaaaaaaaaaaacattgttggaaggttaggaggttaataaatgaaaaaaagaaatgaattagagagaggcaaaggcacataaacttattattatttagtccgcatttaaatcaacgatatatacttaatacttgcacacacactctacaaatctgaaattacaaatctcatcatctccttcctcccttgcgagatctgatcgtatcaatg

SEQ ID NO: 9115 - DNA, 3000 bp, Unknown
  misc_feature (1)..( 3000): cDNA_ID_2180343_gDNA_ID_1971986_Annot_ID_177742 3000 nt of promoter + ATG
cgataacaaaaataagaaagattaaaataagttaagccttaaatattagaattaagataaattacgaaaacacggatattacatgaagtcttaaagatgttgacctcgaggggatgcatgttgtgtaaactagaaaattgatttttggagtttttcttcttcttattcgtatcaagttcattattactttcatttgtcaaccaagaaaatagttttaatatcactaaacttataataaaaataaaaaatattcttttttaaattgggtgaaaaatccaaaacatcattctttttaaaacatggaaagtataaattaactctgaaactcatttctattttatgtagactagggtatagggctaacaaaaattggtctcataatagatatcgaacaaaagacacagaacctaaagcaataacaaaggagactaataaccacaaatttttctcatatagaaaaagtttacatattctccatagctattttttcgaacaaattaagagtcaaatgcaaaagattttaaaaattttgtgtgctttcaaagatgaagtttttagcggttaaccatgacatataaattcgtaatattttgtagttgtttttaaaaatatgattggattatataataagttttaccttgttttccacaactcattgaataaagaatttgtcacataaacaatacatatttgcaactgtcatagtaaaaatatattatcaaatctaacaaaaattatgtatattatgaataaaatactctaaatttaaagaaaagtatgaatccaacactatctctatcttagtacatatatatgtggactaatggtagttagttagagttactcttaagttttaagcgataaaggaattttgttttgtttttgacagaaaaatatgttctctagtcacatattttaacgaaaagttttaaaatagcttatctaacaaaaagcaagtgtacaacataaaatccaacttttggatttatttcaccactttcggacacaattgtaataagaacggaaagtttcgaaaagggacaataaatcaactaaagacgaaaaaggattaaggtgaaaatcttgatgccgttgacttttgttctcaacggccatgattgagcgtgtgatgagtataagagaccaaattatggctatttctaataaccccaaaaaataaattgattgatgagtttttcttcatttgatatgtaattataatcacttattccatttcaagatttgtggatatctattgatattctctaccactatcaagaagctaaaagtgtattaagtgcatgtacattagcttaggccgagaagttttttttttttttttttaaaggtgatgtatttgtggcacttaggcttaggcatgtaatgtgtggtgtgagatgttgcgcgacttgcgagtaacaaaaatgggtctcaaatattgaggcatgtatttctaacgtttgctatatatgcctttgatgttctctaaattctattttatatcgtatttccatagtaatattcagtaaaatcatgaaattcgaaggttgatatcagagtttatatagtataaagttttaagatataaataatccattgaaaactcaaaacataggtacaaaatagcaccatgtacaaataaatagctaaaataaagtaataaagtaacaaattaaaacacgtttaatactattcatgaactaatgttcaagtctatttaacattcacatttttccttgcttgtgatcttctatataaacttaaaattaaacatgcatggtttcctgataataataagatgtttagttatattaaagaaaaaagatagtagctctcaagacttaaggcggaagcataaccttattttttttaggttggtaccacaagagaccacaactaaacatttggatgaatataggtataacaaatctcttatgatatgtatatatctggcttatatatgaatgcatactctacgaatgtatgtgactgctgacgacattggtgttagactgttgatataattatatgaggcagtggatcgagatttgagaactacttaagtcaagattatcataccgagaattcaagatttaggtgacacatattttgggaacctcattggcccatacactaaagaggcggtcattctttctttataactctaaaccatattttccaaccaaaaacggtcgatgttaagctttaatatgatgttcaagatataggatacgagggagaagatgatcgctagaaactccacagcaccatttatcttcctctgttgtggggatcacattctcctcatttttatttttccattgcaccagtttccactatagaaattttcatcaaatgttagttaattaatcatatctaaatatattgaatactattaaagtatatcataaattcgtatcgagtatttaatgaatcgatgataaaaagtaaaatcaaaataaaatctccctttatggaaattataccctcgaagatcctctcccgtcctaaatttttcaaaagacaacaaataaatatatagtaatcaaagcaaactttttcactaaaccggcaatagccggtgtaattcacgtcacttccgggacaaaagcgtgactggacaccggcagacaaatcacatcaaataaataatagtaatatatttaattcctcagacaaaaaggctcttccacttcttatcgaattacaaacatttcatgttattgtttggttatatatatagagagacaaagctcttaactcctttttaattgcttgaacaaaaagcaaaactcaaaggaattttctctgtatttttttctatctgcagaaaattaaagaaaaaaagagaaaactcaaaaacccacatttttcctctgtttccagcttttctttatctttggagtttggtttctggagaagacaaaagttgttgtcctttttaagagttcgagatcctgcagaaattaaaagggctcttcccggcttggattcctaaat

SEQ ID NO: 9116 - DNA, 3000 bp, Unknown
  misc_feature (1)..( 3000): cDNA_ID_2180333_gDNA_ID_1971986_Annot_ID_177738 3000 nt of promoter + ATG
tattttaagttatatctttaggagtacgaaatttgtttacacattttaaaaaggtaatagtattttagattttgaatcatagatatagaaaatgatacaaaattttgttttacctggatcaccatttttaaatggacggccaccatattagacatcaaatgcccatttatctaagagccatattggttgtcttggtcccaaaaacctagatttctaaataataatggattctatagataccaaagcaagtgtccatttacactagcttgtagcttcgcttaatttagttgctatatatgtccacatcattcgcatatgctatctgacacataaaataaatgtaatttagtatatttagttcatatttgattaatttcggttacaattttcatattgtactctattaaaattctaataattgatattttttttgtacaaaggttaaattaataattgatattttgtaggtataagtgaagcttttcttgttaacatgcgtttaagatggttaatagttttttttgacatgtaaacaatcgatcatatggatcgttcttaaaagatttttatgttttttttacttgagatgcttaacacacttaccatgcatgtgagatgtgtcatgcatattaggtatttagagcaaatccagtagtggtttctaagcaaaatttctaacctataataataataataaaataataaataatattatttaattaagatagtttttaaggaaatgtgagagagtttctaattcaagagattttgaatactcttctacctattttaagaaacttttcaaattaaataatattatttcttattttattattactttagtagattagaaactatggttagaaaccaccattggacatgcttaggttaaacttgaatttcaatcattttccggatctgtaaagaatatgatattactactcttaaacaattatcaagggtattaaattggaattttattatcaatcgaattcgtggaatatttgtcacgtttaatcaaaaagtcacttatgtaaagcgtttgcatggtaactgtcgcattttaagcaaattaaaacactattgatgcatatggaggatataaagtcattgattaattatgtgttttttttttttggtatcaagattaattatgtgttatactaatgatatctaacatgtattcaaggaagaattgtggatacagaaaactgaagtatataatttgcgtgggggaatttatattgggcacacttgaacagcatttgtgaaaattcttgacgttaaaggaaaatgaaaaatgtgtgtgttcgtttacataaatacaaaaaataaaggtgctctatatcctaatacaaaacctagggggtagaagctgaggtggatcgcaatagaagaagatggtcggctctcactctcgagatcggacggctgagaagagaagagaagagaagagaaggagaggatgcgtttcttacggggagagagaaataaggccaaacaggtagagcccacaagatgactaatctccaccgtccaactcaaaaacaacatcaacaacaacacatcacaccaaatattattcggtttctctcttcaggtccgactcaatactgtcatacaccacatccactactctactactacagactttttggtgctcttccccctgtggagtccaaatcctttgacacgtgtcgttttctcaagagattcactgtcccactctctgcgtgattcccccccacatctgacggctgcagttcgccgccggtctactcatccgtcaaacgccggttactgctcagactttggtttgatcaaaataaataaaaaaagatcaacggctggaagaggaagtagaggttgaatctggacccttagatttatatatactaaaaaaaggtatttgggtcttcatgtcagtagaggcgtttctcttgcttgtttaacacaacactcccccactcttcacatttcttctattttcttctaatttctacatctcatcacatgtagcacacaaagtcacaaacacttgtactggaaatgattgaaagagaaatatgtcttatatttgcggatatataaatgtgctttcacttcaatatcatttaaaaaaaaaaaaaactctaattttctctgctaattgttacgtttgtaaatatattttttaatagaaaataactatgaaaaatccgagtgcaactatagattgtagataaaagggacaaaagttgaaaggaagtggaagcagcaaaagatgtttcaatggataggggagtcatgacgtgactaatacacttctttttataaaatgtactatacattagtactaaatacagtattgtacaaatattcccgtaaaaacagttttaatttttaatcaaaaacaactatcaaatatggataaattagcgtccatagttaaacaaaaaatgctaccctagctaaaatctccatttcttagaaaagaaaaaaaattctataatatataatacctcaaatgaaaaatgacacattgtacacgttcatcaaatgggaatagtattagtactagtaacctaaagatttggtaagaattaagaacaaacaaaaactagagaagagagagatatgtaagaagaaacacatgaataatgggacaattttattattagaattaagagataaatgaaaaagattcgtgggacggcgggcgcatagttcagagtgtgtcagagtcagaccaaaccctttctcttatctctctctcttacgaagaatccatcaaaaatcccacatacacacaatatacgtgtatctatatattccttcaaataaaagtgacagttttttaagaaatataattaaattgtttaaattctcttttttcgtcttcttcttgctttttcaaaaaccagctttacctttccacacacacttcttcgtttctctctctctctttctccttagcttcctcttcaagttttttttgatcagctgcaaatttccatagcc

SEQ ID NO: 9117 - DNA, 3000 bp, Unknown
  misc_feature (1)..( 3000): cDNA_ID_1029576_gDNA_ID_1971986_Annot_ID_177720 3000 nt of promoter + ATG
ttgattatgttatatagagtagatctttagacgtttcttacacgtccaccaccatgaacaaagttgtcatagcatattttatgcgcctaaaagctttaaaaaatattaaattaagacgtaattaggcactaagtgcgtgttgtgggtgagtagaataacaacgactactataatttattcaataataatgatgttcttagcaaataattatgataaacaatgcaataattgacgacaatgaaaaaaacgaatctcgctttgggagatgaataaaaaagcgaggacatctaatcgtgattattcttactcagccattttcaactacttacccaaagtggatccttacttaagcccttttgcaatacataaaatttttattaacagtaacttgttttcctagtggggacatctaatcgtgattattctttcttttaatgttataataacttccctaatttgttatttagctgttaatcaatattttaaccccaaggagaagaaatgcttgcaacgtaaatccccacttgtttcaagttgatgagtgtttggcaattgacaattgtgtgtcccttgttctgtaatgacaatccttccttccttcttccatatttggactaggttgttcatcaaaggaaggaaggccccggctacactacgttagaggctctccaaatctgtccttttcatccacaactaaaccaaacccaaattcaaataaccaaactgaactaaaacattccaccgcaaaccaaaccgaaattgagtatcccggaccacggtaactctgaattccaaactatacctagttttgaacacccctagaattatggacatcatgttcaagcaaagcatcaaagtgaggaggacagagtctccaattgaaaacgagtgaacactaaacaatagaatataacgtaaaaggatatggaaaaacagattgatatcacaacaaagtctcattgacccggagaaaatactgagtcgctcaatatcggtcattacatgataacaaagttttctgacccagagatttccaggaacataacagaagagaagagacaagcagtgagaaaagtcgaatcttacacgatacgctccagctctctggcgtagcttagagtctggttgatgagttgcagagacggaatctctttgcacggtgcagtttctttggctttctggaagacaacaaacccttccttcacttcccactcaggatgctcctataagatttgataaaacctaaatcgcgtcaatggttcatgaaactaaaaaagattctaaactttgcacaaaatgttttttctcttacatctgtgacataggttaagagttcttgatcagaagagaacaacaacatctgccgggcatcgctgatagagacataatcataagctttctcgctgcatccagctatttcatctctgtgaattcagtcataacaataaaaaggtgagataacacgcgagaagacataagactgaactaattcagagaaggacagactcattgatgctaccttatggtctttgccaagagatccatgaaatagacgtaagttgcatcaggcgcggtctgtctagcactcaacacacggttataggcaccctccatgaaggattgctcaagctctactgcatgcttgatgcaaggatcctctagtgtagctgatgaaagtaattcaagctcggtgtggaattcagcaattctattttgtaccagcagcctcagaaggttaagacccaggataagattctcctgtggagactgaggaatacggttcctggtgcagaggaaaagaagatatgttagaccaaaagaaaatgaaaaagataatgttcagacagttggttctttctttacctggcatccacatagtaaggtttcagctggaagaaatctctctcaaaagcatcttgatcctcggttttgacgcttagaacaacagcatgctcataaatgtcccctagaatacaccaattgtcaaagttttagaaacggataatcaataagaacaaaaattaccaataactcaatccaaaccaatgcagcattcaacgattaatgtatacatatagggatagacagacaaactaaagcagtacaatccctcagacactcttcagtggtatttaagtatagttaacaaataactcatgagaatagacaaatccaaaacactccatgcaattgaaagcaaaactctaaacttactagcaaatagctcatgtaaaaccaataatgaaaaagagaaacttacttgcaatagtcaattccttggctgcattaggtgaattctcgaacaatggaggaagacttgtgaatttggtaagaagaacctgaagaacacaacaaaaccccagcgacatcagagactcgcaccagtaaattgtaaatctaaaccaatcccaacaatcccttaaagtagaaagttaaaaatttcatagcacttagctcttctaaaagatccttaacacacttatatgctaaaaattctcacttcaataaatcaaagctctcatagatttaaactctcgcgacataacccatcaattttcccaaagttggttcaataagcagatatgcaaagaagtgaattgaaacaaattagggttcaaagaagagagagagatgtagaccttaagctgagacaacagatcgctacaggtattgtaatccttcctcgcaaacgccgccttgaatctctcgaactgctgtgaaacttcagttagctgcggatccatcgcttctatggttttttctcttcaccggcgacgattcttttcttatagatttgattgctccgagaactggcttgatcgcgaagacaaataatacagatagaaataattgtctttacaaaacgggcctttaacaggcccaataacctaaaaaggcccatggtgtacaatagaattctgactaatgtgtaccatcatcatctcttatccaaattttactctctcatctcctctttgctttcacaatctcacaacaatg

SEQ ID NO: 9118 - DNA, 3000 bp, Unknown
  misc_feature (1)..( 3000): cDNA_ID_3044630_gDNA_ID_1971986_Annot_ID_177727 3000 nt of promoter + ATG
gtttcttgactattctgcttttgtctcccaaggctatactattgttgatcgtatggattctctcgttgaagctagactagatcttcgattgtgggtgtcaactgattcttatgatagtgattatgaagacaaagattttgatgtctatcgtccatatgatgtttttggtgatgttacaagcctggtttcagggatacgcaaagttaagacccttcacctgtctcctgattctcttgaggtcagttctgttctgctactgctgactgatgggtggttttatcggttttgtatcatgtctatatgtgtttactggttgtgattataaaccaggcgtttttcttctgctgcaatcacatgccggtcttcaacaacctccgtaatctatctcttgagagcgacgaagaaaaaggatggcaagcattgcctcttctgctcaataattctctaaatcttcatactctatctatcaaagtatgacatgtttttgagaaattaatacacaatgttctttttggctcttatgtaaaagaagtttgtctgatttgttgttatggtttttagggtcttgtgcacagagttactagtagatgtggagacgcatgcgcctgcattagcgagaggaagacaggaatgtgttgtttatcggcatgtcgaatcaaggtgctagagattacagggtatggaggaagttttatagagctgaaacaaatgaggcattttttgggaaaactgcaatgtcttgaaactgtgagaattggtgttgaaagggacggcaacaacgagcacctgcgagccaatctaagctctcttcatagagcttcatcagagtgcaacatccagttcatttgatctctctttaaacaagttatagataatatgagtttgttagtaataaaaatatgacattttgtttaatttggtaaagttttgcactgattggcgaaacaattaagaggtctagttttggtaaaatccaaattgctaatctatcatctctcaaacatgtgttaacaaaaacaaaattgaggacttttgatttcacaatggccttgagccatgttaagagggaacaacgttaaccggattaaatcataatatttggtttggtttagtaaattagaaaacgtactgtatactctctctgcctgagggagaaggttccaaatagccctaaaaagcttcgccttctctccttgccttcatttcgggtgtggaggaaagttatcaaatcagtttttgtggaattttgaatctcgtcgcttctgtgttggctatgactgaagttgcgagctcagtggtgtatgaagtgctcggacgcagagctcaggatgtggacgagccgattatggactacatcattaatgtcctcgctgatgaggatttcgacttcggtgaggaaggtgaaggcgcctttgatgccgtcggtgagctcctcgtcgctgctgaatgcgtttccgatttcgaagagtgccgtttggtaagtaaccattcgcagcttgttgcttggctttcttcatttcaattatcgtaattctagattcgttttatctttgcttgtttgtatttatgggattttttcgttagggcctctgtgactgttgaaatggtttcaataaggtctcgcttttgaatgagctgagatatttaattggatgtggtgtgtgtaggtttgtagcaaactgtcggataagtttggaaagcatggattggtgaagcctacacctactgtgaggagtcttgctatgcctgtgcggatgaacgatgggatggatgatggacctgttaagaagaagaagccagagcctgtggatgggcctttgctcactgaacgtgacttggctaagattgaaaggagaaagaaaaaggatgatcgccaaagagaggtatacagtaatggcagtttttttaccggttttgaactgagaatttgtttcttatcttgtgtttatttactggtttcttgtttatgcagctacaatatcagcagcatgttgctgaaatggaagccgctaaagcagggatgcctactgttagtgtcaatcatgacactggtggtggctctgctatcagagatattcatatggataactttaatgtttctgttggaggccgtgatctcattgtcgatggatcaatcaccctctcttttggacgtcattacggtgggtttgatcttcgtttttatttgttttagctgtctgtttaatccaaggaatagacggtatggaaaatctaccttacaaatgggtatttgctctctttggatgactttacaggtcttgtaggacgtaatggtaccggaaaaacaacttttttgaggtatatggctatgcatgctatagagggtattcctactaattgccagatattgcatgttgaacaagaagtcgttggtgacaagacaacagccttacagtgcgttcttaacactgatattgaaagaaccaaactgttggaagaagagattcaaatactagcaaagcaggttagacacaagctactttactaatatgtattagcatttactcactcaggtgttttaccttttcgtataatctgtctttggtggtaatgttgacttttgtttggttatctgaagagagaaacggaagaacccacagctaaggatggaatgcctaccaaagacacagttgaaggagatcttatgtctcaaaggcttgaagaaatatacaaaaggcttgatgcaattgatgcttatactgctgaggctcgggcagctagtatccttgctgtaagttgctctttaccattataaattttctgtagccctttagagttttcatttgatagcatagatataaacgatatctggacccaagtcgtgacccatcactacataaatcatataaaatgctagatttgggtgatatctcctgttgaaatcgttgcatgttcttttgttaccttcaacttctgagtactgctaacttgcaaacgttcgctgtgcaatattttcagggtctaagtttcactccagaa

SEQ ID NO: 9119 - DNA, 3000 bp, Unknown
  misc_feature (1)..( 3000): cDNA_ID_2180306_gDNA_ID_1971986_Annot_ID_177730 3000 nt of promoter + ATG
acacttgaatttctctgtcccaacctagtaagaaatagagcttatgcagaataatgaattttctcatctgagaacatcaatatgcagaagatagaatattgctccctcatgttggcccagtccaacaagttatgaacattccacaacaatatataaaactgtttcacaagtcttgttaaacacaacttgcttgctttttcgtgctgcccagccagcattattgaatatcatatctcagtgagatgtataatgatgtgcctcatttctatctttttccttcgtgctttgctcgagcctcgacctatcaagcgttgctcaatgatgtaccttcgctaacaggaagagcttcaagagctaggcacaaaggattaacagaagttgaagttttctttatagcagaatattgaattttaatgctgcccagctccagcaacatatcttccaattgtccatcaatttgcagttctccatatgagcagatcattgaatttatccccatcaatatgcagatcattgagttattaagcagataattgaatttctaacacgctgcccagccagcaatatatagatctcttactgttaaacaagtcttacagtgttataatcacacagcttgcccaatcggacatcatagacaagtcttacaaaaggcaatttatccccatcaataataagcagatcattgagtttttatgcagatcactgaattttttcccatcaataagcagatcattgaatttatccccatctatataagcagatcattgaatttatccccatctataaaagcagatcattgagcttttaagcagatcactgaatttatccccatctataagcagaccattgagcttcttttaagcagatcattgaatttatccccatctatataagcagatcactgaatttatccccatctataagcagatcattgagcttttaagcagatcatagagcttcttttaagcagataattgaatttatccccatctataagcagatcattgaatttatcctcatctatataagcagatcattgagcttcttttaagcagatcattgaaattatacccatctatataagcagatcattgaattttccccatctatataagcagatcattgaatttatccccatctataagcagatcattgaatttatccccatctatataagcagatcattgagcttcttttaagcagatcattgaatttatccccatctataagcagatcattgaatttatccccatctatataagcagatcattgagcttcttttaagcagataattgaatttatccccatctataagcagatcattgaatttatccccatctatataagcagatcattgagcttcttttaagcagatcattgaaattatccccatctatataagcagatcattgaatttatccccatctgtataatcagatcattgagcttttaagcagatcattgaagtttatataatgctgcccagccagcaatatatatagaagataatcgcaaagatttgatctttgaacataacaagacttacaatgtttaatcacagcttcttacgattcaattatccaatctttgtgcataatttgtcaagacttacagtgtttaatcacagcttgccagccttacgattcaattatctaatatttgaacataatttgacaagacttacagtttttgatcacagcttgcctgtcttacgattcaattatccgatatttgaacataaatctgacaagacttacagtgtttaatcacagcttgcccctgccttacttaggcaacatcgggacaaattttcccaagttagaaaccggacaaacacaatcatataatgtgtagttccctttcttttgggtttgaacaaaacataaaactttctttgaaacgaaaacagagaatcgatgatggggtttctaatccagaaaaacgaaaaacaaaatctttaaaacacgatccgtattagaaacccaaacaatctttcacaaacgtataataagaaatcgcagattttaaaagagggtttctgatttaaaacagaccaaaaacaaaagaatagaaaccctaattggtaaccacaaatatgtataatttttgaagaggaatacaagattgaaattagaaaccctaagacaaaagacggtttttttcttagattagcgatataaaagaaatcaattgaaactatgattctgaattacaagtttttggaaaatcaagaacctcaaaaatcagatctaaaagagggttttttcgatttgcacaaaaaaaacaaacataaaatcgaaacgcaatttggaaattaaagagagagaacttttggataaaaattcaaaatcgaagtagtgaatctggaaaaagggagtttcaaaatctaagaaaacgcaaacaaaagtctccccaaatcaaaagaaacacacgaaatcaaaagaatataaaagaacaaacgaagaatcagacaaataaaagaagtaagcatggcgacgagcgagtataaataaccgttgtgaaatagaagaaagacggtggtctctgtgttgggcctaaatgaatatgtaagcccaaatacaagttgtgttgttttttccctcatcgtaatataaggcccacatatgtttttttttgtcgtcgaaatattttataaagcccaaacgaaggcccacatatgtttaactgaaagttatggattttccaaagagaaaaagaaatacaaaaattaggatccgacccggctgaacccgagtggtttgttcttgttcccacggagaaaaactttgctctccctttcctttgtcaatcggaatctgtcccatttatcgattcttcacagacacgttttcttcaatctttctccattggtttcgttctcaaggtttgtttgtgtcgatcgaatttagtttcaggacattgatcgtaattggttctgttgcagtttgagaattgcaattgttgtcatgtttagatagtggaaccctaatttgagtc

SEQ ID NO: 9120 - DNA, 3000 bp, Unknown
  misc_feature (1)..( 3000): cDNA_ID_2180319_gDNA_ID_1971986_Annot_ID_177734 3000 nt of promoter + ATG
gtagaaatcttgatcacttgaaattcataattaatttaggcgttaaagatcttcgataatggttcaagtataattttctttgaaaatttttgaaggttgaatctgactaggtatttaacacggagacgtttcatgtaaatccatagctcatgaatctcgtggctgtgctttgatcaacgaaactcgtgcttacttattttaatgtgattaatattattataaattaaaaccaagatacgatcttgtattaagacgtaagggatctacacttatacatcacactatcaaaaattcaaaaacgtatcgattaaagaaatcattttttaaaactttataggatatatcgcccgccacaagttattcaagtctaatatatagtcaacgtgtaaaaccacaaagttacaaacttacaataacattcactcgacccggttggatttctctatatttttttttatgtattgttgtaacaagaagaccaatacatgttgttgtgatctatcaagaggatttaccaagtaggcaagtaagtaaccaatgtttccaacaatttttcgttcaaaccacaaaatcatagaaatagtccttaagattgactgatttgagtatgtatcttgctaattcagcttgtgatatagtagcataaggaacgggcgttaattataccaacttaagcaaaaaaaaaaagtatatttatatgtagattctttttatataaaaaatagcgtcggtcaacaaatattagaatctaaccattcatggaagaaaagagtatgaaactgattacaaaagagagaatcaggtagccactcacaaaaatcccagactgtatggaccataatagcttgaatatatgtaatagttctccaaaaggctaccaataaaactaataaaatgattggttaataacaagataaaaatggtagcaatagtggcatgccaaatagaaaaaggatgtgaccaactctctcttggcaagttggtgtccaattacacaacctaacccgttttatacataaagcaaagattccaacattgtcaaggtcgttccaattccaaaggtggaggagtctcttttcttattcccattaatcaaaaagttgtatataatgtatattcaacgtctctcacccaacgatcatatttttttttagtgtgggatccttggaagagacaacgcctcccaaggtggaggagtttatttattcaaaacacttcatcaattttgagtttatctctacgtctcttgtatcattcatattatatcctgcaaaatttgcttaattattgattcttggaggttggaccacctttttctttaatagagagaaaaaagaaatgaattttcgatccataaatctttcaaaatttaagaccaatcattgaaaatatttatgatagattcacaaaatgtagatcattgaaaatatgtataatagattcacaaaacgtaaatcattgttttgtagacgaaacgtggtctctatatagtgaaatgatagcaacttttctctctttttttcatgagatgatttttttttcatataaatacatttgaatatgtattccataacctaatgtatctttgcaaattcttctacaattaaaggacatgatgcaaattaaataatctgataacttactaattatattcaatttctctgtaaagtaatattctatcttgatgagaaaacttcaagattatccttatattgaatttgacgtaagatgatttataattatgaggaaaatttttaatactaattagatggatcattctggacctgcaaataggacacatgtatatagagttgaaacatattataaataaaaataaaaatagaaattagtggaattgttagtgggtagtagttggatttgggtaagattactttatgatgaatttcatattgaggcttgaagatcttcttctcatccattgacggattggatcctccaagaacagagagaccaattagcttactctattgtgccattctccaccgtatcttttgcttcaaccacttacaattttacaaaggaaaattaactacaagacaatttacctaaaggtggaatttaagaatattctgaaaatatcactttaactacgtgtttgatgtatgaatcatatacaaatgatatattataagaggctttaaaaaaggatcaagtctttgttatattccttcgtttagagtataagcggtcctaaatgcacttgtagcattcataacaattattgtagcgcggtatacaagtattacagttatttacatacaaataactgtaaacgctctatggagttgagaaacttgtatgtaataagaccatcatccctacagttgggtttatacattttgtaaatgaaaattggatacatcttaggtccatgtagataaacctgcacttttcaatagagtgtgtgactaggtctgggagatagagtttccttcacttcttatgatgattataaaagtataggagggggaccatatttaaaatgtaaagattcggaggataataccattagaaagttggacatcattagtaaatagtgagtgttacccaaaacaaggcactatctatgcattgtttctgcttttatattacagtttttctttatatattttggacgattatggtttgtattcacataaatttcaattataattttgctatatgattcatcttcctctatcattcctcttagtcaaatagagttggctaactaaaccttttattttaatcaaattactccgttttaacttgttttggtgccaatcaaaaccaaattttatacactaattatttttactcgtttttttttacaaaaacattaagaatgatacaacataaaaaaatgttgtctccctttatccgcatttgttcctcaaagatgtagcactataaatagtctcatcaccctaagaccaaaaccccaacactcaaactcaactgctctcccataaccgaaaccgagagaaaatatagaaaaag

SEQ ID NO: 9121 - DNA, 3000 bp, Unknown
  misc_feature (1)..( 3000): cDNA_ID_4359977_gDNA_ID_1971986_Annot_ID_177721 3000 nt of promoter + ATG
gatgatgatgatggtgatgacgctcctaaaacatgggaagaagtcagcaaatctctagaaactaaacttaaacctgccgccgttaaaccgccggaagtagactctgttaaacctccggcgactcctccacggcggcttccgcggaagagcgcatcgttccacacactggacgagcttgaagtgagggccaaaagaagcatcgccgcgcaaatcccgacgacaatggttaagcttaagagaaccgagtcgatgtccaagctaagacccgagtcagatgatcgaaccgagtccactcagtcgtcctactcggggcctcggtcagtgaaggagaacatattcgtcaagagagacagagaacggagggagaaagaagggaacaagaagccggtgatgaactgggacccacttagggagttcccggagaagtgtccgccgggaggaggggaaggtttgattgtctacacgacgtcgttgcaaggagtgcgtcgcacgtacgaggattgtatgcgtgtgagggccatcatggagcagcaaggagttgtggtggacgagagggacgtgtctttagacgccggagtcttgagcgagcttaaggagcttctccaagacgaagcatcagtggcgccgccgcgagtgtttgtgaaagggaggtacttgggaggagcagcggaagtgacagcgatgaatgagaacgggaagttagggagggtgttgcggtgggcacgtgtggagagagtaggggaggaagggaggctcacgtgtgaagggtgcggaggagcgaggtggttgccttgtttcgagtgcggcggaagctgtaaggtggcggcggttggggcggccaaaggtgaaaggtgggagaggtgtgtcaagtgtaatgagaatggattgattcgttgtcccgtgtgttttgttaattaagaacattattagtttacacaagcaaatagaggtgtgtcaaatatactttgtcccgtttgttttgttatatgtatgtgacacgtttgattttgtggaattgaaaatgatttgaaactatgctaggattttcataaaatgttaaagcatgaacgtgaaccattataatgctaagcttgcaaggtctctcactcgtatatgttgatggttttgatcaattacgtaaaggagttcaacaatctcactaatttaagtttggatcgtcagaaggtaaaagctggcaaacaaagtcacttctgcctgaatactttacaaatttgttctttgttgctattttgtttgattgttatgcatccgttgaggattttgtgctatgaaacagagtaatatgaattccatcattatagtaactatggcaagttagtgttagttaaaatcttttaatgaaaatgcatacaagtatgcttctcaaacttagctttaagagtttctcacagttacataagaaagcagagcaatgcacaaaaaaagatacaaaaaagatagatttacttttgttcttacaaagaaacaaaaaaagaatctgacatttttctcacatacacaatgttcatggtcttcagttgtacttcctcttctttatcttgaaggaagatgatcggataatgtcatcgtcggcagtgagaacggtctcgagtggaactattgattcgggtttggtgaagtaagtgaagagaaggtagattccatccaagtaagtgttggtttctccagctttgttcttctttcttatgctgtaagccaacggaatcactcctctgttaaacacttccacatacattccacctcctgccacaagcaactgccacacacaccaaaaagaaatcccagcaacataatgaatctttcagagtctgcaccaactaaaaacttccactactccgaacataaatttcagaattcctcattagattaaacatgtgatatagcgtaaaagaacccacgcgtaaaccacaaatgataactgtgtattagctcgtttcgagcatcaaaggacatttcaagaattgagttaaaatgttatggtaaaacatgactaaaaaactaagaagtgcactaagggctcctatcttgtttcaaatggttgagacttaaagaattcacagcccacagaaggatgagatttgctcttagaaagttaaactctttacttcaattttaacaaggagtcgtcacaaacattcaattgatagctgcaagttacacaactctacattgaaaccattttctcttgctttgtcattaacgtgtaagaacagacacaagatacaacttttagtgatctcttactcaacttctaattgaatcctaaaatctctttctctctcaaataatcaaatttccctctgacatgaaacagaaaacaggtaaagttggagacttttacttacctcttcgtatttctgggtaagaccaagccgttcatcttcagacatgtctggtctcaaaaccgccattgtttcgtactgcctgagcccaggtgggcactgaggttccggtttgtcttcaagggcagttgagactcccgacccggaaggagaagtcgggtcatcatccgacccgaatccaccttcaaagaaagttccagagaagtcaagagcctgagatttcaccacaaattgagagccatctctcttctgtatcgaggcacacataggtttcgacttggaaatgaatggcctgagagagtgggagaatgatagcagcggctgcgaagatacattaggcagagggcaaattgtggaatttgatacacacagcgaagacgccattgttgtgagattgtgaaagcaaagaggagatgagagagtaaaatttggataagagatgatgatggtacacattagtcagaattctattgtacaccatgggcctttttaggttattgggcctgttaaaggcccgttttgtaaagacaattatttctatctgtattatttgtcttcgcgatcaagccagttctcggagcaatcaaatctataagaaaagaatcgtcgccggtgaagagaaaaaaccatagaagcg

SEQ ID NO: 9122 - DNA, 3000 bp, Unknown
  misc_feature (1)..( 3000): cDNA_ID_2782011_gDNA_ID_1971986_Annot_ID_177716 3000 nt of promoter + ATG
acgcaacattatacctaattttaatctatttatctttcttattatgacattaatattcctatatatttaatatcttttttttgttaaagatatatatttaatatcttaatgatgttgaatttgtgaatcgatttttacaaacagacgatgctcgaggttgatacaaacaaagatgggaagattgatgaagaagagtggaaagagctcgttgctaagaatccttcaatcctcaagaacatgactctgccttacctcaagtagacttttatttcaaaaatatttctctttcttgtttttattgacatataaagtaagtacgtcgtcgtttctatgatttatagggaagtgactttagcatttccaagctttgtactcgactctgaagttgaagactagaggaaatctttagaagaagctagaggctttttcgaattatacgtttgaggtcttttaatcctttttatgtataattcggaattcattcgacattatatggtacaaggctgaaacaatttgcaattctttttgtttcgattatgtctctcggtcgtttagttacttgttgataatctatttctaagggaatttttttacaatgaaataacaattttctttaaggttttatcatttaaatggctttttagaaaaatggcgttgtggacaataatctcaaaatataaagaaaagtgaactcttaacggtcactggtgagcaacggctataggaggagccactgcagtagcaacgtcgggtccacacgtgtgtcgaactgtcgatatatgtgcggccaattggttttgaattttaaatagttatcttttgatgttgttgtattcatgtaccaacaataatcgtgacaacattaacttatcttcttacaaatattgaaatgtatataaatacgtcaggtcatattattttattgtcagatgaaaaccaccggccataccagatgttatcaactactcttattaaagcttagatgatacttggttgatttcgtataaaatatagtaataatgtaagatcatctctaatagttaagaaccaattacttcttaaccttgaatattaacgttattttaaattaaaatttcactgttttgaaggtaagaaaaattagagaagattttaacaaattactattccaatgattaagaatcccttcttaagaagataaaaatcaaattattgcaaaacattgttttggttaacaaattactattccaatgacacatgtgtcattcttaccttaagaaaaacatcttagttaaaatacatatcttaattggtttgattaattataattgcttttaatgctaagatgtttgctaagattaggctaagatatacgctggggatgctctaagatttttaccatattttaattctggttaagctaatttttggtgatgcatatcgatcagagtctaattttgaacacaactcgtttcatcaaataatttataattctatttaatcatatattgacaacaacatcaaaaagatattgtattacttaaaaaaggatcagaaatttagctacggatggtagatgcatgaactggtcaagaaatcttgtcgaaagaaacgtttgttgtatctttaatgttatgttatgttatgactcacttttcctttgaaccttctttcgtggtacaactcccttgaaacgttcgcattattgaaagttcataaaacaatttcaaaattctttgtcatcaatggtgaaatgaaaattatatatataattatcatgagattatgtaatatattagtattatgttaatggtgtattaaataattcaaagctagaaatgtaaagatttcgtgaatggtacttgttgaatgggggtaatcgtaatataggaggaggattctacgaacctacatgattcattagtactcataatgcatttagatatttttcaaatcatacaatattataaagatatactaatgtataatgatgatttaggcttttgagatatgaatttttgtagaaagaggacccatccatgtgcaacggcaataatctcggttttcagaccagttcaagtttcctaaatgttagtattttaagtctctgattaatccctccaatctcttttaaagaaaatgattaatcactttaattaatggttagtttttgttccctttacaaagaatcacacgtggcaagatatcattgcaagaatgactcacaataccgtcgttagcctgcaagccaaaagccacgttaacattcccgttagattaatgacggcaacatcaccacgttacatagtctcccttattccgtttatcagataagatcataagaatgggtaaatcaaaacaattaatttttctaaatggagaaattataaatggtacttatcaatccataaattttaaacttttaggagatattaaaataaatgaaattcaatttaaagtataaaaataaagggaatattcgatgacttattttataaaacaaatttgatggataaaaaataaaatgaatgcaaagaaacggtcgtagatgtgaaaagtaacggcgttaagaatatacaaaatccggaaaaggctaagaagcgcgtctatttaaagaaagagctctctccttcttccaaaaaaaaaaatctagactttgcctttcttttagcgattttttttcaattcattcctcaggaaaaaaaaaatcatcgatccgaaaaatctacaacgatctttccagaaatctgtggttttgagatctaaagatcttcaatttcatcaccatttcctcgatcttcgtttgattgttgttgcttaagaggagattcatgaatttataggtgtacttatttgggttcgtctctgttaggttcgtgagggaggggttgatctagttgttgttgttaggatttggatcgattcttttcatggaagggtgtctcttattgatacccgtacgagaagattattgtttagatttggattagagctaggttttttttgtttcaataggaaatg

SEQ ID NO: 9123 - DNA, 3000 bp, Unknown
  misc_feature (1)..( 3000): cDNA_ID_2991955_gDNA_ID_1972003_Annot_ID_177762 3000 nt of promoter + ATG
tctacttctttactctttctctctcttccatcttttacacagaaagtaaaaaacattctcacaccttctctcccaagtgcgtgccacgcagacaccattatttgccatgagtagttagttgctagttgctactaattaagaaaaatgaattaagtttttaaaacaaacgttgtctagttatataatccatgtccatatacatctagatatatgacttagataccaatgtttcgactcttttaggtctacacgtacgttgcccaaacttcatatttgagacatctttatttatttgtcaacagaaatattgaaacatgcatggatcttgatattctaaaggtgcctgaattaaaatagaacgataacgttttaaaacctaattcccaatttgtagtttatatatttcttgtttgatccatattattacaagcctatatatagtgtatataaaactcaattaagcttcaaaaagtcagaaaactcatcaatagctcaagttccactaattaatgcccgaatttaaagttcatctctatagtttaaaatttgttcgtagctagattttgcatcttggagtggttagttatgtttattagacacttggaatgcttttgaatgtacaatgtccggaaaaaaaaactaatactgaaaaggggatttgtccaagtggtggtagataggaggaggcgcgtgagattggggaaacattggtttcttctgcaatgaatgaaacgaaagcagctatcatcattttctttttcttacttcacaagccgcagaaaagcctctcctaccttaaaatggacatgtacgtgtcgcttttctattgcttcctatctattcgacaacattgaagttttgttctattactttcgtattcaatttttaatttttgtttgagaataccaattttgttttggatctaaactcgttctaatgtaaaaaataataatcagccgcagtatatcaatatgttacattgtatctggacgtgggatatctgaccatgtctccatgaatccatgatgattgacagatttatagggataagtatcctggtttaggtaatccataagtatttatgaatattatgaaaataaattttgatcagaaagattaattagttaagactatgatgtagggtattttaaaatattgctaaaaattttgcgcgctttcagtatgtatatttattttactagttttcggttgatatatgatttcttgaagtaattaaggttattagctaaatggaagagaacgtgaggaatataacacatatgtgatcacatacgaatatatgtaggtttaacttaattggttcgttgattattctttataaaagtgaaagtagatttaaatttgttttccaatcttctatgtttggccattgtttgcaagagttttgggaattaaagtctttttaggtgagaccaagaagggtaaaatatgagtttttgggtctagaatttataagttaaatagtttattctcatttctaattattgttgaccaaaaaaaaaaaaaactgtttggttttgaggtttaattacttattgtatatgtacactctcaatcataatgttttggatatactgtatagtaaatttttaatcaatcgtgtttattagtatatatgttacaagttacaccattcgtcgtctcagtatcactctaatatcattctggcggatttactacacacaattatgcaattgtaaataactaaatacaaataattttccttcagacaaagaatctacgagcaaagatctttcttctcaggtgacgtagcaagtccgtatgtagtaatttagagagacagctaaaaaacgttaaaaagtaaaaaaaaaaaaaaaaaaaaaagtctagacagtggaaattacgtaataggatgggtgatgtggttcgaagtacacgtgtcgatatatgactgaatagtaagtaagctttgacttttgtggtagggggctggcccaaagggaggagtcacctttctaacagtgacttgtccctcttgttttttttttaccctttcaatttgtttgatattttaccgtcttattactttgttaattgtggactataatctcttctttataccttttacaatgattcaaattgtctagtctcatttaggttatatatatatatgatttgataccggaaagcgcaacacgaacgcaaagagcaaatgaccattgggggaaatttcaatagaagaagaaacacatgtatcatgctcacatgggtttcatattcacccaaaatcctccaaagtagaagaaacatgttgccactgtatatagtaaggcttattggcaaaacctgaccttacctaacatatgttttgaaaatttcaacaaaaaactattatttgtttagaatcattcaagcaatatgttttgtaaacgaccggttatgattttatgaatgcgtcaatggtggcacctagaagtagaatcaaagaatccatcattgattaagctttgcatgtcttcttaattacctatgacgatttagattcgaataagtaaaatagacactaccattcgcaaatggcccattagctcagttggttagagcgtcgtgctaataacgcgaaggtcgcaggttcgaaacctgcatgggccatgttttaacacctctacttttgatatttagtctctgatccctctattttgtgttttcttacattcacacccgttatcttttatttatttatgcttggtccaaccctgtctttggttttcttacattcatacccattatcttttatgttgatcttggggagtttatgtagtagggttttaaattaaagctccttcttctttggtattttgcctctggaaatcgaagcgggtaggactttttatttatttattgcatacacgtatttgtgattcctcgtcgagttacataaatcaatagcggaagtaattggatttgtgagtagagagacttaagaagaagaagaagaagaagaataccaaagcaatg

SEQ ID NO: 9124 - DNA, 3000 bp, Unknown
  misc_feature (1)..( 3000): cDNA_ID_2180608_gDNA_ID_1972003_Annot_ID_177774 3000 nt of promoter + ATG
atccttggtcctaaagcttcctgcatttccttcaaggactctgcttgtcgttgcttcggctacatggtctccaagaagaagtacatcttcactattgatgacgattgcttcgtaagtttccacaattctgtttatagatctgttctttttttccttcttcataggttcagtttgagatctagtgataaagtctgtagatttgactgatctttgaattgaaaattgaaaatacgatcacaattctctaggtcaactttaagaaacacactgttttgacttagatctatatattcatctgcttgatgggtttcgatctgttttcagaattgaaattgtgttagtcttatgtttgtcggcattgccatgatctctcttatgtttaggtaatgtcattgttgttggaccaacctttctatgttatgtcttaacagttaacttcacaagattcttgcatgtcattgtcctgcacatttatgttgtggtcataaggcttaaggcaaagaaaagtccaaactttatttgtggggctttctttttagaattgagttttcagttacgccatgattgtagcattgatgttgctttcatattgtgttggtttagtcatgtgtaacgtattgtctctttttcttatttttgttggctttagatgcatttgaatattctttgcttataatttaaatattattgttgttgtcatgtgttataggttgctaaggatccatctggaaaagctgtgaacgctcttgagcaacacatcaagaaccttctctgcccatcaactccatttttcttcaacaccttgtacgacccataccgtgaaggtgctgacttcgtccgtggataccctttcagtctccgtgagggtgtttccaccgctgtttcccacggtctgtggctcaacatccctgattacgatgcccctacccaacttgtgaagcctaaggaaaggaacacaaggtagtgttttatttaacatcttctgtctacattttttttttccggtttttataagctaccaatgcttaactggcatcactattaggtatgtggatgctgtcatgaccatcccaaagggaactcttttccctatgtgtggtatgaacttggcctttgaccgtgagctcattggtccggctatgtactttggtctcatgggtgatggtcagcctattggtcgctacgacgatatgtgggctggatggtgtatcaaggtacttactttccccattccactcgttgcttcaaaatgaatttaaatgttaatttgtttactgatctccctcttatgttcttcaggtgatctgtgaccatttgggattgggagtgaagacaggtttgccctacatttaccacagcaaagccagcaacccgtttgtgaacttgaagaaggagtacaagggaatcttctggcaggaggatatcattcctttcttccagagcgcaaagctcacgaaagaagctgtgacagttcaacaatgctacatggagctgtccaagttggtgaaggagaagctaagccccattgatccttactttgacaagcttgcagatgctatggtcacttggattgaagcttgggatgagcttaacccacccactaaagcttgagcagcaaaaaaaccaccaccgcagttttggttattagctcaacatatcatctatcttctccgttttgtttttgttttgtcttttctcaaattttccggcgattcttcagttcgtttttaagttgccggagtttatttaaatagtgaatggtgtagttctatttatgaccgagacaatctctcttttgaggtttttcgtttttgtttcaataataaaaaatcatatcccttagtcgttggtgtctttgcttgctggtttgttgactgttattttggatcaaattagttgaaagacaggaacagattccaatcaaatcaagccttaaacatatttgatttagtagaacccagttggtgtttttggctgtatccgacatgttatgtaaaaatggccaagagactccaacatcattattaaaaggattttggaaaagagatgatgaaaacaacatctttatgtatcagcaaatgcttttagacttaaatcattaagccggactgcgggaatacgctggtctgtattgataagctcttgaacaaactctaaaaaaccttaaccctttttttatgatcacccaaagaaggagaccaattaggcttttatccatctaaggattaaagtcaaacacgtattttccctggggacgacttttaacagaatcggacttgtactcttttaactttttatacttaaaaaattggcaagtagctctgataatttggtgctaatcagcttcaaatggacagaacgatgcagctcatgaaaaataataattgcttttgactttgttttcttgttttctaattactactagatgtacaagggggtttcattgtagcatctaactagttttagattgaaaagtggcatcggtacgtagtagctctatacattcagtttgtgataattacttaattagtgataacatatggtatttggtaataaaaattattaattcacataatgatgagaaatgagccgaaatcaaatactgtaatccagaacaatttattttccctcacgtatatttatcgaattttgttacatatatgaaaggacgttaattaagaactttataaactcaaccattttagattttgactttggttttctatatatataaataaatacatatatcatccacaaaaacatatgacattcactcacatcagaatttcaaaaccgtaaagaaataccttccttttgaagtctttattctctccacgattgacgattaatggagatgaagaagtggagttatgcgaatttaataaccttagctttgttgtttctcttctttattattcttcttttggcatttcaaggttcggcttcgatcctcttgttattttttcttccatatctataatcatttacttgatagtgatg

SEQ ID NO: 9125 - DNA, 3000 bp, Unknown
  misc_feature (1)..( 3000): cDNA_ID_2106821_gDNA_ID_1972003_Annot_ID_177776 3000 nt of promoter + ATG
ccacggacgaagtcagcaccttcacggtatgggtcgtacaaggtgttgaagaaaaatggagttgatgggcagagaaggttcttgatgtgttgctcaagagcgttcacagcttttccagatggatccttagcaacctataacacatgacaacaacaataatatttaaattataagcaaagaatattcaaatgcatctaaagccaacaaaaataagaaaaagagacaatacgttacacatgactaaaccaacacaatatgaaagcaacatcaatgctacaatcatggcgtaactgaaaactcaattctaaaaagaaagccccacaaataaagtttggacttttctttgccttaagccttatgaccacaacataaatgtgcaggacaatgacatgcaagaatcttgtgaagttaactgttaagacataacatagaaaggttggtccaacaacaatgacattacctaaacataagagagatcatggcaatgccgacaaacataagactaacacaatttcaattctgaaaacagatcgaaacccatcaagcagatgaatatatagatctaagtcaaaacagtgtgtttcttaaagttgacctagagaattgtgatcgtattttcaattttcaattcaaagatcagtcaaatctacagactttatcactagatctcaaactgaacctatgaagaaggaaaaaaagaacagatctataaacagaattgtggaaacttacgaagcaatcgtcatcaatagtgaagatgtacttcttcttggagaccatgtagccgaagcaacgacaagcagagtccttgaaggaaatgcaggaagctttaggaccaaggatacggttgatgtcgttcctgttgtagagttcgtaatcgaacccttcagggacagcaatggtcttcgatggatctccatcttggacgataatcagatggtaaggctgaagaaaaggcctccacatctccaggaaatcgaggttacggatcgtggggatcacgatatcgagctcatccttcaacaatgggatgtggttcaccggaattccaacggtgttcgccggctcaaccatgattggattgattcagagagaagagaatttggagagaaaagattgtgagatttgagatcggaggtgatgggagactctgaagaccgtcgctttggcttttatattagttggcacgtgagagggctttgtgtgagttttgacacgtggtggattataagtcgttcaccaggtcaaaagaatttttaaccttgttatggtgaggaagtgaagactttactattttgtctcttaattgtccgttttctaggctattaataatttgtcttattggtttagaaaacatttgttaattaatttcccataaaaatagaagcttataatattgtctagagattatattttagatatttatcaccacaaataaaataaaataattgtcaatctttttaaacagatacttttgaagaatatccatactttttgatattcttgtttagttattaaattaaattatcagatatacctacgaactaatatggatttatatatttcagttacacttttggttttataacttgttgtcaacagaaaaataaaattgttgtcaagacatttgaattttagaaactaacttattttggttaattaaaaggtcaaaagattcaaaataaatttgtttctcaaattttagtggtcaatattaaatttctgaccaacaaaaatcacaaaacctcagttttgatcatttattattaattatataattgtgaattttgttttgatttaaggctttttaataagttaaaaagttttgtttcttgttcgtttaggtttttttttttttgttatacttataatcagttttagacttagaggaaattgaacagtttagaatagtaggtctagctaacctctttttttttggccggtctacataaccttgcgaaggatagatctttcagctagcaatttaattcatttctgcttaccattgtttcttacttaaattagttacattaccatcaatgtacctcaattcgtgtgtgagcgtttttaacaaacaaaaaaagtcgttcgtgagaattaaaagatggggggatacaaaaaccgaacaataattgaatactttttgaccggagtgtaacatcaataaaggtgttaattagagaatgtaattaggctttttactaacgggaataataaattaaaaactgtcctcgatctactttactatgtatggaaggaacattcgcatgtggcattgtgggaagctgaatctcaaaacttattttaagttttgacattccttacacttatgaatatactatacgattttttttttatcatcaatatacggattagtacattgatgataaaagaaaccacggatgataactattaataattattttattatatgatgaaaatgattatgcatttcacgaaatttcactaaaaaacaattattatgaacaaattcattttgtttatctaataacaataaaaatcattggactttgattttatacgtcgtgggaaggtcgtcgaagcacgttgcgtttgatcattgcatgcatcgtgaaaattccactaaacatcgtcttttaaaaaaagaaacctttaaaacattacaaatggaacgtgaacctataaaatatgataggtagatctcacactttatttacagtattaaacaatatggaacattgacgttaaattattattttctacttataacaatttacacctcccaaaatttggaaaggataaacccaacaaggcaacaagtatcacaaatgtagctgaaatagatgggcttttaaagtttatggattgggccgtcatgaacacatattccataacataacctaattgggtgctccgacttcttttcgcgccgctcgcttgtacatgtcctcttcttcgacttccagataaaatcgcttcctctgtttttttccgatctaaattcacagctcatcgaaa

SEQ ID NO: 9126 - DNA, 3000 bp, Unknown
  misc_feature (1)..( 3000): cDNA_ID_3044666_gDNA_ID_1972003_Annot_ID_177778 3000 nt of promoter + ATG
tctcgaaatttccttaaaataatacttttgttcaacacatgggaaaaagaatgtaaccataatatgaaaagaataaaatgcacaattacacagcaaaatgtggggtactgcaattacaaaagatgaagtatggaaaccatgtaagagtatcatatactttctctgccgataacaagtgctagaacttttttttttctttttttcttatcttcttattatccttgccaataaaattgataatcaatgtcatgtaatgaaagaaacagaagatttttcttttgactttttaacattttaaatattgaatgttcttccctagcccacactacacattgaacatgctttgaaaaaaaaaaaactatgactaaagatcacaaacttattagtaacagattgtttttttttttcgttggcaagcaactattctgccttaaaagcgtttttgtaaactaaactttcattcctaattgatgatgatattcacattcacgtatatataaaatatgtaaacgatataggaatcacactttaacaaaaaaaattgtactaattaaaaatagaagaagaactggcgcaaaatgtaaaagcaaaagagagattcaaagggagatttgagacttcagtttcatgtgtcgtcattgccatctttcaacatcacctaaaatcttcagagaagtcaacgaggaaatctcgtccgtaggatgatgaaatcgtacaaactctgatgatgcatgatcctcaaagtcatgggttcacacaatgtggttaagtttcttctttcgtgtcagaaattatcaaatgaaaatgcgtctcattattctcgcctacttttgcttcttcttagaaattgcctcctccatgcatgttatttcaaaaaagttcttcgtcatgcatgtctatagaattacataagcccaaaattattcctacaacctatgaaactttgttctatgtctatggaattaccaaaagcccaaatcaaagcccgtataagcccattcgagatactttttgtgttcctcattttcctctcggtgcatatccatattccatctgtttctcttccttgattatcggccaatcatagaacaagaagtagagaaagcagaagatacactacagagacagagagaggtaaataaaaatcaatcctttagatctctcttattacgtgtctttaatgattcaatgataatcttttttgggatcttcttgctcacatttaactgatctgatctgatctgataaataaacaaacttaataaaacattttcaaaattcagatcttgacaagatgggtaaagcaagaggagtgaacaatggcgtgaatgaaagttctctcggttatctttttggttccggccagccttcttccgctgctgctgccacaatggggactactactactacaaccaccacaactaccaccgatgggaccggaggcagaccgataaccaccacgacgaccacagtcactgataacaagaagacatctgcaggtgttagaggaagtcctaataattacttcagatcagaaggccaaaactgtggaaactttctcacggtaacaggagatctttagtctttacaaagttttgagatcaaagaattgacttttgatttggaaactgataaaaaccaaaaatgtttgttgatgagaacaggacaggccatctactaaggttcatgcagctcctggtggaggatcttctcttgattatctgtttggaggaccaagtcctgctggatctggaaacaaatgaagttacttgtagtttttttcccactattcagattcgtgtaaatcatcaaaagtgttggcttttatcccttagtgaaccctgtgtgattcaattgtgatgtttgccttttgttctcttctttgtcttgttaaaaggaattttcagacaatgttctctttaagagttccaagaaaataaactaagtactgatcaaccaagagatctatatcaaatgaaacaaacaatgcccacaagatcttgcgttgaatcagccatgttcaaagctctgatcaatcgtaggagaaatgattcgaattcagccatatacttacgttttatcatagagtagaaagaaacagagtcaaatcaacgaccaattgtaggagaaaggattcaactattataattcataatcatgcactcttcttcaagttctaagatttaaacatagctataagccacaaaatccttaacaaaaaactaaaacttttaggggtcaaagaccacaattccgatacaagaaagcaattaagaaactcggacgaatctgagtcacggtgagagtgctctagaatcctagcttggtacggcgccagtgcctacgcttagcgttgtacctgtgtgaaggtgatggaacaatggaactcagtatcaaagtctgcaactttttcacggatcgaatgaaaaaagtttacgaaaatctataaacctgattttgttatcagtacggagacggatccaattagggatcggtctgttctgtctcatcttcttccctagcttctttttgatcatgaacgacttgtgcgacggctaatatcagagaccatgaaatcgatcaggcgaaggaaatatttaagagagatagaacaaaggatacagagagggagagagtaaaagtaccatcttgacttcaacggtggcgatccggcggaacacggcagcgtttaaaccctaatcttctcaaatgttaactgaggaagaaatcgatttttataagggttgtggactagagctcaatcctgaccgttggagttttctcataatttattagccgtcagataggtaaaccgttaatttaggaatcgtattcggttccggttacctttaaccggaaaagaaaaaaatatagagatttagggtttcattttcttctctctctcttgtctctgctggtcggctgctgaaacaagttgtaattgtggtgcatttgttcttcagcgcagccgagaagattcgaaaccggagctaagctatg

SEQ ID NO: 9127 - DNA, 3000 bp, Unknown
  misc_feature (1)..( 3000): cDNA_ID_2180622_gDNA_ID_1972003_Annot_ID_177781 3000 nt of promoter + ATG
taatctcatcttaacgggtgaagtatgtttggtgcatttcatctacacatatctttatctaagaaaaaaggtcatataactggtcaaccagtttattctgaaggttacatgctatttatagtctttcgaagtgtatatctctttaatctatcattcatttcacagtttaacattttaaccacgctgtttattactttgatgcaatcatgaaaccatctatatacacaatatcatccaagaatcgttataagatttattcgcagaaatgagtgtcaattagtaataatcatatatgtgtttatcaacttgacactcaaaagtttttccccaaaaatggtggctcatctctaactatgtacccacacatactctcgtttctaaaacagtgattagttaatctttggtaatgataacaaaattgtttaaacacaagcaaccaagagattgcatgaagtttacataatacatttgcagtaagcttaaataaggttatgctagctataatctgttgttactcacaaattgttattagtgcataaaattgaaaaacgacccaagaattcaaaccatcaaatcatacataaaggtaacgcgcttgaaattgattatggtacaatatttgaaagcaaaacctaatacccatgtgtaatagtatattcctcggtacttccaaggtcaaatcaattaattttgtttttttatatgaatagcaaacaatatacttgttatgaaaaaataaatagataagaagtcacaaaccccacctggttcacagcacattgtggaacaaagcacgtgatatgcccacaagctttttgtgattagtacatctaaggacataaaccctcaaatcaaccaagacaaaatactaaaagacgacgacgactttattccatatatataataattttcttcctcattttatatgccagattccttaatgttgaatgattcacatgcaaaaagttattacatcatcttaagcactttatttaatacattaagcaaccgactaattgtttttaataatcagaaagtaatgaactttttgatctaatcgtttcttcagtttgataaccaacttgtggttttgtccacaacacttaaaacatcatccactaaataaatcactctactattcgattagggatctaagagcgctgaaatatcacaatctttaactggttaaagtaattatgcatgcctggctataaattcattattgttatattgatttgacgcatactcttaacaacaggaaagagatgtatgagtaaaaagaaccttgcacaataatgtcttagtagccatctaattatagaaataggttcctttcatgatatttattggtgtttaatcgaaagaatcaaacaaatgaagttggcttattttttaatatgagatcggatacagtttccaataccaaattcatgtatgtatatataaagtagaagatgtagtctatataagctgtgtcgacatctagaatcgattcttacttaatataatgttgaataacctataattcatcttcacctagtggacatagttacaaacacacattaatacacgacacattatccaaaactttgaatgtggttttttaatagccactctttaataaactataatttatgacaaaccatatttagtgtttgtggatattcacaaaaatgtggtccttcgtatatgcagaaacttgaatccatattttgctttaactgtttaacttgcatttgcatatgcatgcattattatgcatcagtctctcgctaaactattgaagtctatgaatcaaagtacccaaaattaattattttcaataactaaataatattgacaaatttaaaataataatatcctagtttgaaagacccaccaatctcagaccatgcaagctttcttccagttcaccaatccactttcccccctaataatttattttgattttatgttgccattagaatacaaattttatttattatctcttattatcctttaagataaatatatgtattatcaaatgctgtgtgttcctgacaaactccacatgcacatgtaaaagaggcaccaagacttataaagacccaccaacattattttgttcacatggatgtgtaaggctaacttagctaattatcaaaactcatagataaatatttttttttttgctaaaatagataaaacttctaagagaaaaaaagagagagtcatatttggagagaaaaaaaatatgtattataaaatgtatcaatttctcattcattgacaatttgagataaatcaatgaatagataaacatgcctaacatttcttataatagatccaaaatataaccaattttttccgaatttcaaaaagcatttaattttgttttctctaaataagttgccttgtgctgtcatgtgcgtaactatcatcttaggagatgaaacagattcctcattatttggcgagcagaatttttcagagctctgacataattaaagaatatataagattactagtgtatataatactaaaatacataaaatctcatacatgtataaactttatatgttaacacatgtacatgcattacattatatatgcttcaaacttcaaagcctcctttgacagttgtatctttgcctttaaagatagaaacctctctctctcaaagaccaaaaacaaaaaaaaaactttttttttttcccccttctcttctttcttcttcaaggtagcctccaagccaaacacggaggaacctaatctgttgtctgctcgtaacttcacaagaagctataatttgtcgttaatgttggcttcttcttgtccatttcttcttttcttcttcctctgaaacacaagaaaaacatctttaacccctgagcagagtaaaaagacgaagaaactggtaactccaaaaaacagagtatatatatgaagagaaacttgagtttgtgaaagtttttttagttatcttgtttttgagataagagttaagtagaggaagaagat

SEQ ID NO: 9128 - DNA, 3000 bp, Unknown
  misc_feature (1)..( 3000): cDNA_ID_1398573_gDNA_ID_1972003_Annot_ID_177779 3000 nt of promoter + ATG
ttaatattagatggttaactagatccccttgaaaatggctaccacttctttgttctctatctccatgttgggaagtaaaagatattcagtataaacttttgaaatagtgtgtagcatcaagttaagaaacattactagcaaaaaataatgtataggaaaagtctccgcatatgtttcagggacaaaaaaaagattcaaagatcaaaaaaaccctgcagccaaatacacagagaaaaagctttaaggaagacaaaagattcgttatagaattgagcttctctggggatgaaacggtttttcttgatagctttttcaacgaacactcaagccttgaatagctgcagcagatgatgatgatgcctgagaaccttcctccgttaccttattcgattcgatggtagttatgatacttgaaatgttgtcctacacaaccacacataagaatcagattcaggagatgttttgtaataaaattctgtaataagtgaaagcttttgtagttaccttccaagtcgcaagctttgttcggagagattgccattgctttgtcccaaattcacgttcggaagagcggctgtaagatatgaatcaaaccatcaaataatgaatgttgcgtttagataagtgcagagtttcaatagatgtgtgacttgcctgacaattaaaacttggttcatctgatccatcttacactcaatcagttttgcagttattgccttcacgatccataactcgacatcctgttcatttacctgaaaacgaaaagaaaaatgagaaactaaaagggtctcaatatttcatgttaagtgcaagcagaggagagtttttacctgaagagtgtctttaatcgaggtgtaaggtattttgccagattcatctgaggccaaatccactagtgacaacaacctcatcttcgtaacacaatcttcattggaaagtcctagaaacaccacaggattcatcaggagatcatatttcagcaaaaacagttagtgagttaacaatgtagtaccatagctttgcagaaatcccgaatttgcattttggaattccgtgtaggcatttaacctctgagtaagaaaaatcttcagaagttggtaaacaggtgcatatttagcatccttttccaattgtgctacggctggcaagtccaataaatcacactgcaagatttaagattgccatcgttgaaattccaatcaaatataaaagagcagtgtcaggacaagaaagacaaatccaattcacattatgatacctggaaaatactggaagctttgacaaattcgataactgcacgcacagcctcctccttggcttcatccaggacctgagcatcctcattggagaaagttgctaggtacttcgtcaagaacttaagggattcattcaccaagctggagtattaatagaaaaaaccatgaggctattgttatacccaaacggaaacaaaaaaagaaagagacagagaatgactgatgagcatagttataaagtataaattatgtttcaataccttttgttttctttcagcacattagcaatggcaagaaagagttccctctgatctttaatgtcaatattccactctttcagaaagttatcgatcttcttaaaagaagaaactatgtactcagtaaccttcccatcaacagctagtgtaagagctttcatgtatacttgaaatcgagcatacgggtggtcaaccaggttatagagattgaagaggctacacaaagattaagacaaaaaaaaaatgagaagtgtgataaatgagcaaagcattcagaaataagcagaaacgattcatacatcttcaaacgaagtgaagctttgtcactgggttgttgagcaaccttggaagctatagctttcaccatttcaaggacttgctcagggcttttcgcattcttgacaatgctgcaaatgatggtgtaggtacactcaagatctgaattaaaaaaagatgcaaatcactgagaattgaatactcgaaagacatacaaaataaacaggtataagtaagaataggaacacaaacctttctcagatatcttagaagataccaattcagctgaagtgaccattaacgaagacaattcaagccacttctctgctaccattgactcctcagcctccctacagagcctggtaatttctggctctgctgcctaaaatttgaaacgataactagttaagtacaggcaagccttgaaaacttaagaagtcgcttaatgaaactaatcttagatggttgaactaatcggatgcatcagaatcctcaaagattacaaactattctagtccagaaactatcaacaaacccttccataaccaatcagattcttcgaacgaaacaacatataccagatcaaatttcccatctcacttaagatagacattcttaaattcccactataaattcacaaccaaggtgtggaggttacctcgggaccagcatcggcccaggcgagctgggaagtgaatcggacaacagcgagaaagggattttcttcggaggtgggaacaatcgtcgtcatagcttagctccggtttcgaatcttctcggctgcgctgaagaacaaatgcaccacaattacaacttgtttcagcagccgaccagcagagacaagagagagagaagaaaatgaaaccctaaatctctatatttttttcttttccggttaaaggtaaccggaaccgaatacgattcctaaattaacggtttacctatctgacggctaataaattatgagaaaactccaacggtcaggattgagctctagtccacaacccttataaaaatcgatttcttcctcagttaacatttgagaagattagggtttaaacgctgccgtgttccgccggatcgccaccgttgaagtcaagatggtacttttactctctccctctctgtatcctttgttctatctctcttaaatatttccttcgcctgatcgatttcatggtctctgatattagccgtcgcacaagtcgttc

SEQ ID NO: 9129 - DNA, 3000 bp, Unknown
  misc_feature (1)..( 3000): cDNA_ID_3610136_gDNA_ID_1972003_Annot_ID_177784 3000 nt of promoter + ATG
ttattaattttattaaattgtacattgtcttttaaataaagtgatataagaatattagaagtggacgaaagcaatatatccttatgaatcgaaacaaaggagtaagagaaaaagaaagtgtgatgatgatcattttatcttaagacatcacatgggaacaaaggagaaatcggacaaacttagaatccattaagtcatgtctacttcaccgactccagaattttgttgtctcatgaacaaagattggggttttaatagcttttctatagtattttcacatccataataataattaatgatgtgaaggatatatatatcaacgacaataatatcctaaaaatcatgttaaaagttaaacacatttctccatatttgataaatagcaatcaatatcagcgtatataaatgagatgaagctaaagttagcaagacaaacaaaaacgtatgaattacgtgagcttacgtgaatattgcaaatagaacaccaaatcattaatttcggttgacgtggatattcaaataatgatctacacatatacagtaccgtgggtacgcatgccatttcgagacgtatacaattcagtttcttccacttgagtttcagatctttatcaaaattacaaacacgtttatatatatatacacatatagatagattgatagccacatttctgagattcgatagtcatatatacgactatatattaaatattccagaagatatattgacactttttctgaaagactaattaagaagaacgcgcaagtatgactatgcgttactaagaatatttaatttccattagaaaatgtgtaagtttatctgatatactagttaattagccaaatgattttaaaatttacgttaagaaaatttcgtaggttcaactttttagtgtgtaagttattaattgtgaattatacagctaggaacgtccgttatatgtaaacaaagtaactatatataaaatttaagacttagagtaagtatttattatgtgattgttatatatactcgctaaagagtactagatgaagagtgaagaggttgggcatctcgagagagaaactgaagaaaacagaagagaaagagagttattcactcgatggtccccctaattttcctatcactttttctctctcaatttaaccgtctcttgtattatccccaatagttacatttttaattactcttatcatttcaatacccaacaaagcagaaacagcccagcaaaattttcacttccagaaattataacatggttgaatacacaacactaattaactgcaatatgaatcataaataaatttattaagatttctatataaaaactgttgggcagcaaatgcatgcgtacgatatctatagaattggagtttagtgcaattgttggtatttctttctttggggaaagtgacacgttaaaatatgaaaaatgtaaaaatttgaacaagacttacaataactagaaaaatcagagatacaaaatttactactctatcagtctatctgttgtcttatacactacacctttattatgcactgttcctatcccaaacaccaatccctatgctcagtccatatggtagatactactagagatggtaacccaacacatatgtgttagatggccccataggcagtaagcaaaacattactttttacaaccatatctttgtttataaattttaaaagctatgtgaatttaatttagtattactatcctggatcacaatcttgggccaacaaaagaaatgtgtatgggccaactgtgatgaaagaaaagcccaatggatcaaagttcagatgctttctgtagctcttttgtagagaagtttttgtaagtttagttatagaagcaaaaataggtaaaccacaaaactgaagcccggttgactaaatccttaaatgtgatcatgtcacacagcaacttggctacatgttgtcgtgaagcaatgaataaagtggtacgtggtgtattctagaagcgaaacgtgtcactaatcttatcacctttttagggtaaaatagatttgaaacaaaacatttcttcaaacatacaaaaaaagaaagaaatagtacaagttggccactatgcgtgtcccacttctcgatctcctctttgattgtttgcgtctctttaggagatcctcccattcattcattctttcctctccaccttattattactattattctgctgcatgaatttcaaaaaattatgtaacaacaatttaccgaaatgaaattaccacaaaggattagaaactagcacattcttaataaccaatattgaactcttattagtattgttgttagaacttgaagttaattaggccacaagaaaaggcgcgtagaaatgtttagataaaaaaaatgtctaacgtatttctttggtttgccgtgtcgggggcccagtcaggctggatacacgtggcaataaagggactgtcgtagttgagcacgttgattattagacacgtgtcgagttgtatatgaacaaagtagcctacgtctacgccacttgatgcccttttccacgtggcgtggtgggtggtcgtctatcttttcctataaaaaatcataaatcaatattaaaatgttttcaagaagataatccgaataattccctatattttgtgtctgtcaacgagaaatcactatctattttcattgattatactaatgcaaattggtatattaactggaaattatgtctattttaagccaacttgtgtgaaaatatactaaagtaaagttttaaaatccgtactacatcgtcaactatgcttgtaatataattcaaaaacatgattttctttttttttccctgaaaaatataaaatatgcaaattgaagtactatagtttataatagtaagcatttggtgcttgttttaagacaaaattgtttcgtctctctcaagattgaaaatagaaagttaagccaaaaacgtttctcccttctctttcgaatttctctgactttgatatttggtt

SEQ ID NO: 9130 - DNA, 3000 bp, Unknown
  misc_feature (1)..( 3000): cDNA_ID_1567735_gDNA_ID_1972003_Annot_ID_177783 3000 nt of promoter + ATG
aattaataacttacacactaaaaagttgaacctacgaaattttcttaacgtaaattttaaaatcatttggctaattaactagtatatcagataaacttacacattttctaatggaaattaaatattcttagtaacgcatagtcatacttgcgcgttcttcttaattagtctttcagaaaaagtgtcaatatatcttctggaatatttaatatatagtcgtatatatgactatcgaatctcagaaatgtggctatcaatctatctatatgtgtatatatatataaacgtgtttgtaattttgataaagatctgaaactcaagtggaagaaactgaattgtatacgtctcgaaatggcatgcgtacccacggtactgtatatgtgtagatcattatttgaatatccacgtcaaccgaaattaatgatttggtgttctatttgcaatattcacgtaagctcacgtaattcatacgtttttgtttgtcttgctaactttagcttcatctcatttatatacgctgatattgattgctatttatcaaatatggagaaatgtgtttaacttttaacatgatttttaggatattattgtcgttgatatatatatccttcacatcattaattattattatggatgtgaaaatactatagaaaagctattaaaaccccaatctttgttcatgagacaacaaaattctggagtcggtgaagtagacatgacttaatggattctaagtttgtccgatttctcctttgttcccatgtgatgtcttaagataaaatgatcatcatcacactttctttttctcttactcctttgtttcgattcataaggatatattgctttcgtccacttctaatattcttatatcactttatttaaaagacaatgtacaatttaataaaattaataatttgatgaatgttattgattcatatagatatttaaaatgtatttgaaaaaggggtacaaatcttattgtgaatggataattaattaagttgcatacttcaaaagacaatcatgtggatacttttttattattagttttatggatttgaaattctgaaaaatactcgtctcaattattcttagaacattaagtttgacctaaaagaatggtttgactagtaatatgggaattatataggtgccccttttcacagatgatgcatccgaataacaaaatcatattacttcttatatcctaccgtccatattaattatattagattacacatttaaatataatatatacatcattagatctaatatagaaaatcttattaaaaaaaaatccttatataaagaaaaatcacaaggttaacacaaccttatcgataaataaagatgttaaaactgatttttatatatgaagcaaaagtaaattagggcttagtgatgtctagttaaagtacttgtgttttgaaaaggtaatgagtcatgactcaacaaggtacacaaggcgtgcatcgggtaaaccacaaccttttgtaattgtcgatataacagcatgccaatattcacatggaccatatactgtgtgtatattatatattaccatatatgtgagttacatttcatattgtagaaccaaggactaaatttaaacataatgtaccatattcttttaattagattattcataagatatccaatttaaaagatgagttaaaatgatcaagaaaacgctacgctgaactctaaagtctaatctttatcatttatagaagtgttatgaaacaaatcaatacctggttaataattgatgtagtttcatttttttttttaagaaaagaaagtgatgaagtgtttaactagtcataatattatagatccaacttcatttcaatatatcacgagtgcattggcggctgcaaaacatatttttgaaaagagcaaaaaaaaaaatcaaggatcataaataatataggtcttggctttttaattctaccaatagatttacagtggacaattaaagaaaaaaaatcacgaaattatcatggtttggctaattgagataaaattcatacgttttccatcaataatcgtacatcatccatttcacaacaataattattcctaaaatgtcgttattttcataacattggttagatgttctaataagctactattatatataacttcacgtcaatgtatgtttgattttggcatctaaaatttctgtaaaatttagatattcgcgtatactttttttgggattttcttcttagccgtattataactgcaactcatatcacatacgtggatgataaaatattcgagtttaatatctcctccgtatgtagatttgatatgatccataatattaaagatgaaaatgaacttgactgattattcagcgcattcattttattttcccttcgaggatagcgaaatccgccacgtggcattactacatccattgctttttttaacataaatacttaagtcgcaattcttctaaattttggaggcttatgatattggtagggttctcatattcacttccaaaagcatcttcttctttctaattttctttttctttttatcttattttcattttattcatatactttttgaaaagaaaagtcgaatcacatactttcttctctctatttctcattctctcttcttcatcatattactcattttatagaacagcaaaaccctagatttcctgttcaagctcaagaccgtacaaaactttggaactcatgtaagaaacagtacacgtttttttttttgtttcttcttcagtccggattataagaattttgtcgattgaagaaaacaggctaaattaaaccctaattttctctcttagacaattcctactttctctccatttttctggattcgctctcgttttaaaaggattcagaaattaactatattatttgaattcttttgccataattcccttatgttttctgctaatggatatacatttggtcttctttctgtattagatataaagatctcgagaatagcattatg

SEQ ID NO: 9131 - DNA, 3000 bp, Unknown
  misc_feature (1)..( 3000): cDNA_ID_2180614_gDNA_ID_1972003_Annot_ID_177777 3000 nt of promoter + ATG
tgagcgtttttaacaaacaaaaaaagtcgttcgtgagaattaaaagatggggggatacaaaaaccgaacaataattgaatactttttgaccggagtgtaacatcaataaaggtgttaattagagaatgtaattaggctttttactaacgggaataataaattaaaaactgtcctcgatctactttactatgtatggaaggaacattcgcatgtggcattgtgggaagctgaatctcaaaacttattttaagttttgacattccttacacttatgaatatactatacgattttttttttatcatcaatatacggattagtacattgatgataaaagaaaccacggatgataactattaataattattttattatatgatgaaaatgattatgcatttcacgaaatttcactaaaaaacaattattatgaacaaattcattttgtttatctaataacaataaaaatcattggactttgattttatacgtcgtgggaaggtcgtcgaagcacgttgcgtttgatcattgcatgcatcgtgaaaattccactaaacatcgtcttttaaaaaaagaaacctttaaaacattacaaatggaacgtgaacctataaaatatgataggtagatctcacactttatttacagtattaaacaatatggaacattgacgttaaattattattttctacttataacaatttacacctcccaaaatttggaaaggataaacccaacaaggcaacaagtatcacaaatgtagctgaaatagatgggcttttaaagtttatggattgggccgtcatgaacacatattccataacataacctaattgggtgctccgacttcttttcgcgccgctcgcttgtacatgtcctcttcttcgacttccagataaaatcgcttcctctgtttttttccgatctaaattcacagctcatcgaaaatgggctcacggcaaggaccaccgaagcatcagaacaaattcgcctgggttcccaaagccggcgtcaagatcaacgaaacggtaagctatttgctcggctatgagattaacgaaattgagtgagtactgtagctagacccttgattttttcggaaatttatgaattgttaggaagtcggcgggagatttagaccattatccgagattaccggagtttgctaccgatgtcgagagcagatcgcctggaaacgcaaatacggcaaatacaaaaccctaactgaagccaccaaatggtatcgtttgatttgaatttagagtcttctttgtcattctctgttggattttgaaattgatttgttttgttgtgtgggtttttttttcttaaaagagcaacctttttgtttgtgggtgcagtcagaagtgtacaaagcgaaatgttcgtcaagcataccataagttatgccctggttagtgttttctttctttgcttttgttctcgtactttcttggctaattagagtgtatagatcagtatcttgttttataagttgatgtgttatggtattgaaatgggtatgaaactgataacaggttgtgccaaggagcaaaaggtgtgtgcaaagtgttgtcaaagtgttgatcaaatccttggaaggtacttgtaccttgaagacagtctttcttctacttatgctagatgctggtttccttaagagtgggtttagtagacaagatattaaactaatcttgaggtaattattcgtttctcgcagagatatttacgaagtagaggctgaacagaagctgcttgatgaggtttgtcttttaattattccgcttttggcttctaatgttcaatttcatgcttgtttttgggaggttgttgctgatttcttattgatgtgatgcagactatcaagaatgctagggaaagagatcgaaggaccctattacgtgctgtaagcttctctagttactttgaagagtttttgagatttgtaaatgtgtatgtttgtgtgatttggtcctgaagttgcgtatttgcttgacatagatgaacaaagataacaaaccaaataaatcagatgaagaagcgtcaaggagtgatagcagcaaggttggtgatgtgtttccctcaacttcccttgaagaatatgcaaacaagtccggaagagttagcgggattattggtcatggtagtgtgcctgatcatgcccatgatgatgctagtggacctgaatcagatgaggatgacaatgttggtgatgatgagcatgatttgcgcgaagacagtgatgaaaatgagcaatctcaactgcagaaataaactcatgtttggttgtactactgtcaatttggtaggattgtgagattttgcaagactgtttattcctgttgttttgataaaacttttacttggtcacctgcaatgcaagactagcaaagaatactataaattttgttctgttttcttgtatgggacgggcttaaacgggcctaacagtcgttctttatcggcccactttaacaacacctaattgtctagtctagtagtagtattctctagagactttcaaaaagtctttggattactaaatagtaaatgcgaatataagtaaactataaatgtgaataagaatgtttgaaattgaaaaaaagaattgctagctaagtgcattaatgcttgtgcattaagtcaaattataacacttggcacgaaaaaacccatctcatcccccactaaagcagccttcttttggctttcattaatctctctgcacacaaaaacccaaaaagctggatgtctccattttcaatgaacaattatgagttctttttttaaaaactcattatactttgaagattaatcacaaagatttcgaagctaattcgtcatttcttgttactataatcttttcattgttattaatcactttggcttaagtttctgtatattacgtcgagcttcttcagtcttcatccttgtcttgtcacttgtcagagacagaagattaaagaagaagaggcgtttctctctctttttttgcttcagaaaaa

SEQ ID NO: 9132 - DNA, 3000 bp, Unknown
  misc_feature (1)..( 3000): cDNA_ID_3044670_gDNA_ID_1972003_Annot_ID_177775 3000 nt of promoter + ATG
ttgttatctttgttcatctatgtcaagcaaatacgcaacttcaggaccaaatcacacaaacatacacatttacaaatctcaaaaactcttcaaagtaactagagaagcttacagcacgtaatagggtccttcgatctctttccctagcattcttgatagtctgcatcacatcaataagaaatcagcaacaacctcccaaaaacaagcatgaaattgaacattagaagccaaaagcggaataattaaaagacaaacctcatcaagcagcttctgttcagcctctacttcgtaaatatctctgcgagaaacgaataattacctcaagattagtttaatatcttgtctactaaacccactcttaaggaaaccagcatctagcataagtagaagaaagactgtcttcaaggtacaagtaccttccaaggatttgatcaacactttgacaacactttgcacacaccttttgctccttggcacaacctgttatcagtttcatacccatttcaataccataacacatcaacttataaaacaagatactgatctatacactctaattagccaagaaagtacgagaacaaaagcaaagaaagaaaacactaaccagggcataacttatggtatgcttgacgaacatttcgctttgtacacttctgactgcacccacaaacaaaaaggttgctcttttaagaaaaaaaaacccacacaacaaaacaaatcaatttcaaaatccaacagagaatgacaaagaagactctaaattcaaatcaaacgataccatttggtggcttcagttagggttttgtatttgccgtatttgcgtttccaggcgatctgctctcgacatcggtagcaaactccggtaatctcggataatggtctaaatctcccgccgacttcctaacaattcataaatttccgaaaaaatcaagggtctagctacagtactcactcaatttcgttaatctcatagccgagcaaatagcttaccgtttcgttgatcttgacgccggctttgggaacccaggcgaatttgttctgatgcttcggtggtccttgccgtgagcccattttcgatgagctgtgaatttagatcggaaaaaaacagaggaagcgattttatctggaagtcgaagaagaggacatgtacaagcgagcggcgcgaaaagaagtcggagcacccaattaggttatgttatggaatatgtgttcatgacggcccaatccataaactttaaaagcccatctatttcagctacatttgtgatacttgttgccttgttgggtttatcctttccaaattttgggaggtgtaaattgttataagtagaaaataataatttaacgtcaatgttccatattgtttaatactgtaaataaagtgtgagatctacctatcatattttataggttcacgttccatttgtaatgttttaaaggtttctttttttaaaagacgatgtttagtggaattttcacgatgcatgcaatgatcaaacgcaacgtgcttcgacgaccttcccacgacgtataaaatcaaagtccaatgatttttattgttattagataaacaaaatgaatttgttcataataattgttttttagtgaaatttcgtgaaatgcataatcattttcatcatataataaaataattattaatagttatcatccgtggtttcttttatcatcaatgtactaatccgtatattgatgataaaaaaaaaatcgtatagtatattcataagtgtaaggaatgtcaaaacttaaaataagttttgagattcagcttcccacaatgccacatgcgaatgttccttccatacatagtaaagtagatcgaggacagtttttaatttattattcccgttagtaaaaagcctaattacattctctaattaacacctttattgatgttacactccggtcaaaaagtattcaattattgttcggtttttgtatccccccatcttttaattctcacgaacgactttttttgtttgttaaaaacgctcacacacgaattgaggtacattgatggtaatgtaactaatttaagtaagaaacaatggtaagcagaaatgaattaaattgctagctgaaagatctatccttcgcaaggttatgtagaccggccaaaaaaaaagaggttagctagacctactattctaaactgttcaatttcctctaagtctaaaactgattataagtataacaaaaaaaaaaaaacctaaacgaacaagaaacaaaactttttaacttattaaaaagccttaaatcaaaacaaaattcacaattatataattaataataaatgatcaaaactgaggttttgtgatttttgttggtcagaaatttaatattgaccactaaaatttgagaaacaaatttattttgaatcttttgaccttttaattaaccaaaataagttagtttctaaaattcaaatgtcttgacaacaattttatttttctgttgacaacaagttataaaaccaaaagtgtaactgaaatatataaatccatattagttcgtaggtatatctgataatttaatttaataactaaacaagaatatcaaaaagtatggatattcttcaaaagtatctgtttaaaaagattgacaattattttattttatttgtggtgataaatatctaaaatataatctctagacaatattataagcttctatttttatgggaaattaattaacaaatgttttctaaaccaataagacaaattattaatagcctagaaaacggacaattaagagacaaaatagtaaagtcttcacttcctcaccataacaaggttaaaaattcttttgacctggtgaacgacttataatccaccacgtgtcaaaactcacacaaagccctctcacgtgccaactaatataaaagccaaagcgacggtcttcagagtctcccatcacctccgatctcaaatctcacaatcttttctctccaaattctcttctctctgaatcaatccaatcatg

SEQ ID NO: 9133 - DNA, 3000 bp, Unknown
  misc_feature (1)..( 3000): cDNA_ID_2105710_gDNA_ID_1972003_Annot_ID_177772 3000 nt of promoter + ATG
aaatgtgaagattttgcattttgattttttttaaaaaacttctaactaaagtgtggagtaattaattttgttacatttacgtgccattgttaattcttagtggatacgtgtcttctgaaacgaactatcattgaactaaatcttgatttgcaatccaagttgggtggtacatttaattggatcccctctcgcgttacgcccacctcagtcccaacacatttacgttcacacaaacccactatttatttactatcaatctacgtactgagacctaaatgatcacacttaaaacaatggggagttaaaaacaaacaaacaaatagaaactttttcaatggttaaactcgtcgcgtttgaattaattttctttgtgtttttgattttttaaatagaattttgatgtcgtggactagaaaatgtcgaaatcgtatattactattatagaccctctttaaatttgtcccaaaaaaaagaaagaccctttttcaaaatatatagttttcaaataaaaatcatttcatacattacaattctgtatatgatgagacttaaaaacattaatttcgctgtcgagggccttgcatattaagagcccttttctagacctataaccacaaactaatcaatcataaatacgttatcactcacgaaacaaaacaaataaagaatcgttttcagtcgacaacataaacttttaattcaatttgtacttatggtttttagaaattaatgtgtgtttctggttgtattttcttttgatttctaaaataatttcctaactttgtacatgatgattatacattagcaatctacatatgtatgtcagtatgtgtctatatacttatatgcacacacatgtgacatttctcaaaattgtaacttgagaagatagtaaaatacaaacaaaccaagcaactcgccaggtcacgggcctttgtctttttatcctcttttggtgaattttctcaattctcatattaactatgtaacttctgtttctgtgttttttgtccacaaaatctgctattggtaaagcatatagtataacgtatagttcacgtgaaggaaaactatttaggtataaaaatctttggatttgatggattcttatccatatatatatatatatgaatgaaaggatttggccatccaggtaataagttgtatatttatttgtcttcctcataaataaatctaagttttaaaaactaaaaatgaaactgatatgctacaaatgtatactctgatatgctaaaatgaattctaatttagtttattgttgacatttatacgatgcttcaaacgaaactaaggtaccgaattctatttaattatctttgttcttctactcatagaaaacatattattactttcatattttcctttgctttcatttttttcatattattacttacaattattatattttagaatatagtaagaaaacaatacatagttagataccatggacctacctattttgtaatttgttgaaaaatctatatgtccatgggtatcaacaagagagatccataaaactagaaaatgcctctttgtattcgttttatgtatgtttattgctaaattagtgggttcagcatattcgttccttatatataatacgaacaacaaaatatcacagtagtatatatttcaactaacaaacaaatgtatgaagtatgtttactaattccataatcactgatcaatataaaaaatgatatacctaagaatatttaaatcagtaatttttatttttttcttctgtttatgcgtttaatttaagtttggcattgagttacttcatcggttcaatttagtgacaaaaattgtttgagaaaaggacctatatatcgatgtggtttagctataacggaaattatatactatgatacttaacttcttataaaatactaaaatacaaaaattggatttggtaattagaatataattaataaacgatgtggtcaaacaaacttcaaaggttgactcttttcaatcctatgtaactttgtgaagaaaaacataagagtttggtatttgattaagataaagttactatacgtatataaaaaaacatcttttaaaataatatttgtgatgaatttaagtattttgattatactcctcatcattaatctttaagacttagttcaaatcggtgtagtatttgtttttgaattttgatgaatcaaatcaatgtaattggcaaaaacgaatccgtgttatattttaaagatattgttcccttaagagatattttattttgatcagtatatataaaaagatgaagcaaatataacaatgggttccaatttccaactgtctttacacagaaaaggttaacaaaaacggtcagaaaaaaaaagactaccgacaaaaaaaaagacagttcatttttttgttatattgatctttcgattatcttttgcacattcttgtcctgatcttcttcttctttcttcccagtttctctcttcgagcttccggaatctttggtgatcaccgaccggatctggacgaagaatctcgttaacaaactcaacaagcattctccaaagcttcctcctttttcttcaacgatcgtcattgcattgtaatttggagagtttagctacaaagtctgtcttcatcgaattaagatctatctgatttttctgggtggttctcatgtgtgagatttttgatgggtttagagttgtcggatatggaaggttcttcttatctttgatttgttttatatattaagcggcagaatttgaggttgacttgagcgagaatctggattctttcgaggagtatttaatgttcctgagaattccctgtttttgcgtcaagttttcatttttctgagtgttaataaatttagaatcattagtgcagcagatagagagagagtgtgtaaatctgaggaagactctctgtggatttgattcgtctttgtgagtcaggaatctgtttgatgaaattcccctgtggagagttttaggattttagaaa

SEQ ID NO: 9134 - DNA, 3000 bp, Unknown
  misc_feature (1)..( 3000): cDNA_ID_2180580_gDNA_ID_1972003_Annot_ID_177764 3000 nt of promoter + ATG
aatccttttgaagtttttcactttcctgggaaattgcacaattaatgagtttctatatttatattaaaagttgaaaatttaaagccttgtctctctttcgtcggttaatttgtttcatctgatcgaaaaggaatcagtttaggtctttgcctcctctctccggccagctcaattctcgatcaaaggtttactctttctttttaatttttcgattatttgaaaaattactagaaatatgttttcatcaataacgatcctgatcgttatttgatctcacaagtttgttttctgatcaaattttactgtttttttgtttgtcggttgatacactctgtttttctcagttctttggattaatgcaaatggggtttttcacttttcggtgtctcttatctcaattgagtttgtctgtttctctgttgaagcaaagtttttatctttttcttctttttgtgtggttatatatgtggttgtcggaaatttacctaatttagggttttttcctgtgtaagtgcttgcatttcactttaacaaaacctcaagttagagttgtgagtgttcagagttcagatcgattgaaactctcagttgctactcaacagaaattggacttttggtttgttgagatgtattgtttgaagttgctttgttccactagtgtaaaataacattctcttctctgcatctttagacttatcaaggaatcaaacccattttatcattgcaggtgacgtggatatatgaagcagatgttttggggaaccagagttctgtaaatagaaaccttcacgcgacgttgaaaggtttttgagacgaatataggaggagaagatgggatgtgtttcttcttgcttccgggtcgaggacattgatgagtacatgaatccaaacagctctgtctataggaactgtccctgcataagatgccttgctcataatttccttaacctggtaactgcttgcttcacattgctatttcagtttatgcttcttatggttagatatctcgaaagttttcatgtttctatagttacaatttctagttcttgtcacagttatttactttgatctgtaatctgattttttgagcccatattaatcgttgcagtatatttcggtcttcagaagaggggaaactcgctctctcccatcttcggttcaagctactgcatcgataacttcctcttcttcacacgataactttttgtctgaagcattccgttctactccaagacctctgccttatgatgctgatcctagatacttccgctcactcgtctcaagacgggagaagggttcaagtcattctcatgaggaagttgaacctttaagaagcgatagcgatgcagattctgaatctttcggggtaggagggtgcaaatgggctaataataagtccaccctctctgataaagattccaaagaagagtactctagtaaatccagtctcaggattttgagatcaaggtccaagtcaataatggccgactctgaaaacatgtatatattgtctgaagacgaagatgtctgcccaacttgtcttgaaggtaataataatcccattcaacagtctcctttttgttccttcagtattcatatcttgttggttttttgcagaatatacatcagagaacccaaagattgtgacaaaatgttcacaccatttccaccttagttgcatttatgagtggatggagagaagtgaaaactgtccagtctgcggaaaggtaaccactttttttttctgcattcttagaacgaagtgcgtataaaactcccgtcaaagcaaaaggccatatgcttttcgaaattgcacggtctagatgatgaaaagctctaatattttcctggaattcataacaatattgttgttctgattcattctgatttttaaaaagctccattttcaaatttcatcatgctctttccatggcttcttctggttttatctgcctgagactcagatggtagaacaagtgaaagcatatgtgcgtacaagtttcccgataaagaaataatcttttcttggaatcctaacagttgtgttgttctgattcattcggatttttaaaaagctcccatttttgatccattgttcatgtatgcaggtgatggaattcaacgaaacaccgtgatcatcgaccattgatccgtgtcctgtatctgaactgaaaccggggaagatgacaaggcaatgcaaggaatataatttgtaaatttggctttgttggtttgtgaatattttcatttacaatggtaaatatatgaagcagaaaaggagaaactgttactctgcaacagtttaagttcctgagaaaatttaacttccatgaaacaagaagcaatgtttcttctttaagtgactttttctcatgaaatgcctctgttgttgtattctctagtcagtcatcaaaactcttacatcattgtcgttatataaataaatttttctttttttatgtgttcaatctaaggaactgatgcagtgataaaagtcttatgaagtgggggaaaagagaaaagaaaacataatttagggactgttttgtaatattttataaagtaaaggtcttccgatgttaatatcagaaatgtctctccggagtcggtcccggagctctcggagcaaatgaatgaacgagactcattgcttctctctttccctccgtttcttacacattaactactccaaaaaccgaacaaagaccttcagaatttgcgattcatccaatttcaacattgatttgtgaggtacggtttcagattctttctccttttttttttggttaattgtgattctcgtgcatatgcgtgtggtgtcatctttagttatgtaattcgcgattagctctaagatgggtattgaaaaacttgcctgattcgtgatcgcttctgctcatttctgtaaaagtcagagttttgttcataaagtttgggtctttaagaagaataacaattttgtgcatgttttcttctttaaaaggggaatttctaaaaatg

SEQ ID NO: 9135 - DNA, 3000 bp, Unknown
  misc_feature (1)..( 3000): cDNA_ID_2180594_gDNA_ID_1972003_Annot_ID_177768 3000 nt of promoter + ATG
gagaagaacagactgctagggctttttcttatagttttcgttttttttttttttttttttccatctcttttagttttcgtttgggacatttaatgtctataattaataacaaacgattgggccttaaatttagctcaggcctggaataagcccatatagtcctcgtttttatgtcactctcaaaacctcgaaagtggtttctatctatcacttgggcttttattacttgttaaaacaaatttgatccaaatctcaaatggaaccgacaaaatagaaaatccggttctctcaaaaggccaaacacgtgacgtttaggaacaaaaaagacgttatcactgcaagaagttttgactttgagaaagtctttgaataatcaaaacagagtttttcaaatttcccaagtctgaaatggtactcgcaccctgcagacattttcgatcaaaattttcagagagtgagagagagagaagggagatcagataatggcttctcgtaagaaacgtgctgcgaagatttcagaggattcagaggaggaacagagtcgccgtcaacggttacaagccattcttctcgctgacagtttcgccacgaaactccttcccttaaccttagaacgccccaatgtcttgttaccgctagtgaatattcccatgattgattacaccttagcttggctcgaatctgctggcatagaagaagttttcgtcttttgctcgatgcaagtcatcgattatctgaacaactctgactggtactcgcacaaagactttacggtaaaaactatagagtcaccgcaaaactccaccagtgctggtgatgctttgcgttatatctacgagcagcagattgagacgtctcagattcaaggtgactttgttcttgttaatggatgtattgttagtaacatgcccctgacgcagctgattcaagaacacagagatagaaaaaagaaagatgagaaagctatcatgactatggttatcagacagtcactcatcaccgatcatcaactcttcatcgctgtaaatcctttaacaaaacagcttctttattacgatgaggacaacatctgcttcgataaatcattgctggatcgtaatccatctgttttgttatgtagtgatatgcaggattgttacattgacatatgttctcttgaggtgcttagtctatttgtggataacttcgattaccaacatatgcgttgtgattttgtggaaggtgttcttgctgatgacattatcggttacaagattttcactcatgagattagctcgtgttatgcttctaggattgaaaatttcaggagctatgacatggtgagcaaggatataatccagaggcggacattcccgtatgtaccggatatgaagttcagcggaaatcgcactcttaagctcgagagacaagggatctacaaggcttctgatgctactcagttaccatctgctcatgttggagcttcctatgtcattggacatgccacaaatattgggagtgggactaagatcttgaactctgttattgggaatggatgttctattggatcaaatgtggtgatccaaggctcatacatatggaacaatgttacggttgaagatggatgtgagataaggaatgctattgtatgtgatgaggtgaaagtgtgtgcaggagctattgtgaaacctggtgttgtgttgtcttttaaggttgtagtcgggagggactttgttgtacctgcatattcacaggtttcactactccgacaaccaatggaagaagacagtgatgaagaaaatcttttgtcaggtgtagatttgcaaatggagtctaagcttggtcttgatggagcaggttacatatggcgccaagcgtgtgaagacgagtggaagcattctgttccaccaatccccaaagataaacttgctgagatcattaaggccattgacgatgatgacacggatgatgaaagtgttgtcacaacttccggcgatgctaatactagtattaacaatgatctctttgactttgagagagaggttgatggcaccttcttaagggctgtcgaagagaatattgtagccgaccttgcggttttggagataaactcactccggttgtcatataacatggaatctgcacattgtgctggtgcaatattctactctatgatgaaactagcagttagtactccacatagctctattaatgacttgtatagaaacgcatcgagtatcattactcgatggaagggacttcttgggttctatgtaaagaaaagtgatgaacagatagaagtaatatcgagattggaagagatgtgtgaagaatctgctcatgagttgggaactttgtttgctcatattttacgttatatgtatgaggaagagaatgaccttttgcaagaagttgcaatcttgagatggtcggatgagaaagccggagctgatgaatctgacaaagtttatctgaaacaatgcgagccattcataacgtggctcaaggaaacatctgacgatgaagatggctaatgaattggtggtaaacatgtgttcgttggctcccaaaaggaacattctgattgattatttgcatcgaagagattactttgtctttttttccatgtgttattctaatgatgtgctattttatatctcatccattacatgtatgaggtatataaatacaacttttatgtttttgtaaatgtattataggaagcttattacagtatttcccaaaaaaaaacaattatagttatctaacgaattagagaaatttaactaagtgaaaaataataaaggaatgatctaaatattaatttttgggctgattttgaaagaaaagaataaggaaatgaaaacgaagaagaaggaacatcgtcttctccacagagtcctctttcaccgcctttgattctttacttataaacccttaccttcctcttccttttgtatatacctatttctctagaaacctttttcctcatcgaactcttcttctttcgcctcgccagaa

SEQ ID NO: 9136 - DNA, 3000 bp, Unknown
  misc_feature (1)..( 3000): cDNA_ID_3044676_gDNA_ID_1972003_Annot_ID_177766 3000 nt of promoter + ATG
tgctcgtagatataacgcaaagcatcaccagcactggtggagttttgcggtgactctatagtttttaccgtaaagtctttgtgcgagtaccagtcagagttgttcagataatcgatgacttgcatcgagcaaaagacgaaaacttcttctatgccagcagattcgagccaagctaaggtgtaatcaatcatgggaatattcactagcggtaacaagacattggggcgttctaaggttaagggaaggagtttcgtggcgaaactgtcagcgagaagaatggcttgtaaccgttgacggcgactctgttcctcctctgaatcctctgaaatcttcgcagcacgtttcttacgagaagccattatctgatctcccttctctctctctcactctctgaaaattttgatcgaaaatgtctgcagggtgcgagtaccatttcagacttgggaaatttgaaaaactctgttttgattattcaaagactttctcaaagtcaaaacttcttgcagtgataacgtcttttttgttcctaaacgtcacgtgtttggccttttgagagaaccggattttctattttgtcggttccatttgagatttggatcaaatttgttttaacaagtaataaaagcccaagtgatagatagaaaccactttcgaggttttgagagtgacataaaaacgaggactatatgggcttattccaggcctgagctaaatttaaggcccaatcgtttgttattaattatagacattaaatgtcccaaacgaaaactaaaagagatggaaaaaaaaaaaaaaaaaaaacgaaaactataagaaaaagccctagcagtctgttcttctcaactcaagtttgggcgaatccaccatgaaagtaatcttctacgcttttagtgttttttctaataagcttaacttttgttagagctcatctctaatttttatggtataaaccaattgttatgctattttttaaaaatattgtataatgttatagtatactcgataactatgtcataaaagtggcaaaaacttttctagtgaagaaaacatatcaactcactttgatttctttaggggctcagctaaatctagttttaatggttgcagaacaaaatgaaaataaaaattttagtatctcaaaatctagtttctattttttttttgtgacagtaatcaatgatttcaaaataaccaaaaacctcgtaataagattcaattgaatcttaaaactacacaactttcagaactaaagaatgacgaaaaacgaaataatagaggagaagtggaggagctactacacaactattttcatttttctaaccaatcagagcgcaccggactacgcccactcgcaccaacttcgcgtcacgcgctccggaccacgcccactcgcatcaacctcgcgttgagcgcgtgtcgtcgatttctgtaggggtaaacccacaaaatcatgcctattttacatctactcgctttgtttccaaaacagcctcgagtgactttttcttttgttttttttttctcaaaaccgtactattctaatacaaaccgaaccaaaattaattttcatttcacaaccatctaaaccaaacagaaatcacttgtaatttcaaaacctatgtacgccgaaccgaaatctattgtcatttcatcaaaaccatgtaaaaagcttcttcgattgttttaacatgcaactgaaaataacaatcctaatttatcaacagagaaatatagagataccaacgaaactatggggatgacaagttatcatcttatccacatctctgtccagtgtgagtttcacgatcgttgatttaataggtaacaaggaccagaagctgcggcagcaatgaaagctgatcttgtttcaaagccaccgccaagtcttttggttttgcataccgctttcacacattggaagaccaaggaacatgagacacatacttctgctgacctatataggaatcataagtaaccaccaatgttggcataagcagagagtatgaaaacttttgttactaatttaacataaaaacagtatgataacaaaatgaatacatgcgtaaactctgcttcttctaagacacatatatactaaaagttccccatttgaggctccatttaagaatgaaattgaacaattgaggttcaaattttcttacttgtcccacagatgtttccaccaatgcaaaccacttgagctgttcaataaaagccttgcaacacttgggatataatcggaaattagatgacaataaaacgaacctctgagatattcgacaaggtatttcttaacttgagtaaggtctgaaacgatttaactactctacctttgattttgagaagatgattacagttgtgattttggtggagacaaaaatgtccatctatgtatgttgctagccatcttttttcagatacttttgtcttattttcgagttacaagttacaaggcactatgctctgtaactaattttgcatgtcttccacttattgtgttgttgtgtcttttggtggattaagctaagagatcaacaagacaagaaaaaaccaacatttctgttctgatacgtggattgctggttaaatacggttatatagatgttggtttagtggtttaattcgtattgtatactttacaagtttgactttgtatttttcaaaaaaaaaaaaaaacctagcagtctgttcttctcaattaagtatgggcgaatccacagtgaaagtaatcttattctccttatggatttcttcttacgcacgactgtgaagtagaaagctcaccatctctcttagaagaagaagaacacactgtacattggttcaagatcaatttggcttggcagatgccctgttgttctggtacaaacatttggttctccactaagatttctcgatttaattcggttctgattttaacttgccaatttaaatcatcagaccgggatccggttgtgcagttattctttattcggacgggtggtggcagtggcggcgatg

SEQ ID NO: 9137 - DNA, 3000 bp, Unknown; identical to SEQ ID NO: 8994
  misc_feature (1)..( 3000): cDNA_ID_2993983_gDNA_ID_1972008_Annot_ID_177804 3000 nt of promoter + ATG

SEQ ID NO: 9138 - DNA, 3000 bp, Unknown
  misc_feature (1)..( 3000): cDNA_ID_2180561_gDNA_ID_1972008_Annot_ID_177815 3000 nt of promoter + ATG
ctgatgaagatgatgaggcggtgttagcattagagaaagagatgtggaataggttttacggagctggattttggcgaagtccgtcacagagagaatcagtttcgtctccgagagtttccaagtctctttcgtcatcgccgagacaatcgtttactgaagtataccggaatagggatacaacggttagaggaggaggaggaggagctacggtggtggcggcgacaccaagagccgttaggcattttgattagggtaaagaaagagagcttatgaaaaaaatgtctcaaaatgtcttttgttaatagtttcattcgtgtggcgagagttgttgtgtgtgtgagctcaaagtgtgtgtctgcgtttgtcaaatctttggtgtgtgactttatttgcctatggtatgggattttgtgatcatcaaatatgaaaattcgaaatggaattgtgttttgtcgaaatgtgacatgacatgagatctttgactatcaaagtctattgagggtttagtttggatgtttaatcactcataacacaaggtataattacattgttagattcgcaagaagaagaatagatcatgaggtaaataattagtgtgacatggtcatggatcagttaaaaagataaagataagattcaaagggtaaaaggagagtctagggtttaaaaaaacaagtggggagctgtccttttctttcaagggggtttggaacttgtagccttgtaggttgtgatgtaaactatgaggaccacaacaatcaatcagtacttggtcattagtgttaagcattaattcaggtgttgctaacaactactaccaccttcttcttctgcatctctctaatgactcttctttcctttttcatctctgtttttttttttgttaactttgacctgctttgttgtgtttcaattgtctttttactattactcactaattcagctttgatgtgaccctacttcatttatttcattatttggtgaatctcatgcaactgtttttttgtttcttttttcagatgtttgtaagaaaataaacgacttgtaattataatcgaatagtaaaatgtgtatttattttttcgacaaagagtgggcaaccaaatgttcctcaaccattgattgttgaaatataaatttttattattctaaatgaaatcgtgcgtcttgtatcgaaaggaaatgcttgaggattcaacttataacaagataacatttattaattaagaagattttggttgttattttgttcttaatataaaattcacgaggattgttttaaaatgtattatctttcggctctttcggcaacttttagttgattatacttggaccttacagtttcttgttattcaaagataacgaatatttaattcttgaatgagaggcaaaaggtcgtcaccagtatatacttctaactttaacaaaaatggcgtcaccgaaatgaatcttggatagcccatagatttttatatagcagtgcctagcatctctcgacacctcatttagcttccccttctcatgttcatttgatagttggcccatttcggcccaatattttacatgctgttcgtgagatgggtttatgcatgacttgtgtttcctaatttcagatcgttctagatgaccttctgggtatataaagtgtatgcgattttttgtttcttttcgaagaaaaaaacgagttaggcccgtagcaaaacaataagagaaatcgggcttaagataaaagacttcgaaaagatgggtttaaattcagttgggccttaaagcctgtcttcttatcaggcgggaacaatcagaatcgcataattgtgttacaattttccacaagtccacaaccattagccaaagacgctgtcctctggctcttttgatgtagttggacgtaagggcacgtgccaagttggagagcgtgagagtaacaggtaagtggaattgaggtgggacattacacgattcacgaacttagcgtagcaaccaaaaggtgtcccaataaataaataaatgatggttgtattaggtcatacaccgacagcttcaattcaagccacgtgttctcccttcttcttcggctgcttctctttgcttcacatgatgtctttcttttttatgtttggttacatatttcttcttaatttcactttcaatttaagtatcattaactatagaaaactgactaattaactactatcccatttttatcatctagtactcgccgattgccttagtccttcttatgttaagaattaaaagacttgaggaaaagttcaattaccatcactttcactactctaccgtattacaggcaaatatttaattatctagttccgaatattttcttttaactatgattcttatttatgattaattatgtccaaaatgtattcaagattcttttctgattatactatagtattcggaaattgatgtaacagttttgtatttgagtatcaaagaatattatgaccattggaattgttgcgcatgactatttaatatattacctaaatcacggatcaaaaatcaatagttattcactttgcataagtagaattccatctgaagagtttaatataagagcagagcttgtttgttctgaaatagtaatactttcatttattaaaaaaatagtttatcaataaaagacaaaaacaaactgctgtgtttattcaatgattataaataaaaaagattaagccgacgctgagccgagacttaaaaaagaaagccaaaaaagtcagagctaaaataattaaatgttattcagacaccgtgtagtccccaccaccagcctgtccgaaaacccaaacctgttttgatacacaaacaacacagaccacccccaaaactcacatctatctctatctctcttctctgtctctcactctccactttccgatcaccgacgattcaacaaaacatagtaaaaaacaaagcaaattctttttttctccttagttacttcttctacagattatctcaatcttacagagcacc

SEQ ID NO: 9139 - DNA, 2862 bp, Unknown
  misc_feature (1)..( 2862): cDNA_ID_3044701_gDNA_ID_1972008_Annot_ID_177816 3000 nt of promoter + ATG
cttcctttcttataaattgccttacgttttaaggtgttctcttctcacttcttccccatgattcatcttgactccacaaattcagggcaatctttgattctctttggtctttgatttgaggattaatttgttttctaaaggtgtctgctgattcaattgagtatggagaagaaacgagatgtttctgagtacagagagagacttaatgagaccttgtcgtctcctgagctcattaatgagcaaactcttaaaaccctagtcagaaaacaactcaatgaaggtttttcttgttgttgatttgctatatactctttaattttgcctttgctacaatgttttttttttatgttttcacagagtgtagtgttgatatattggatcaaagagtagctgctttatccagtacaattgagaagcttaggagtgtatcaacaaaggatcaagacttgtctaaatcaagcaccgaggcatcttatggtgattggaaagtatgtttctcttttggctctattggacagtttttgtgaaacagaattgtcataatgttagccaattagtgttttcttgtttataggtgaaacatgatgataaagattgtcgtgttatgtaccgtgaaggacttaaaggaagtccatttcatacattgctcgttgaaggttgcactgatgggactatcgaagactgtaagtttttctatagagtttgcaccgcaagaaaacagttttcgatttgtatctaactatgtttatacaggtttatgtgtatgctgggaatcatcattctatgagaaatggtgagagtttaatgttttgtttatggaattgtctattgtttgcgaaattttttggtctttttgtttgatgttttctatgtctttcaggtggccaaagttgacatttccgtcattcagggtcttagaagctaaatgcttgcaaaagtttaggattgatgaacagatatgtttactgaggtttgttttcacaaattgtaataatgtttgttcctacagttacattttcgtgaagctaatccaaagctgaaaactttgatcatattttttggggaggtagggtgaaagcaccgtggccactgacagacagagaagctgttctgcagtttttcgtattcgaatactttaaagatgatttagtcatcatcctacttaactcggtaaaaccatgttagctttgtttttttgcatcttaatccagttcttagtgatttgacagtatcctaaactcttatctattagtacatctttagatcgaagtggagagcggcagtgtagctgaagtgaatgcggtgaggattgacttcgtaggcggagttgcgatacaaaaagtgactccagagaagagttacataaggtgagtgttgagtgaatgagaacatgtttctataaccaaacatttcgaatgtctttggcgggttttttgaatcgctaaacttttgtagatttatagcggaagtggatataaagctggacttggttcctccatctcttattaattttatgtctaggcagcttcttggtaacggtttcaaacttttcaagaaggtcagttccagttttatttacttcacaaaaacttgatatgcctggttgctagcttgtgtgatgttgtggtgtttacttgaatgtttacagactattggttcggtggctgaatccgatgattacaagacagttttagctgatccattgtatactcatatacgtgaagctctgtattctagtgataaaactgatgaaatctgccaagtaaatgagcttcatagccaacaaggaagagattgtgaagagaaagaacccaagttggaagctgatgatgatatggaaaaagagaatgagactcgagactgcgagaatgaatctgtaccttgcaaaagagatgttcctgagatcgaggaagaagaatgtgttgatgatttaaaggaagaaaacaaaagttctccttcttcttcttcttcttcttcttcttcttctgaggatgaagacaagaatggcaaaacacgtttctgcataagtccggaggtgaagcaagctttagggacattagagagagtaatatcaatggttagaaaatccaaaacagataataataatacatcaacctcttcggaggaagaagaagaagaagcatcatcatctccaatgcagcattcagggagcactcagattgtttctagtagcaaagtttgtattcaagatcctaacactgaacttctcgatgaagcatcctttgcacattatcacaacagcaacaaaatagctcctgcatcacccgagatcgatcttacaacaaactctgaggtaacaaggataacagtctcgcaagcaacaaatcttttctgccaaacaacagagaatagtgacgacaattacaaaccgagcggtttaaacggaggtaagagctcaaatctgcagaggaaacgtaaaccgagctgctttggtttcaggttttggagaagaaggacttgaaattgtcattggtaaatccaaatattttgtctctttgaagttgcagatcattatatacaaggaaacatagtgttaagattttgagagcaagtgtttcaataaaaatgtaaccatagaaagaagatacaataaagttgtgtatgaataaaccgaaacttaatatggttaactcaaaacaaaccggttcggttcgtgagtaaaccgaataagccctaaatggctaatgggcttggacccgcgtaaaggggataataaaccctaagcaagtctcatcgtcgccgtctttctcatagacttaacatttcatatagagaaacttgaaacaacaatctgagcaaagagcgttttatcttgttgattttggaatctccattacgatg

SEQ ID NO: 9140 - DNA, 3000 bp, Unknown
  misc_feature (1)..( 3000): cDNA_ID_3044708_gDNA_ID_1972008_Annot_ID_177808 3000 nt of promoter + ATG
aaagccatagccaaatctattaaaacaatgaggaacgatagtgcttgtgtgaacgcacacattgacaactccaaaaaggccattaaaaacttaaagattgcactcaaatcttcttatccagagacatataaagatcttttggagatcattcccggagtcacaatggcatcaatcctgatcgaggtcgtgaattgcgtcgagaagatctacgaggctgtggaagaattctctggtcttgcacatttcaaagagactttggattcaaaactatcagcggagataggacaacatcaattactccacaggggatgtgtaaagccggttctagatggcgacaacgagaaagaagacaatagctcatgtcatgttcttatcactgtccatgatgaaggatatctaccgacggccaccgcgaagaacgttttgggagcagagaagactagagtagatattgtgtgaatatttttgttcattgcgaaacaattacacactctttcaagagaacattatttagtatataagagatatccgcattctacttagttattgccaattaatagaattataatcaaccattgataataatgtagttgatttcctacttataacattagatgtcatgtgttatgtgtagtgaatctagtgatatgataggataaatacatgcttaagttaagattgtccttagatataaaaaacaaattcaaagtttattaattggaggctttaatattcaacatctattatgtgttacaaggtccaaaatattacctttatcatatagtcttttgggcaaaacgagacaagatggaggtttggaattgtaaaatcgtagtctgtaagttggcactccaaaatgctcagacactctctcctaacaacaaacgtaagttagaataatgatcattctcttataaaaataatgtttttcaaaagaatcagctaaggtacctgaaatttaagatgttcttttctttttataatctatatcttttttaaaactaattacaagtagaaaatcaagtattaagtttagtaaacaatacaatctttttttgtactaaagatattagaaataaactctacaaaaaattaatacaaatttaccaaaaacaaataacactagagtcatatttcgatgtagtaaaaatatttaagttatatatatatatatattgataagtttatataattattaatttatgacatgagatcatatatttacataggattttgaaaaagttattatcttattatttgatcgatttatactatttttttatcgatttacactagtctcaactcgatatcagaagaatttattaatttattaaatttatgaaattatcgaggttttactgtacaaacataattgcgttggcgccttttttgaaggtgaaaggctagtggcaaaggtagttaaggagtataagggtcatatgacacccatagagagacataaagcgcttaagacttatataagctaaaatctacaaacacaaataatttatgtacctcttcatctcccccatattgttcatcgtaagctcttataacatcaacacttttgactactttgtcgtcgaatttgaacttgatagtgaaccttgaattagttagggctctttcttacttttttttctcttttgttaccaccgttaaaagtctctgttttttttttctttttaagattcgttaggattttgtttaattattaatgaattcttctagttcggctgaattgaaaataaattctgttatcagtgaggctgatttagagcgagcagatgagatttgaagtttaatatgagtagtatttgtgacctgagtgatgacttgctcatgaagatactgtcattggttagcacaaaagatgttgtagccacgagtcttttgtcaaaacggtggctttcggtgtggaaactggttccaaggcttgactatgtggtactccattgcatgagataggttcagcttttgtaaacgatttgctgctgctaagcaaggctccagttctagaaacaatgcatctcaggattggggataagtggatacaaacctgaagatcatgaaagatgaatattggctagacacgtgcgtgatcttgagcttattcattatctaatgaatttctctgtcagctcgaatatctagagccatgatttggattcaatttcatatacagggacgtttctcaagcttaccatttggattcaatttaatttgttaatttatcgtaagttgagcttgttaatttttatttttatttggtattctttgataaaaagctttaacgagagcgatcaaaggcaaatcactagaaactcttgagcaagagttcatgtcgaccgtgatattttgtatgatatatatatggtcaagatggtgaagacaaaggttctactattgtataatggtatcaaaatttgctaaatttctaacaatttcacaaggtctcgcgtggcgtccgttggttgttttggttaagtcggcctctattttgatccgttaatggaactcgttacggtctaattacgtccactgatatcactttccaatgtttttttttgttaaatgtcattgtcaataccatgccccgtaggaccagattcttcgattccagcatattcctaagttaaatccgacacaatcggataatctcgtcaaccactcacaacacgccacgtaatcaatgatgtggaacccatgccacgttggacacggtctcacgggacaaggcttcagtaaagagcgcctatcgtccgtccgacttgtttattttccacgtgttaatcttccagaataatcagaaagagaattaaaaaaataaaacaatccaaattaatctcagccgtcaatttctcttcttcttcttcccaaattctctcaacagatagagaaaaccttattagcagcactctcacgaaatcgtcgtgacgaaacgataaaccctaagtcatggtaaaggaaactctaattcctccgtcatctacgtcaatg

SEQ ID NO: 9141 - DNA, 3000 bp, Unknown
  misc_feature (1)..( 3000): cDNA_ID_2180545_gDNA_ID_1972008_Annot_ID_177811 3000 nt of promoter + ATG
aagaagaacatggcactgaatggagattggataaaatacgtaagacacagacgacaacaatcatacacgtgtccaagacagaaaaaatcatgttcaatcactgagccgattcattccccaggattccagacacgggtggatattatttggaatgcaaatttacagcctgatttattttggtatatctgttattattgtgttgatcataatagctaataaaaagaaattttcaattaattaaaaacatttgatagttaagatggttgattcggttgggtaaactagattcgatacatagttcgatatatacttgtgttaaataagtggcccataacgtgaatagaagtcacggactgggtcttaattcaggcctgtaacatgtttcggcccaatcattgcgctagacaaatattgctcaaccattttgctcggccatagtcgatttttttttctttttcttcttcacacatatttaattcattcacggttcttgagtttattataacagactatttattttggagtgtgtgtctcaagtttatgggtacaaaatgggtcggttctaggatttaaatgatctcaatgttaagtaatatacataagatattatttataaaaagacagacacgcaaattataacagttgcaaaagcatgtgtatgaaggtgggataagaactatattatcagaattaagaaaagtaaaaaaaaatagaaaaaaaaataataaaaaaacgaataaagttaagctaaattgtcatatagttgtgattttttattttatttttatatatagttgtgaattttgatgtcatattgctgaccagtcctacgttatgagaagatccaagttccggtcacattgatcttcttcgtttaggaattagtcacgcactacgttctattggaatttatcaccaacatattgtcttatatagtgaagaaagttaatcaacaagatttcagtgcaaaacttgtaaatcctaatgtgatcaatcgatatacaacttcaacaagaaatctccaatcactaacgttttaacatttggacaaaacaattaactcatattgatgtatcacctaaagacatcgaaatatttacttgttttggtaatagatttttaaattcaattctaattgttttggtttcttattactattacaattctaaagttttcagatttggtacataagaattagcgactcggtaacgataaggggtggtcgagactcgagaggttgcagcagctggtcataagcatgcagtgatgcagacatatcagagggaacactaataatcacaaatatttttttattcgagtagttattttgtgttctaacgaatcattgtcgatataatagaatatcttaagtagttatttgctatggattagcaagtaatgtacacaggttatacaagaatcaatctaaaactttttgaaaaacagagagtatatcattattaaatctagtgtgacacaaaattgttcctttgtagtgataagttatcttgtcatgtttaaagatgtgaaaatgaaaaaaaaacaagaatatgatatacgatgtacggattggtgcagaactcagaatgaaatctcgatcatacattcatgttatattcttggaattatgctttgggaataatgcttagatttggtgccaacaaaatgaaaaaaataagtggtgtgttttttttacaaattctaaagtagaaacataaaagaatggacgaaatgaccattgtttataaatagatcttgcacttaaattcatcttacaccttttaatattataaatcagtggttttctagagattgaatcatcatctaatcaatcttcgaattcttacacctctttccatggctaccatttctcaaatttacagatatcatgatcatagcatatataagttcagatcctttaagaaaaaaacccataagcatatataagcatatataactttagtctttttttgtcaaaaaaaaaaaaaaaaaaaaaaactttagtctttttttttttttttaaacgtacggtttagatacagaaatcatgtgtatcagtttcatgaaataaataaataaagaagtcaaaaatattttatttttgaatagttcactgtgaaccgtagaactaatcgtttttttgttcttaaagaaatttaatatgaaaatattttaaattaaatttacaagttttttttaaatgttaaatttatttttaaaaaatattaaaatttacaaaggtttgaagaaaaaatgggttaggtagagaagaaagctcaaaagtcaaaacaataatatacaagttcagaagttcttgctataacaattttattcacttatcagccacatgaataacattaacacattatctttatttatttatataattatcattatctaatcatcataatacacattgatttattttgttacataaagttgtctgaatattttctttttatcatacaaacattaactgctgtaaagttataggcaaacattctcaacctctgatttagatatatagcttctctgctgagttctagtgggttcgatcaacttggtccttttgttttatttttcttcaacttttcattttctacatatcactttcttcatttttcctgaatattaccgtgtgttgtaaataaaataaatatatataaaataattattagtcttatatttgtcgtacgttataacaacatgtacatctatattctacctagctagctagatgaaaagccatccatcaattaataagatctaactaagaaaaatcaccatcacttaaaaagcaaaatcaaatccataaaatattggttgagctgctagcttagtcagcaatgaaaaatctgtctcttcacaaactaagctttttctacctataaatatagcccaaaactatcccacataagcaccacacatcccaaaggttttacgaatataagccaatttcactagctttaacattttctttgagattctcatatggaaatg

SEQ ID NO: 9142 - DNA, 3000 bp, Unknown
  misc_feature (1)..( 3000): cDNA_ID_2730470_gDNA_ID_1972013_Annot_ID_177825 3000 nt of promoter + ATG
catcttatatttgtttataaaattgccaataattgagataaggtatcatgattcatcaatctagctagactgtgtgtaccatacataaactataacccatgtgtataaaatatacaaatatctgtgaacatcaaccacctaactataatgaatatgaaaatcatacgactaaactaatttacgtaaactatactactttgaaacaattattcatcaaattctcttatactattaattgtggtttactaaacttccaagttttatgttttactaatcctgtaaaattagactttagccgagtccgtttgaatctaggatttttgaaatttccaggtggctcaaagctaaagaaaatgtgaatgagaaatgatttcaacgaaaataagatttacataatagccaatgacatatatgcacttgtcaagttggagttaaacaataaccacacaccgaattgaggagcccattggaaaaaacagaagcaaatatatttttatgtaaaaatagaaacggaataatatagtaacaaaaagatactctcttcaaccttatccattcttcgccacttctcccactaatccgctaaatcattcttcttcatctctctctcattcacaattcccgaaattctctcaaatcacagatccttttagggtttttccactgtttctaggttttttttattgctcaaatctgatcaatggatagttgtctctctaatcaaacggcgcttcagtttctcccgtcgcgttccaggagacagagcggcgatggaggcggtggttttgttattccggcgaagaggaagatccagtatagttcgatggttgtggttgcggcggcgggacagagtcggtgtgagcctggaagcagtctaaacgcgccgcttgagccacgatcggcgcaggggaggtttctgagaagcgtgttgctaaacaaacggcagctatttcattacgccgccgctgatgagctaaagcaactggctgatgatagggaagctgctttagctcgtatgtctctcagctctggttccgatgaggcttctctccacaggtccgtgaaacctttccttatctaatctctcacaattcaaagatccgtaaacagctgtagaattataaacatacaaagaaatatgtgtaaatcattacttacatactcttatttaatcgaccacaaatcagtattttattagtatttatcacataagcttgtaaagtttgattataagttgtttgatggtgtttatcagtttatgatgatttgagaatcacactaatgatatggttgaattgaaacaagagaattctgtagttatgatcttcaggtgctttctcatactctgccttgtgaagcaagttttgttttagtgtttgataagggctggttttgcttttttacatttcattgttgcttagttcgttaaatagtttccgtatattttagtttcttgcctgtgttaaactctctgacttgctcaggccattttatgctctgtttgtgaacattttctcaactatcttctgctcttttacgaacactaacactctgattccatggttggcagaaggatagctgaactcaaggaacgctactgtaaaactgcagtccaagacataatgtacatgttaatcttttacaaatactccgagataagagtccctcttgttccaaagctatccagatgcatctataatggaagactcgagatctggccttcaaaagactgggagttagagtcaatttacagctgcgatacccttgagatcatcaaagaacacgttagcgcagtcatcggattacgggtcaactcatgtgtgactgacaattgggcaacaacgcagatacagaaactgcatctcaggaaagtatatgctgcctcgatcttgtacggttacttcttgaaatcagcttccctaaggcaccagcttgagtgttccttatcagatattcatggaagcggatatctgaaaagtcccatctttggatgctcattcacaacgggcactgcacagatctccaacaagcagcagctgagacattacatctcagactttgatcccgagacattgcagagatgcgcaaaaccaaggacagaggaggcaaggaatctgatagagaagcaaagtttggctctttttggcacggaagagagtgatgagaccatagtgacatcgttttcgagtctgaagcggttggttctcgaggctgtggcgtttgggacattcctgtgggacacggaattgtatgtagatggtgcatataagctgaaggagaatgggaatgcagaagaacaagaaggaaagaaaagcatatgatgaacaagtctggttagaagaaaagcttcatgatcttctggtagtgtatatatagagaaatgtttctgccgaatctctcaggcagttgttcagttcaatgtatagatcttgcttagaaatattttgatttctgaataagaatgtggtgtggttataaggaataagagatactgtagttgggttcaattttatgttatgtgttaagtttccttgttcaatttgatctttctccttttgtcaaaagactcaaaacctcaaaaacaaaactaaaatttgggtcccaaagaagctatgcaaagggaaggagatactttgataatgcttgtatttttgggcttattttaggcccaaatagcaccttatttcggcccaaaagttagacctaccaaaaaaccttcaattgtcactagagcgaatgaatgtaaaaatctggtctcctattatcaattccgtttctctctcgccggaagatttttgctacttcatctccttatcgccccaccaccgtcacatattcactggtaagcatatccattttgcttcctcatcttccacattaggcttctcccattttcttcttcctcccgccgcgaatcgcgcgtgattagggtttatgaaatctaacgcctcaggtttcgcattttctcaagtttctcgttaatttcggttaaagaagatg

SEQ ID NO: 9143 - DNA, 3000 bp, Unknown
  misc_feature (1)..( 3000): cDNA_ID_3044753_gDNA_ID_1972013_Annot_ID_177851 3000 nt of promoter + ATG
tcaatcttctcgatcatctgcaccaagtctttgtctggaatgtagattcctagattctccaatgaatcattcagctcttgcttcgtgattttgccatcaccgttcctgtcgaacatttggaagatcctggcaagctccgcttgatccattcttaattggagtttattatttatgagctttgaacagagaatgaatgagaacaaaactagaatatgggtttatagagaagaagagaattagggcaggagacaagaaggactgcttcttaaaggaaaaggagtggttaccattttagaaaactcattacaactgtgatcgtggtctgcaccagttttctgttgaactggtcttaaaataggtttatgtccttcaagaatacacaaaaactaaagtctatcaatagagatacacacggaatctacacattatctcgtattttgtcatcttcaaaacagttttccgttaggatagttatttcaggttaaatcttttgagactcaatttatggtatagacaaatataattcaattcaaatgcttatcgtctgtttgtatatgtttggttaattttctacaaaacttatttatttattttatctacataagatgtaacttattctaagtggatttgttctatacacttctttttttgtcgatttgaacatggcgatgtttcgaaaatagaagagacaacttgaacaataataaaattaaaataaaagagatagcctttaaaatagtcaaggtcttaatcacttcttaacagattgatagtctgttaacaggtttaaattatgttgtattgcacatccttataagactgagagtaatgattattgtgttaagtgcaccacaagcagaaattgattttgatatcgacgttttcaggtagatagagatgagcatccatttttcagtttgctttggtttcggattttgaaaaacgagtaagaattagaaaactattcgcaacatttaaagatgcctaagctgtgtttagaaactactggtaggaaaataatatctaaacagtatactcaatatgttttgttactgaatcaaaccctgaacaagaatcgatcctacaaacagagtttctgtttacaaggctcaaatcaaatctactaaaccattggtataagatgccagatccattctaccttattccctttccctaaaagcagaaactgtgattacaatgctcagagtatatttaatgttatctcagcctcaccaaagatgcagtggttatgagaatgaaagatcaaaactccactaattcttctaactcaacggaaacacctccttagacaattagacccgagaatataaaggatggcctattaatcctaagcataccgaaaccgggaagattactatatggtctgtaaaaagaatctcattccagtactaagaagtcacatcattctatatactctctttctctatgcttaaagctgttggcaaattgagctcgagaccaacagatatcaacaccaggtaaccacaattcaacacaatgtgttcaataacctcctagcattttccaattgcttttaccaatctctagatataacaccatagtctctaaccaatctaatggaagaagaagcaacgaaaatgaaatcaagaaaacaacattcacccatacttgaagcagggaatcgtttaaacaagcagagttctttaccacattacaaaatttaaatgtaagcaaacgaaaattacagattcaaatggagttatcttcagagtaccgaaatttccaaagcgaattttattagccaaattgagaacgaacccaacatttatgagatcctcaagaacaaaaacttacggaatatcccaaggcttagcttcagggacagcgacgaccataccttgaagctcctgcgttaacacaacttggcaaccaagacgcgagtgcttgttcaagatacgggatctagagctacgcttcagcacatactcctcatcgtaagtacgcggcgggagcttctcgagccattcctctgcgatctgaacctcgcactccgctgagcaagcctcgatgtcatccaatctatgcgatgctggatctatcagaccagtgtgagtgagcgcacgaaggagagtctggccagagagtccaatgatgtcctgcttgtatccatcgggatcgatcgcagaaagcttgacgattcggtcagagactttcttcgatcccagagacggagaaggagcagacgttgcggatgtgcgaacgattagagatctggtgaatggagagagtcggtggatttgagaggagagtttctgaagagtcgtcgccatcgtcgttccccaatttttggtcggagctcagattttttgtgctaatggttgaaaccggaaaagtgagtgagggtgaaacgctaatttggagatgggcttctttataagcccaaagataagttacatacttacaagcccaaatttctaactggaccgttcaatcgaaccggtcaatattaatccaaatattttgtttggtttagtttgggttgaagaaaacattgcttctatgtattttatgaggcatttaagacagaaaaaaatctataaacattcgaatagccgcaagtccggccagatccactctgttcccatgtgatacggtccacctactttttccaataacgcgtaagaaatttaggaagttagaaccaaaggcttaacgaaacaagccacatttaactaaatactgcttggtggacacacatccgacgtggctatcgttcattggtctgttccatctatggaatgagaagcacaagattactgctccattccaaattccgccttcaataatttgataaaattttgatccactctgtttcaagctgtcaccagaatgtcgtcttcttcttcttctccttcttcgtcttcccttaaacccattaattcaatttcctgataaacgagcagagagagatctgtcaaaatcacaaaccgtgaattcgggaagaataagccgatgatg

SEQ ID NO: 9144 - DNA, 3000 bp, Unknown
  misc_feature (1)..( 3000): cDNA_ID_3044745_gDNA_ID_1972013_Annot_ID_177855 3000 nt of promoter + ATG
gaacacgtataccttggcaaaaaatccagggttttgagtaaggaatggcaatccgagcaatcccatagggttagagatgagaacaatatcaatgaaagaagcctcccacaaatgcaaggctttcacagttttgtaccacggttcttcacacaccaaatcagcacaagttagctgtctctccagtttttgcttcttttgaattggattctgagcatccaacgactcatcagatagatattcagaagcttcagaaccaacaccagatggaacaggagagaagattttgattgccgaaaggtccaaagggcagtcaattaaaatcctgaaaccacatagattcagcatatgacaaggcggatagtgaaagccatctcctttgctcagacatgtctgcaaaaaaacacaaaactttcatacttacccaacccgaggttttcaataactcacacgaaaagtattagactttcattaaccaagagaaactcaccaattccatggagacaaacaacagtataatctgtttaaaaaactgaataagcgaggtttaaattcagagcttttccaaacaacgcaacctaaaaaaacagccagaaatatgcgtatcatagaagaggttcagtataactccataaaaatttccgtcttgttttttagagagagactaacagatgcggcaaggaaagtacggaggtttatgcaaggcggcgatggaggttgtcgaggacgaagcggcggatttaattcgaaactggtttagattcgaaaatcgaatttctccggttcggtttggttggattagttaattttttcaaaaactaaattcgggttggttgctttgatacgatgttgctgagataatagaccggagaaagacgacgaagagatcagcgattttgtttactcctccaatggattcagctcgagaggtcagcgatggtagactcaccgtcgaaggtttctctgtagcttctcgagcttttgccgataagtggaagatacataaccaatcgttccctccatggtcttgggttcctctgatcaatcgaactctacttgtttcaaagaaggttgatgaacaccaattctccataattcaaccttctttaagatactgttttttaaattccttggtcttgttgttttattagcaggaggaaggttacttgtcgctggagaagatcataattctcagttcacttgaggtagattcacagctcttaacagtgatgttcttcttttcttgtttctcacaattaagtttgtgtgtaggaggaaattccagaggatgaatctctaaatgtagctactgattgcttggaaaaagaagaaacagttgatcacacgattttggtacataaccttttgagaaattctcattttaactatctctgaagcaggtatctagaatccatgagattgttttccttgatgcccttttatttgtgttaggtcccaaccatggaaaatgaagcacactactatgatttccatatagtttacagtgcatcatacaaggttcctgtgctatattttcgcggatactgcagcggtatgtcacaatataacctgcttggacttttttggtttgttcttttgtttagtttgaaaatcatctttgttgtcacttaggtggagaacctcttgctttggatgtcataaaaaaagatgtaccctcatgctctgttagtcttttgctggaatctaagtggacttttataactcaagaggtatcctctcaaaatcaatactacattacaatgtccgtttaaagtatattatatggttatttggtattgaatccctatgcaaacaatcaatcgcaggagcatccatatttgaacaggccatggttcaagctacatccctgtgggactgaggactggatcaagctgctttcccaaagtagcagctcttctggatgtcagatgccaattgtgttgtacttggtttcatggttctctgttgtcgggcaggtggttggtcttaggatccctcttgagatgctgaattagtagccatcttctgttatcaaaatatataatgtatcagtggctccaaaccctcggcaacaacttttaaaggtacgcatttctgaataagaattttcagaagaaactagggactaaaaaacttgagtttcattaacatatgagtggcttcaattcatgagtctgcaaacatcgtaatcaaatctagctattatgttcttgaggtatttaagttgaattcgttttttccaacaaaccattttgcttacaccacttcgggtaattgtaacataacggctgattctaaaaaaaaggcttactatttcagtatttctacgtaaagtttgtaatgcctctcattgtatagaaccaaccagtttatagcttgattgaaattatgaaaataaaagtttgtatccgaaatatatggcagcagcagccatcgcagatacgccacagatatttgtgtcggaaaatagtgtcgtaatatttgtgacaatgtcgactggcaatgtcgctctttgcgacaacacgtttctatccagaaattgctaatttgctttggatgcgcgatgcctaaaatccggtttgcagccgcaaaatcctgttttcttatagtgcgggctttgttgataaccttgaggaaaaggttcttttggagtatagatggggtcaaagaagctaacgttttactaagcaaagcaagaaaaccaatgaagaaaatggtagactgagtaatgaagacttggtccaggaattttgttagtaagtggaagacttggaaaatgaaaaataacacagctgtttgattgattgacttgagtaaagtatgtgccgtattatatgggatataaaaactccataaaagacaaccttaatgaccttggaatcttaattagtacctgaagagtaaattagtttaaaattatttggaatcttgaactaaattagatgtcagatatatagcttataatacaaataggggctagagaacaaaagcttcaccaagatg

SEQ ID NO: 9145 - DNA, 3000 bp, Unknown
  misc_feature (1)..( 3000): cDNA_ID_3044749_gDNA_ID_1972013_Annot_ID_177853 3000 nt of promoter + ATG
aattctctgacacctttcgggaatatccccgaaggtaatccgtttgccaggaggatctcgtatatagtctcagtctctgatatcgccgtggagatcgagatcccggcgacgagaacgagacatagaaacgcgatttgaacaatacgaagcatcatcggcttattcttcccgaattcacggtttgtgattttgacagatctctctctgctcgtttatcaggaaattgaattaatgggtttaagggaagacgaagaaggagaagaagaagaagacgacattctggtgacagcttgaaacagagtggatcaaaattttatcaaattattgaaggcggaatttggaatggagcagtaatcttgtgcttctcattccatagatggaacagaccaatgaacgatagccacgtcggatgtgtgtccaccaagcagtatttagttaaatgtggcttgtttcgttaagcctttggttctaacttcctaaatttcttacgcgttattggaaaaagtaggtggaccgtatcacatgggaacagagtggatctggccggacttgcggctattcgaatgtttatagatttttttctgtcttaaatgcctcataaaatacatagaagcaatgttttcttcaacccaaactaaaccaaacaaaatatttggattaatattgaccggttcgattgaacggtccagttagaaatttgggcttgtaagtatgtaacttatctttgggcttataaagaagcccatctccaaattagcgtttcaccctcactcacttttccggtttcaaccattagcacaaaaaatctgagctccgaccaaaaattggggaacgacgatggcgacgactcttcagaaactctcctctcaaatccaccgactctctccattcaccagatctctaatcgttcgcacatccgcaacgtctgctccttctccgtctctgggatcgaagaaagtctctgaccgaatcgtcaagctttctgcgatcgatcccgatggatacaagcaggacatcattggactctctggccagactctccttcgtgcgctcactcacactggtctgatagatccagcatcgcatagattggatgacatcgaggcttgctcagcggagtgcgaggttcagatcgcagaggaatggctcgagaagctcccgccgcgtacttacgatgaggagtatgtgctgaagcgtagctctagatcccgtatcttgaacaagcactcgcgtcttggttgccaagttgtgttaacgcaggagcttcaaggtatggtcgtcgctgtccctgaagctaagccttgggatattccgtaagtttttgttcttgaggatctcataaatgttgggttcgttctcaatttggctaataaaattcgctttggaaatttcggtactctgaagataactccatttgaatctgtaattttcgtttgcttacatttaaattttgtaatgtggtaaagaactctgcttgtttaaacgattccctgcttcaagtatgggtgaatgttgttttcttgatttcattttcgttgcttcttcttccattagattggttagagactatggtgttatatctagagattggtaaaagcaattggaaaatgctaggaggttattgaacacattgtgttgaattgtggttacctggtgttgatatctgttggtctcgagctcaatttgccaacagctttaagcatagagaaagagagtatatagaatgatgtgacttcttagtactggaatgagattctttttacagaccatatagtaatcttcccggtttcggtatgcttaggattaataggccatcctttatattctcgggtctaattgtctaaggaggtgtttccgttgagttagaagaattagtggagttttgatctttcattctcataaccactgcatctttggtgaggctgagataacattaaatatactctgagcattgtaatcacagtttctgcttttagggaaagggaataaggtagaatggatctggcatcttataccaatggtttagtagatttgatttgagccttgtaaacagaaactctgtttgtaggatcgattcttgttcagggtttgattcagtaacaaaacatattgagtatactgtttagatattattttcctaccagtagtttctaaacacagcttaggcatctttaaatgttgcgaatagttttctaattcttactcgtttttcaaaatccgaaaccaaagcaaactgaaaaatggatgctcatctctatctacctgaaaacgtcgatatcaaaatcaatttctgcttgtggtgcacttaacacaataatcattactctcagtcttataaggatgtgcaatacaacataatttaaacctgttaacagactatcaatctgttaagaagtgattaagaccttgactattttaaaggctatctcttttattttaattttattattgttcaagttgtctcttctattttcgaaacatcgccatgttcaaatcgacaaaaaaagaagtgtatagaacaaatccacttagaataagttacatcttatgtagataaaataaataaataagttttgtagaaaattaaccaaacatatacaaacagacgataagcatttgaattgaattatatttgtctataccataaattgagtctcaaaagatttaacctgaaataactatcctaacggaaaactgttttgaagatgacaaaatacgagataatgtgtagattccgtgtgtatctctattgatagactttagtttttgtgtattcttgaaggacataaacctattttaagaccagttcaacagaaaactggtgcagaccacgatcacagttgtaatgagttttctaaaatggtaaccactccttttcctttaagaagcagtccttcttgtctcctgccctaattctcttcttctctataaacccatattctagttttgttctcattcattctctgttcaaagctcataaataataaactccaattaaga

SEQ ID NO: 9146 - DNA, 2052 bp, Unknown
  misc_feature (1)..( 2052): cDNA_ID_3044732_gDNA_ID_1972013_Annot_ID_177862 3000 nt of promoter + ATG
ttcacctggaaagctgagaaatttgttgaaagttgattgaacatttgagcattttgctcgagaagatctccactcacaccaccaatagctgcaataaagccgaaacacttatgctccttctaatccaatctagaagatttagcctttaaatggaaaaagcctagaatcttagacaaacctttatatgaaataccatcatcagtatcgataggcatcataggcggagcataagaaggaccattaggatgaacattcaaatgagatgaggacttggctgaagaatctgtagctttttcctgctaaacagatatgtgaaagacaatcaatcagtttttgtagacttataaatggatccacaagacaacacaagaactttcatccgtccaaactcacaagtaaatgactaaaggttcaagctagttacacattagaattcaatcaagctgatttatggtttgtacttcaaatatctttcttagccttgctagtatcgaaattgctaagtagcagcaaataggattgaaatccacatactttcttatctttgcttttcctcgaggaatgatcttctttcctacgctttccgttttcctttttctgcaatccatcagcaaccacatggaggtgaaaaaccgtcagttgattcttactaatcaataaagccaatacacgaagaaggttaatcaagaacaacgaaaaagtcgccggattaagcaaaatcaagaaacttacagtcatccatctacagcgcagggcaacatctcgaacagtcttatctttcattttcatagcaatcttcgcatatcgaaaaaccgacggttctgtcgcgtacctatataaagattaattactaaaagagtgataggatttaacaaggctcctacaaaaatttacaaccagtcattacagataagtagacaactcatcctctaattaaatcctaaaattttcacattgctctaacactaatgagcctatcataaatatgataccacactagctagctagtcatttttctagtattttatttattaccatacttgaaaccacatccaaaactcacaatcagctaatcaaataccactgtttctcttctcagatataattcaaaaaacccgaccaaagctaacaattctcaacacatattccgattcaagctacatgatgcttgaaaggccatggaaaataacatatcgcagaattcactacatctagtcacatctagtcagatagaaagaacattggataaaacagcaaatccaaatcttaaacatacagagagagagcgagaagattacttgacaagcaaatcttccaatagagattgttcctcaagagtccaatcggtagagatccctggattatgcctcaacgcgccaatcgtctgtgaattatccgccgccgcgcctgtatttccaccattatcgacggaattcacagcagcgccattcgccgccgccgctgaagaagacgataccttctgcgtcgccgacgaaccttcctgattgttccccgacgggttcgcgctcgccgccattaaatacccaatttttggagcttaagaagtcacttggtttcctaaaataattccaccggaaaagtttgaattttgggaaattcagatatgaattcgccgggataggaacagagagagggagagagagagatgatggggagattaatccggccgccgactgagcttcttcttctgcttccctcgaaatatggaatctttgcttataataatataaacatataatttcatctctatcctttttcggattttggttttctatttttgagagtcaaatacgtcaattttagtaattaagaggctttttgggtaaggattataactataggggctgatacataataacctaaaagaagaaagtaatctgttttgttttttcctctcttttcgaggtcccttctcctctgtcttcttcatcccacctctcttgtctctctatctctctctctccgcgcttgaggttggcgtcggagattaccaacaagagctctctccaatcgtcgtctctttgatatatg

SEQ ID NO: 9147 - DNA, 3000 bp, Unknown
  misc_feature (1)..( 3000): cDNA_ID_2038391_gDNA_ID_1972013_Annot_ID_177858 3000 nt of promoter + ATG
gcattttagagacaaggaagccctggccaacgtttctaacccaatgtcactgatattgcagcggtaaagactaaccacacttagattgggacaaaagctagcaatagtggagatcccatcatcagaaatcccaaagcaacaatctaagtaaagagtatgcagtcttgcaccgggatacctgagggagtcgagactcgaatcattcagcacagtgcagccagaaagcgaaagatgctccaaccactgaaaccgagtaagaagcctgtggagatgatgagagctcacatcaggatttgtctgagacagacttgaagggttcaggacagagaaagaacactggaactgtaaagagcgacggctaatgttttggatgttgagccagcgatgacaagtcaaaccaaatgaatcatggtcagcaacactatcaagtcgttgaaagataaaggaaaggcaatcatctggaaggtggataatggaggtctcaacattattatcagactcggacacatcttccatgcctcacttcaattcctgtataaaatggacagcaaaatctaatctttaaaactaaaactatctcctccacatatatctactctgatacagaacataaactcatcaagaacctaagtcagataaacctctatattgatctaaatgaagcaatccagagagccttcacttcagttccggatcaccaagaaagaccagggaaatggatacgttgcaagcttagaatccagccctacatgtctttggaaaacagactcaaaaaagcaaaactttgagactcagaatctctggattggattagattgatcggaaaaaaagaaattatgaaaacccacacaaaagatccagagtttatcgaagaaatcaatcaagtaaaaagagaacaatcgctcaatccatgattgaaaatccaaataccaaaacagaacgagagcgctgaagcagaaattttgcttgctatgatttttttttcttttcgcatttgtttatattattatttttattttattttctaatccttcaaattattcaatttttgagatttatgccgaagttgtgtcaccgtaccgtaactttagcaagtggtgtggattgtggattgtggattatacatgagggtaatgtcaatcctaaatcatataagcacattttcttgaatgagaatgatctcttgagatgaataaatgatctcaatttctgaagacaactcatttaagtgactaccttaagaagggtcttgagctagacaacatggaagagatgtacaagaaggtaaatgcagcaatccgagctgatcggctccaaacaattgataaccaatttttggatccaacaggaaattctgatgctgctgaaataaatcatcagtggtagcaacatcgagaaaaaacaagaaaaaaaaaagcgtatgatgaaaaatgttcattgataagacatattgggctgtcaagtgtgaagccagctgatattaggatgaggtttgttttgttcccgctgatttgacacatgctaccagatgagttgttttcctctggattcgacaggtaatttgtcttacgtcttaactatgtgtatttgtagttttggagatcttaattttttgttatctagatatatttataagtttgcattcatactgatatttaagtgtattttcaaaagtgttgtgactcaaccaaacgtgatcatatcttcttaacttgaatcgcatgttaaagaacactgtcgttccaaggcttaattataacctatatatgttgcccacccacgagataaaaacaattatttagtaattagtgtctccttggatgttgtgaagaagttggacttttgcatattaattctcccgccagtgtcgcaacaaagtcttcatgctcagagtatcagttcacattcgaaacctgatctttcttactagtctattgttatgagattggttttttggagtgaaaatgagcttcgtggaactctcatcaacctcgtgagaacataacttcgtgattgtgttctttgacaagaaaagttgagctgtagtttttttttaacaaggttttgggatgaccagtagtaaatcaattgttgtaataatttggttggtaaatataacatttgttttctactaaacatccaaaaatggaggtacgtgaatgaacacatggtgtgttgtaacaattaatctcaatatggccaaaccaagtcttctccatttctagtccttgtctctacaacgaagctattgcgctatttgttttgtttgtgcagtacgcttccttcttcttattgcctttcttcttaggcgtcatatgactctcttgcatcctcaaaaactatgctgattaatttatgccacaccaccatttctcattgaaagctaaatcgaaattcaaataaagtcccaaaaacatgcaaaagtttaattgaccaaaaagctgaaaagcttgatggcgtttcaaactaatgcactagttaattcaatttccataattacgtagtagtttttttggagattatatatttattattcacgaaaaatgtggataagacaaataaaagacaaagcatgctgcattgcttgttctactttttctttttctttttcagacattttagcccaactatatactactcttgattaatttgaataggattacatagtattccataacacgagacaaaataacaatatttggcaaatagaaatgttgtctagttgttttcctcgtagataaagatagtagtctcgactttaataattggtttgcatagaaaagagaagatagtgttttgtatagtactaggcaaaagtcaaaaagattcttttgaaagagaggacccaaatttacttgacgtaattattgcatttcatatacgttcttcttctctccctacttgatttttattcaaaaacactagcattaagtcactctttcgtcctcagatagtgcgcattgcagaacacaaaatctctacaagaaaaccccaaaaatg

SEQ ID NO: 9148 - DNA, 3000 bp, Unknown
  misc_feature (1)..( 3000): cDNA_ID_3044755_gDNA_ID_1972013_Annot_ID_177849 3000 nt of promoter + ATG
gcttggtggacacacatccgacgtggctatcgttcattggtctgttccatctatggaatgagaagcacaagattactgctccattccaaattccgccttcaataatttgataaaattttgatccactctgtttcaagctgtcaccagaatgtcgtcttcttcttcttctccttcttcgtcttcccttaaacccattaattcaatttcctgataaacgagcagagagagatctgtcaaaatcacaaaccgtgaattcgggaagaataagccgatgatgcttcgtattgttcaaatcgcgtttctatgtctcgttctcgtcgccgggatctcgatctccacggcgatatcagagactgagactatatacgagatcctcctggcaaacggattaccttcggggatattcccgaaaggtgtcagagaattcaccttcgacgtcgaaacgggacgattctcggtttatttgaatcaggcatgcgaggctaaatacgagactgagatacattacgacgccaatattacggggactataggttctgctcaaatctctgatttgtctggaatctcggcgcaagagctattcttgtggtttccggttaaaggaatccgagtcgacgtgccgagttctggtcttatatacttcgacgttggtgttgttcgaaagcaatattctttgtctttgttcgagactccgagagattgcgttccggttcgtgggattcacaaggtatgcagaatgagttttttcaattgaacctttaaagttcttgaaaattattgaaggatactaatgggctatagtgtgaatagagataattcaaatgttcttatcgctggattttgtggtttttcaatgtcgagcttttgaatattcacaagtttcaggcttgccactaagaattcaaatgagaatcctttttcaaagtttttttagcttatctcattcgtcatcatctgaaacttttgagattcctttcaatggtcattttttctccattcttgacttggttgcgatttttgattggtcaggaactgttagacatgtgacatgaagaattatctttagagctaggaaagattgttcctttttagggttatgttctccattcttgaattggttgagatttttttatcggtgaagaactgttagacttgtgaaattgggaatatctttcgaactaggaaagatggttttgaaagttttgcattgatcagattcaatcatgtaatggaaaataagctaatgtgtgctcaatgggtcttcttgcaggttgagttgccattgtaccgagtagatcaaaatcttgggagaaacatcatttagcaagagttttaaagaattgttgtataccataccagaaagaaaggaagatagatgttctcatcaatcaattcttgaagatacttcaactgttttggtctcaaatcttaggcatgattcaaaatcaaattgcttcattctttccctccccattccagttttgcttctgtaattcgttctcagattaggccggggactgaaccgaggagagaatctgtggttttgaaaagatgctaaagggatggcccagattttgttgaagtgatgataactgtgaggtgatgaatgttttgtgttgtattcttgtgtcatgtctaaaacagatataataaatcctatatttagccaaataagtgttatagaaaattggcaatttgcaatcatttctctttcaccgaatatctggctgctttgtttttggtaaatgaatctaaattttacagtcaaatcaactgtgacaattataggatttcgtcgtcattctaaagacctgccctgaccctgaagtggaagtctgtctccagttggcttcggaagttactgtcctaagaagattcagtggatcaatgaaacagtaatgccaaaatgagtccatttaggagacttggaaacttgtctagtgtctcattattttaagagggatctttagtttaagattgtgagatatttattttatattttggtatatagtttaagattgttacaaaatccactttcaaacacacattacatggtttcgaaccttgttactgaaaataacaaggaggagctaaagccaccaccaccaccagactatgtcatctttggtgaaacatgaagtttaaaatggtgtagacccatgacttcaatgggcatatgttaagatataaacgagactagactatatatgatcgatttttttttcgtcgaaagactatatatgatctataattaaaaaaaattgataaatatatctctgatatactgtatatggatcggatccagatattcaaactttcaaatctaactaattgcatagaaaatgtgaccctacaagccataagccccaagtttcacgttccatctaatcaaactcatgcaattatttatcgtttgttcgcctactataattaattataagcaaaattaaaaaaaaaaaaaaatttcaaaaaccagaaaaagatatttgtaatgaaaagaatctcaggttcttacacagtgatagtacttgcggtttttggtcgagtcagaagatgggacagccatgtggtcgtacatttttgtcggctttggttcaacttgtgccgtgtaggcactcatcttacttgcgcaaatcacgatccaactctaaaaacccaaacccaagtctctctatgatcccatgtggtccggtccacctacttttccaataactcgttaaatgttagaacatggcttatagtaacgaaaccatttaaataaatacaaatttattggtggatataatcagacgtggctttcattcattggttactctcaccatggcctgagaaacagaggatcactgctctcattccaaattccgccttcaataattttgttccactctgtttcaagctgtcataaaaatgtcgtcttcttcttcttcctcgcttaaacccattaattcaatttcttcatagccagcaataagatctggcaaattaaaccattccactatg

SEQ ID NO: 9149 - DNA, 3000 bp, Unknown
  misc_feature (1)..( 3000): cDNA_ID_2038459_gDNA_ID_1972013_Annot_ID_177829 3000 nt of promoter + ATG
cttaattttaatttcaaatatggtgcagttcttgtcgatgaagttatcgtcagtgaacaccaggctggactttaacatggacgctctcttgtctaaggatgtaagtcaccgtcacaacatttatagtaattttaattgacaattattgtaataataattacttttttgtctttgtgaaccaatcgtgtgtttgtttaaactaatttcttttgttttctgacagatatttccttcaagcaacaatctaatgcatcatcaacaagtacttcaattagattcttcagcagaaacgttattgggtgatcatcacaacaaaaatttgcaattgaaccctgatatttcttctaataacgtaataaaccctttggaaacttctgaaactagaagcttcatttctcacttaccaacacttgctcatttcactgactctatttctcaggtttccttttctaaaacattcttctatcacttttcttttctttttctcttcaatttgaagcggtcttaaccctttttggttttgtttttagtattcaacattttccgaagatgatttacatagcattattcatatgggttttgcgcaaaaccgtctccaagaattgaaccaaggtaagaatatttaaatcatattttttctttccatttcattatataggcaggaccgtttagatatgatatgtataaattgtactattatatatgcaggttcatcaaaccaagtaccatcgcacatgaaagctgaactttgatcaaccactatatgcatttttacaaaaatattggcgttttaaaggtctcgaggatagaaagtaagaaaaggattgatgggtgtacataacaagaaatttgaattggaccacaccatatgcgaattcatttctataatcatcttcatatacataacttcttctttttatccttccgattcatttgtggtgctcaattgtattgtcatgttgttatccgctattcttcttcttatcagattctttaaacttttcttgtttggatttaatatcattgtatgttttaaccccactataagtactatagctataattcttccgaacaacaagactgtttttatcaaacccattcagttcttgtaacaaaaaaacatcaaactcttgaaaacgaaaaaataattcggttttcttataaagagtttgtatgtgataagaagctaacaaggacagatcattcctagaaaatacacatttttggtgaaggaaaaacaacagtgtgttgcaaaaattgatagatactaagtaaattttcttatttcaattatcaaaactatatagcttctgcatgttaggtgagattttgtagtttatttatgtgtattatttccttatttatttttggaaaaggtatttaattatttgttaaagcgtatgaaatgttagtatgcagtttttggttggaatacgatttaacattgaaaccaaaaagttggtattgagtttttttcggcaggagttacatagcgtgacaactatctttgtgctaaattacatgtgtgtaatttgctcaaatgtactatttccaacaaatataataggtactacagcatattcacaaacatcaaatcttagctaagcttgactttttcaatatacactctcaagtcttaataactcgttaacgtcagtttcaatgttagatcatatttgatatatgatttgatcgttgctagtgttaaccagctgtgtaaggtgttctgtcattttctccattgtctttgtgggagttattcagaaaacaaagatacattagaaagtctaatatgagtggttatgagcaaaaaaccaaatttgattaattaggattatgatgtagggatcacgccgtgattgatggaaactatatagaacagagaagcgtctctttctatttacctactatagcaaagagaacccgcaacaagttatcaatcaagcaaaaattaatgtctaatcaaaaaccatctatctcaagttgttgataatatcttacatgatcataaacaattataccgcagaccggccggatactcgaaaaattgcaaatacattggtcctgacggggttgagtggatcacatacttgaaagaaaaaaaaatagccgtttcacacttatcttcttctgcgttggtcgtttaatcctgcttgaaaaaatattcgttagaatgggccacacaatcaatacgcactgtgaaagctaaatttacgaatcttaaatatgctatgggctagttctaaaactttttaatctgtagaattttagtgagctctttgtgtggtgctttatttgtcggcccaactaaacacacgctaacaattcctttttttttttctctcacattttatttttttaataataaaaaaaataaatgttacggcatggttatatcatatattttaatttcatggaggatattagattgttcccattttctattcatcatattagattaaataattagaaaatactatttttctgtctctattgtagtggtatgtatgattggagagttgatgaaaatgtaagcaagtaaaatcatcgtgcagatcgcgatgctatgtttattatcatatatgcttaaaggatcatttgagattaataccgcaatcagcgggtgagtaagaaacttaaaacacataactactctctttgtcaatggaagaccctcttaagcatctaacacatgattcgtctagacaaccatttaactctaattatatcccctaattgatattaattaaatcaagaggacaaaaaaaattaaatcacttataaatattaattttatagatgtatattttaaaaaagagaaaaaagaaaagaaatgggaggaagacactgggacgaaagacgacgtcatctattgttagtaagtttagcccaatcgtgttctctctgcgcttgtctcccaaattctcagatctaatcagatcgacgattcctgatttcatcagcttcgagagagatccttcttttgttcttcgttgaatg

SEQ ID NO: 9150 - DNA, 3000 bp, Unknown
  misc_feature (1)..( 3000): cDNA_ID_3044728_gDNA_ID_1972013_Annot_ID_177836 3000 nt of promoter + ATG
aaacaaaacatatcggttgtgtgtgacaaaagaaacatacgtgtcaaatgggcctctttcatatatgttccacataacatgataacattaatatgataattattttatttctttcaattattggtcttgtcttctatcttacaacactttaattggcttccaaatacgtccaaaccccattaatgatcttctgtactctatatatatgttttttttaatcgaaaaagtctttaatgtatgaactaaaactgaaagatacgaaccaagaatggttattgtttcatattcagaaatttttatcagaaatattttcgattctcatgtatatatggactgaaaaatcactatacaccaaaaaatagcttgtacccatgaatttcgacgtacattcaacattatttcaaattgaatcttccatcattttgaactgcatgttggaatatcaacattacgtttttttcaaaaaagaaaagaatatcaacattccgccgacaaaacaatagggcgagaggaagtggagaagtttgagaattcaaacacatacatatataacatcaaggatatttcgctataaaaaacactaaaaatatcccaagcataaatatataatatgtccagtttagtgtccacatatatgttttatgttaatatattttgacaatttgacatttctttttaatgttaacgtacaccacaccttacatgccaacaactcataatttcatgaattttctctgtgtaatttcatctgtagattaccaaactcactgcattgtgaagaaaataacaaagattcatcaattttctcttgaatttaaccttgtaccaaaaaaaaaaatattttctttcagaagattcagtttgtttttttcaaacttttggaaatgacatgttcaagataagagtgttattatcacacaatcaaaacttaaaggaaaaaaaaacagaaacaaagataataatttgagaaagcagagatgtctagcaagcagagaaaaaaaacgacagttcgaagataacgagggcattagaaagggacacgtgggttagagggtggtcctacgtaaactgattttttatcagcagtccagcttggcacttgtgagattctcttctgtgtttgcagatgagtggtgcccacttctcagaaataatagatattattcatacacgtgtctatttcaaaatgccactcaataatagttggtctactaacaacttcaaatttgagaattgagttgacactattctaacctcaacactttgtatcgttgtatatgaacatcgatcacccactcttatggatggtggttaaataaaccgaagtacaatagtatttttttttataaaaaaaatccatacaaatttaaacaaattcaataaatgtactaataattttagtttgaagttctaacaattaacaatgtagacaaagtgccaagacaaattccgtggccaatatatataacttggtttagttaaaacatttgttggaattaaaacatattttcaaaatttcatgttttggtggaagaagtcgttttcaccttttaaatttgtttcagacatggagtgatgtgtcatcttgtttaatattattgtctacagaatgttactaaaaggtgaaaaccaaatcttgataaagaagttaattataaaacaaaatcttccggttacatttttttggtttttttgaatgttatagatttggtcaactctcttaattcatccaatcacgcgtcgaaagctataataacacttggttgcttttttttttttaatacaattttgtttttaaaacgtttagaacaaaaataaaaagaagaaaaagaaagagtgaaaaacggcaggggtaaaaacgtcaaagaagaaatagagagagagagtgaagaggagtacaacagaatccacgcggaaagacagctgttcccatgttggaataactgtgcgggtcccactttcattacactcactcctctcgcacatcttctaattttcgccgccgttaccgtctttggaattttttttggtttaccacactaatgttacatttttcgttagagatgattttgttttttgattacaacctcctacgacgtttgagttattgagattacttttataaatttccttactctgtttctttgggtcaacaattcaaacaatgatggtaatggagtgatcaattgacaaaaaaaaaacacgaatcaaacaatgatcgattatataaagctgttatggtctaataactgaataataaaatcatcataagtaaggaaccaaattcgaatactcgcaataaaccaataatagtaatttagtggataaaataatagttatgggttcggtgtcttaaagatttgagtttgatcatcgtaattcgtaaacctttgaaacattttctgtttttttcacaaacttttgggaatatttgttttggcttgacaaactctccaaatagctctttcgtcgtttaaaatctcttagttacaaaacaatgtattgaggtttcgaactcccaaaaccaaacacaagggaaagatgaaaaccattaggccgatcaattactattaagttataactagctaaattaccaataacgtgtatggatttatacccaaaaaaataagtaaacgtgtatgagtctacgagacaaatcgtgtcggctgtattttgacaccttagtcgcgaggtaggtcatacgtgctgcattattaaattcttaattttggtcgaattaattagtaaatactcctaaataatgacgtggcaaattcggtgcaggccacaattctattatagtgaagcactagagtacaacaacaacacttgtgcctcttcttctctcttcctcatatttattactctctctttcacaaacacacagaaaataaataaataaaattaattaatgtgagaaaatcaattcaaaaatttggacatacgtatcatctgagagaagaagggtttggtgaataccggcgggtggaaccgacggcg

SEQ ID NO: 9151 - DNA, 3000 bp, Unknown
  misc_feature (1)..( 3000): cDNA_ID_2038422_gDNA_ID_1972013_Annot_ID_177844 3000 nt of promoter + ATG
agacaggtccggcggtactgagagagaatcgtaacccgtcggcgattacgggacttgaagtctggattgcgagagagagtttctgagctaggactctggttacagcgattgctaaagccgcgagagtagcgagagaccgagtggacccggtgagtgtcgatgaccgagctgttgacttctccgtctggaggattggtgttgttatcggcgaagcggatgcggaaattcggatggatttagggttttggattgatagagaagggaaggggttaagaggaaagaagagacgagctggtggtggttgattggtgaagccatggaatctagggcttgtggcagatgatgggagataaacaggagagcggagagtgagagctgtaatggcggccatctccgttattccgcctgttgaagataaatgacgataggtttttgagtctttcagatataaaacccaaatctgtccaaaattattattttcgtcctttaataagaattatatctttcatccttttaaatcattaatactatttgtaaataaacactaataagtaataacttttaaataactaatactatttttttttttaaactaatagtaacttttatatagatttttagcatttttgttgttatacataattgttaactaaattctatatatacacaaactaaaattcttatttttgagaaaaatgaaatatttggtcaatttcatgtttaatattgtcaaaatttaagaattcatgcatcatttttttctttttctttcactagcataatatttactttgttgttggtagtaaattagtaatccatgacacacaaaaaaaaaaactcaaaactagttgttttcattaacctcgactcttaaagaagaagctagcaagaataaagatttattatgaagccgattattttgattcacacaaaaaaaataagaacaagataaataaatattacagtctcacaagtagaaattggtattacaaaaatcaacacagtggaaacaagtgaggacgtaagattggtaaagaccaaaggtaagcatctaagaacttaacatttccaccatttgagagtatccccaaaatgatacttctcatcatcttcatcggctttcccatgttcatcctccatctctgcataaccatccgcggtggccccaccaaaaaccctcgtcgccggtttcctaaccgcacgacgactcgttttcctttccttcgttgttgcggccaccaggaccttgacggaagacttgacatggcatgaactgcgtttcttcttaccatatttccttcttcttcttttttattatgtctttcggatttgatttaaatatcaaagtttggttctctaatttgcaagttcttgaacgtggatttatataagtagaagaagaagtgagtgagtgatgatcgatgatgtgtaaagctcgggatcaaaagagctttaaatcattgaagaggcaatgattatgagcatcatgaaggcctatggtgagtaggataggaggttaacctttttgaataatattccatttcaatctctcaaatactatactaatcaagttaaagatagatcataaatctaagtcaaactgatccacaataatttcagccttacaaatacattttgagttttggggatcgtaaaactaatttttggtgacacatactctaacttcttcaatttctgaattagaaattccatagttagtggaattccttggacttgagattttattggttgagagataaatgaggaagtataagtcccctagcttaattctaatgttttagccgaaagttttcaagacttatacaaagtttccattagtttagtaagaacttggaagataatattggcattttgttggatcattggccactctacgatagtctataaagtctgttagggtaatacagtttcttttgtaacaacagggggattattaaaacatgttgctttcgtctgcaaattctagacctcaagcctacgtttagttgggagaaatactatttcttatcaaaaggttaattatcttaatagtgatttattcggccataggttttgtacctctcgtgctaaccatcattacaattcgtgtacatgtgaccccattccattctccttttctttttccaactgcttaatgcttaatgacaagattcgtacctaattacaatcgatacaatacaactggccgttttaactttctcaaaaatcaaaatggttttaggcaaataagatcacaattaaaaaataagaggcatttgaaataaaccgatttattaaaataactggggatttattcggtttatttttcattacctagctaaattcatttataaccaaccataaggtatagaccatttaaattggacattcagttatatactttaggatagtaactttagagaataagtggttaataaatactttggaaatacaaccaaaatcatgtattgttggatcattcattttaacatattttttttggaacaaaatcagttgttaatctaaatactagtagaatttcagaagaaacgaaaaatactagttgaatttcgacatatatgtgagcgccagggtgtgaattgcaaattaatcaaaaatctattgggccatttgggcctcaaaattacaattattcaggtttaaaaccctcaatatgaactgtttgagacacagttcccgcgaatatccaaaccttgaagaataccaaactttgcctttctctctctccttctctgctctctctggcttctctccgcaacactgaaacaatccttttccttgttccaacaatctaaacttcctctaatctctcaaattcaattatcttcaagtaatcatcatgtttatatataatctcttcttctcttttgatttatccaactcaaggaacctcactaaactcaaatcttcctctcagtttctcccactcttcttcctcaaccttccgatttatcggattactctaaaatacccaaaatg

SEQ ID NO: 9152 - DNA, 3000 bp, Unknown
  misc_feature (1)..( 3000): cDNA_ID_3044761_gDNA_ID_1972013_Annot_ID_177842 3000 nt of promoter + ATG
atatattcaaagttgcccaacaactaggaaattaaagaaagaagaaaataacagaaaagaaatgaattttggctcataaccaattctcatgaaatgacctcaaggaaaattccgatattacccgccattgttccacgttattgacgctgtgtcgtttggagaaaatcaaatatctcgtccctagacacacattattcctttccaaattcgaaattgaatgtaagctgtaactaacaaaacttgtattatttggaaaattatcgatcttttttttttgttaaaggaaaattatcgatcttaatttatcgatcttaatttattttctcacattgcccacctctataaatttcacacacttcaaaactagtataatttatcaattttactttaacactggaatattttcatcttatacagacttcgataacaaaagaatatatactaattttaaacgaaagacttttccaacgaagctacaatgaaaaaagtcatgcatgtaaacaaaaaaataaatttcaacccctttgactgatgacaatatatacacaagaaacaggttgacatatatgatgagtatatgacttctatctatatatatatatatatatatttaacacatgtaaatatatttctataattcttaataaattgaaaaaaatattttcttctaaataaaactattaataaaataaaaaaacatacgatttcttacctagcgatgcagtgaaaatatgagagacgccagttgcagtcaacttccaaaagaacacgcactctccacatgctctacccaaattcctccttacctattataatcacctccgacttttaattataacaaaccaattcacatcgtgaacgtgacttttctatagctagtggtcaactcgacacgtggcatcatctcaacggtctccttgattctctcgtcatagaaacgatgcactgaatcaatctccataacttcagggcattgcccttctatataaacatcacatgtccctgtgtcttaaaatacctcttatcaaacaccaaaccacaccagaacagaactcagccatggcttcttcttcttcttctcttctaatcctagccgttgcttgtttcgtctcgctaatctcaccggcgatttcacaacaggcttgcaaatcacagaacttgaactccgccggtccgttcgatagttgcgaagaccttccggtactcaattcctacctccattacacctacaattcctcaaattcatctctctccgtcgctttcgtcgccactccatctcaagccaacggtggctgggtcgcttgggctattaaccctacggggactaagatggctggttctcaagccttcctcgcttacagatccggcggtggtgcggctccggtcgtgaagacgtacaacattagcagctacagcagtctcgtcgaaggtaaacttgcttttgatttttggaatctacgcgccgagtcgttaagcggcggtaggatcgccattttcacgacggttaaggttccggcgggagctgatagtgtgaatcaggtatggcagatcggcggcaatgttaccaacggtcgtcccggtgtacatcctttcggtcctgataatttgggctcccaccgtgtgttgagtttcacagaagatgcagcaccgggctctgctccttcgccgggatctgctccggcgccgggcaccagtggctcgactaccccaggaacagcggcgggaggtccagggaacgcggggtcattgacgaggaacgtaaattttggggtcaatttgggaattttggttttgttgggttctatttttattttctgaatggggatctctctctagtctctcttctcttcttgagtctctctctatttttttttttttttggtttgttcgaacaataatggtgccccatacttttgtactgttttagtcttagggccatttactttgtttcaccacattacttagagttattggattgtatggaccattactatcatgagattgagatcatcttatcttcttaaaatatctatttgccatccactgtactattttcattaatctaattagtcgacatgtatttgaaaaaataaataattcaattgacaaaccaaacaacacaagaaatttttattactaccgtgttccttgttaaggagacaatcaaggagttgattatgtcaatttatttcaatcaaatattctgtaattatgtctgattagggcaacattagactctctagcttgtgaatcattcggtaataaaatcacccgattctatcctgtgtttcttttatttcatttggtgatatatatatattgaagctttagaacaaaaagttattgtttgttctatttgctgttgtccacaataaacatccataagtgataaagaaatattcgttttgttattgttggttcaaaagtgtgctgacaacgttctaatttcacaacgaagttttcatccttggttagaagaaaaaactagaaaagtttactagtgtttaattttaatttagctagctaaacttgccactgaatgtatcaatgaactaaacgttcaaattttcaactcttaaaatatttggtcactagtattccaaagttttcgtcgaattatgtttgctaaatcaaaacataaataaaatcctaaaacttgttcccgcgggaccatctatacaaaataatttgggcctaaagcccaatagtaagataagtaacaagacccaagaagtatagacagtttcgaacaaggagacgcatatgcgcgttttgatgctcaaaatctctctctctctctctctcatccctctgcttcacgttcgcgacattactctcttttaaggcgcttccttaattttatcatcttctcaaatctcaccctgagtattcccattttcaaatttcgacgcggtttcaatactcaaaactcaagcgctccaaactaattccggtctttactttcgatttagaggtgggtattgaccaaaggttgtagta

SEQ ID NO: 9153 - DNA, 3000 bp, Unknown
  misc_feature (1)..( 3000): cDNA_ID_3044781_gDNA_ID_1972013_Annot_ID_177826 3000 nt of promoter + ATG
tgctcacaggggaataatacctgtgacccgattcaacgcggaggcccatgtcagaaacctgatttgaccgttttgcacgccagttacgcctttagctcttattgggcccaatttcgtaagatcgggggaacttgctccttcaacggcttagctacacaaaccatcaaagatccaagtaagttaaattccaaaatccaaatcataattaaaccgattcgtaaattagttccggttcagtgatatcaggatgttaaaaccggtggtggattttgggtttgctaaatttttgtactctgttgtcgcttgaaaccaggttacggacgatgtgagtttccgagcgtgacattgtgaagacttacgagttacgaaaatgcatggtcgagaagagacgcacgagggaaaaccgcacgatgttacggctttcattaatggaaacagcacgtgactctctgtacgatgttacgtagcttgattatttagaaacggcacgtgattagtgtttaacttgctgtttatttattttatttttcttttcccgcgaataatgaaaactcatgaaataattaattcgttttcgggtaatgcaatcgccaatcggtctcttatgtgtgttaagctgaacaaaacaataaaattactaatgttctaatgggaaaaagtttgcaagtttcagactgtttccttgtttttattgctaaaattattagaggaacaaaaatatatgatcttcttttgttaacaaaaagaaacgtttgcaaaattgatcttacttttgaaaaagcacatgtaactattgagaatcggatgccatgattctcttctctgcatcgtgactcgtgagaataggatgtcgtcatagctttctttctcactttgcaaagaaaatgtttgaccttttgcagctaaaaagtacaaaccatgaagttgtctctactttactcttctgcatgtataaaggattcgtatgtggtcaatacattcacaactccatttcaacttcataagcggtaaaaacttgttacacaattctctcttggttgattgattgctcttctttcttgttaccaagtacaactttggatgtaattagtgatgagattgttatttatttgatcgttttgaccatgttttcaaatgtcgaaattttcattttaaccatgcgttcgtacaccttctactctctattgtatcatttcattcaatatctggtatatatatatggcgacatgtgttgtgctccatagtgccctcatatatatgttcgcttttgcttccctttttttcttctgctaattagctttaattacatctactaaaaaagtaaaaacacatttatgaaaaaaacatagtaataactagactatgacacgtaaattagtggtttaacttgtgtttgtaccattgttatatcaccatggagatttatcaaaatatatatatatttttaaaaaaagagtttagtttaacaactatatttaacaactatatcgaacatacacttagacttacatctatgccattgtctcatctattcacatttgaaatcttttagaacgatgggttaaaactctagattaggctgtggaccacccaagtgatagcaaacaatgtacacgccgctatgataggagcttccacttatcctaataattaaagtattcaataccacgattcagaagtcatccaaagtcaaaacctcgcacgagtcatgggctcatggcttacccgctccgcggttgtactttgtatatgtttcaaaagcaggaaaacattttttaaagcaattgtaaaataacaaaacaaacataaattatttgatagccggaaactatatatgtatttgttacggccagaagttgattataaccaaagtagttaaatcttgaatctgctttttcattctaacttttttttttaccacacatcaatccaaaatactgccgatgaaatttgtaattagtatcaacttctgtctaaaatacaaatttgaacttctaatttagatccaagcgatgacaactacatttcaagtatcattgtagtttgatagactagtgttacactaaacctaataaatataccaatcaacacacaatgaacccttgttcaggagtaataagggttcaaatttgcaactcttttgtcaagggaaggaaataaataatcaaattgttagccgatgcatgattgacgaaaagtaggggtgttttttacaaataagctaagatggctttagaggaccaccaatcggtccaatcctttaacactcagagcctgaggcagagaacacgatgggtcatcttatatttgtttataaaattgccaataattgagataaggtatcatgattcatcaatctagctagactgtgtgtaccatacataaactataacccatgtgtataaaatatacaaatatctgtgaacatcaaccacctaactataatgaatatgaaaatcatacgactaaactaatttacgtaaactatactactttgaaacaattattcatcaaattctcttatactattaattgtggtttactaaacttccaagttttatgttttactaatcctgtaaaattagactttagccgagtccgtttgaatctaggatttttgaaatttccaggtggctcaaagctaaagaaaatgtgaatgagaaatgatttcaacgaaaataagatttacataatagccaatgacatatatgcacttgtcaagttggagttaaacaataaccacacaccgaattgaggagcccattggaaaaaacagaagcaaatatatttttatgtaaaaatagaaacggaataatatagtaacaaaaagatactctcttcaaccttatccattcttcgccacttctcccactaatccgctaaatcattcttcttcatctctctctcattcacaattcccgaaattctctcaaatcacagatccttttagggtttttccactgtttctaggttttttttattgctcaaatctgatcaatg

SEQ ID NO: 9154 - DNA, 3000 bp, Unknown
  misc_feature (1)..( 3000): cDNA_ID_2180666_gDNA_ID_1972015_Annot_ID_177877 3000 nt of promoter + ATG
tattgactattatctatttatctttatgagtccaatactcgaaaatgtttatttatatttacaaaatgtacagaaatacttaaaagctattttcgttattttaatgagttagaagattgtcttttcccatggggaatcgacaagaaagtatatgtattctcataatgaatcgaacattagaatgtctctttctaacgaaccagtaaccacgactgagtaaagtagtatcattgtcgttttaaatagtcaaataatacgccctaaagtctaaaatttgtgatatgttattttttattgatcattttattatgatcaactagacaactaacgaatcatcagtttttagaaaaatgaaaagaatgccacgtctatcgtttgatatgattccgtgtcaaatgaacctgaacattgttttgaccggcgcagattcctcaccattgtttcgtagcacaccatttctcttttgccaattctcttttcccaactctaaattcccaggtttattacaatttctcgatcgctgattaatcttggtgaccacctgatcgaaactgaggatccttgggtttttcaatatcgtatcttgtttgcttgaaaccctaggcccctttctggttcggttaggttttggggtttatgatcatcgatgcttgcttggtaatataaagttttgaataatgagcgcggttagttttctttacagctcgaaaacccccaaatttcgaggggttttcaatgggatttgtgctctggttctgttttgcttcttctttgatcggagcgaattactcagaaaccctttgttaaggaacgcgtctttcgtcaatggtggtagtggctcaacctccggaggtatcacccagtttatggtaattcgtagaaatgcgaggcaaattgaaacgaatggttctggtaataatagcagcttgagtagcagtagtactgttttatgctcagggttacacaaacacatgggttatgctgatcaatgcgagttcttaaaagcaaacccaatttgttcccctgatggattctttgattacctcagcttcttttactgctcctgtagagatttcagtatcttgggttacatgatgttaggtgtttggcttgttgctttgttttatctgttgggtaatactgctgctgattacttttgttgttcactggagaagctttcaaagcttttgaggctgcctccaactgttgctggtgttactttacttcctcttgggaatggagcaccagatgtgtttgctagtatagctgcttttgttggtacagataaaggagaagttggtcttaacagcgtcttgggtggtgctgtgtttgttacttctgttgttgtagggattgtttcgctttgtgttgcggataaggaagtcaagatcgataagaattgcttcatcagagacttgagtttcttccttttctcgcttgtgtctttgctggtgattttgatggttggtagagtgacagtccggattgccatcgcgtttgtctcaatatatgtggtttatgctttccttgtggcagcgaatgtgattctgagaaaacatgctaagaggtttaaactagaggctcttactcctttgctacctatgcaaggaagtgtgttttccccgagtgttggagaggatatgccaatgaatacccccttgatagaaactgagactgaggatggtccacctcggctacagagtcttcctcagtggatgtgggcgtcaaatgtggccatctattcaaaccatttcgcaaaagttagtgtacatgatgaagacaggccaccttggggatggattgatgacactgcagaagtagagagctcctcatgtactaaattcacttccttgttggaaattccgctgaccattccaaggagattaacaattccatcggtcgaagaagatacatggtcaaagacatatgctgtggccagcgtctcattagcgcctgtccttttggcgtctctctggagtagccaagacgatgtgagtctccaagcttgtggtgtcgcatactttttcagcgttgttataggctccactcttggctttctggcttacaaaaacacagaacctgatcacccacctcgaagattcttgatcccttgggttcttggtgggtttataatgagcatcgtatggttctacatgatagcaaacgaactcgttgctcttctggtgacatttggtgagatttacggaatcaacccgtcgatacttgcgctaacagtacttgcttggggaaactcaatgggtgacttagtatcgaatatcgcattgacaatgaacggtggggatggtgtacaaatcgctctatcgggatgctacgccggtccaatgttcaacacactcgtcgggctaggtatgtcgatgctttttggcgcatggtccaagagtcctgacacatacatgctaccagaagacaaaagcctattctacacacttgggtttctagtactcggtttggtttgggctatggtgatactcccgcgcaacgacatgcaacctagcagaaccttaggtgttggactcattgcaatatatctgatattcgtcactttcaggctgagctgcgccatgggattcataccatgggctgcttaaagagctatgtataaccttgtttagtctctaaccaacaaactaatcagaggcttattgtataccaaagaattgatcatgacatgagagtcgtagttttgaatcttagtgtgtttgtttgttattggtttgtccttttgtcatacctgcccattttcataaccgcaaacatttcttattatcctcgtgtcaacattaaagcagtcatgtgacccacgtctcctccttgattattccattattcactgttatcttttcgaagaatcatttgggaccaattattgataaattgcagacgtggcatatagacgaaatacaagattcagagataataaatacgtcaccaaaagttatcacccacaacgaatcttcttcttccatcgccattgccatg

SEQ ID NO: 9155 - DNA, 3000 bp, Unknown
  misc_feature (1)..( 3000): cDNA_ID_3044850_gDNA_ID_1972015_Annot_ID_177881 3000 nt of promoter + ATG
gtctctatagtgcttggatttctcttctaagttgaaatgcaagaccacaatcaaccatatcaaatgcaaatccaacggagatttactatccaactccgtgaaatccatatccggtgtgtttggatcagaaccagtagagggattcgacatgatgagatcatccaacgtttgcttataatcagagatcataacaatgtagttcatcacataccttgtcaatggatgaatcgttcctccagggacaggaactatcgaaggttcgcgaagaaccgcattctcaaactccgaaagtatacctctcgctgcttccgctaacctcgattgaatctcaacagcctgagctctaatagcatctgatgaatctgagtcaaagattgcttcaatatccggcaacatatccgttaaagcatcatgtaaatcaagaatcttgaacagcttctcaggtgatcttctactgatacttatagcttcagggaaagtgaaaagtctcagagcagaagccttcactgtctccatgaaacaagtctcatccatggcagtgcaaataccatcaaagagctgctcacatagtctcttctcactagagaaaacaactctaatgcaaactttagcagcacgaatccatttcctgatctttccttcaacaacttcccactcaagcctttgaacatcaccaatgcttatcttcacaatcccaagctgcttaaatattgcttccatggctgatttgcgaacagttccatagacttggatacattcacgagagtaaccggcggcgaccattcgttgaacaatcgatcttagatcagaaactgcttccggcgaaatcagatccatttctcgtatactgctagtggatctgtaactgcttcttctacgagttaaccggcttgaaccggaaccacctggagaatttaattcttcttcttcgggagttacggtggtatcttctccaacttcgacggttaaagacggagagactgatggttcctcgaggaaaagtgaatcaggctcgaaagtagttgtgtgggagagaagaatgttacggaactcgtcttcgagtctagccatagcgatttgaatagctgagttggctttgacctcgtgttcatcgactacggtggcggcggaggtggcggcggaggaggaagaagaagagaaagagacagaagataaggaccgttggatttcatcaacggctcgaagaaaccgatccacctcatcacgatcgctttggaaaatcatcttccctcttgctccatcagtcgctgctgagtcccaccggagtattatcctctccgctgtctctaagttcgaaccatcggaatctaaactattctccggcggttccatctaataaatcaatcagacaacaacaaaaaatcaaaaacagtataaagaaaacttcaaaattcgaaagccaatgaatgattctcacctccaccgattcaaattcttctcagatggaaattcgtgaaggagattggttgattttttggtaagaaaccacttcggtttttttttttttgcttatcggaagaagtcttagcaaaggcaaagctgtctgtttgtattgtttttagttttaatttttggaagtttctgcgagaggtgggaaatcggaaaaaataagtctttggacttttcaactcctctttgtgtgtacgttgccgataaattttaaacttttttattccgaattactcgccggcggcgtaaaatgcccggtaaaaacttttttggtttgtcgaattattgggtgagatctagtcataaatgctattatgcctaaaacaaagtcccactttctcgatataaaaaaaaagacacacatcatgtcttattatgatctttcatttccatagtgggatcacttaagccagtaattttggaaacttttttttttcagttatctaaaaatatatatatatatatatatatgacatatacattttcaaatatacaatactttcaataaactaaaataatgtagttgtttctgtgctactaattcggattttttctttacataatttttgttataaatagtttacctaaaatgttatgacgtggttggcccatgttggcatggcaaggacatcaatttgtatatgtaatcaaattacctgcggataagagagtaccaatttggacatgttttttttttttgtatatttttgaatagtcgagaaaataaatgtagattgtcaaacctcataatgagatgtggttggtggaccatacttgattttaatcgagccgattaagtaaaggagataatacaagttgtagtcatgaatatttaaggttattgaattgtttgaacaattaggttaacttaacaataaattgaaaatttgatatatctcacatacaagatcataataatacaattttctttttcagttctcaatttgtttctctttcacacaaaaaaataatcctcattttatttgagtccttaaataaattcatctaatcagtcacaaagaccggactaatccaatatacacgcttgggtccacagaacaagttagtcagaaatactggtcctcctttgatatctgcaggataaacgacgtcgtctttagatatgggcttgggcctaagactgggctgtcagtaagataaggaacggacaaggagtattattggcagtcactaaaaatggttgtcacagtgccgtgacgttagtttcacctgacttgttctctgaaaattagcaataaaataaatcgtgctataaatagttcacttgtgccgcacggtccctctcatcttctacggacagcttctttctctttcctctctgattttttttttctctttctacctttttctttttttattttctttcttttttttttgttagtttttttttttttctttcttcatctcgtgaacgatatagtacctgaaccctagcggaggaaaatcaaaaattgtctaggagaaacaaacagagatatctttctttctttttatcagtggggaaaaaaa

SEQ ID NO: 9156 - DNA, 3000 bp, Unknown
  misc_feature (1)..( 3000): cDNA_ID_1662981_gDNA_ID_1972015_Annot_ID_177882 3000 nt of promoter + ATG
caacaataacgacaacgaaagatgaccttcaaagtatagatataggcatccacatggaaactagaacagacaaaagaaacagtcacgattgctatgatatagccttagaccaagagaaatagctaaacatctgagaatcaaatattaattatgaaaagaaattggcggctattctgacaaaatttctttaaccctgttcatctacattgctttgctttctgcacagtccaccagcattgtttcatataccatgtatttcatattgaatgaacaaatatattgaaacgtaaaatctgctcatcaacactaacaatctaaacgaacctaacttcaaccatagctgaacagacttacatagtcatcaggaagaagacgagcatgttcacgtgttggagcatcaaaatccagatggtgtaaagtgtcagcgttagagccatttttcttgagatatctttgtgtgtgatgccacactccagcattaggaagataagtacccacatgagatccctgcacctgagatcattaacattccctggtaagtaaattctaatcgagtgttaatcacctctatcaatttgagggttcatcacacaatactttacgtacgttgaacaaagtctaggaaacagtaccaacaccctcaatacaagaaaagtaggaacataaacacctgactctgatttcagaagcaatagtgttttggaggtgttttccatacagttcctaagatttccattcatatacaacgagatctagtatctctctaggtggagagtgaacactactagaaaagaaaatgcaacaaccgttttgctcaacttctgtttgtgaaaattaaaggaactgcactgcaattagcgagtttataacgatcctatacatgatctctacctaggaatacaaaaatgaccagaccagatacaccaatcaagtagcataccaaaatgacaatgggaaagtaatatattgaaaacgaatatactggaatcatcaccttcctttccaagtcaagtgattttgaagcaagttcttcaagccacatgactatccgaaggcatagctgagctgtatggtcgtttaaaacaaactgacaagcctccaaatgagatgttgatgggatctgccgacattaacatagtcaaataagtccatgcgtaagatgtatcaataagaatgattcatttgaaaaacgactacgaaagaatgcattaccaggatcaaattctcaggaacttcatcagtacctgcaagaacaaatacacatcgtcaataatagcatctctaacacaaaccacccagtactttaactgaaaattttccaggtagacatgaaaatattacacgacaccgagctttatcagacatcagtgatcaaaacgaagacaacacctaccctgttccaaaagtaatagaaagatggagctgagtttcctaaccttttccatataggttccataaaagtgaccaggaggcagcctcaccaagcaaaagctgagccttctgtctcataagtttatcctccacagcacgatgtctaatatctgatccatatctgtagataacaggaaaagatgaaccaagcacaaagttgaagaagttttgacggtttaactctcagagccagaagacatacctaattgattgtgaaacattcctgcatgattcttcaagcctcaacattagatttggaatggacattagtcctgcaaaaccaagacgtcataattacaataagagaaaaccagataatactgggactctagcaactaactaacgggaatcccacaaacacacaaagcagaaacactgcttagttgagattttgaaaaaaaaggagaaccacacacatgcatgcagaaacaaacccaaatatctgcatattcatgtatgtacacatattatattcgaagactgatatatcatacaaaccttgaagcgcagaatcaaacagggaagcaaacaaagcaaaggttgtatctccactctccgctaactcatcattctcaatcttgcaagccttgagtgattgactttctactcgacgaaacaaagcctcatcgtcatcattaagaattccaacactctccctcctggaagcagatatcgggtttgtaggtgttccttcgtaatgatcagtgtgaaagttgtcaacctcttccttaatgttttcaaggagcaatgcagtatttgttggactatgaatgttatgcccgtcatacagtaatctgttctcgctgacatttgaactcaacatttcctcatgtggcgatgtagagtgtctctttctgcaagcaatgttatttgacatagccgggcatcaaaacactatacccagattccatgaactaaaaccataacccctaataagattcagttcttagagaaaatccaacaattcaaatcgcattcaagtctcgctagaatcagctaatttagaccgtactaacaaacaaacgacaacccaggaaaaattcactttaaagtaagaagacccagaaaatcggaaaagggtagtcgaaaattttaccgatagcgacggaattgatccctaacactgagggcctcggggtcgaagtagctaggggaagtgtccatatccatatccatttcttcaccaacgaaagctaaccccaagtggtatgcagaaatatcaaatcttagaatagcagaagagcgcggcaatgctcaagttgagctcgattagggttttgtagtcgtcaaaaatctaaaacccttttaaaatcctccgctccagtagaagactccgctgagacaaagacagcgacgacgacacagaacagtcgccaccagagtttaagcaaaagctccttaaacgctgcgtttcatctttgaagcttagtaaaaaagggtttaactgtaattaaatagaaaaacaggggcagtcttgtacaagtttcataaaaaacagaccagcggaaacgagttttaagcttcccaaagcgtttgttttatcctctcagagagctttctttagtgatg

SEQ ID NO: 9157 - DNA, 3000 bp, Unknown
  misc_feature (1)..( 3000): cDNA_ID_2992324_gDNA_ID_1972015_Annot_ID_177889 3000 nt of promoter + ATG
gtcagatcgtccttagcatccatctgaaaccaaaaacacataggatagagtcataaaaagtgtcactttaagttccaaaactagattaaagatgcagtctcaccaaaatctccatcaaagacagagagatagacattgttttttaagtacagtaccttttcaatgtcccaattgagatgcttctccttgatgctggaacctgcaagtacaaaagatcaagtttagcacaagcttactcgcaaagattggttaaacatcatagcttagaagatctaaatacaataccatgatgaagtagcatgagatcagcagagtagtgatcatcccaaagattttgctgttctttgatgcatttgctgtgatcatgtaaaaacctttccccagctatatcaatctctttcacagcagcagaagcaatttgcttgttctttgaagaagcagcagctttcgcatgaatcccagacttgtttgtaatatcattcagagccttacgagctcctccaggtttcttctgaccaagtacagtccctttggatttcacagaagcagcagtgacagactctgtaaataatagccaagaaagaaaatgttaaatctttgtttcaaagcaatatgatttaaagagagtagagaaagattaactacttttgcgatgaattggagcgttctcgtctgggaagatcatttgttgaagagcgttcatgttcgccatatggttttaactgtgaatcatcaaagaaccaattgcagaaacgaagatttgattccagaactgacgattttaagcaattagaaaccctaaaaaaggtaacagaaacccaactcgaaatcgaaacaaagatcgtttttttcacaaaacccaattcgatcctcaagcaaatttaacaccacagaccccagaaacccagaacgaatcaagtagcgacatacgaaaagaagaacaaacaatcgcaagaagaacagtctataatgtgaacctaaatcagaaggaagaaagagattacctttgtaaaagtgaagaagtttcttggtgagattcttgttggaagagaagtgtataagaagatgaagaagagcgcttagagtgtttaacggtaacttttcaatgttgttctgacgaaataatgaagaacctccgggattaggccaaaaaaagtaaatttatagaagaagagaaaaagtttctagccgttggcagaatattttaatgcaggcctaatcaagaattggcccaggtacaggcccatcacataaatcaaattgacggcatcaaactatcatgtaagatagaagcaaaacatgtcacacttctctaagttatcttcttatcggctagatttatcatcatccttgattaaatctccttaattttggaaggttaaattataggtaaagtgtatataattagtctaaccaaggatattcaacgcttctcgttcctgttccttatataaaaccattatcctcacataaagaagacttaacaaaaaaaaaactcttttcaaaacacattagagacaattaacaagaaaaacccttctaataatttgatcagagatatgggtttttcgcacaagttgtgggatgaaactttggccggtccaacgccggaaaatggtctcgggaagttgagaaaccacatatccggtgaaagtgccaaccggaagttgatggtggatctgaaacgtgtcccgaattctcctgaccgttcaagcaaccccgtttcccctttgactcttatgttaccttttttaaaaatcctttctgatccactttttttttatcttctatgcttgtgttatgagcagttaaaaccctatatattcatgtaaattaaagactttgcaaggtgatacatatgttcatagtcattataagcttttttttattattttttttttttattttgacatccataatcattattagcttgagagtattatggatttgtaaattaatgattaccaaaatcatttgtatgcagctggaacaccaagtgaaacacatgctacaagtctcaatgcttgcgattggtttgatctccctctcttttctttcctctcaaactatacttcattttatccaacgcattatcgctttcattagtaccaccatatctaattaacgtccggtaatactgcaggattgtgctaaacgcattggaccgttgaaaaatattacaaggtatttctacgagaagaagaagtatcccaaactacttttctttgtatatatatatttgctgtgtacataacataatggtcgcttttggtgttttgagatttgagaaatattaaatttctgtttgtttcacaattcacgaagattatataaggtctttttgaaacatagtatttctggaatgtttaaagttgtatctttgacaatggtgaaaagaaaaaatgatactaagtgataacatgctaacgtagcgtatggaaagcccaataaaaacccatgcccaaagtaaataacatccacgtcaccgttcttattgttaaaagagagactaattcgaatcgatttaacgaatgaagcaagacaacgaaggaagacaactggaaactatcgacggactaaaaaaagtctacgaccgatattgaaactgacggttaggctaagggtaatttcggtacatcaccggaaaaatggttcacggggatagttccggtaattatagtaaaactagatgggcttttccgtcaatacacttcctcatcggattacgaagaaatggggaaattacgatacaaacccatcttttacccctaaaccgagccggcaactttaccggtgacggaatcttacctctgacctaccaatcacgtcattccacgtcatctccccgtatcttctcacgtccttccacgtgtcccctctactcaccgacgccgtctccttcccgtttacccctcccgaacagaatattaacccaaaccctaaccctatctccctctttcacgagcttctgactcagatccggcgatatcgaattccatg

SEQ ID NO: 9158 - DNA, 3000 bp, Unknown
  misc_feature (1)..( 3000): cDNA_ID_3044819_gDNA_ID_1972015_Annot_ID_177893 3000 nt of promoter + ATG
atatcaagctgacatggaatataaagcatattagtatattcttctttttgtttatactgatattccattcgctagttgctttttaatgattctattctctaatttacaacttttagagaagccaatggcctgacggcatgtcgaatctaacttacattacatatgatacttctgacttctatatgatgttcatttttcccacatgttatatgtaaaatttacctatcatatatatatatgactacaagtctgtaatatatgagggcaagtctatatatataaatgactacaagtctgtaatcatttacgaacctaatttttttaaatactcagtgattaactttcttaccgcaaattataagcagattattataatatttatttattaactttttaaaaattatataatatcacgcgaaaactgcttagtatttcacatttcacctttgtaattaaatttgtgtgtttttaacggtcatatcttatatatcatatagatagaaacataaatcatttagtaagttaatagagctggttaatttaatcatgccaaaaaatatcttgaagaaagagaaggattcatacaagggacgttgtactcccgtacacgttttgcttaatcttctaagttctaagaaaagtacgaataagtctttaattaatttgaattaatattttattaatgtaaagtgaaaacgagttttgacattatttgtaaattagaaaatcgacattcccgaaaaggctgactgcgtttgtcattgactcaattatagctggttagaaaaacgcttgtgaaaactttgtctttgggtggttgagattaataattttgaaatcacgaatggttgtttcctaacacgggtttctcattttgttttgtcatattttgagtttgcatagtcccaatgcaaacaaagtaaccgtaggtttgttgtctttccatactttgaaaattgaaacagtataacaagttaataatatttgtactattattttattacaaattttttttttatcagacagtaaaagtgttctcaaaaacttgttcttactgtatttcccccccaaaaaaattagtggtttaaaaatatttagtggttccatcagcctatcaatcacacctaattaactactaaaattcgatgcatttgttttgtttgttcaaatatattctctactttttatttttacttgataaaaaataatttagtagttcttgcattacatcatcatatgcaaaattgtgttatgatttggcttacttttgaacttttactgttttacatgatcaataatcagatttttattttattttttttgggttggagattattataagtatttatatttgtttctttcataaatgtgtcatgtagttatactttaacgactttaattgtttttacaacagttacgatcgtggattcgtttgagaaaaatacactaaacgtcaacgcaaacacaaacaatcgaggtggttataatttaaagattcaaaagtttgtaaactaccgttatagatttcgcacacgatcatggtagttatacttacaacgacttttagattctagattcgtttgtgataatataaactaaacgtcaattcaaacacaaataatcgaagtagttacaatcttaaacacttcaatcgatttgtttaaactcaacgatcatatttagctattaaaatatgatataatgcaaaatacatgagtagaaaatcaatacattatttatatcactacatgaaattcaataaagtcacattctttccttataaatgtaaatatgtaatgtactaaaaaaaacgggtttatacatctcaatttttgtatttgttttcatcttatattttcttttattttagtatcatcaaaatttaacctctggctatttttaatttttacattaatcttttacttattagaaatatattttattttatttgtatttatttgggaataatttctaattaatttcttttcctaaccattttgtatatttgtaattttttattaagcttggattaatttctatattgattggaatctatataagaatataagaatctaaatttaataaatatagattcttatatttatttctgttttgattcccatatatgatagtattgttaattattaaaattgaattgatggtttatacacactataatgtttaaagtaaaatttctttatttgtgccattgtgtgtaaatgatttaagctcatatgggagttaattttatcagccagctcatatgaagctaattttagaataagaactatctatactagtttttttttttttaatatagaactatatatgtacacagttggacaatttctatataatttttcaaacataaaaaaagtatttaaatattttaactaatggaacaagttacaagtcaccccaaagattacagtcaaacttaccttttcgaaattgaatatttcttttataagaaccgttttttttgttttttaataatcattttgacaaacaataaatataaaattagagatttaggtgatatttaaacgagcgcctaaagttaaaaacttttaaacccagaaatcaccaaaaaaaaaaaaagtacatttcctttttttttgttcttaaatttttctgtggttccggtcaccgcagctctgtcatcatcttcttcttcttcatttaccaatctgaaatctactcagattctttgtgattttctccttaaaatctcgatctgtatcgtacagtgacttgtgaaattaggatcgttgtgtctgtgttttctggttacagtttgtaaaatttgaatatttgtgtgtgaagtcagattcagtttcgtgagctgttcggatttggtttgggggtatatatatagcgttgtgtgatctatttggggggttttggtttccctttttttctctcttgtgaattcgtttattgttgtatcgtcggcccgagtttatcggaactccgggtctgacgtgagttttccaaatg

SEQ ID NO: 9159 - DNA, 3000 bp, Unknown
  misc_feature (1)..( 3000): cDNA_ID_2180724_gDNA_ID_1972015_Annot_ID_177896 3000 nt of promoter + ATG
gcgtttggtacttagtgatcaattttgtcatttttaaccatgtgaagagtttttgttttttttcaacaatcaattgtatatatattttttgccatctttatcacttttaataatagtaaatgaaatatcggtattcattttctgtgacctttatagtctatcattgaaaatagtgttggtgagaagtttagtctttagggatatggtgttattggaggaatcccaaggcctgaagcaatctttgtgtgaagcaaagcaaatgtaagaagaatatatcatctaaatttgtttaagaacacatcactttatatttaattagtctcatataatagcaaaatttcggatctaaaatacatgctacgcgagcctaatatttcatatgcgattgagatatcttttaccttgtagactgtacttgtaatttttttcaaagaagttacatttactttactatcttactataaattactaacttttgctgtataaatatgaccactgaacgtctgtgaagttcacgaccaaaccagtcttactctctcttaatattaaatcattggaatatttattaattgaatttaaatcattggaatatttattaatttatatttaaaaatattaaattactttttcttattgatactagaaatgtataagttacaagttttattttcaaaaaattagtttttaaaaaacagttgccaatagaaccgattccaaaacaaacaacaaagtgtctttgtagctggttgtggtcgctagcaaatacgaaacaattacatggccatatatatatatatatatatatatatgcgtttggtacttagtgatcaattttgtcatttttaaccatgtgaagagtttttgttttttttcaacaatcaattgtatatatattttttgccatctttatcacttttaataatagtaaatgaaatatcggtattcattttctgtgacctttatagtctatcattgaaaatagtgttggtgagaagtttagtctttagggatatggtgttattggaggaatcccaaggtctgaagcaatctttgtgtgaagcaaagcaaatgtaagaagaatatatcatctaaatttgtttaagaacacatcactttatatttaattagtctcatataatagcaaaatttcggatctaaaatacatgctacgcgagcctaatatttcatatgcgattgagatatcttttaccttgtagactgtacttgtaatttttttcaaagaagttacatttactttactatcttactataaattactaacttttgctgtataaatatgaccactgaacgtctgtgaagttcacgaccaaaccagtcttactctctcttaatattaaatcattggaatatttattaattgaatttaaatcattggaatatttattaatttatatttaaaaatattaaattactttttcttattgatactagaaatgtataagttacaagttttattttcaaaaaattagtttttaaaaaacagttgccaatagaaccgattccaaaacaaacaacaaagtgtctttgtagctggttgtggtcgctagcaaatacgaaacaattacatggccatatatatatatatatatatatatatatatatatatatatatatatatgcgtttggtacttagtgatcaattttgtcatttttaaccatgtgaagagtttttgttttttttcaacaatcaattgtatatatattttttgccatctttatcacttttaataatagtaaatgaaatatcggtattcattttctgtgacctttatagtctatcattgaaaatagtgttggtgagaagtttagtctttagggatatggtgttattggaggaatcccaaggcctgaagcaatctttgtgtgaagcaaagcaaatgtaagaagaatatatcatctaaatttgtttaagaacacatcactttatatttaattagtctcatataatagcaaaatttcggatctaaaatacatgctacgcgagcctaatatttcatatgcgattgagatatcttttaccttgtagactgtacttgtaatttttttcaaagaagttacatttactttactatcttactataaattactaacttttgctgtataaatatgaccactgaacgtctgtgaagttcacgaccaaaccagtcttactctctcttaatattaaatcattggaatatttattaattgaatttaaatcattggaatatttattaatttatatttaaaaatattaaattactttttcttattgatactagaaatgtataagttacaagttttattttcaaaaaattagtttttaaaaaacagttgccaatagaaccgattccaaaacaaacaacaaagtgtctttgtagctggttgtggtcgctagcaaatacgaaacaattacatggccatatatatatatatatatatgcgtttggtacttagtgatcaattttgtcatttttaaccatgtgaagagtttttgttttttttcaacaatcaattgtatatatattttttgccatctttatcacttttaataatagtaaatgaaatatcggtattcattttctgtgacctttatagtctatcattgaaaatagtgttggtgagaagtttagtctttagggatatggtgttattggaggaatcccaaggcctgaagcaatctttgtgtgaagcaaagcaaatgtaagaagaatatatcatctaaatttgtttaagaacacatcactttatatttaattagtctcatataatagcaaaatttcggatctaaaatacatgctacgcgagcctaatatttcatatgcgattgagatatcttttaccttgtagactgtacttgtaatttttttcaaagaagttacatttactttactatcttactataaattactaacttttgctgtataaatatgaccactgaacgtctgtgaagttcacgaccaaaccagtcttactctctcttaactaataatattgag

SEQ ID NO: 9160 - DNA, 3000 bp, Unknown
  misc_feature (1)..( 3000): cDNA_ID_2105344_gDNA_ID_1972015_Annot_ID_177892 3000 nt of promoter + ATG
atgggagatacacttgcacttcagtatggaggatccgcggcacacaacaaggtctcttttacttctctggccataagtttttgtctcgctagataaaaatcttaggacataattgttaaccaatgatcttacttatgtggccagatattttgtgaaaggcgtggtcaatggagagcagcgactcaatcacaggaattcttcagaactttacaacgttactacagtaacgcctatatggatgccgaaaagcaagatgcaattaacgtgtatgctgggttaaattttctctgttttctttttctatggtatgaaaaattatatgactttgatttgtatctttctacaggttcttgggatactttcagccacaatcagataagccagcgctatgggaattgggttctgatcagcattacaacgcagcaagatttcttgccaattctgtaccagagacttcaaggtatattttctttcctgtttaatgagacacttgtagagaagtttgatacattctatgtttcattagagatgcttacattccattttattgcctttagatcgacgatgaaacgatctctatcagaaagtagcatcattagcgagagcagtccagccgcattgggaccagtaggtagacatggtttagctgaaaaagatgaagaagttaaaggtctttcagattcagcaccggagatctcaacgtctgaaactgccaagattgctgctagtttgaggtaaaaaagcttatgatctatgtcaaagaaagcttctaaatatataggggttgctgtcagctaaacctgaggaatggctattgttttgcagtgctccaccaccgatattagaggaattaggtttagatgatattcttgaaaacgattgcttctgctgtgatgggaatggtgagcaatgtacatgtgcagcttttgatatggattgggtatcttcttcaggaaactcttgtgaagatgagagttgcggaaggtaaccaacaaaagtcttttcgaatctatctaatgtggctaatgttaatatcaaaccagaaatgttctatagaaagtctttgacatgttttcatttgtgcagagccacagtggttagatcctttgaaaccatccctgaaagtagaaaaatagagtcagaaatttgtgttgttgaaacagttggttccaacagtagaaaggtaaatacaaagcagccattgatgatgcataaaaccgcaatgctaataataacaaactctgctttcctttataaactacagggaaataaagaagaagaagaagccatttccgggattcctgaaggttatgtgaggtgggtgatggatgaagacggtcatttctggtgatgagagaacaaagcttttcaacaacacctacaagccatatgaaacaaaaccaaaaaaagcaaaacaaaaacaagaaagagcatactctttagtctttagtgggtgacaaagaaagaagaaaaactgaaaaagaattactaatcgccgctaatttatggttaatagaattggaagaaaaagggtgaaaaggtgagaaagaaagagaggatcacaacaaatttgtaaataatttataaaaaaagacatggagattgaacatgacttacatcttgttccatttttctttttgacatattactttaattttctggagaactatgatcgattgcaataaaacagagtgagtaccttcatacaagttcattactcttcattatatcttcaacgactccaataaagtggacactagatatgcacacacactatataatatacatgttatgtgtgtgtttctaatgttatcgaatcatcacttgagcattgcaaatgcaaaaaacgcatcttagttagtactttataacgaggccaagttactggtttgtttattagctttagtaatcagtgtattaacattacattacaagctcaagctatatgaatgaggtcaacttcaaaataggggagaggagggggcggcaaaaatgaaatgaacaaaagcactcgtaatcgtgattagtgatttgatttttatagtataagggtcccgtacgtggtggatattgattgacgcgtttaaagttaaaaagcacacgtttccaaaaaattgacggtgacgcaaagacctcatagtttattgtagtttacgaaaacgccacattcattagaaccttctggcgagtgtgaggcataaaaatatcatcgacacatctgaaaaatctcagccgcactctcatgactgtactattattcgtccaatgttccaaaaaattaaacaaaaaattcaacttcttgaccaacgaaaattataaaaaagagacaaacaaacatttaaatgaacgttttaattaccaaatttactgatacgtaagttataagtttgggtgatgtggtggaagcccaaaaagaaaaggtttataagttgggggtaaaagaaacagttattatttatatttttactttgaaaaatttattagtcttttttatgaaaataaaaatgaagtgattagtactatttgaatagatattttttgttctaagaagtattattattagtttgacgaaaatggaagaatacgataaattattagtagtaaaaaaagaaagtagtaggaccaattaaaaagatctaaacaagtggtaagagaggttctggagagttccattccatctttgtacgagagagaaaggcagagttagaaaaaacatataaaaaaacctgtttgttctttcctttcttctctccaaatttctacttcttcttctttgatcgacacctatctaaccctaatctctccgggtttttttttctgcccttaagaagacgtcgtttcgaacctctttagtatcgatactcaaacctatacacacaccaaacatcccaagtttgttggctctgtttttgagcggtgaaaactcgtcggaaaaacgagtttttttttaattgggtttctctttttttttgttgatctggaaggagaaaattagcgatg

SEQ ID NO: 9161 - DNA, 3000 bp, Unknown
  misc_feature (1)..( 3000): cDNA_ID_3044846_gDNA_ID_1972015_Annot_ID_177883 3000 nt of promoter + ATG
gttgtggaacttacaactggctcatcaggttgtctttctattactgtgcaaattcttatgtttttttctccttctcctcaaatggaatttacgaacctacattgattttccctgagtaatatgaaaaactttaagttaacaaagccatattggtcgtttgattgtgcagaggatggtaaagagacattaaatgaggaaacacctgaaaataattctcagtttaccactgtttatgtgggaaaccttgctccagaggtacattatccactaggaagtgctccttgtaatactatcacaacaaaaacagtttatttgaggttctttgatgaagttttacattagtagatttcgggtacatcgttacagctatctatcttgcaggtaactcagcttgatctacaccgttacttccatgctcttggcgctggagttattgaggaggtccgtgtccaacgagacaaaggctttggtttcgtgagatataacactcatcccgaagctgctcttgctattcagatgggtaacactcagccttacctctttaacagacagataaaggtacttttaagtttggcttaccactctaaaccctctctatttgatcttactgctcccaaaagttacttcatctgaaacttagcatgcaatctgacatttgttatcatgttaattgtagtgctcatggggaaacaagccaactccaccaggtacagcctcaaacccacttcccccacctgccccagctccagttcctggtctatctgcagctgatctcctaaactatgagaggcaattggcacttagcaagatggcaagtgtgaatgcgttaatgcatcaacagggtcaacaccctctaaggcaggctcatggaataaatgccgctggagcaactgcagccatgtatgatggtggctttcagaatgtagccgccgcacagcaactcatgtactatcagtaataaacctcagttcgtggcgccgatctcaagtttcaatctctttgctttttctcttttttttttgtttgtctagaacttgtttgtgtgtgtctgtttgtctctcacttaagttatctatataaagttttatctgcagttgtatgattagttatgtattcccatggattgtaagacaagcgaattacattcaataaaagggatttggatatccattctatgtgattttacatgaacataaacagacaacaaagaaaaaaacattgcggaaggatcagtcagtctctaaccgagcaatgtacgtatcatagaactttccagctttctcgagatctcccagctcggtataacagtctgcaatagctccatatgcttcagtgattccagaatcttcactttccctctttgagatggctagaaccatggagtgatactgtatggcttccctatacttcccttggcgctgcagcgaggcgcctaggcctcttgcagccttcttttcttcggtggggtctttgagactctgggcaagttccaaagctatcttgaactctgtataagctttctctggttcttggttcctaagaaaggtttttcctgttttcaacttggaaatcaactcttgtttctttggttccacaatgatttcactatctgggattcttgctcccactggagcataactcaagcttggtgcataagactcgattttggcttgtctcctaagagctgcgttaatctgtcgtagttgttcattcaacctctgtaactcccctttcctctgccgagcaagcaaccctgatttggtacaccacaaaaaaagtgttgtcaaaaccccaatgagtacagttcatagaagcatagattgaagaaaagactagtcactacctccaacggtggctccaataagagcaacaagcaacaaaataggcatgctgaacatggagctctcaggctcacatatctcagcagccaaagcttcaagaggtgtagccatctgaagggagtttgtcaacaacactgccatcaccggtaatttgagcctcccaattccctgccacatccatatctaaaagcttactatcactaagaaaaaacttgacaacaaaaaataaaccgagtcaaacaatataatgtgttttagctggatatagctagacatcccggaattcatcaccaaactacctcaaaagctgaaaacttgtcaagagatcccacactggcaaatggcgtttgtaagattccctttccttgtcgctccttaggctgtgaagacgaatgtataattttggagaaaggaggatgatccccaggttttctgactactgagtagccaatagatgtagcaaattttccaatctctgagaaaacgttatggagaaagatgacttcagaagcgacaaagaattggctaatgttattgaaatgaaccaacaaactattgatgcctcaaacaatttcgatctagaagttctgatgcctcattaccaaaagaggatcactcatatagcaacagtgactctgaattggaaatctgattcagcgaatgagctatgagctatgagctaacctggagctcgagacttgtcacgcggcggtggttggccaccggaagtatgagagaaggaggagcaacaccggataagcgccgccatcactaaagaaagctctctgagaggataaaacaaacgctttgggaagcttaaaactcgtttccgctggtctgttttttatgaaacttgtacaagactgcccctgtttttctatttaattacagttaaacccttttttactaagcttcaaagatgaaacgcagcgtttaaggagcttttgcttaaactctggtggcgactgttctgtgtcgtcgtcgctgtctttgtctcagcggagtcttctactggagcggaggattttaaaagggttttagatttttgacgactacaaaaccctaatcgagctcaacttgagcattgccgcgctcttctgctattctaagatttgatatttctgcataccacttggggttagctttcgttggtgaagaa

SEQ ID NO: 9162 - DNA, 3000 bp, Unknown
  misc_feature (1)..( 3000): cDNA_ID_1033146_gDNA_ID_1972015_Annot_ID_177879 3000 nt of promoter + ATG
ttttgctttggcagtggccatcgatggaagtcgtgatcctaaagccgtcgctgagcgataaacagtgctgaggattcgggtgtgttcgatttgatttctcagatcatttagccaagcagatgctgttacctgatgaaaaggtggaagggaagaataaatagtttatctcaagaaaacacaacagacgttttcccaagtatataaatgaagcatagaatttgggtctaggaagctaacctcagcacgtaagtcatctacagctgcagcagaaaatgtaggcaccagatcagctccgtttatgacagatacgatgaagtcattcccagagtcggctaattcccaagtcatacaagcagctgaagaaaataggtaggaacaagcactaagtcttgtatcttaagaagatataaacatatataattgaaaactagattgtatgaaaaacctggcgcaaatgtaacacatgtagctgtagagagcattttctgctcccgcataatatatgttaaaagtgcagccgttccaccacccaaagagtgccctacgatctgccaacaaaatgcaggagaattacaatgtatagggctagagacaatctttggtttctcacacaatgggttttaggaaaagttgaaataaagattagagaacgggctacaaaagtaccttgattttgtaatctggatattgctcaagacccttgagaagacaaggggtggcaagtttagctatacaccgggcagcagcaaccataccacaatgagcataacctaagaccaaattgctgacccctctttcatttacaacagtatgatggaacggtacgattgctccagttgcagcagtcaaggtatctttgatgctatgcgttccacgaatcaataacagaaaatattttgtattgtgatcgacaagaaccgtaaaagctggcttcaatatctacatggtgcaaaattcaaaactaaacttctcaatttctatgttgaaaaagtgcctaagagttgagagttgttaaagtttaccccagctttgggttcatgaataaggacattttcctttgtaaagccggtctcttctaagaaaaacggaaacgacttcttggaaaaatgccaacacaatgtcaacaagtgcaaaagatatttgagttcagtggctacttctgatcctctaagttctacactatctttaccaccaaagacacgatcaacatgtagaagtccctacggttttaggtacacaattacaaaaagttcaattttgaccacaagataattagaaaaaaatccagaacttaagaccgttaaaacgatgaagagatgttatacctgcctcttgatgagaaaattgatcccaaacgcaagatcaccaataggccacttcccaagagtctcagagtaagtaaaacgaagagtctcagaaagagtagaaatagtctccaaccaagttgccggagcttgaataagcctatgcgaaacacggtcaatcctcaaagaaggacgagaagcagaagcttcagaattctcatcgtcaacgtcagatggaccagctattaatttccgattcaacgtgtaatataaaagagcagctgctccagctgctgttgccatagttgcagttgccatgatcaatctatccctaaaatcatcaatgaaacaaattcgctcaatccaagacgaaactcaatctaataagaatacaaaatttaaagacaaaatcgattgaaactacattggatgccacaatttcaatctccagatgcgttcttaagtatctcagacttattccagaaatctccaaaaacatgtaaagctggaaaattggatataatttcgtacaaagaacattcttttcaccaattaaccccaaagaattcgggatacaaaaaaaagaagccattaatagaaaactctcactttcctgaaacttctcgaataccacaacaaaccctactcctgataactatcgcgtcttttaaccgatgcaaatcataaaattgaatgtgatttagcttaaaattgaacaggatcggtgaactatagaaacaaaaccctaaatcctaccccaagaatagcatcgttaaaacacgaagttctttgtgaatcaaacctggaaaaataagacgaaatcgtgaccttaatttgagggttttacagtggagaaggaaggttaaggttgctttagcttatgtacgatatctccgggaaggggaagctgctttctctccgatgatgttgttagctacaagatgctgcaatgcaaaagtgtgaaaacagaattttttgttttgctttaaataaactgcgctacgtttttgtgctaagcgaacgccgcgtagtttcgcgccgccgagatctgatgcttacgtgggaatatattattggatgacttacccataaaagcgttttaacataaatcaagcagtaaataataatagtgttaaatcgacttttttggtccataaattaaaatttattcgaaacagatattttattagcttggaagattagtctcatttatttaagaaacattcagtcacaataattattaggaaatttaacattaaattggaaagtgcttaaagtattaaagtacaacgtcttatctatcgagttaagaaatcgtggacattgcttgaaaataataaaaaagggacagtggacggatttgctcgctagttttctcttcgaattttccacaaacaaattttctcagccaaagttcgatcggatctgggttttatatttttttgaagaacccgtgtccgtcttcgatcaggtgtcgaaagtctcaatcttttttaatcactttatcaatttaaaccctttggtcaaaaccctaatttagatttctctttccgtcttcactttttttttttcctgtcaaagttcgcgttcaatagccaaatcttatctcttcagctggaatctgacgaacattattatcatcggtagtgttctatagaaagaccgaaagttttcttcaatttcaaagtcagtggcg

SEQ ID NO: 9163 - DNA, 3000 bp, Unknown
  misc_feature (1)..( 3000): cDNA_ID_2180674_gDNA_ID_1972015_Annot_ID_177880 3000 nt of promoter + ATG
atgtctctttaccatcctctgcacaatcaaacgaccaatatggctttgttaacttaaagtttttcatattactcagggaaaatcaatgtaggttcgtaaattccatttgaggagaaggagaaaaaaacataagaatttgcacagtaatagaaagacaacctgatgagccagttgtaagttccacaacactttttccatcagaactgagcttatcatcaccagaagtagcgcccttcgtggcccagttgcatctgatttgtctgctacttaaccacttacctgagaagatgtgatagaaacaaagattaattgctaagaataaagagaaaacctcaattttagatgacactgaaacagaagttatgcaactttcagcagctcttgactaacaaatcaagaaaactttcagcaggtctttctaggcacagtatcattcagttgcatgcaaattctaagcacttcagaacaagaaagcatgagaacgaagtactgagatctcagctactatataatccttaccattcatctcattaatggcagtttgagcatcctgcaaatgaaatcaacatttaacattaatgtaaaccacgaacaatccttgagctaaaacaaaaactcactgcatgatttaaagaatgtacattacctgttgattgcggaaggaaacaaacccaaagcctctcgagcgcccagttttttggtcccacataactctcgcatcccttcaaaatattagacacagtcagagattatgatatttgttttacaaccaagtagaataagttagttaaaaggagctgatcaagcaacagaacttacgaacaactggaaaagacagaaaagctttgatataatgttgcatcagtgacctctggactgagatctccaacaaaaatgttgaaatgacctgcaactcatggaaactaaaacattgagtatcctcaaaaacatacaaacaaaatgcaacacttaaaaaaagtcaaaacttacttgatgtatcttccctctgaccagtggcatacgcccaattgactttgataggctgtccaaacctgtaaactcgacgattataacctaaacaaaagcattcgaacgataagaagaggagaggaaggaaactatgaaaattgttccttacagatgccttccgttcagagacagtatagccagagcagcggatcttcgatcaaagtagtgaacaaatccatatgatgactgcaaataaataaaaagatgcatgctttatgagtccatttttagtaagcagcaagtagagtagtttccttaaagtattaaaaatgtgcaattgttgaggtatgctcgtccaaaacaagaaagctactatataagagggtcactttcacaataaagtagaaatcaggtggattttagaatctaactaccttatcctttctgatgagtttactgctttcaacagggccagtgcttgtaaaaatctcttgaagcaaaggctctgtgacctgtgtatggatgtttccaacatacctgccaatattagaataattggagaagttaaaacataaactcggaactgcacctttcagacaaagcgatgctaaaaaaattcactcacacgctacggcaagtactgggatcaaaaccaggaggaaggtttccacttggaacaggctctaactgcaattgccaaaagtaagaaagaaagaaaatgaaaaggattgcaatttcttttctatccccattagaaaagcacgagaaggtaaatatcagctcaatttggtaatgacgcaacaaaactaaaacacaaagacatcacaacagataaaaggaacgaattgctagcctacaggatctggaaaccctagccatccattcaatcaaatgagaaaaagaaacacagaatatgaacaaaaattatcttcaaatgaagaacacaaactaaacccgacccggaataaaaggactcacgaaagagacgacagtacaaaaaaaaaaaaatccaatttcgaccaaaattagacacatcgaagatgtaataaaggtaaaataaaaacctgaggaggagccaaaacaccaggatggtaaagagagtgttgctgcatcagagcttgttgctgcatcatagcttgttgttgttgttgctgctgatgttgcttcagtctcggattctgcattttttttccccactgataaaaagaaagaaagatatctctgtttgtttctcctagacaatttttgattttcctccgctagggttcaggtactatatcgttcacgagatgaagaaagaaaaaaaaaaaaactaacaaaaaaaaaagaaagaaaataaaaaaagaaaaaggtagaaagagaaaaaaaaaatcagagaggaaagagaaagaagctgtccgtagaagatgagagggaccgtgcggcacaagtgaactatttatagcacgatttattttattgctaattttcagagaacaagtcaggtgaaactaacgtcacggcactgtgacaaccatttttagtgactgccaataatactccttgtccgttccttatcttactgacagcccagtcttaggcccaagcccatatctaaagacgacgtcgtttatcctgcagatatcaaaggaggaccagtatttctgactaacttgttctgtggacccaagcgtgtatattggattagtccggtctttgtgactgattagatgaatttatttaaggactcaaataaaatgaggattatttttttgtgtgaaagagaaacaaattgagaactgaaaaagaaaattgtattattatgatcttgtatgtgagatatatcaaattttcaatttattgttaagttaacctaattgttcaaacaattcaataaccttaaatattcatgactacaacttgtattatctcctttacttaatcggctcgattaaaatcaagtatggtccaccaaccacatctcattatgaggtttgacaatctacatttattttctcgactattcaaaaatatacaaaaaaaaaaaacatg

SEQ ID NO: 9164 - DNA, 3000 bp, Unknown
  misc_feature (1)..( 3000): cDNA_ID_2180847_gDNA_ID_1972016_Annot_ID_177911 3000 nt of promoter + ATG
ggagaacgtgggagccttccatctcaacaagcttcatcttgtgtccttggatcctgaagttaagagtggatttgaatccaacattgcagatcctgtacttgtaagtctttccgggcttcatggtgaagagaggagcgttgtttccgcctagtttaccagatttcccattgatgagaacaccgtcgggggatcctagagtacgtccgctgtcaaggaagttcttgagggcggtgtggctcttggcgtaccagtcgttgatgaggatggtgcggtcgtcttcggggtcagcgtatgggactgggatgaggagacggctgttgacacggaggccaccgaaaccaccggcgaagcggtggagagcggtggatgggtagtagaagtagctaccgatctggtccttaggctggaaatggtaagtgaagttggtgcctgctgggattgggcatgaggtcccagtcacaccatcttgccatgagttcttcctgtgctggagtccactcctgccatgtcacccaaaaccattgtcaggactaagtattcaaagatacaatgaagactagttatatataggtgtggccatataaccgaatctaatgcaaagcaaatctttaaaaatcttttaaaaaatgtgattgcaaaagtctaactccaaatgcaaatggttgatacaaaaaaaaagatttgttttcaaaaacaacaattttaatgtaaaacaaaaatcacgaaaacaattgaatgacaagttctgacgaaaggaataagtttacagattagttacaaaccaggtcaagaggaaaggctcgtcgaggttgttgaagacattgatgacgacattgttgttggaggttgagtttaggttaggaccagggaactgtccgttgatgagaatcacctgttgaggaattccgagaggcgcggcggttccgtaggttacgttccacgtgtagtagaagtaagggtcaccggcgctcaccaacgccaccgtggaggcgaggcacaccaacaccgtcaaaagcctaccaccctgcattatctcttttctgcttctttttatttttttttattaataaattaaccctttcctatataaaaatatataattattttttctcaaaagcaagaagaaactatgttctcttgctcttgacgaatcttttggtgatgttgtgaatacctatttatgcaggtgaaggaccttggtatgcacggaattgttgcctcttttcacgctgcacctctaattctctttacgtgaaatttctatttttgaatctctctcgctcgctggtccttaggactcccgatttctctaacgagcacacaactcggatcttattctattattggacatgtctctaaagaagccaaattaactacccacaagtgtcatcatcaagtaattttgtttgtcttaacatatttcagctacggttgattattacacggacaaaaaataatattatggtacaacttagtaagtaactacagaattaattaccaacttaatatgctttgtaattttaattttaagaacttccatgtttttgataataaaatttcaaaaatgaacttgcatgttattcaatcttcttttgatcctttaaaaaaaaagttatgcagattattgaaataagataatagtctgcccaaaaaaataaaaaaataaaaataaaaaaaaaagataatagtctgcacaataaatggtaattgagatgtacatgtgtgtatatggtgttctatatataaaaataaaataaaataattttatatattagtatagatatattgtgaggtgggatgttgataaaggcctaataaatggtaattgacatcgtgggtcttatgcgacatgtttattttcttctccaaatgcttagagtttcttatatatacactacaaaaaaaaacagtttatcacttataactttaacaaaaagttacacattcaaaatatttgtatttacggcatcatgaactcttgttcatctttgtatcacaaactcttggtcaaaaggagtgtgtcacaaactcttttcgtctgaccaaagggagtgtatcacaaacttttgttcatctttgttttctaattagaaagatgaaagaacgttttggcatcaatgacataacgctagctgagaacgtatttggagaccatatgtctcttaccaaattctacacagtgcaagattttttaggtaagtaatttctaagattattgaagtagtttctcatacttaaaggttccggtgctctccgtgaatttatcgtcaacggttgactagctcgtatgattgaagaaaagggaaaagatactactcctattcctaactttaacaatattgttgtgaacaaatgctatgcatcattacctgattttcaatgtcatctaatttttcctatggttacaattagaagtcaaaagatatatagatagaaaaaatacgacatatcgaattattttctggtatatattatataaaaagacataatcatccaaattccaaaagcataatgtacaaaacaaagtgttatgattaaaataagcgattttcaaaatattttctataataatgtaaaatgtttattggtcgacctatacctttgtcacatatatatataaaattatatcctttagattattttttaatcccaaatagcaaaattctcgaagacatgaaaaccaaaaccaaaaaagacatagggaaaaaagaaaataaactaagaggaattaaagagaaacaccaaaaatagggagaggttaaacttcaatattcccaaatatggcgaaaggaatagcgaaatggtaggagaccccaaagaagacgagaaaaacctggaaaaacattcgtcaaaaataaccctataaaaatgcctcgaaacatttccacaactcgaaattcaaaccccaaagcataattatatataacaataaacaattagtaccaaaacacataaaaaatctataactgttatctcaaccaaaaattgtttattgttatg

SEQ ID NO: 9165 - DNA, 3000 bp, Unknown
  misc_feature (1)..( 3000): cDNA_ID_3044889_gDNA_ID_1972016_Annot_ID_177924 3000 nt of promoter + ATG
gtatccttactcgccagcaactagccctgctccacagcttggcggggaagggcagttgtacggtgctcagcagtatcagtatcctaactattttccaaacagtggaccgtatgcttcatctgtggctacacctacccagccggatctctctgcaaacaaacctgctggtgtgaagacactacctgcggatagcaataatgttgcttctgctgctggtatcacaaaaggaagtaatggatcagctccagtgaaaccaactaaccaggctacccttaacacctcaagtaatttgtatggtatgggtgctccaggaggaggtttggctgctggttatcaggaccccaggtatgcctatgaagggtattatgctcctgtgccgtggcacgatggctctaagtactctgatgtgcagagacctgtttctggtagtggagttgcatcctcctattctaagtctagcacagtaccttcatcgaggaatcaaaactaccgctcaaattctcactacacggtatgatgtctttccaaacttctttttgctaatgaacaccattgtctgctttactggcatatatatatagccgctcaagtcttccaaatttgttaactgaccttcaatcaacttttttctttgcagagcgtgcaccagccttcatcagtgactggctatggtacagctcaggggtactacaacaggatgtatcagaacaagttatatggtcagtatggtagcacagggagatctgctttgggttatggttcatctgggtatgattcaagaacaaatggaagaggatgggcggccacagacaacaaatacagaagctggggcaggggtaacagttactattacggaaatgagaacaatgtagatggtttgaatgaacttaacaggggacctagagctaagggcacaaagaaccagaagggaaatctagatgatagcttagaggttaaggagcagactggagaatcaaatgtaactgaggttggggaggcggataacacatgtgttgttcctgacagagaacagtacaataaagaagatttcccagtggattatgcaaatgccatgttctttatcatcaagtcatacagtgaagatgatgtgcacaagagcattaaatataatgtttgggctagcacaccaaatggaaacaagaagcttgctgcagcataccaggaagctcaacagaaagctggcggctgtcccatctttctgtttttctcggtgtgtatataatcctgaaattaaaaactgtgctctttttactttgttttatgatattgttctttatactccagtttttgtctttcaggtcaatgcaagtggacaatttgttggtcttgctgaaatgacaggaccagttgatttcaacacaaatgtggagtactggcagcaagataagtggaccggctctttccccctcaagtggcatattgtgaaggatgtgccaaacagtttactgaagcatattactttagagaacaatgagaacaaacctgttaccaacagcagagacacacaagaggtaaatatttgtgacatcttttggcttgttttactgattactccacgagcgtttttgttttcttgtgcctaactttctttgtttggatcatattaggttaagttggagcaaggtttgaagattgtgaaaattttcaaggagcatagcagcaagacttgcattttggatgatttctcattctacgaggttcgacagaagactatcttggagaagaaagccaagcaaacccagaaacaggtaagaactagaaaacaatttcagaaatctttttcattcagtatatatataacttgagtgtttctaatgtattaaagcttaacaggtaagcgaggagaaggtaaccgatgaaaagaaggaatctgcaactgcagagtcagcgagcaaggaatctcctgcagctgttcaaacgtccagtgatgttaaggttgctgagaatgggtctgttgctaaaccagtcacaggcgatgtggtggcaaatggttgctaactaagaggatggtgtcgctcacggcatgggcataaaactgactagagatgaagatatgaacaatcccgtttaacgtttctcttgagaagaagattgccgtgagccttgaagcatggaaggagctttagtacctgagacggatccgtttctttgcccttagaagtttaaatcccagttatttttttttcaatcttttcttgttttcatttttccttttcttcaaaatcgcagtctcgttacaagtttatgttgggtttctttttcattttctgttgttcctaccctgtaaaaatgcgcataggacctactaaatcgtgggaagaattagagaaaaggagataaaagcagggtgggattttgttttttcatgtctgttggatttttaggcagagttttcttttcttttggtttcttgctttggtttcagacttgactctcttgagtcgtttagaatttgagatggtcttttgcctctctcgtcttgtttctgtcattctccaaagttatctgaatcaatccatgttttaagattttcaaagcaaggagataagtattgttgatttttttcgtgtaacaaaacaaaacgaccttgatctcataattttgttgctgtcaccaataattgtcaaagaagccgagagaacctaactttagtcagctctccatttcaccattccaatgtatgatgtgtcgttttgatctatcttgccgaaattgctgatgtggttaaaatcccaataataaatgaagctgatcaaataagtacttgttgtctgatctgacgtggctagatagcttctccaacgctttatctcggaaactccgtgacaaaagatagtactttcatgtctgttttggtttcatccaaaagtatcaaatttgtgtgatcttctccagaagaaacttgaggaactttaagctaaacctctgtagttttcagattgattcgttggtggaaagcgtctaaattttgcgtaaatg

SEQ ID NO: 9166 - DNA, 3000 bp, Unknown
  misc_feature (1)..( 3000): cDNA_ID_3044885_gDNA_ID_1972016_Annot_ID_177926 3000 nt of promoter + ATG
gttaacaaatttggaagacttgagcggctatatatatatgccagtaaagcagacaatggtgttcattagcaaaaagaagtttggaaagacatcataccgtgtagtgagaatttgagcggtagttttgattcctcgatgaaggtactgtgctagacttagaataggaggatgcaactccactaccagaaacaggtctctgcacatcagagtacttagagccatcgtgccacggcacaggagcataatacccttcataggcatacctggggtcctgataaccagcagccaaacctcctcctggagcacccataccatacaaattacttgaggtgttaagggtagcctggttagttggtttcactggagctgatccattacttccttttgtgataccagcagcagaagcaacattattgctatccgcaggtagtgtcttcacaccagcaggtttgtttgcagagagatccggctgggtaggtgtagccacagatgaagcatacggtccactgtttggaaaatagttaggatactgatactgctgagcaccgtacaactgcccttccccgccaagctgtggagcagggctagttgctggcgagtaaggatacgctgcatacccataaccctgaggatacacaacagtcccattctctccataaattccctggtaaaatattgaacctgttaagcaaagaaaatataaagacgatgaaaggcactattataactagtcagcacacacttacagaattcatgtcaacaccctcaggatttgtgtaagctgggtagtcagtccactcttgaccactcccatatactgaaaagttacaaaacgaaaaacttgttaaaccagtggtgacaatttagtgaaataatgtttctagattgtaaatgatttgaggatgaagctaccattgtaatactggtagggattgtaaggattaggaacatagcaaactgaagggtcagcagcatcactgggaagcattggtgtcaaagatcgatcataagaaggaacttgaccatgaacatcaacgcctccatactggtagacggcagtctacacaagacacaaaacaaaagcgttaaaaaaaactggaagaagcaaaagttgtgacaacagaaaaccaaaattcaatctgcaaatcaccttcttgttaggctcagggatctctgaagcttttgctggcgagtccaaggatagtttctgcaacagatctgtagcttctacaaacaaggtgagtcaaggaagcaaagaattacacaattaaccattagaatagtggaaagcaaacattctcaaatcaatcaaactcgccacaaatgaatcgatttgaatcaatatagaaacctaacaatcgagaaatatattgagaaacccgaaactgaatctaggcaatatcaaatatatctgaacaagactcaaaatcagctcactggattcaagatccaacagattcaagatcgagaaatcaaaacacagatcgagaaacataaagaaaggatacgatcagcaggaggagcaacggtagccatgagaggagattcgacaaacaaagatttggatagatccttctcggataaaaggggatgcgaccaaagagaaagaagaagaagaagaaaaaaaagaagatagagaaaccctaaatggaatcaggaaaaacccagatcaaatctagggtttaagagatagaatagaagagagaaagaagaaaaaaatggccgcagccgccaagaaggagaagggttttgcttcggggaagaggaaaaaaagggttttgtctctctacctctccctctgattcaaatagatccactaatcaaccacctcaccttctctcttttttttttctttctttttttttttttttcttccaccttaagatatttcctcttttgttttaaaagaagactatagaccgtgtggttttggttatttttcctgcaaaatctggataatatacttttccattttcttaaaattggtaatcttgtaataaaatagatataaatctcaattctgttaccaaaatataattcaaaagtaaatttggtcaaatttaaaagcaaaagagggcatgctttctattataggtgtgtttcttctataaatttaccccaatatacattgaaatatctttaaaaatatatattaaacttttttgttttgagcaactatttaaaaactaaaagcaaatcattaagataaaaccaaagaaagtaaaatctatttttcagagaaacttaccaaaactagctattcaagaaaatatactttacctttaggataaaaggaagtaaattaccttagcttaaaaaagctattattaaataaaaacattttaagatcgagagtatgtaatgggcctatttgattaaagattcataaacaggcccaaatcaccaaacaaggccaccggaaataaacccatgatccgattacccatccgacgttctagagagttctaatgagaaaacaatgaagagtacatccaacggctaagattagctcgaagtttcaagagctaaaggctcatatcgcctttatattcaaagaaaaaattatcagtagcaagtgcattcttcatttcgtcattggagaaacctacttcttcctccttatccggaataaacctcttcggcgccatctctctcctcacctccgtcgttccaccgtccggtgagtgtcacttttcccatcaattgagctcacaatgttggcgcctatgtaattgtgtgtgtcgattgattgttttgttagaattggaattaacaagtattactagtagctgagaaaaagtatgttaccttgttttcgtgttcccggagatttgtggctattggtgtagttgtggttttgagtatttggggattgagctctgattttgaaattcatctgttttttgttttttgttgccagttttaattggttagtacttttggtgaatctttcgttttatgtgaactgttggattgattttcagtgtttgagaagtgaaa

SEQ ID NO: 9167 - DNA, 3000 bp, Unknown
  misc_feature (1)..( 3000): cDNA_ID_2180910_gDNA_ID_1972016_Annot_ID_177932 3000 nt of promoter + ATG
taagtaacgaattctagagggagaacgcacggacgagagactgtgatgaagtaagcatatatatacataaaactgtgttaaacaataaatctgcatgcataggtaaaaaactatatcttcgaccaacattggtcttactataagatacgtaaatgtgaactacgcaacaaactttgattttcgaacttatagtatatcctcatcgataaaaagaacctataagtttcaacttatatatacaactcatgaattgtgtctgaaatacttaaaacaaacatttttgagttttaatttagtattacatgaaaatagagttttataacctcaactcgtgtggtgacgcaaacacataataaacctataggcaacatatatgttttttttttcaaacaacatatatgttattatcgtactttagtatgtaaactgtccggaatatgtttaatagcttataaagtttagtgtatttttgttttcaaggatatgaagtttaacgttagcacttagctagcctgtattgtttacattaaataaacttcttgaagaaattaaacttagaaacatatctagtaccataatttaagattgtgaacatgcttattagttatctgtatttgacaaaagcttaccacgagtcttatttaacgatagtgatgattcatttattcgcaatagatatatccatatatataaatagaggtttgtgtactcagttacactcacaatttatggttttataataatcacacaaatcaccacaaaacaacttagtacacatatatgccaaccttctagatcgcatctgtgaccccttcttgaagcatggtagatatagaagacatcaagattcgatcaactatatatcttcctgtatctagtcatgtcctaagctagaagacgacgctccaacaatcccatccttacaatcatccatctgcaaaggttgagatattgggataatattaccaaaaggatcaccaacatcgttgatgagcgaattaagaaacgatgagaacttgtcgtcgtagcagaaaccaaagtcttcgtagccgtgttcaccaccaaagacattgatactgttcttgctatctccatccccgccattaacagtggtatcatcagtatgagaactagaaataggctctagagggtacttttgtccaccggaaacttcttcttctggtttatggatgttgtttgcatcaagaggcttgtgggtttgaggatcaattccttgccttaaaagtttcttacgaagatgagtgttccaatagttcttaatttcattatcagtccttcccggtatccttcccgcgatcaatgaccacctgcatcacacattagaatttccatgaagaacaagagcggttaattactaatatggttacaaaacaagcttgcatttttatcctagtaatcataaacaatttgaaaaaagaatgaatgatctctagaactattaatttgctctagaaccagaatcaacttaattaaaattatactctaaagaaactagagaagggattaaccttttgttctatataaatatcgaatcaagaatcaaagtataattgttttatatagctataagaaaaaatgggatcaagctaaaatcagaaccttcatgtttatgtggaagaaataaaaccctagctagcttaaacaaaaaaataactctagtgtatgggtagagagagacacacacatacgtatgcatataaactaaacgatcttgtatagttgaatacttgacgagatttttttttaatatctatatatatacctgttgccgaggaggcggtgaagacggaggatgagatcttcctcgtccgacgtaattcctccacgtttaaccgagggtcggagatagttcatccaccgtagacgacagctctttccacatctgagtaaaccagctctcttaggaagcgatcgccaccgtccttcaccttctttcttaatgaagctcacaagaatctcgtcttcctccaccgtccatggtcctctcttcatccccatcttcgtgcaacacggcgttgttttcttagacactggcttcttcccaccacatgacatcatctccgccgtcttcaacaaagctttctctctttccactagggtttcgtgatctctatgagttcttcgattggttgtttttttcttttctcaaagtttctctctctccattagtctgctgatgttaccaatgaacctaccgaccttttctctcacgcgctagcttcggcgtttggtaataatcttcatttggtttttatttcacctgcgtggtttttttttcctttcattttaaagattttgcagtaacaatcatattgaaatccaaatggctaatgttattacaatgcataggttagttgcttctagttatttatattaaagatttgatactactatgaattataatttgattggctataaacatccgattataccagctcctacaattgagaaagttataacaaaatggttgataatacattaatgaatactaaccaccttaattaaaattgacaccagtgaaaaagcattaaatatttggaccaccttttaaatagatgattaatcagtaattggacaaaatgctagtatttttacaaatcgggaaataaaggggtgaaatcgtaaataaataaaaagtatgggccacataataaagaagaatacaggcgcatgagaaattaacataattacctctcctttattacagttagtcaatttctaacccaaaacttttgttttgttctttcctttttcttaattttgattttattaaaatttggtcatgtattttcactactgtaatagagctggcatctctgatctttcaactccaccaatctcgaaatcttttctttcaattttctcaaaaaattaaaaccctaattcttattggattctgtttccttgaggagcaattgtgttctgttcgctgcattttttttgttctgctgacggaggaagaagaaacgagaagagatg

SEQ ID NO: 9168 - DNA, 2073 bp, Unknown
  misc_feature (1)..( 2073): cDNA_ID_2180918_gDNA_ID_1972016_Annot_ID_177935 3000 nt of promoter + ATG
ctcatctaacattgttatggtgaaaaagatggtcctattatgggagctttttgacgtaaggctccttttgttttgaatcggcatttgaacactttccagctattttcttctgctttctttttccaaaaagcatctaagaaaaaaaaaactttgtttctttctttcaaacaaaatgccaagattaacggtttcttactttttagttttttctcttaacattggaagttttattccaaaatccaaaccctgagacaagtcaagttattaattacaagtggtcatatggtatatgagtgttactaacgattctgttcttttagccagaaattttttcttctgttgacttgtctgagtctctcgatccgacaaaagtcttggtcgtcgcaggtttttgaattttcagttttcccgtagagcacttaagcttggatcgaaatgcacggcgataatgtcgataatcaattctttcttcgttttggagaaatttggaaacaattgtttgctattttaatgatcccataaaataaatatatacgaaaacttaattaggcaattctaaaagactatcaatttccgaataatggtgaatatatatatttctgaatcatttttaacggtgatgaaagaaactgccaaatcaagaacaatttgagcatgcaagaaacatttccaagaaaacatttgggagtcatgcacatgaaattagcaaactcacgaatctttcttttgattcaagattatatttaaataaaaattggtataaaacgaaagaaaatgagaagagcgtggtaatcgagcctcttacaatcttgttttcttgtttatttgttaatttagtattcttttattatgaaggtggaatattgccgtattattagttgttaacggactttaaaatatttgttaatatttttgaactgttttatttgattttcttaaaaagtataatgcaaaacttagttgtatttgatgttttgtgagctatagtatatgccatgtcttttactattggccaaattatatgtagttaaatgatgttttcatttcctttttgtttttgggtttggatgacaagttgagctaattaataattagtgtgacacattgaggtaattaataatttatttagagcttctttgaactttgaagcctcccctcaccttctattccacaaacacacctctctggtttcccacgcattatatataaggaaagatgaaaccaaagtttactgagagcaaatcaatctcttaatttgtttttgttttttcttttccatttcctttcaatttcgacaaataatattcgccgaaagacaagaaaaaaaagtgtttactttttgggttcctcttcggtgggttcactacactagtaacatctctgaacctgttctctgtctctcagcagcaaaacctcgaggcttctttttctttcattctctcaatttcttctctctgatctgaattctcgccgagtgaatctagaaccaggcaagctccaattaggtacttttgtatataatttcttgattttgcatctgggtgtttcattgtctcacattgctgtcttcgctagcttttcattgtatcttccacattcttccttgctctgcaaatccagtttctagagcacatgtctgaaagaacgaaaacgacaaaagagttaaagattaaaaattgtgtcttttcgaatgctcgatgagtttgtttactgtttctccccttctgttctcagaacgttgcttagtttccagaccccattagtttacttctgtcggaaatcctctgttttcttaatagccatgagatagttatctaaaattgctttcttgaattcaccaaaaaaaaaagttgcttacttatttttagggttcttaccatatttgaccaattataactctcctgaaaagattaaaaaaaaacaacagttttttctgacttcagagtgagaaatctacaatccattgttatattaggtttcaaatttctgttaaaatcattagcatatggctcaattttgaaccttttcagagtttttgtaggtttaaggttttcaagcactctgtttccaatg

SEQ ID NO: 9169 - DNA, 3000 bp, Unknown
  misc_feature (1)..( 3000): cDNA_ID_30436_gDNA_ID_1972016_Annot_ID_177933 3000 nt of promoter
ttaagatgggatatataatacattttgtaatattcttccaaaaaataaagttaaatacataggttctcacttgatggtgccactatgccgaagtgatgactgcaaagctcgtctagagtttcgtatccaagggtgagagagcagtgtctttgcatcaggcctctgcctggaatcctgtaaaacacaagatacaaatcagatgtacatactggatattaaataaatcattgtctaggttctggtacagaggtaggtgaataaaccctatagcagaaaattataccttcttgaagcactgtcgtagaaagtccgtaatatctggagaaagactatcaggaataggagggttgtcatcctgaaacgaaaccataagaaatagtttgtcacttctggctaacagcttttgcatttttcaggagagaagtgtttacgacatggagaaggggacggaagagacacctaaatttgattgacttaaatgcaaactcataaaatgttgtcaaatacctgaacaatacgaaagagggctggcatgggttgcagatcatagtaaggaggtacacatgtcagaagttcgataacagtgcatccaacgctccaaatgtcagaagcagcacaaactcctgacatttcaataacctgaaacagaagttgggcttctgtcaatacgtacataatcaggtaaaagttctctaaaggagcaaacaaaagcatctttcaaacaacaacaaatattgtttcaaaactgcgtacgaaagctatacagaatatggagatggaaaatatataatcaaaggtgtacctcaggagccatccagtaaggagttccaaccaccgagtgagtattaacatcagcctcgttaagtttagtggcaactccaaagtcagcaagcttcacaagaccctgaagtgtgatgtagtcaagtatctttctaaggaaaaagcctagaagaatcttatccagcagatctcaaaacaaaaacacactgaagacatgtctgagaatagataatatagaaaacacacctcctttgtcgtcaaaatatttgcacccttaatatcacggtgtataacaccctgctcatgcagatataccaaaccttccaagacctgtattcactagttagtacacaatgcataacgaaacttaactcaacttgaaagatgtatacagacctgagcaatgtaaacagccaccaaagattctgggaaaggtccaaatttatttggtttaataatgtttgcaagagagccattctcaacgtacctgcaaacacataattgaacttgagtttcccgtccatagtccagagtggaccaaaataaacaaaaaaagctacttactccaaaataatgtgaaggtgagtctttgtcttcgacgacccaagatacttcacaatgtttttatggttcaagttctgcaatgaaatattatctcagaatacatagagaagaactgcatcttaaccagcatcataaccattcatgagaagaagccaaaattcagaaggtgattgatttgacataaacttagtatcaggatcccaactctgtaaacagtacaaaattcagaaaactaccttcaaaagatcaatttcttgctggagaaattcatcccaacagcacaagaatcatccacatgtaaaaaccaggattagtcagcatagcagtggtaaggaacaaataaggaagatagatataaggaaaataacaaaccataatggtgttaagatcctcttgaacaatattttccaaagagacttgtttaatggccacaaagtcaccattctccaagtctaatcctttataaactcgaccataagctcctttaccaatttcatctcccagcatctaccctcaacatatcaaggatcaaccattgaaattaatcaaaattgaagagaaaacagcaaaaagcaccagacttaagcttaaaatcaataaaattactaaagctaaaatcttaaggagacccattagaaaacccaaatcccagaaattacggagaagaagaaagctcacatatttgttgtcgagagtctttgatttgtgaaactgagatgacgtcatttgccgcgccatctcttctcgtttcttcttcctccgtcagcagaacaaaaaaaatgcagcgaacagaacacaattgctcctcaaggaaacagaatccaataagaattagggttttaattttttgagaaaattgaaagaaaagatttcgagattggtggagttgaaagatcagagatgccagctctattacagtagtgaaaatacatgaccaaattttaataaaatcaaaattaagaaaaaggaaagaacaaaacaaaagttttgggttagaaattgactaactgtaataaaggagaggtaattatgttaatttctcatgcgcctgtattcttctttattatgtggcccatactttttatttatttacgatttcacccctttatttcccgatttgtaaaaatactagcattttgtccaattactgattaatcatctatttaaaaggtggtccaaatatttaatgctttttcactggtgtcaattttaattaaggtggttagtattcattaatgtattatcaaccattttgttataactttctcaattgtaggagctggtataatcggatgtttatagccaatcaaattataattcatagtagtatcaaatctttaatataaataactagaagcaactaacctatgcattgtaataacattagccatttggatttcaatatgattgttactgcaaaatctttaaaatgaaaggaaaaaaaaaccacgcaggtgaaataaaaaccaaatgaagattattaccaaacgccgaagctagcgcgtgagagaaaaggtcggtaggttcattggtaacatcagcagactaatggagagagagaaactttgagaaaagaaaaaaacaaccaatcgaagaactcatagagatcacgaaaccctagtggaaagagagaaagctttgttgaagacggcggag

SEQ ID NO: 9170 - DNA, 3000 bp, Unknown
  misc_feature (1)..( 3000): cDNA_ID_3044875_gDNA_ID_1972016_Annot_ID_177930 3000 nt of promoter + ATG
acactgggtttggtctctctatttaaaaactaaaacagccagcataagtcatgttgattttctttatagataaattctctcatatgtttttttttgtttcattggtttggatgtgtagtgaatctactgatgtcgctatagttacgttgtccatgacatatgaagaagtcagaaattggatgaaaggcctctatctatgtaatgattcaactaagaacgaataaaatgaaaaagtcacatgtgatatgtatcaccccgaagacaatatgcatacatctattcacacgatcaggtcaaggatacattagtaccgtgtctatatatataattatttatacagccattgacgaacgaatcattttgtactctccaacaatccacccaattaactcttggattagaaacgttcaaaatcacataaccaccgcgatttttatgtgacttccacatattttgaaatacttaagaattttggtatgcacaccaagagattatgaagaagatattcctccattattcaaatttaacatttattttattcaaaacaaatttaacatttatttggtatgaatcatatcatatgtgatgtgttatcatcgtatattcataagtttgtacatgaagagggattttcaaaaagattctcattatgttaccaataatggagtaacattaaacaaaaaataatatagatgatacgataagaaaagcttgtggctccacctcctttcgtatggtcataaccatcatatcactattatcatacttacttttctccatgcctaaatttatatcgctccataaaatcaaatcttttacttgcttttctccctcctttaatcataccctatcacaacgtggctttttattgcaattatataagttttggatagcctttcactttaccgaaattccggactagtcttagcccatgtgtagtagtcgaatttagataagtcatgtagacacatattcggggatagtttcattgttctaactatatgagaaaagaaaagaaatagtgttttgcctaataaatttgattacaaagttcggttctctaacttacatcccaaaatcacaaataaagacgaatccattagaaccaaaagatagctacaccattgcaaatgcataacttctccccaaacttcctgatttaccgatttgtttctacttacatgaatgttttggagtaaaactaaagtagctctgagctaaaccgacttgaatttaaacttcaactctacaattcccgacttcggccgtaactaccggcacatacatttttacttagatttcggtgatacaccacacacacacattttgtcggcgtatccaaaaaactccaagtattatattatgttttctctctcttaatttcaaacatcttccttgtcatttgtcaatacgatgctacacgttaataattcttctcaaagacatgcccaacatgttttcataaatcatgcatgtacttccacgtaattatattagatgttaatgcgacaccgtgtgatgtaataattgcatacataatgtatgtttgcggtgttttaacatgtatatgaatctaactacgtagccttccaatgctgctaatcaccaatcatattgctatctaatttaattggttcattatttatttataagtctcttatactaataaaacgttttgatggaagttaaacttttattattgagcaactgatggaagttaaactaagaatgtcaatttatgaaaacaaagcatcactgcaaaaattgtatgaacaaaaggaccaataaatctccacaatcatttatgattttgccctaaagagatactataataattaggtagagagagagagagagaaactcggctttctttaagacaactatatgggttccaactaatttcacattggattctacgattttatgaccgttcgctagacttccatttcccattgttcttgttcatgttcagtggccataacctgacacgtgtacggtggaagatgcaacttcacgcacgtgtgtgagctttgcctaaacacagacagattacgtgcgatctctcgtgtgcgatgctactagagtagtagttactagctgtcacatatacaaaaaagcgtggctcatccatggttggctgacgtggatttaacgacggtactcaagattttaacgcctcaccgtttaagttccccattcaaagaagacaaaaacatccttgttcccaagggggaaaataacatttttgctttcatcgagaggggtaaaacagggaaatttgggagattaatgtggaagagatccccaaggttgtcttcaaaccataaacaccacgtgacagagagaccaattatactcaaaaaggtaaagaccaatttgaaaaacattacaattttaataatgctcatagactcatagttaaagattacaagaaccaactaactaattgacattatcattatcaaaataaaaaccacctaattgcgaatttatagttttacagtgggattggtaagacgtttctaatatgctttcttttcaactttagaccttcttctctcatttctcacaaagcaaatcaaaagtaaactataaattgctaatcatgcatattagtatataattaactaactaaaaaagggaatggggtggggccattggagcgagaaagtgagcaaaaaaaagagagagcctccactatctctcaaagcagaggaagagagagagagagacagagacagagacagattgagagaaagtttggattttgatatgtgtggttggatttttgttacaaggcaaaaccagacccaccttcaaacttgtccccacgaactacattatcattgttttgttcgaacttcttcttcttctcgttagggttttctttcattggctctgagctactctttattgcttaggccttagtgtgtgtgtgtgaatcttctcagcgaaagccaagttcttttctttgttggtgtttctgggtttattgcgaca

SEQ ID NO: 9171 - DNA, 3000 bp, Unknown
  misc_feature (1)..( 3000): cDNA_ID_2180882_gDNA_ID_1972016_Annot_ID_177925 3000 nt of promoter + ATG
acagccaaatgattccaaatcaggagggcacattgattgatacccacatataggttttttgttataaaaacatgacctacctccagttagaatggcaatatcgtcaaggtattggctcttgcgctctccaaatccaggagctttgagagctgcaatcttcagtgtgcctctaagcttgttaacaacaagagtagctaaggcttcttgttcaatatcttctgcaattatgaggattgggtatccgcctctaatcgcatcctctagaaccccaacaagatcccttgcattggttactttcttgtcaacaagaagcaactgcacagtagaaacttgttaggctatttgcatcacaatatcattttggtagctcagaataaagaaaaattaccttgcaattgtcatactcaacagacattttctcactgtctgtcacaaagtatggggagatataaccacggtcaaattgcattccttccacaacataaaggttgttctcagcgctttttccctcctccagggtcaccacacccttcctgcccactttgctcattgcttcagcaatcatacttccaacttcgtggttattacccgcactaacagctgccacatcagcaagttcactgtcttcaacctatatttccaatgacataacctttagaccatcttgctatagactctcgaaaaattaagaagaaggaagttttagcataatagttacttacctccttagacataagtttcagctcgttaaccaaagcctttgcagtcttctcaatccccctagtgatcaatacagggttcgcacctgcagccaccacctgaaaaatacaaaatttcagattaatatactgttcttctgagtataaaatcagagaaagctgaaagaagaatgtaacaaccttgacaccctcagcaataaaaccttgtgcaagaacaacagatgttgttgtaccgtcaccagccaagtcattggtctttgcagctgcttgccttacaagctttgcaccaatgttctcaaccgggtcctccaactcgacctaagcagaagaaaaccttaagcttagagaagtaattaaaaacgaaaggaacataattggttaaacagacaataaatttcatacctccctcgcaacagtgacaccatcattaacaattcttggggatccatacttgctctcaagaacaacatttctcccttttggtccaagtgtgacaccaacaaggtccgcgagcttgttaacaccagtctaataacaaacgagtaatcagaaaccaaaaataaaacgaatcctaatcattactccagaaaatcaattcattaattctcacctgaagtttccttatggtagtcccatccttattgaaatgcaactccttggctgcacatactatggcaggacgggatcttctgacgcacacgttatgtctccttccaaacgagcttgaagagatgctagtcgcagaagacaacttgatagcattgggagcaagcaacgaaccaagggaagacgtggcagtgaatgtcgatgccattttcacttctcaaacactgaaaatcaatccaacagttcacataaaacgaaagattcaccaaaagtactaaccaattaaaactggcaacaaaaaacaaaaaacagatgaatttcaaaatcagagctcaatccccaaatactcaaaaccacaactacaccaatagccacaaatctccgggaacacgaaaacaaggtaacatactttttctcagctactagtaatacttgttaattccaattctaacaaaacaatcaatcgacacacacaattacataggcgccaacattgtgagctcaattgatgggaaaagtgacactcaccggacggtggaacgacggaggtgaggagagagatggcgccgaagaggtttattccggataaggaggaagaagtaggtttctccaatgacgaaatgaagaatgcacttgctactgataattttttctttgaatataaaggcgatatgagcctttagctcttgaaacttcgagctaatcttagccgttggatgtactcttcattgttttctcattagaactctctagaacgtcggatgggtaatcggatcatgggtttatttccggtggccttgtttggtgatttgggcctgtttatgaatctttaatcaaataggcccattacatactctcgatcttaaaatgtttttatttaataatagcttttttaagctaaggtaatttacttccttttatcctaaaggtaaagtatattttcttgaatagctagttttggtaagtttctctgaaaaatagattttactttctttggttttatcttaatgatttgcttttagtttttaaatagttgctcaaaacaaaaaagtttaatatatatttttaaagatatttcaatgtatattggggtaaatttatagaagaaacacacctataatagaaagcatgccctcttttgcttttaaatttgaccaaatttacttttgaattatattttggtaacagaattgagatttatatctattttattacaagattaccaattttaagaaaatggaaaagtatattatccagattttgcaggaaaaataaccaaaaccacacggtctatagtcttcttttaaaacaaaagaggaaatatcttaaggtggaagaaaaaaaaaaaaaaagaaagaaaaaaaaaagagagaaggtgaggtggttgattagtggatctatttgaatcagagggagaggtagagagacaaaaccctttttttcctcttccccgaagcaaaacccttctccttcttggcggctgcggccatttttttcttctttctctcttctattctatctcttaaaccctagatttgatctgggtttttcctgattccatttagggtttctctatcttcttttttttcttcttcttcttctttctctttggtcgcatccccttttatccgagaaggatctatccaaatctttgtttgtcgaatctcctctcatg

SEQ ID NO: 9172 - DNA, 3000 bp, Unknown
  misc_feature (1)..( 3000): cDNA_ID_2180874_gDNA_ID_1972016_Annot_ID_177922 3000 nt of promoter + ATG
gcatcatttgttgtaaatatgtaataaacaactccaccgcatcaagtttttctctttatatgaccacccattaagtctttgcatagtcctaaagcttaaaaagatgaattggaagttggttttgctaattggttggattctcctctcgtctattgcatcaaacccagctttggctaaagttacttatccaactcgcacaacaagtaagtatccattacctatctcttttattttatagttgttatttgatagatattcagatcaaattcgtggatctattatctatacatatgccacgtaaaactctttgatgtatggaaaaagttgatcttgtagaattaataattgctttcgatcaataaatgataactacaaactagcaacacttttgttgtttaatttgtatagaaatatacaattgttaatttacatatacataaattcttgaaaaaaataggaaatttattttatggttaatcgaattttaaataggaaaatggcttggaaatatacacatcagcaaaggaatgaagattggctttacaggcagtttttctagacctgctcctcacggaggcggtccaccgaagatcatttctaagttatgacatgtaacgatcttaattagcgatccaatctatatataatctattaacttgtgatttctgattatttgtaaagttgtttcattgtgtgtgatactcttcgaataaattaaatgaaacttcgatatgtaaattattatttagttcactatacgatttaaaatcgagtattgagtgacaacaaggtctttttcattttctcaccaaaatgatgatatgattaacattggacttttcaacaaatgcaaaaataaggaaaaaaagacaagacttagaaagtcaatatgttttcattgcatgcattgacgtatacatatcagtatcacaccaactgtaatgagaacgaccctgatatatataatctctgcctaacagtctaacactagctaatttatagtttataagatgttatatacatatatacccgggaagaaagaggaagaaagaaaaatgagtctcaagttcattcttatagctttgcttctacttttatgcatcacattttccaattcgaccgtcgttcctttttccaaaaaccggaaaattagtaagtcttcataactgcataagtgcaaatattgttattatatggtgttaaaatgaggtttgtaatatagttttaacgtgtaacaagccaatgaagaagaagaagaagaaggtagagagattgacattcacaaaggaaagaagatcaccgtaaaagtcagccgttcgcctcctgcaaaaggctggatttgttgcaatgattaactaaaaggagctatgtgaacattttcataagatcccatccttcaatttctatgaagataatatcgaccaagatcaaacttcaaagcttgaaattagaaacgtgtatttgctatatctcaaccactaatttaaggggctttcggcccattacacgcatgggaagattcaattatgttgattttgtaagttttggggctaaagtgtaaattattgaaacttgtaggcttgatttcattattccaagtttccactttttctcctccgccgtagccggtgcttcttcttcgtgaaaatctttcgtctgagattttttctttactagttgaataaaattgaagatttcgaagactacccaaaaccgcgttttacaaaaagccagattctttttttttttttttttttttataatttcattaaaactacccaatgggcttgggccgaaacttacaaacaattcggtccagttacaaaattagggttttctgacacatcgccaggaaaaagaaaaaagctcgccgcctgttgaccgtcgctagcagagcgaccaaaacctagatccggcggactcaagtcccacagctttgtggccgcctccgagaatcgtccaccaccgacgaaagattccggttttcgtctgtagagactcaactccaacgcaccaacccaccacaagactcccggaaagctagccgctccgacgtagcggttccacggaaccggatcccgacctagcaacccgaaacactcagcgataacacttctctcccatcaccggaaaatagcaaagacccagagccaaacacacgtcgatccggaccggtggagaccaaaaacggcagacctaaagactggtggctcagtcagactctctagatccaaaacccgctgcagccatctaagatccaaacagatctactgttaaccaccgcatcagacaacgaacccccccttacccctctccaacttccgccgtggacgcagcgactagaatcacgggtgagcctgagaacctcgcagcaaccctcagcgtccataaccaagagacccccgccgcaaccttctcgaccgacaaaaccagagccaaatccacatcagagagagagctccacaccacacgttgacggagacaagcatcggctcactcctggacttccttgaagaggcttcaaaccgacgatgaagagcagatcggaacaaaaagaaaaaggaaactaaatctacttaccggaaattgtcttcaagagagagagaagggcacgactttcaaggctacgattgagcctccatctcataaagccagattctttatcttccataatcgtattaaagctacgaaaacctcgatttcgtgttcaaaacttggatttgctcgctatcgaaaggtctgacctttaatccttttcatgggtttaatcgttcagatatgatttctcgtatcggtattatagcttagaggaaaagtgtcgtagttttggcagatgaaattaaaattggctctgtattcccaaatagttgaaacccatttgatgaagctatcttatcagacttttacgcataagttttcttgtggtcttggatcgtgtctagtggcaattatcttctctgagttcttttgcttagtttgattgtctgttgttttagacga

SEQ ID NO: 9173 - DNA, 3000 bp, Unknown
  misc_feature (1)..( 3000): cDNA_ID_2180851_gDNA_ID_1972016_Annot_ID_177912 3000 nt of promoter + ATG
gactggaccagggggtagctgcgaagaagcgggacctttgcctccctcatagcggagaagaccagtggtggttataaccgacttcaagaacctagaggatgcaaccatgtagtaatctttagcttcctgattagcggtaaggatggttccgtaacactgaccaacgtgaacgtcgagagagtcataatcgttctggagaacgtgcgatccttccatctcaacaagcttcaacttgtgattctgaatcctaaagttaagagatgtcttgagacccacgttacagatcctaaccctgtaggtctttccaggtttcaaggtaaagagaggtgcatcggatccatcgcctttcccggactttccgttgatgagaataccatctggacggccaagagtacgaccgctgtcaaggaatttcttcaactgggtgtggctcttggtgtaccagtcaccgatcaagacggtgtagtcatcttctgggtcagcataagggaccgggatgaggagacggctgttcacacggagaccaccgaatccaccagcggaacggtgcatcgcggtgctggggtagtagaaatagcttccgatctgatccttaggctggaaatggtaagtgtagttggtgccgggcatgatcggacacatagttcctggagtcccatcttgccaacagttcttcctgtgttggatcccattcctaaaacgcaaaaacaaaacatatattataagcatgcatattgaaaatgatatattttggtgaaccgtgaaacaaatgttataattaccatgtgaggaggaaaggttcgtcgaggttgttgaagacattaatgatgacgttgttgttggaggttgagttgacgttgggaccagggaattgtccgttgatgagaatgacttgttgtggaacaccgagaggagacacggttccgtaggtcacgttccatacgtgatggaagtaaggatcttcggctcggactaccaccgttgcggcagcggccaggtagaggcacgcggccaagagtttaacccctcgcataacaataaacaatttttggttgagataacagttatagattttttatgtgttttggtactaattgtttattgttatatataattatgctttggggtttgaatttcgagttgtggaaatgtttcgaggcatttttatagggttatttttgacgaatgtttttccaggtttttctcgtcttctttggggtctcctaccatttcgctattcctttcgccatatttgggaatattgaagtttaacctctccctatttttggtgtttctctttaattcctcttagtttattttcttttttccctatgtcttttttggttttggttttcatgtcttcgagaattttgctatttgggattaaaaaataatctaaaggatataattttatatatatatgtgacaaaggtataggtcgaccaataaacattttacattattatagaaaatattttgaaaatcgcttattttaatcataacactttgttttgtacattatgcttttggaatttggatgattatgtctttttatataatatataccagaaaataattcgatatgtcgtattttttctatctatatatcttttgacttctaattgtaaccataggaaaaattagatgacattgaaaatcaggtaatgatgcatagcatttgttcacaacaatattgttaaagttaggaataggagtagtatcttttcccttttcttcaatcatacgagctagtcaaccgttgacgataaattcacggagagcaccggaacctttaagtatgagaaactacttcaataatcttagaaattacttacctaaaaaatcttgcactgtgtagaatttggtaagagacatatggtctccaaatacgttctcagctagcgttatgtcattgatgccaaaacgttctttcatctttctaattagaaaacaaagatgaacaaaagtttgtgatacactccctttggtcagacgaaaagagtttgtgacacactccttttgaccaagagtttgtgatacaaagatgaacaagagttcatgatgccgtaaatacaaatattttgaatgtgtaactttttgttaaagttataagtgataaactgtttttttttgtagtgtatatataagaaactctaagcatttggagaagaaaataaacatgtcgcataagacccacgatgtcaattaccatttattaggcctttatcaacatcccacctcacaatatatctatactaatatataaaattattttattttatttttatatatagaacaccatatacacacatgtacatctcaattaccatttattgtgcagactattatcttttttttttatttttatttttttatttttttgggcagactattatcttatttcaataatctgcataactttttttttaaaggatcaaaagaagattgaataacatgcaagttcatttttgaaattttattatcaaaaacatggaagttcttaaaattaaaattacaaagcatattaagttggtaattaattctgtagttacttactaagttgtaccataatattattttttgtccgtgtaataatcaaccgtagctgaaatatgttaagacaaacaaaattacttgatgatgacacttgtgggtagttaatttggcttctttagagacatgtccaataatagaataagatccgagttgtgtgctcgttagagaaatcgggagtcctaaggaccagcgagcgagagagattcaaaaatagaaatttcacgtaaagagaattagaggtgcagcgtgaaaagaggcaacaattccgtgcataccaaggtccttcacctgcataaataggtattcacaacatcaccaaaagattcgtcaagagcaagagaacatagtttcttcttgcttttgagaaaaaataattatatatttttatataggaaagggttaatttattaataaaaaaaaataaaaagaagcagaaaagagata

SEQ ID NO: 9174 - DNA, 3000 bp, Unknown
  misc_feature (1)..( 3000): cDNA_ID_2180860_gDNA_ID_1972016_Annot_ID_177914 3000 nt of promoter + ATG
attcatcattcatttaatcatatgagttggagaactcgagtcaaatagagagactaaaatggctggaatctggcaccaagttagtctcctcaagttgtcattagatcttataaaatgataacattatgtttatatctgtttcttctattctcttacggatattacaaagaatatttccccataggcaaatcatgttgctactttaaaaatctgcaataaaaacttcactgtttaccaaacattttggatgaaaaaactatctttgaagtttatactaaccctccgattcacctatttttcatgtacagaaaagaatgctaatgtacattcgtagtccaaataaccccaattctatacagttccgagtaaaatgaatgatgataaaggcattgttcttgcttgttatccactatgtaaatctcggatctggattcttcaaattgaaaacaaagaatggccttagaattgttgaatgaagttgctcgtgacaaaagctatcttcctgcaaaagtgagttggaaactgccaggcaaaaatgataaaagctgagagcagtgctgcaagtagtaatgtagattgacaaacacatgcaatttactgagtccaaggatataccaaagcaacaagtgttctttctatgtctataaaaaggtcaagtgtgaaagttaacctaaccaaaagcaaggtatagtatagtaccgtccacaatcattagatgttctatcaacagagactagaatgaagtgcttctaaggatctggatagaggagacttctttcgagaggcttctgcagcagatgattgggatcctttgtaaatgtctccagctgaatggtgcttaatcacctacaaaaggttgaaaacccacttgctatgtctgtgtaagttttagaggagtactgagacaagaaaagcagcatactatgatgtaatatcaatactatgtggcctttgtttgttagtgagaaacaagtttcacctaacctagagtggcaaagagctaaaaagcatggttgggtgatctagatagttcaatccaattctcactatattgcatacagtttcaaaagaaaggtccgaaaagaagcatctggaaacccaattggtaaaaccatagacaaaccaagtataaaaacctcaactacaatgagtacacaaacaacttaagagaagaataggtagaaataaaaagacctgtgttgcattgggcaaagtgatattgcttaggccgccatctaacagaggagtgtaggaggcaggttcgtcaatagaatcttccaagatttcgtcagaacgtgaacgttgcttagctatagcaggagcctgtaagaagctatttcgtaattctggatcacgtgaacgttgcctagctaaaagaggaggttctaagaagctattccgtaaatctgaatctgattgacggggaaatggagagtctataatagaagctcccagcctatagatctgaaaccataacagagaggacgatagcctcacaacgaacccagcaatttccatagccagggtgagtttcacagagaagatgtaaaagacttgatacatatcagatgaaatgttcctgcattaacaattaaatcttttgtcagttataggcagcagatgaatactggctcaacagaatctaaacacgacatagcaaagatttgcaaaaaaaaaggtttaaagatcaatcagttcaaaaagatgatgagccaatcaagagaaattcaggacagtttacaatatgtgatgcaatgaaaattaaacaagacagagcaaactcttaaaccaaatatttgatcatgatcacaagcacggctgttccaaggatagtgacataccaaatctctttggagaagagaatgaaccatgagacatcaagaagaatggcgcagaaaagaagaaccgcataggttctgccaagactttggctattactctcgattgctactaacccaaataacgcaatcgccaaatttatcagcacgactccattgtacaatgcccctagtgaaccgatcaacgcgcaccctatctgaaacaaatgattcatcaatatgagtttcttgcacttctaaccacaattaaaagaataacaaacaaatatcgacagagaaatcgtagaaccctaatcccaaacagatacgaacaattcacgagaaaaaacgtgaaatcggaggaaatgaaacaactacaaagcgattacggatttacctgagcatagataagaatcaaaacgacagattggagcctaacgtagtcgcgaagccaattatgtattcgatttcgtaacgaaacacaaagcatcgtaaaatctcaacctcgcagctctcgttacttgttacttcaatggactttcataatacaaaatggctcgacgattctgatgctaaattgcaattttccggcgaacgaaatcggtgaatcaagagagaacgacgatttgagaattttcgtgagggagaaagtaaagagtgtctttggcgggatcgcgttgcagaagaggcaacaaaataaaaaaatgaggaaacgaaatattccgttcaatcgtgacgaagttattataagatttaaggaggtttccgtttcttgtccagagtgacggacgcttaacggagtcacgaaattttgggccgtattggaaaatctttaaaagcctaatcaagcccaaaacttcagaccggttaatatctgaacataaccgaaaccggttatctcggttagcgattttcgtttcaaaaacgacgccgttaattccttacatgtcgactactcatatgtgtcgcccagatttgaagatcggagatatgaatctcttctttctctggatttgaaagttcgataaaaatctactgatacatcgacttctggaagcgatctcgatctctctaggtttgtgattatctttgaatttgctgattgtttcgttaggcgtgaggaattgttcgattgattttttttccttttgtctccggtagaattgtttcgacgacgaagatg

SEQ ID NO: 9175 - DNA, 47 bp, Unknown
  misc_feature (1)..( 47): cDNA_ID_2180752_gDNA_ID_1972017_Annot_ID_177946 3000 nt of promoter + ATG
gatcgcggaaagctaggattagattcacaaatggatctactaccatg

SEQ ID NO: 9176 - DNA, 3000 bp, Unknown
  misc_feature (1)..( 3000): cDNA_ID_2990851_gDNA_ID_1972017_Annot_ID_177968 3000 nt of promoter + ATG
atggatgaattggcatgctttgctcctggaatgttggctttaggagcatctgggtatagtgatcctgctgaaggaaagaagtttctcacactcgctgaagaggtaaacttatgacttgaatgatctttgatcatagcgtcgtaagtgcttcagatctttcgaatttttcgctctctgcttttctgatttaggctgctgagatatagcctttattgctattttccacatattttgcagcttgcgtggacatgttataacttttaccaatcaactccaacaaaactggctggggagaattatttcttcaactctgggagtgtatgtcatttgcctgtctttttcaaacacattgtttattttatgcgttatttattgtttagtatacatgatgattcaggacatgagtgttggaacgtcgtggaacatcttgagaccagaaactgtcgaatcactgttttacctctggcggttaactggaaacaagacatatcaagagtggggatggaatatatttgaagcatttgagaagaactcgcgcatagagtctggatatgttggtttgaaggatgtaagttttccgtaggcgcttaattagatcctgcattgttaaaaccttggtgaattgaattatatcattccaccatctatattagtaattgagtgtaactgatggtagattcttatttctttcaatcatttccaggttaatacaggcgttaaggacaacaagatgcaaagtttcttccttgcagagacactcaagtatctctatctactcttctcgccgacaacagtcattcctttagacgagtgggtattcaacaccgaagctcatccacttaagattaagtctcgaaacgatcaggtaaatctcaaacaatccaacaaagtactgctacgaaaaccggcatttagaatacgccagaggcattatggtcggataacaaagaagtaaaactccctggagaggtcacagtgtgattcgtaggaggggctctatggatatatcttaacagagcaattggatttagcttggctattcaaagacccttttatttaagaaaccatttttggaaagatttcaagatatagactattgttgtactagttgggatcagaacccaaacaggttcaccacagtttacaccttgtgttttgtatccttactccttagattataaattaagagtattatcttctgttttgtattcgacaaaagatcaatgtataaaagtttatataaaagactgcaacaatgcagaagaaatgtaatggaagcaaccaagaaaagaagaagaagcaatttgcaatgagaccaagtctctgaaaagacattagtgttgactaaatctccacgtcacaccaaaaggaagacgaatgacttggcggctagtgtaatagttttaaaaatgaccacataatctcaccagcctcaaaacctcacgacacgtcattctctccaattctacaaacaccattcatttcatttccctaaaaaattatggctcatgtaagtttctttgatgtgtgaactgtggaagagactactctcatcaaccatgaaccataaaaactccaccgctctttctctccctcaatcatttacatctcttccttaaatctctcttcccaccatcatcattccaaaccaattctctctcacttctttctggtgatcagagagatcgactcaatggtgagcttttgcgagctttgtggtgccgaagctgatctccattgtgccgcggactctgccttcctctgccgttcttgtgacgctaagttccatgcctcaaattttctcttcgctcgtcatttccggcgtgtcatctgcccaaattgcaaatctcttactcaaaatttcgtttctggtcctcttcttccttggcctccacgaacaacatgttgttcagaatcgtcgtcttcttcttgctgctcgtctcttgactgtgtctcaagctccgagctatcgtcaacgacgcgtgacgtaaacagagcgcgagggagggaaaacagagtgaatgccaaggccgttgcggttacggtggcggatggcatttttgtaaattggtgtggtaagttaggactaaacagggatttaacaaacgctgtcgtttcatatgcgtctttggctttggctgtggagacgaggccaagagcgacgaagagagtgttcttagcggcggcgttttggttcggcgttaagaacacgacgacgtggcagaatttaaagaaagtagaagatgtgactggagtttcagctgggatgattcgagcggttgaaagcaaattggcgcgtgcaatgacgcagcagcttagacggtggcgcgtggattcggaggaaggatgggctgaaaacgacaacgtttgagaaatattattgacatgggtcccgcattatgcaaattaggacatttagtgtttagtgccttaattatagtttgtgtcattgatctgtttgatctttcttttcaacgtaaactaaaaatggtctgaaccaattgagatgatagatatttctttagaggagatttaatttttttaatcaacagtaagaagattttagaaacggaataatggtaatccaatagtcattatcaggttcttttgagatgaaattgaaatcttttctttcccaatttttttaaacaaagataatttcttagaatattatgttattatcaataaaaattgtaaattgaaaagaaactgattttcttatttcaaggaaaattcgttattatcaacatcaaaacaaaacaaaagagaatagaaaatacatcaaaagtaattcctaaggacaaaagtaatcgtaatccaactataaaaaaaaagccaaaagaaaaagaaaaacccttatatgtatgtgtgtgttatacaaaccctactctggaaaagtcctaattcctaaagctactttcaacaaagacgcctgaagcatctgcctatagtgaaagatcagaagactcttcaaccaaaatcttattctcatccaccatg

SEQ ID NO: 9177 - DNA, 3000 bp, Unknown
  misc_feature (1)..( 3000): cDNA_ID_3044913_gDNA_ID_1972017_Annot_ID_177965 3000 nt of promoter + ATG
aaactgtgtttctcttcttcatcatctttacagcagttctgttttaaggttacttgggatggaagtttttagacctaaaacctatactcacgcaccaaaacgagtgtcgtttctacagattttgtaacaacaattcatcgtcgtgacctaaatcaaggagacaatgggtcaaaaccggttcttgggttgaaggcttgggccgaggatatttctagctggaccaagcttgaccaaagtcaatttttggtttaatacaagtaaataaaaaacgtagaatgagttgtgccagagttagattcattcagaaacagagtgttgttctcaagggtcttcttttttgtccaatatcagagtcagtcttcgttcttggttctctcggcgagcttgtagccactgttcactccttaaattttgaactccttaaattcgataaaacttgtaagaataagagagatagagtgtaagagactaataagactggactagtggttgcgggtcgacattatgttgctttaacgccaagtcttaggtttaagggagagcttttcatggtggagcttgttcttggcctatagcgacctagacctaatttgatgttcttggtttataggaaagaaaacagattaatttgatggaaaacagaataatttgactctgacgacaatatatgccctggtttaataagagataaccaacattatattaatccagtcgctgaagaaaaaagaaactggaatcgatataataaaacagcaaagcctgttatatatcaagacaaggatagagaatgcataaattagtgtgacaagtataaatcactagctagcctcttccaagagcactagataccttgctggatttgaaccaaacttggaacataagtaaggagaattgggcatccgatatctccatctttattcacttgtcttatgtatatatcctctcccacaatgtgtaagatgttgtagtagggtaggagtatatggtgaggcactaaaactttcttctcatggtcggccgagacatttatacaaatcttagagtgaaaacgacggaacttggtccatgtcagttctcccgtagtctcctctgtcttagttgctacgaatacatctaatttgtatacattaccagcgccaagagtagcaaacatacatagttgttgctcttctctagtcaccgataaaaccacagtaagatgtagatttttaacatccgccggaagaggcagacattgaaatctctctcttgaaaaatcaaaacttagtaagaaacgacgatcgtcagatgaccaccagtctttactaagagcaaaccagtaagtagttcccttgacattcatgccataactctcattcgtttgtatgtggaagtcggtagtcacaccaacacttctccacgaatgagaagcaaagtcatagacttcggactcaatgtgaaatgggttaccaacgggatgcatcctcaagattttgtaggaggaggatctgttatcgtaacctagggcatataagtctgattccttgtaggaatttctgggttggatccacttggtttcccctgaacatggattccaaacaaccaatctcctgtctttggtacagcatagcaataagccgtcgcagtgaaaggcgttacgtatatcaacttcttctgaagaattagaaagagggtcttttaggctgaattgacctgttagcttcgcagatggggcaccgttgttattgttaattccatggagatctatactcactaaataaaccctaaactcgatcaacataataactataggatactgccttggaccgtacgcatagtgcttcttagcaaagcttccatcgacgaccagagcgttccatcttctgcaagtcgatcgaaatcgtgccagagatacagccggaaccttagagagtatctccaggaccaaatcctccggaagatgcattgtgcttgaagccttgaaagcgaatgtcacttgggaattgaggttagggttaagttagaatacttagaaattagggttaagttagatatatgcttcttttatgggcttcgtcttagattcagctaaatttgggcttttgggacacttcttattctcaacaatctctcttcacaaagccgagctctgtcaattttaatcacttctgatttatttttattttgccaataattcaagagaacatctcaaattttggattacatcctcccattggaggtgctcttcaccaatggtaggatcctaaaaattaggatccaaataatttttgtaattttaaaaatagaaaatcaaaaatttagacactttgagtatttttttaattttgagagagtccaatggtgagatccaaaaagtgaagatctaaagttttcaaattttgaaaaaatgtctattagttgtttgttttacaagtgtttagccattatattgaactaactaaacatggtgctcacaaaaaacaaaaagtaattgtatatcttacacacacaattgggcttcagcccaagttactacaccagaaaacgtaggaaaataaatttggcccatttattaaacctgatttcgtatttacgaaattgcccctgtcttcaacctctccgcgaaacacagccgcaaatggtttttcaaaaataaaaaaacagagatttgttgttgtagagtcgagaaacgaaagataaacacgtgaaaaacaaaaatttcgtctctacacttccccccaccaacgacacgtatgcgtttctaagagagtttaaaaatctaaaattagacccgagtctaaagatttattttgtttttgattttattttttggacactttggcatttagactcctctttgcatcccccgttggaggtggtcttaggttccgtttagaatccttcctatcttcttgttttgcctctgtggctgctactgaattcgggttcaagattgttttaacaatttaaggttttggtttacttgtggtgtaggtgttagtgtctcttgtttctggaatg

SEQ ID NO: 9178 - DNA, 3000 bp, Unknown
  misc_feature (1)..( 3000): cDNA_ID_3044920_gDNA_ID_1972017_Annot_ID_177958 3000 nt of promoter + ATG
taacaaaaataacttaagcgattcaaaaactccgtatgatcaaccaaattcacaaacgtatttgaaatatgtatgaatttaacattcatttggaagtgatgcgattcattggtttatagtttatacatatttctccaattgtgttaaaccgaaccaagaaataaaagcgaaaccgagccactactcaactaggtgattttgcaattgaactttagggtttatgattaagcgcactatataaataaaatgttctggagactggagagggattagtttagtcactttgcttgatccaagagaatatacagagaaaaaagcttgacgacagttgaggctatggcggcgaatctccaagacggtgtttctgatgactttgactacgagcattggtctccaatcgcgaaaaagagactcgtggaaaatggagtttgggatgttgttcaaaatggagtctcgccaaatccaacgaagattccacagttagcggcgactatccaagccgtagatctagcacaatggagaaatcgtgtgattaaagacaacaaagcgcttaagataatgcaatcttctctcccagattcggttttcaggaagactatctcgattgcttcagccaaggaactttgggatttgctcaaaaaaggtaacgataccaaagaagctaagctacgtagattagagaaacaatttgagaagcttatgatgtacgaaggagaaccaatggatttgtacttgaagagagttgaggaaatcactgaacggttcgaagttttgggaaatccgatatcggatgataaggttatcaccaagctgttaacttcgttgtcatggccatatgatgattctattcctgtgttgaaggaattcatgactttgcctgatctgactcttcgcgatcttcttaaggcttttgaattgtttggatcacatcctgaaactatgcctcaggagttgatgaagttcattaacattcttagaaaagctcactctgagcggatgccgtgtggtatctgcgtgaagaacaatcacaaccaagaagaagacttgtattacaaccataggcctagggtagtgaatttaagtggagccaatcaatttagaggacaagggcattatgcaagagattgcagcaacactagaaatctgcaacaagctgagaagaggatccaaaaacctgagcatctgatgttaggggtaactgttggtggtatcacatttgatgagggcatgtggatggtacacaccactacaacggatcacatgactccatatgagaagtttttcacgactttagaccgatcatacagagctagggttggactggcggacgggaaagttgtcatggcagaagggaaaggagatgtcatgattatgacgagggaagggaagaagaggatcaagaatgtgctttttgttcccgggatcaacaaaaacgctttgagtgttgctcagatgacagaccaaggctgttcagtaacatttggaggaggcaaatgcattatgaagaatcacactgggaaagtatttggagaagccatgttggaagagacaggttatgttattcgtttgcaggtgattaaagaagttatctggcactaggcttaactcgtatggtggacgtattagtttggtattcttctgttttaagtttctttgcctaagaataagaaagctactgctgctgcagtatggattagtgtggtctttttttaacctaggacggtttggaatcaatctagtttttgggaaactgttttgtatccacaatgcaatgcttttgtcaagttttgctaatggtgaaagaagacgattcttgtagaaagataaaagggcttttggtaaattgatgatcaaatatacgattacagaccaaacttaattgagaaaatttaccgaaattgaaagagagagatagacatgcagaaggtgggttgttgaatcagtagcggcagatcttggccgtaggcattgtgacacaaacttgtgcgtatttcttcttggccgcctctgtccctcgcttgggctcttcttcttcagccatggctaccttagccaaagaacaaaccgctgcagctgcagccgtgaacatgaggtccctcctcattgtggtgctgctctgttccttgacttctaagctgggtgtgttgtcgctcgtggaggctctgactacggagagccttcgtccgccggtggctgagggaaccttggcgacggccgggaagaaggtagcggtcatggtcatcgatgccattgcttgatagttgattctactcgctagttggctctcggttaatggtttgtgaggtgatgggaatgtgtttaagaagttgggtaatttgagtttgtggaattgtggagaaatgatatccatttccttatccaaatatgattttcgtgcaaatgggttgtggccacgtgtcatgttctatcttttgttaagaaaaaaaaccatgagaggttctcgcaccaaaataaaaaagtgtacagtgtagatacttttgttgtggagtcccacatgtaggtcccatcttggatttaatttaatgaaacagaataatgattcgaaattacaacactggttaaaccccaacccttggtctaagtctaacgccgttagtcgttcttctctgttctctccatcaaattcgtcagaaaccaaagaagattcatcaattctcctctaacaccaatcctgcttgctttcactttccttctccgatttcgttctcacgccttcgcattcctttttttaatttcgtttcgaaacgcgtttcaaggttacgtcgatctcaaagtaacatcgccttcagagagaaattgataaaccttgctccaattccattgttattcatggctcttagaaactttacctagattactcggattcaatcgtcaagtttatattggatcgttgtgtcgtaggaaccctaatttcgagggcctgtgcactcactcactcactcaatttgcacaacaccctcagagaccaacaagagcaac

SEQ ID NO: 9179 - DNA, 3000 bp, Unknown
  misc_feature (1)..( 3000): cDNA_ID_2180801_gDNA_ID_1972017_Annot_ID_177962 3000 nt of promoter + ATG
ccataactggcttttttcgcaggaagggctcgagatggaaataagaaaaggaagtgaagcaacctggtggaaacaacttaggacattaacagcaagatcattcataaacatgtgtcgtgatgtcggttactattggacacgaataataagctacattgttgtttctataagcgtaggaaccatcttctacgacgttggctatagctacacatcaatcttagcccgtgtttcttgcggcggattcatcactggtttcatgactttcatgtccattggaggcttcccttctttcctcgaagaaatgaaggtaaataataaaaccctacttataatctcacaaatcttgaattgctctatcgatgaaaatgcgggtttgctttgtttcaggtgttctataaggagaggctaagtggatactacggcgtttcggtttatatcctctcgaattacatctcttctttccctttcttggttgcgatttcggttatcacaggaactattacttacaacttggtgaagtttcgtcccgggttctcgcattacgctttcttctgtctcaacatcttcttctcagtttccgtgatagagagtctcatgatggttgtggcttctgttgttccaaacttcttgatgggtcttatcactggagctggcctcattgtaagaacagagcaacctctgttttcatttctactaataatgctttgaacgatcttgaatctgatttctgtttttgtgtttggaaaagggaatcatcatgatgacttctggattcttccgtcttcttcctgatcttcccaaaatcttttggcgttacccggtttcttacataagctacggttcttgggctatccaggtaagtcaagaaactaactttatgagcttattacgattcaagaacataaaaataatacatttgggagtgttgcagggagggtacaagaatgactttctagggctagagttcgagccattgttcccgggtgagccgaaaatgacaggagaggaagtgatagagaaggtctttggagtgaaggtgacatattcaaaatggtgggacttagctgcggtagtagcaatccttgtgtgttacaggcttctcttcttcgtggttctaaagctgagggagagagcaggacctgctttgaaggcgattcaggcgaaaagaacgatgaggaatcttgataggagaccttcttttaagagaatgccttctctgtctctttcactgtcgtcaatgtcttcaaggagacaccaacctctccgctcactttcttctcaagaaggccttaactctcctatccactactaaaagacttaatataatgtatgcatgtgttctgaagctttcatcaagatctcatcttaatcagctttgtcattgttgaagaaaaagaacaaactgataacaaagtttcgtttgataaaccctacccaaatgttccactattgaaactttacttcaaggtttatgtaacacaagtaagacagtgttgcgcacagtgagagtatggccaaataaaaacgaaaaccttgttacaccaacatgtttggtccaaataagtatggcgcagagatacccggatcccatagtcaactttaaatgaccaaaagtagtttatttaggtgtaaagggtcaaagaaaaagaaagaacattttcttgagatcccatgaggaaaaaaatacattttgggctcggtcagtcagtaactcagtatatactaaattggagatattgataccaaaattttatcatgagtaaaactaaaatttacaagtacaatattatcgtgatcattcaagatttccgacatgaaataaggaaactcaaatttaactaaattttagatggactaaagaaagactaggtaatttaaatggggaaatgaaaaacttatataagttgataatagttaagaaaacaacatacgaagaaatttcgattattaatttgccatctttgtgtgaaattaagcaaaaattgacacgttgtcctttagtcaacgaaaatgaagctctctggaagacccacatgcatatatttagttatcaaaattctccttataaatttagttggagtgttctaataaaatgcataatttttttagccaaaataaaaaaaatgcataatgtttttagagcaattattaggactgtaaaactatccatttaacaaaaggaaagtaaaacacaaacaaatatgaaacatgtccatatactcataagatagtatctaaaagttaagtttttttttatataagatctttgttcgtccaatacattggaggacttgatatggatcgacacagagagaacaggaccgtttaaccaaagacaaaattggcaaaatagtcttcaaaaggtatgttttggttgactctgactctcttcccattaatttcccaaatacattttcttgtgcccgaattaaagtcgatagttattaaattagtctctacgtaaaagacaatagtagtagagtcagtttctacgaaagaggaattcacaatcacatccaatcaaaaagtactagtgttaatcataaattcgatactgatcaccatttaaacattctaacatgattgcaagaagactttagtcgttcgaaagaaaaaaaaaagcatactaaaagcataactataaacctcaataaagtaaagtaaatacgtaggcaaaagaaaatacaaaaataaaggcaacttggttgaattattgccatgaaagaggacgaagacgtgctagtcaagtgtcaaggcctcttgttcattaagggccaagggtttcgaccccaattttcttagataaactatgcctatggagaattgctgaagtcctcaaaagctgctacgcgttgttggggacccaacttatatctgtaaatgcccaagtaattaacggtgtaattacacgactatctttggctttgagtatatatatctttgttttaatgaactttaatctctctctcgatatatcatcttcggtcatagaactcaatg

SEQ ID NO: 9180 - DNA, 3000 bp, Unknown
  misc_feature (1)..( 3000): cDNA_ID_2180809_gDNA_ID_1972017_Annot_ID_177964 3000 nt of promoter + ATG
agaacccatacaacataaatgacgttacaataaaatgtgatattataagtagtatggaataaatttaaaccgagagggtaaataatatacatagaagaaaaaaaaacagagattgaataacgatataacgtatatatatggtcacagtctcatagaccacgaaagccacctaacttacaaaaatgaaacctatcattgattggaatgatgtatttgtcaacacctattaagctatatatgatgtaataatgctctatacatataacatttttatgttgttgtaagaaaatataatttgattcaatgtaccaattacttggttttaaatgctgatatctattcttagcttagaatgattgaaagtcttaacgtttctaaagcaaagattatgtatagatttggtcgtaccaacacatcaaaagtccaatggctagaactcatcatattcaaaaacccgcttgtgggcagaagctgttctttgaactctagttataaagccatttaatatttcttttctttttcgatatgagatattttagcgatgagttagtgatcatttagtcactttccttccaaatgtgtgagatctgaaaaatcttaaaaaccattgcaggaaaagttttatgacaatcacttcttctaggttaaaatgcaaccaacaacgtaaagaatcaccaaacacatggcaagcaaataaacgtggaagtaaattacatagttgggccgccggtgggcatttttacttattctccgggttctcttcttcggaaatgtgatatatgctttacttgggcctaaatgggcttcttttattgacatgcagatttctatctttaatctcggaagaaacaattcgttttagattacacggattggaaaacagcttacagattagagtgaccagacttgcccaaaagaacaaaagtgtgcaacatgatttgttttcttctttttttctggcattcatgatgtgacacctactcatacacctaggatactaaaacttattgccccatttttaattttaaaatgttagatactagtccttgatagtcatcattgttttatccatttccggaaaagttttaatacagtttttaaaatcttatttagtcaaattaaaaaaccacataaaaaataacgaaaatttgtttattttttggcaaattgataattctcgttttccatgaagagcatttactttttgtttcattattgtctgatgcatggttctgccaaaaaataatacgaactctggtcaaattgactatgaccattgagaacctcacgtgtccccgtaaagcaatcttcgcagttgacataactgctgctacagtttttgacggttgagatcagacgagagtattcaagattcggtgcactcgtcgtagtggaatttgccaactgatgaaaaatttatgtcacgcgcgggttttagtgagtcagggcaaagtaagcgctcgtatcgaggcacggtttcagttttttttgcggtaaaaacggaaaaaagttaaagaggttaaaatttgtttggttttgttttccaaacaagaatactaatttatagtaatttcttctagttacatggttgttacaccgaatatatcacagtcaattctatgttctttaaaattcaaaacacaagatttttgcttagttttatatagtggtcgtgatcaataataatatctttggcaatctctttcatgtacttttttcacaccttctcaaccaaatatgcatcttggacttggacacatgggaataaacaaaattgaggagtatttcttttgtataccatgcatggattggattatagctatgaaatacattaaatctaagacctttgaatgacatatctttttattaaactaattttttaaaacaaaagtagaagtttgattgaactttataaagtagtgatctcataacacaaaatttaatcaattttaatcgattcataataaataacttgtaatccctaaattagtaattttaaattatgttatagacgacaaaagtacgattgctagggtaattttctcgttgtcatatttcgacaataaaagggagacacgtgaaatcaacgtagaatcaacttttgactactccgaaaactaatgcgcattcggcatctatacataggttacacatataaaaccaaatccgaataactcgcaagcgcataaatatcaaatattcttggaaagttgtgtttcagaatttatttttgttttaatacttttagatcgctagctaattaatattttaaattacaaaattaattaaatctaagttatttgtagaagatatcttcttattaaactaaattgttcaaataacacatagattgaattttaattaaactttatatatcagtaattttgtaacgtgtatatttaattaaattaagaaagatttatatatatataaaaaaaagtcaataacacataatttttagtaaaaataattaaggtatatgaatgaataataacatacttcccatagaatcaaatccaactagttgactaagaaattaagagttaaagttttctaaaccaaaaatgttgcatccaatgggatgtgtatataaacaccctaggttggtcaagggagaagaaaaatatactattgttaaacaaaatcttaaagactaatttatctttttagcaaaaaaaattcgatttttaactataatcccgctcctagtcttggacaaacttcaaaaaaaaaaccctaaacccaatatcacaacaacagaacccgaaaaaaaagaccacattacgaaagtagttttttttttgctttaataaaatggttcattagaagacaaaatcatagtctcaaatctcctaaaaaaaaacatcacatttaacgctacaaaaaaacccaagttagtacccactactctctcacaaaacaaaagagcctcttcttcttcttctcaatctctctgatagagaaaccaaagcaaaaaaagaaaagaaatttactgtgacc

SEQ ID NO: 9181 - DNA, 3000 bp, Unknown
  misc_feature (1)..( 3000): cDNA_ID_2180805_gDNA_ID_1972017_Annot_ID_177963 3000 nt of promoter + ATG
tttattcccatgtgtccaagtccaagatgcatatttggttgagaaggtgtgaaaaaagtacatgaaagagattgccaaagatattattattgatcacgaccactatataaaactaagcaaaaatcttgtgttttgaattttaaagaacatagaattgactgtgatatattcggtgtaacaaccatgtaactagaagaaattactataaattagtattcttgtttggaaaacaaaaccaaacaaattttaacctctttaacttttttccgtttttaccgcaaaaaaaactgaaaccgtgcctcgatacgagcgcttactttgccctgactcactaaaacccgcgcgtgacataaatttttcatcagttggcaaattccactacgacgagtgcaccgaatcttgaatactctcgtctgatctcaaccgtcaaaaactgtagcagcagttatgtcaactgcgaagattgctttacggggacacgtgaggttctcaatggtcatagtcaatttgaccagagttcgtattattttttggcagaaccatgcatcagacaataatgaaacaaaaagtaaatgctcttcatggaaaacgagaattatcaatttgccaaaaaataaacaaattttcgttattttttatgtggttttttaatttgactaaataagattttaaaaactgtattaaaacttttccggaaatggataaaacaatgatgactatcaaggactagtatctaacattttaaaattaaaaatggggcaataagttttagtatcctaggtgtatgagtaggtgtcacatcatgaatgccagaaaaaaagaagaaaacaaatcatgttgcacacttttgttcttttgggcaagtctggtcactctaatctgtaagctgttttccaatccgtgtaatctaaaacgaattgtttcttccgagattaaagatagaaatctgcatgtcaataaaagaagcccatttaggcccaagtaaagcatatatcacatttccgaagaagagaacccggagaataagtaaaaatgcccaccggcggcccaactatgtaatttacttccacgtttatttgcttgccatgtgtttggtgattctttacgttgttggttgcattttaacctagaagaagtgattgtcataaaacttttcctgcaatggtttttaagatttttcagatctcacacatttggaaggaaagtgactaaatgatcactaactcatcgctaaaatatctcatatcgaaaaagaaaagaaatattaaatggctttataactagagttcaaagaacagcttctgcccacaagcgggtttttgaatatgatgagttctagccattggacttttgatgtgttggtacgaccaaatctatacataatctttgctttagaaacgttaagactttcaatcattctaagctaagaatagatatcagcatttaaaaccaagtaattggtacattgaatcaaattatattttcttacaacaacataaaaatgttatatgtatagagcattattacatcatatatagcttaataggtgttgacaaatacatcattccaatcaatgataggtttcatttttgtaagttaggtggctttcgtggtctatgagactgtgaccatatatatacgttatatcgttattcaatctctgtttttttttcttctatgtatattatttaccctctcggtttaaatttattccatactacttataatatcacattttattgtaacgtcatttatgttgtatgggttcttattacttcttaattcttatctttgttggaaggttttcacttcattcattcttttatcaacgttacgttatcacttcatattttaaaattccctgtcatatatcatatgataaataaagttatgccataacaaagttagagcataataaatggagaagcatactattataaagcaagaatgaatgtgtaaccgtagataagcatatgggcttcaactacgatctcgcatttaatttaagacccgtgactctctgtttgattttttttcgtttgtcatctgaaattttccttaacaatcttgaaaaatacgtttttgaaataaaaagccggtgaaaacaaagacatcaccgggtctaaaaccctaaaccaaaaaaacatcaaaacagcaaaaacacctactacaaacaagccaaagcagcttacccgaaacaaattctataaggcacaagcaatgattccaaagcagctcatgtctgttgcagaatccaagctgctcattttcttaattaaatgaaaaatgaaacatttctttactttttttgtataaagctgcatcattttcgcgtttaaaaacatgtcagatttcgtagacttgcttcaattttagtggctaatcaactcacttaactgatttttatttttattttgaaaaagaggtttaactcagttaactgatttaatatttgaggatgcagactgcagaggttctcttattttgctatgagagtttagagtttttgtccgacgattacaaaatttaatgtcacaattagttgcaaaactaatttcaaaatgtaatctcaatctacacgactatatgaataggatctacatatacgactattacatacccatcataagccaataaaagcgcattgtacgtatattaatacgcgtgccatcgatctatctccatctctatacgcatttactattgagaaaaatactaatattatatcgtagataactagcattgacattttactcctcaaaattgtagatatacatgcgcacttgtaaatgttgccgtattaaagacagtccattaatgaatttagttgtttggtgattgcaaaagcttataaatccttttttattgttttgtttcttctgttccttcttactattcactctccgaccaacgaaaaagaaacaaacaaaacattaaaatctctctttctctctatagcattgttatagctagttagagagacaaaactaaaaacaaatg

SEQ ID NO: 9182 - DNA, 1521 bp, Unknown
  misc_feature (1)..( 1521): cDNA_ID_3044937_gDNA_ID_1972017_Annot_ID_177947 3000 nt of promoter + ATG
gatcgcggaaagctaggattagattcacaaatggatctactaccatggcagaaggaactggagatgtgactatcatgactcaagaaggtaagaagacgatcaagaatgttctttacgctccagggctcgtgggaaatgcattgagtgtttctcagatgctgaggagcggcttggaagctagaatggatagagaacgatgcactatatgggatcggacggctgggaagtcttttgctgaaaccaagatgggagagagaggctttcacctgcgtttggatgtgattgatgaaggtcattttcaaagcaagaagagaaaatttgctccagtttaattttagagggtggacaataatagactgttttacatcatcatgtagttcaaagcaagagagagacttttgcctgcgttaggatgccatgttgatttagtatgatttcatctgtctagtttagttagcttctatcatagtctcttatcattttatcctttgtctcatagtttagtacttatttggctttttgactacggggaaatcttgtcttcggctgtcttatgtttgtaatcaccacaagaagcggattcgtaaagggtaatgagatataggtatgaaaggggagagtgtattctcaatgtggaggtaaatggcatgtctttaaagactgtagcagcagaaagaagaatgacgcaattacctgagtatcaaatgttagcaatcaatgttggtcctgtgacatttgacaaggatatgtggatgatatacaccagtacctccaaccatatatatgactccttatgagaagtatttcaccactatagacagaacacacagagctcggatcaaattcatcaccggacattctatcatgtctgaaggaatgggatggtagtttcgtgtgatgtcaaatcttagggggtgttattagattgtgactttgaaagagttttaatgactttaaaaaaatatagaaagtagataaaatgaaagattttaaatgatttttagagagttttgtataatctctatgattacttttccaatatcttgtaaaatcctcttataatcttgtaaaatattcctagttacaaagtcattcacaatctctttttttttacgatactttacatgattttagtttgtaaagaaaagtgtataaaatcataaaccaataacacaataatttaaatcattaacaatcatagattcatttgttttagttgaataacacaaaaattttaatgactttattaaagtatgaatctaataactcaagatttatgaagactttaaattactttttacaaatcaaaatctaataacaccaaactttaaaagagtcttataaaatcttaattgaataacacaagatttttcacaatatttcaaatcattaaaaatccatataaatcacaaaccaataacacccacttattatataaacaggggatgattttattcagtttctcgagggaaaatatacagaataaaacgttttaagaaaccctaacagttgctggctatg

SEQ ID NO: 9183 - DNA, 3000 bp, Unknown
  misc_feature (1)..( 3000): cDNA_ID_3044968_gDNA_ID_1972018_Annot_ID_177976 3000 nt of promoter + ATG
tatttggttgaatttacatcaaactagcgaatgatgacatcttaggaccaatccatctctccgttcaaactcataaaaacgcaaatattgcaacatgtataaatgcagataaatagaccaaaataattaaattgaataaattcaatgaaaggaagacaaagcatgtgaaagatacgtatgaaaattgacaacaacaaaaagaaaaataatttacgaaagaagagaatctgcagagaaagaaacacgcaagaaatcagacaagagatcagatggtggacctcacagagatttaactctttttaaccccaaactttattgtttcggtctatcgacgtcattcctgtgggtgtttgacacgttgacattgtttcacaacagataagcaaaacaatcaaccaaattagaaagtgtagaggaaaaaaacgattttttattcagataaagaaaatgagtgtttataatgggtattgaactaatcaattatgatatcatttgaattgtaatctttttgttacgtgtaatttaatatttgcgtcttagtatttaaacaagttataccagttttatattactaataaattagtttttagttttactacattaaatttgtgtcacattaatatttgatttgtttcactttatttccttcttgttgggctgtttatggtttcttttaatttcattaagttgggctgtacccactaaagttaaccaatctggtaaatgaatacaaatttgaatcaaaagagaaactcaaaaggagtaaaggacccctttgctatgacatgtgctggtacattgattcacttaacatgaatcaatcaatgtgtttaaactttgacgcccaaaacatgatatcgttgtgtaagctgtttaagtcttttaacattaaaaccaataagaaagttttttatgtccacttgtgacccgttaggtatatgttaacaaaaatttggcagttccccttgaaaatcactaattagtatgacaagaatttgatactttgtatagaagtttcgatatgcaatattttgttccaatctaacaattacatcttttatacgtaaggtatcattatctcggcgatcaatccaatctgtagagaaaattaagaataataatatcttgtaacagaaacaaacacaaaaatttgataactgagttcacggctaaccgctacgtctcggggaaggactcttgcttccaagcttaactatatcaaagaggttacacacactactaacttgtgatgtccttggttctttttcagattttaaacacaagaagaacaagattcaagaacaacaaagaggaagaagaaagcttgctttggaagctttttatctctcttctctagaactctctttagcttgtcttgtcacacaactaccacaacttctctttgtaagttgtaataaagatattatatatgtgatatgtaatgtaccacttttgttcttctttctcttcatgccattttcgtcaggcccacaaaggcccaaatgatgtgtttagtcaaacccaaataacaatctccaccttttgaccaaactcaattctgacacttgagtacttctcacaaaaataactcagcttgattgtcctattttatgagactattgaagttaccagggccgctgctctgctctacttcagtggatgttgggaagctcacaacaatgctggaacttcataccaggtactacatccctcttaagaattttcggtcatttacttgtgtgagccttagatacactgatataattcatctgctctaactcactgtccagttgtgaaaagcccttagctagcaccctagacttatacctttgcttttcaacaacttctaaacaagttttatgataacccatatcaagtgtacacaagaagatccaagccgcacgtgtgaagagaagaaaacaagaagaagacacgtgcgaataaacatttgtatataaactttgtagctttcagaagaagttttcatgttttgttttgttgtgcatttgaattatgtgtcatttgtgagagatagagtgatgatctagagatgttctagagctcttctctgaaacaatttatatcgattatttgtttgttaataaagattacatcttgtttctatcaattggtgcgttcgtgatcgagatcgaagtatcgctggaaaaagttagggtttgagtgatgtggggtttttgagagatcgaagaaatttttcaatcaaagatggtgacgacaccagaattaccgtcgattacggagatattagaggcagagcaaacgacggcgtcgttaactgaagttcacgaacaattgacggacatgagtaacaagattcgaagatctgattcaagaccagattcaaagttggagtctgtacgagtcaaattgagtgctcaaattgcacgtcatgaccaacaattgttggatatcgggaagaagattaacaatgtgcttcgcgctttgcctagagtagcgtcggcgccagagactggagggtctagtcatggtggagttacaagatcgcaagatcgacataatcatctctgtcccggaaccatacaatagtgacattaggccaggaattagagaaaacctactcaagaacgtggagatggctgtgtttgaaggagttgggatttactcttggatcgctagggtggagcgattctttcgtactgatggctataatgatgcagagaaattggcactggtattcaatgtaaatcactctctagtggatttacattgaataccaaaagaattgaagtggagctgtgtaatcagcaattgttacaactgggagaacaactgttacctagagaactgcgggaagttttgcgagaatatgagcaggtgtttgagattccttcaggattaccaccactgagaggaagaaaatactcaattattatctcaccagggaataatgcaattagtgtcaggccttataaatatcctcatgcacaaaaagagataatggagacagtggtacaagag

SEQ ID NO: 9184 - DNA, 3000 bp, Unknown
  misc_feature (1)..( 3000): cDNA_ID_2181066_gDNA_ID_1972018_Annot_ID_177983 3000 nt of promoter + ATG
ctttgcctcttttgttgcagtcttgtaagaattctcacagtttttccgcgacgagcgcatcctggccgaaaccatagagcggagttccgctgttatcagatcagctgctttttagatcgatttcccgtcgatctggtagaatatcagaatcaaccttcacatcatcatgaagccccaaggcttatctttctatagagaccaatctcgtctctattgttgaactccttctaggttggggaacctgctacatcatctttgctaccattcttcgatcgcgtcattgttattctcacttgagatcagcaactcaaagttcaacactatcaaccaaagatttcaccgcacctgacgggtcgtcaaatgcacttaagatcaagaagttattcatcttgcttcctgtccaggaaacaactgaaaaagtcctcgatccatgccaagtctgaaacaggatttggtgtatagctagagcttttgcgagacatttttcggacgcaccagaaagagttaaggttcgagtaagtactctttgcgaagatataattacagggaatcctattctttaaacggattatcgattggtgttaatctctatctgcaaatctccttcaaagtttgcccaaaatcatccatactgcagaaatcaggaaacaatgactctgccgcagcaacttcagaggatcatggaagatacatacgacgtctgatctagctagaaactgctcggatgtttttcccgagcaggttatgaattctatcttctgaaacccggttatacttaacaccgatgccccagataagtttctaaacgctcgtaaatgacttaatcagatcgggtcgtaaccgtgggtattcaagtctactaaaatccagttactctaaacacactggtaccgagctaaccacctcgggcatgaaagacaaagcttcaccggaaaacgctccaatatattcactcctacaaaaactcagtcctaactggtaccgagccgatcaactcggaaactaaaacccagttaccataaatactggtgccaagcttttgcctcggccgtttaagtccttccgacttagtctagtaaaatcttgttgtcataaacactggtgtcaggaaaatacagttttttatctgctttggtcttagtgcttagaaatccagttatcccaaataacctggtaccgagtcaatcacctgggtaacaaaatatactaaacccaactttgacacaggtaatttgtacccctgtcaacctcctcgggtatgaaagacaaagtttcttatcgaaatattccaaaatattcattcagaatgtggataaagccatccacgcatgtctttacattaaaaaaaaaatcaaaaaaaaaaaaaaaaaaaatcagaataaaatccaaaacaaagacattgttcgggaacaaacaaataagccttactctaaaaagacatgaatcagtcagtttagatgcgaaagcagctggttcggtcacaccattcatgaagctcgtcgcattaactcttaaaccaacgagctgggggactaactgttggggtcggattcccccacaagcaagaccgagccaaacattcataagaataacaatcaccttatggttaaatatatgataggccccgaggctagaacaaagcatctcgggaccttatttggtcaactatatcggagagttcatagaatggctcgggtggtaatcctatgagcacagcccgagctaaccgcgagaacgctaccgaaaatatctatatcgccttgggggacaatcaactgagctcaatggataagtgtcaagcgtgccccgagccggtacatactgtttgtgtaacgcccacgatcctcaataggatcgttggctaggacttggtccgagagaagaaggtggagtctcggacaagtgagaaggagctgaccataagctcggacaaaggggaaatcatgcatgctaagctaggatcgtaaagaaatcagctgggtcagctcgcccaaagctcaactcagctggaaggagtgacggttactcaggtcgagtgacagtccagctcgggcagctggacgtgtgacggttgagctcgaggtagctggactagtgacggttgagctcgaggtagctggacaaatgacggactagctgggcggttatgggcgaagagatacaacgcttcggaaaggtgcaactcttcggaagggcgcaactcttcggaaaggtgcaactcttcggaaaggtgcaaggaacggatgtgttgattcgggaagcatccattcgccccctatataaggaagggcgcccaggaccattccattcaccacaacacaccgaaaacacaagaaactcaccattaaaactctttccctcttgggagaataaatagtcttaggattcggtagccgggctgtggccgacaataaagaaggagggtcggatcgacctaacctcgagaaggaaggtaagggatcctagactttgtgtctaagggttctaggatgtgagttagtagtcggatcctttaaaggatcgactagagggctgggtagtatccgggtcatatgcatcctacataagactgggtccgcgtagggatcggctgaggcggggacgcggctcgacggagaaccggcgggtcttaactgacctgccgagaatcggccggactgatgcgcgatcttcccctctctgaatcctctccacggatccgagtagtgtatggcatatagagctttgcatggacttgcataagactaagtaaatgagattacttatggctctatcactttcaggaacgaatggtgatcgtgggaaggacttggcttaggcgcgagagactcaaggccgggatgatgggtggtgatagttcggataatctagggatcgattatatgacttgtaatagcttatatgcaaactcataggttgtatcgaatcctttgcttaatcaataaagtatccgattgtttgtttactctattcgtctcatatattgaatcacggaatcat

SEQ ID NO: 9185 - DNA, 3000 bp, Unknown
  misc_feature (1)..( 3000): cDNA_ID_2181048_gDNA_ID_1972018_Annot_ID_177979 3000 nt of promoter + ATG
ctaacatttttattatccttgattatggtaagaacattgttatcacaattaattttttagatcatcacgaaatcctccagagtagagtaaaaggaaaagaatgtaagatatatgattatacggatagatgacatttatagttaacggtaaaagtagtgataatatgttttaccatgataacaatagtcttagttggataatataataagacaatttatgtgatctgtcagcataaacatttataatgagaatatttgctaacatttgcattatcgattacaatggtgacaaaactgttattacgataattggtgtcttatgttttcatgaaaccctcaacagtaaagtgaaacgagaagagtttaagtatatattaatgtggatgggtaacggtaagggtaaacggtaaaagtggggataatatgtttatcaagataactgtgtgcttacctagataatatagttacacttacaatatgtagaaatattaatcgtccaaacacatcgtgaaaatgagggaagctaacgttttgattatcgataataatggtgagaacattgttatcaggttaatgtggatttagttcttcacaaaaccatgtagaaaataggtaaaacatttattatgaatgataaaaagtggtgataatatgattaccatgataaatgtggtcttagttggataaacaattagacgattggttttctagaaagagaaaaaggtatttgaatctccaagaaaaaaaaaatcaaaactaagattttgttatatggctgacataatatctatctaaaactacaaataatacagatatagggatatatacgtcttttccacatgaacaaaattgctgtaacagtgcagtatcttgtcaattaatttctcattcttctgagtatagatcttcataatacccaattaaaaaaagatttggacgtgtgtatacgaagaattatagatgtataatctttgccactacatccactgccgcaacagctgcttttttaatagttatgatagcagctgcagtctccacatacatagagtttgcgttcactttttttttctgtcacaacaacaaatttagtctgtttgctttctttttttatatttttggttgtgacattgaagccatcaaaaccgcctttcttcaaaacaatatggagtataaaggcagatatgattccaaactctagcaaacacaaaccttgcattacctggtaaacatataacattgacatttatttggcaatgttattggacaagtaacgtttgtgcaaagaacaaaccttgctatggaatttcaagagaacatgataagtaaatgttgttaaattataagcacatctaaaacaaactaataaaaaaccttctaaaatcctataattatgcctttacagttaggtgtgttattgtccacttagaactattgggcgaaactggatcaactttccactctcaaataatctcagaataggccaataaaaatgtcatgttagtaacaacgattaatccaaaaatttatagaggtaagtcattttttttttttggcaaactcttagaggtaagtcatttatcataagaaaataaaatataaactcaaccaaatatttcccatcatcctcacgtatagacaaataaaagttcacatgaaattaaaaagataacctatacttgaactctaaggctgccaaaaggttatattttgactcaaaaattgacgccattcaaaattttacgaaaaagtaagctttaataattaatccaaaagtaacacatttggttctgtaatcaattccctaagccaaactatatagagcgatattttctttcttaatgatccatatatgatggggaaagaagaaggagaatcatatatccatgtagaaaccatggtaggaatttaaataaaagaactggtttccatcgttgaacttcacatgacttcatatccaaagctaacaaacatgtatataaaataatacactaattaaatttatcatcacataaagacgaaagaatcatctaaaaatgatacatttatattggggtcggattccctcacaagtaagaccgaaccaaacagtcataagaataacaatcacctcatgattaaatatatgatagactccgaggctagaacaaagcatctcgggaccttattcggtcaaccgtctcaaagagttcataaattggctcgggtggtaaccctttgaacacagccggagccgaccgcgagaacactacggaaaatatctatatcgctttgggggacaatcaactgagctcaatagacatctgtcaagcgtgccccgagccggtacatactgtttgccccgaaactagctctcaaacgaccaccgagccttgaagaacacctgaggcaaagacttgtaaaaaccattcattctcaaaggatcattttccggaaaaaataggatcatttctcggactttcggaaatgataaaggagaatctctgaagataatgtcgaatcaggaaatctttccgaagcctccaaaaattaaggaaaatatacttaggaagattatcctcctgaaccgacttaaggataaatgaaaatcttccgagaatatcgctagagaggcggtttaacgaccctatataaagtgcctcagggacttcacaaaagggatatctttggatattcacaagaaagacacaattttatacccaaagagaactacgaatggcttgatcccttcatagggtacataggcaatccatcacggatgcagctataccttctaaaaaccctaattccttctctgtacttgagcaaaaccctaatgtatttcataagagattagaacctcttttgtaatcgagtcttggatggaatacctatttaagagaaattactagatttgttttccctctctaaacaaatttattgtgtgaatccttggttcaacaattggcgccgcctgtggggacaaaaaagaactctcttcgcatatcattcatccaagttttcg

SEQ ID NO: 9186 - DNA, 3000 bp, Unknown
  misc_feature (1)..( 3000): cDNA_ID_2038561_gDNA_ID_1972020_Annot_ID_178015 3000 nt of promoter + ATG
ttcgtcttaaccaggcggaagaagaaagaaggtgctgctgaatcaccggcggtgaagtcagggaagaagcgagctggtgaaggaagcacctcaagggacatgcatgtcaaaagagttaagaaagaggacgataacaaaaaggcgaatcctcagagagtatggagtgaagaagatgagatctctcttctacaggcagtgattgatttcaaagctgagacaggtacaagtccttgggatcataagaatgcgttttttgatatcgccaagaaatctataagctttgatgttagtcatgtccagttctttgacaagattagaagattaaagaataagtattttgttaaccggaagaacaaaagtggtgaatcgaatcatgataagaaatgtttgggtttggctgttttgatttggggatctgatggtatgaacgttgaatctcctgtgaagaaagatgaatctattcttgttaagggtaaggctaatagcaaggagaagaaggtggagaaacctttggttatagaagatgagcaagtgattcttggagcagattcggagtggtttgaggagtcttttcttgttccggttatcgcgaatctcggtttggatgagtattctgtgaagaagaagtggagcaaggtgtctctggagactaagaagaagattcaagagaagatgaaggttgtggacgctaagaaatgtgagttgttgttggcggagatggatgttttgaaggatgtgacttcggtgcttgctcaaaccaactaagaagaagaagaagaagaagctatcttagggattgtatagggttaatctaaggatgtaatgccctcttttgttatctatcttagggtttatctttctatctacgtttatggatttttagtcttttggattctcgtgtgagaattagctataacaagattaagataagttgtctaacaaaccttttggtcgatggttgtaatgaacttttaggattttgtaaatgtgcttctttttttaatgtctctctactcaaaactcatgaccagagttattacaaaacaaagaaacacacaatagaatggattcacaaacatattcaacaagagttctaaatagcttatatggtgataggttcaacctcattaaacaaaatggattctgaaatgatgtttgtaaattgtatatttattgtttatgataattacgtgcagtttgagttattctggtgacactagttcctctttctcaagtaccaaatgcaaccaaaataaaacatatacatttagttacaatctttcacagaagttattatgtctataataaaaaaattaagagattctgcatcttgaaactgcaaagtaggtgaggaaataaaaagaaacataaattgtgtttatgagcatgcttgttgttagagtcccaatatgtagtagagtagcttgcaagaaatcagagttaattatgcgtttaagagcatgcttgtgtgtgtaagtgtttcaagtaaaactataataagtatgtgtgtttgtatcttgtaagagaatcacccaagttttattatcaagacatcatgctcttaaacgtgttcttgtttctctctaaagaaaacaaaagcaaaacagagtgacaagagagtgagagtgctgacctcaaaagaatgttggaagaggtagtttgagagtgaaagtgtgattttcaacagatatcttcctcacgtagaagaagttgaatggttaatatcaatattgttatgtataaccaagaaagctatagaattgcactatgatattgtgaagctgcagaaaaataaacaacagtaaagtacatacttgaacaagaaaatgaactttgttagtccgcgtacttgtcttaactcttatgcaggggtagccaagcaatatgaaacatttagtgtggcccattttttttttttcaaattctttaacaaaaattatttacaaaatggccccaattttattgattttaacgataattggccctaaattttaaaacctttcaaaataatcttggattttttgtttttttgtatgttgcccataaaaccgtcaggtcttaggtaaaacatctataaattaatattcaataaattaataaactttataaattaataaattcattcaatcccgagttgaaaccagtgtaagaattgatacaaatcgataaattaataaaataataactttttgtgaaaatcatatgtaaatatttggtcccatcaatattataaattcactaatttatatatatatatatatagatatatactaaaatatgaatatagtattcaatttgtattaattctttgtagaatttaattctaatatttttactaaatcgaaaaatttagttttggtttttaaacttgataattgtttaataattgtaattggtttcaaaaatattattgattataagaaaagaaaaaaaataccttttttgattgaatattataagaaattacataatttgtaaaatttctttataaattaatatctcttcaaattaataaattttatcaatcttaaaattattaatttatagagattttacctaatatgcatttttaactaaaagtcataatgttatatattttatttatatttagagaataatatatatattaaaaaaaaaaaaaaaaaaggttgacaagtggaaatatgtgaccggcaatagtaagttaagttgaccaaaaccaaaaccaataaaatcaaaatcgagagactctttcttcccccaagcgaagaagcgatgatcaaaattttacaacggttcctccattttcagcgaaggtaagtctcacctaattccttggaactaagctccgctgtgatccgaatgtacttatatatctctctcttctgatcaattcgcaaaccgccattgttgcttttttgaaatttcgcttctgatgaagaaatgttgatcggagaaaacgttgaagacgtttgaatttctttatgaattagtcagttgtggtgttagttagttacgatg

SEQ ID NO: 9187 - DNA, 3000 bp, Unknown
  misc_feature (1)..( 3000): cDNA_ID_2038545_gDNA_ID_1972020_Annot_ID_178022 3000 nt of promoter + ATG
caaaaagcaagtcctctttgtgaagttaacaagaagcaaactatttatcagaataagcaacaatttcgtcatttgcacaagctgccacattgatcaccattgtccccttggtcgttgttggcactaatttacaacaatctctccgtggagcctacaaaaacatttgacaatttctcgtgaacaataatagaagactaaagagttctgaatagtaaattaacagcaaaaattatgtaccttgctccacctatccggagtaggctttttgtagacaaatatctgattgatctcggaaggatccgcgattccccattcacatttaggataccattcgtcgtgcctcaagtattggctaatcgtcgttgtatcagaagaagaagagttactaaacgcatgagagaaataaaacacacgaggacgctgacaatccgtccatgttaccggacgtgtgttgaatgcaagattagtgaaatcgctacgtaagtgccaatcattaaaagtgcgagtaggcacttccatcatccttgctggcatatacgtacgcgtgatttgaactgtgtatccccacgagattgacattgtccactgatgactcttatcatagcataccgattgttggacaagactcgctgaatcgagtttcgctgggatcattagcttctttaatgcgttgactcggtttgtttttgggaatataggatccactacgtctaggtgatggattgatactattggtgcttgtggatggacagataatagccctaagagattcccgtatacatcaaactgttataaaccataccataaaattaataatcagtaagtgaagtaacaagagtcaatgacaaatgaatctaatcacggattttaagttttactatttcacatttactttgtgtttttccggctgatttttctcggtaataacaaaactaacctgatggaatccaacttctttagtgagaggaacaccaagctcagccatacaagcatgaatccgatcatcggatccgtacaaatcggagtatctctcgatacaccgatcttgcatcttctccaaaaccttggctaatggataacttatagcaaaccctcctccaccgtacgccattccataagaaaactgatgaagattctgcaaatgactctcggacggagctccgatgtaataaaactgtttatgatcgtactttctcaaaaccctaacaagattttccgtgaaaaacacggtatcgtcgtcacccatcacaacccacctcacgtttctctccgcttccgttccgtttaacatcctcaccgtctcggacacgattctcgtgatcctgatcgctgatctgtgaccgttacggtaacggtacttgaaactcgacgtgtcggaagagattctgatctgaggcaaagctgatgaagaagaaacggtgtcgttgatgggtttgtcgagccaaacggcgccgttcatgactccgttaggtttccaccatgttttcacgtattctctacgatgcttccatagatctgaagacgcggcgattccgaagactatgtgtttgagctccgtttgttcctcaggtgtttgacccgacccgagacggataacgggtacgaggagagaattgggggatttagaaggtgaatatgggtttagaaaagagatgaaactgaatgagtataagagatatgagacgaagatcaagaagacgacgatggctgtgaaggaacatggagatgaagaagaagaataaaagggtttattagatttgtcgtaagaaagtgttttttgatctcccatggctctgattgacatagaagaagactagttttttttttgctttgtgagttgtgacagtggtggtgttggtgagattgaaggctttttattaagaaatgaaaccaagtttatttttttttaattacaattataatctgtattatctaatgccaaaaaggcaaggtttgtctcgatgctgtcaattgttaatttacatatgaaaattattacactactccgagaaatttaattaagacaacttaactcaaatttaagacaagatatattttgatgatgtctaaaataatcttatttagttaaaaaaaattttggatttagaaagaaatctcctttttatatttcccaatttattagagtcaaagctgtttttggaacattaattctccacaagaataaaaccataagatggaaaacgacatttcaacattaatgattacagtaattaataactgaaaatagcgtttttcacacaaatctatcagttttttttattgtagccaagtatttgcaaaatactccatcttaggatgatactttgtctaaagtcaataccttttttattggagtacaattcatgataaatatctcttctatttttagtggttgtatatattttgtcatttataagcagatttaggcacatattattttgtccaaaacatattgaatttgtaaccatatatatttgacaaacaccgtgattaattaatgattatatatatgtacgtagttaagtaaattcacaaattcacaactttgtgtgtgtgtgtttcttaataaggttttgcaccaaattaatcaaacttgcattaagcccaacaaatttgaatcattaggcccaaaaggcccagaagttgaaggtgactaaaacgacgtcgatgttaccgaataagaagcagagttgacgaaataaacctgtctcttcttcttcttcatcttctttccctctttgccaagcaaaatttagaattctttctttatctctcagcgagaattttggctaagaatctagctaccttcaagtctctccaggtaatatacaagttctatgatctcttcacattccattgacttcaatttttgatctggtccgccattatcgaaactctagcaagctcttaattagtgaacactgtgttcttcttcaattggttaagaatgtgattaagacttctaaatcctgatttttgattttgatttgtagatcaatg

SEQ ID NO: 9188 - DNA, 3000 bp, Unknown
  misc_feature (1)..( 3000): cDNA_ID_1808340_gDNA_ID_1972020_Annot_ID_178027 3000 nt of promoter + ATG
catttcatgcaagaaaaagccttggtttcatattcataaatcataatacaatataattaattaattggaccttttatttttatactttattcaaagttagtctaatacttttacgccacatatattctaaatcttgagtaattaaaatgaatgaatatagcaatgatctacatgtgatttagctatctctatattaaattgaatataatgtgaattttttttttgtctattggtagcctaatctggaatataagatttccaaataaaatctcagaaaataaagctctataaatttacaagtcaattagctatctctattttaataattgaatatcatatgcttttgcttcaaaggcatgtttttcaacaatgtgaacatctcttttcaccttttctttatttcattgtccttgtccgtcaccaaccaatcatacacttttttcccattgacatgttcttctatgattggtttctttccatcacagtcagtatctttatctctttgacgtacgtttcaatcttcttctctaaatcccgccctcgcgttccacgctaacacctaattctaatatatacaaatcatataaatagccatttttatatcctctcgtaacttttccttctttctttctccaaatttgatcgtaaaaaagattcctatcttcttcaccattcttttcttgaaaaagaatcatgggcttatcttatagcggcgccggagttattatcgccggagttatcttgaatgattttatcaaatcagttcgttcttttcttgatattcgtcgtttgtttggttcggcatcttcagggagcactatcatcgacaagattccgatggacgatatgcttccggcaacaaagttcgaggatatatcatcaagggttaatccgccggagagctgccggatatgccaagatgagttcgacggcggtgacgaagtccggtgtttgaggaattgcgtacatgtttatcacaagacgtgtattgaccgttggatccaagacgataagatgacgtgtcctttgtgtaggaccccgatcgttcctgatttctatttttttcgtttgtaaattagaaaagctaaatgtttcattaatcagattttttttcagcaaatagatatcaatcgttcactaataaaaactaattttttgtctagtttatttatttagttacttcccataattcatttccgtttaaaaattatggttatcatagtcctggacgttcggttatccattcgatttcggttatattcattcagttatcggtttgttgttctaaaggtattcattcagtttggtttcgattctttcggttttcagatatttttttgattattttcaagtatttttattattttatatatattctcaagtatttttaattatttactttagaaataactaatacttttaaaattttgattgatgtttcggatattttcggtttgtatcaattcggtttcggttatttcagttatagaatttagtatgcattcgattagtttccaattttcggttcggtacggttcattatttttgcttcgatttcagtttgatatattcggttcagaatatttgttcagacttagttgataattgagaactctttctcgaaacgtttaaatattaaaagatcacaaaatgggataaacaactacaagaaaattttgccttaatcgacgtcacatgtaaacaaaagaactaaatcggattcaatgttgggcctttcttgaagcccacatgctatttgggtcaaaagcgccaagacccaagacatatctcttaaaatctttgaactttttgagttttgatcacataagaatttacgataagatttactcaccacgagaacacacacgtggcagtttcactgattaaataacacatttggtgtattcactaatatcaaataaatgacgtcatttcacgcttctaatttatttcctaatgtacatttagtgataaaaccctacatacgtgttagagatacggccccgtgcacctactcaaaatagtaaagtcaaagaacgaccgtcagattctatgtctccctcctcagcttataatcaaatcgtggccgttgattctcttttgactcagaacgagcattaacggtgacctttttatccgacttcaccaccatcgttgccgccgcattcgatcgatcactaatcacaattctccagctcaagtgggacattcgtgttcgccactctctcgcctgtcacgcgtgtctctcacgctccacattttttttaatccccttaatcacacgatcttaaggtgtctgatttcactaaaaacatcggaggcaaaaaatgaaaaatcccatgtgcatgctcagtcaaactcacccctcacgtgacacattgcctctatcacgtgatagacgagtaccatttctagatacaactaagattcatatagatcctttaggatttatttttttacagtgttgtatgtttaaattgaacacatttatgccgttgacaaaatttaaaagtaaatatgaggttgacttttgatttataacagattcgtagtatagaatatttacaattgattgaccaacaaaaatgagcaaagatgttaccgtgggtcgattctttacctgggaacttaaatttggtaaaaattagcggcagcttttcttttttaattatgcctactactacatcagaggggtattatagggaactagagtaaaacctaaggacatttccgaccaatgaaaaaaacatggaaaatataagaagggctgagaaaagcaaacaaaaaaaaagttttaataaaccagagaaaaaaaagaaccctcctatcgagttctgtgagatctgcttcaaaagaaaaaaaaactggtggagaagaagaggtgaatcgagttataagcttacgtggtgatgtaaaatatttatatattgagcattttatacatcttcttcttacttgtgtttggtttcttttgggccaaagtattgttttgggtaaaaa

SEQ ID NO: 9189 - DNA, 3000 bp, Unknown
  misc_feature (1)..( 3000): cDNA_ID_3087818_gDNA_ID_1972020_Annot_ID_178032 3000 nt of promoter + ATG
cacgtcgctagcgtttcaaaactgcttccactcatccttcctttgatggactcagaatctgtgcattgtggtcgccccaaaagcaaatcatatggaagaggagcaggagcacaaaaggtgtcaggtatagatgtctccaaacctatatcaaccaagaggcctgtggtgaatgctgatcccacaccagcacgggttcctgaagggacaagctcttcaaaagattctggacactgcgtaacaaacttttaataaatagaaactttgtagagtgtcacaatcaaataactgtagataattcagaagacatttttcaaacacagctcactcacgacctctagtagtctactatcgaccactcaagcgagattgttacaagaaattgttgagattctaaaatcatgctcttgtcccgatttgttttaactaaaatcataatctatagatagtcagtagtgcaaagcaacacaaatgcaagatggtgaaaaggattactgacataatagtaaacaggtgttccaacaagatgtgacttcctcgaagaactacagcaacctcccattttcaccagctatagtaataattaagcaagagtagcgaacaacagtccttgaagcattttacagatgcactgccactgcaggaaaagagtgaactgaacaacgattacttgaatgcaacaagattaatcaaaagtactcttaagaaaccccaataaaaaaaaagtgattattacagtgttagtaagcaaaatgacaaaagaaaagttggtctgatggcaaagtcatccataagaaacacaaaggtatgggaagagtgaatagtgagaagaacattacgaaacaagattaatcaaagcagacttgagaaatcccaataacaagtgattattacagtgttaataagcaaaatgacaaaagaaaaagttgatctgatgccaaagttatccataagaaacacaaaggtatgggaatgttccttatgctctgttgtaatgtcccatcaatagctgaaacttgaatctatattctaaaacaacctctaggattcagtcaagttgcaatgaaaacagtgacgcgagcaaaagcatttcacacttgagccaattttaatcaaacacaacacaataaccttcaaaattggtaacatcattgatatgtaactctaccataagatcttctcataagaatagacgacaacatgaacacagtaagcacatctaaatcagaaactaaacaacactaaacagtacgcgaaccctaaaattgaagaagccgaaaagaccaaaaacaaaaagtacacgaaagccgactccgggaaacaaaaaaagagatggaataattaaccgatgagagcagtaaacgaagataacctgagatgtcgccggagaatttgatgttgtcgtgattctccggtgaagaaaagtgagaagaataaatgctggcgacggagggtttcgacacacagagctccttttctctagtcgaataacctcatcatagtaagtaattatactgtaatcctactttactttatttagtttgcctaattattctcaaatctcattaaataccttttaaatagtacgacgtcggttaaggatacgggctaatcattgggcttttgttttctgaaacatgggctataaacattttagaccatggtccattctacagaaggtcaaaccctctgtcgctatcagaggctattgaatattttgctggtaaggtctcaattctcatcatccttcacctgcctatgaatcttccttgttaaccgtaacctaatattgattgacttctaatcaaagtaatttaatctaccattttattatttcctctaatctaagcctttttcatataaaatgtatctaatagtaactttataagaaaaatattatacctttttcttggtatctttgttgtaaaaaaaaatacaaattaaatgcgagttcgattattgcattaatagagatagacccatctggcatttaatatggtggcggcggaataatcgctaacaagatattagttgaaaattttcaaatcattcggatagattacgtctggcattgaactaattatcctctataaattcaataatgacagaatttagtagatgttctaaatactaaaattatttaataatcttacatatgcaattttccatgtacgtgctgttttggagcgtttaaaccgaattaaagtactactgtaaataaattgaatcgaatttaccgaaccaaaattgaagaaaaaaaaaattaaatcgaaccgaaccaaaaattggaaactagtcgaataaatattaaattctataaccgaaatatctgaaataaaaccgaataaatacaaaccaaaatattttgggtaaaatatctaaagtataaatatatttttaaaagtgttaattatttctagactaaataactaaaaatacttgaaaatataaataaaatagtaaaaatatttggaaatatctaaaaatatttaaaaatattcaaaataaccgaaatattttaaatgaaataaccgaatggatactaaattttaaaatcgaaaccgaacagaactttcaaataaccgaatggatactaaactttaaaaccgaaaaaatcgataacggaatggataactgaacgccgagaactactattatatacaaagtatttagttattcaataaaatttgaaaccaatcgttttttttcaaaattaataattatcgaatttaaatctaaggaataaaaaagcttattacaaatcattagacaaaatgtaataaaaaaaaaggaaattatacacattaattatcttagcttgtcgagtttaaattttgttaatcagagaacgtcaagttgtacagctggcgtcaataaatacccaaaacagtcgtctttttcaacggagaagaaaaagttgaaaaaattgtaaagtcagtctctccgactcttccttccttccgtgttcaccattgctacacgttctccacgaactttccgatg

SEQ ID NO: 9190 - DNA, 3000 bp, Unknown
  misc_feature (1)..( 3000): cDNA_ID_1818591_gDNA_ID_1972020_Annot_ID_178039 3000 nt of promoter + ATG
ataaagaaaaagaatcaaattcctccatatcgttctgtatcgcctccatgtacgtaaagaaagttggtcactcttacggaaagacaccatttttaccaggtctgagcaatttataaggaaagctatttttcacttgccttgtactctattaaatactagggatgattcagcatccgcaaacagtaaatgagaaaccgcatgacttgcatttaccacctttatactaattattaacttatctatttatgctttctgaatattagcaatcagcacttttgtgcatagtacatataaatatgaggagagaggatcttcttgtcgtaggccgcattggggagtaattaagcctcttgattgaccgttaagtagcgccatatgttagactgatgtgatacaccacatcatccattgtatttatgtctcccaacaatccatttttcataataaactctcgataaaatttgattcaatctgatcataagcctttcatgttagtttttataaccataaactttcttttgtatgacgaatttgttcagagaccataaaacatctcttgcgttataagaatattatctaaaatcaatggtctttcgataaagactaattgtgtttctaaaacaaaatttatttttctattttctatttatttaattttccttctcatttttagttgtttttataatatactaagcgaggtagtataaatctagaatcctgaaccagcagtcaaatatcactatttaaagctaactatttaggtttaataataccttaggatattattaccatttacgtaaaaaagtttgaacctggaaaacatatatatctacgtagagtaccgaatattctaaaccatttaaaatattttataatgatcaaccatgattgaaatcaagtagaaaaacttgaacaatgatcttctagttcattttagttgtttcacttaaaaaggatttaaaaagagagtcaacattgcgttttaaatgcattttgaggtttggcaaaccatctacaagctatctgacatctacagactacgtacagttgtgttccatttgttacaattacaacaatcagcttgtttgtttttggcaaattaagagtcatgagtgtgtatacgaaattactttttggtggtctgaatttatgaatgcagttacactaacccttcttcaaaaataaaaatgaatgcggttatactaaactatcaaatatatctactagcaaatatgaaactacattcagtaacagtgatctctctttttggatacaagatgaaacattgttctcttctcatgctctaaatagaaaatactctacgaaatgaaaatgtatgtcatcttataagaactatacatttttactccgatggttaattctttgaaggattctcgacagtttagaagtctgcaaaaaatataatctcataagaaaaaaattctaagtctcttgatacaatgcatatagaaactgacaaataatcgaagaaattgtacttgagcccattacgactattgaaaattctgattttggatgaattcagcggaaactacaaatttaagagtactttatgtgtataatatgaagcctatatatatagaattactaatgtaataaaataagaaccggtgaaaagggggacaagatcacaaggttttcgcattcagtgcctttacagagttatatatttgatgatgttattgcttacttgcctaatagtactatactactatatatatctaaggtaacacatgtatatatatgtcacatagacattactagtatatattatgtacttctatcatatatttatgatattgcagttgcagcgtacacaagtcagctccttttgacttttacatctcatgaatgcattgccatgacatctaatcttactcgagatttgtgcatgcacattattcacttttgtcttttgcaatttttgttattgtaaaaaaaggaaaaacaaatgtaaaagagagagagaccagaaaggtctaactaaacctaaagagtcaatgaaatgtgtttctttcttgtgggattaatcaattcactctttaacacttctttataccattgaagaaattagatgaaagagtcacgagttgcttaccaaatccctcacaagaattgagaactgataaaccaaattgagaagattaaatatcacgtctccttttgatctctattataattaatcgaaaataaaaataagagttttcaacaaaacgtgatcattggtttacgatcacttgcaaagtcaaacctaaaacgtagcattagtacactaaccttaaatactaattatatcatgcaaaccctaatgtcattacctaactatacatgtgtaatgtgttcaacagatcttcttaacccacattagatcaatattaaacaataaaaagattcttatatattctactacttacttcttcttattcccatccatatttttctgtgcctttaggttctcaactaatctcatttaatttagctagcacacagagaaacacacacgtatataaataatatgataacacacaaaaagactcatatatataaataattagagtcattaaatgtggattcatcattaaatgaaacaactcttcttctctgtacaatttctcttcacaccttcaccaaattctttgacttcaaaaatcttataaaatttatatatctccaaaaccataaaaccaaaacgagttttcacaaataaattacttagttgaaatttcaaatctcattcaattagggtacactctctcaacaatccacattaatgagggttgctgcttctgatggctagcagtaacagttttatcgcctccacttcttaatgccatctttttcctcttccctctccttctctatatatattttctgactctgcaaaaccttaattcatccatctctcaaacaccatttttggaaacaccatttcatattccttaaacttttccattttagtatcatttcatattcattgat

SEQ ID NO: 9191 - DNA, 3000 bp, Unknown
  misc_feature (1)..( 3000): cDNA_ID_2038493_gDNA_ID_1972020_Annot_ID_178041 3000 nt of promoter + ATG
acagaagaggccaacctcgccaatgcccatgaacgcccgcactacaagcaaaaaaggaagaccaagtctagcagcaataggtgtcataatagtggcaaaggaccaccagacaacaccaaaacctaaaacaaccttcccgccaaacttatctgcccatatacctcccagaatctatgtccaagagaagatgagctaaagttagaataaatataccctctctttcgagttctataaaagatcagattctacagagagtgatagtattagacctgacctgagtaagtaaatagccccagaagaaagaggactgaattaagccaacagttgcactactccagttatattcttgtgacatgggaagaattgcaatgctcatgttcacctgccacaagcatctctcattaagtaatatatatcttacttcttcagataagtagagaaaataagcaagatatacaacttacacggtccatattgcaaagaagaaaagacgaaaagcataacaagacgatcacccagcgtctaggaaactgctgccaccatggagatgcgttctgtagatttccttcaactaaaatagcttcagctgagccatcagccgatggcacaactccttccgtgatatctgactcctctgatttgtagtaagcacgagatctgttgatcttgatactgttcctaaacctaattacactgtccattcttggttgaaggaaacatccaaaacttcttctcatgtgtcccgattcatgatgtaaactagcttgcagaggttgatgattacggcacaacaatgctacaaagattaagaaaatgcttaagcacaaattgcataatatagctaggtagagaggtataaaagataccgatatataccatttggaaaaagcttggaaacctctgcaccactttttccaagtctctgacaaccattgcctacaaagtaaagcaatcttagcaaatttggaagcaatgcacacattagtgatatcgttcgctacacagaagcaagctacgctcaagcctaatcactaacataatccgataaacaactaaaaagccctaacagattcaaaaagaggagggggatagatatacctgagccgatgaaggaaccgaagttccgatttgaaatcaagccaccgagggccatgttgcttctcagaacaaaaatgtcaagggaagaaggagaagaagaagagagaaggattcaagcttcttccatagaagcggagtaaacgaaggaacctttggataaagccgagagagagactgagagacgctgaagcgggaaaatccctctctattggggaaggaaggaagaggaaaggggggtcgatatagtgacacgtggcacatcatcttctactcgttggaacctccgttctgttctcatttcatgaatctacccccacgttgcaaagaggaaacatgggtactattggttaatggcaggggtattattggaagttattgtggaaaatatctgagccgttaccgccgaagatgacgtcacctttagagaaatagagagagctgacaaaagaaaaaggtaggttggttaatatattgggcttacaatctcatttgtatttttgatgggcttaaaaataaaattgtcttctacatttttttgtttccatttgttcaaagttccaactgctgaaaagtgaaaacaaagagacatttattgctaaagtgcagcccataaaataactaaaatactaaaattaagcactaaaattgtacaacaatgtcattagtttttactaaaatcttgaggatttgtcattttgaacacttaaaactgtatgtatatataaaatgtttttgcaaaatatgtactttaaaccaaatactaaattttaaaaacaaatctaaccgactatatccacgtattaactggtatctattattaactaaaaatggcaaattcacaaactatatggaaaattgcaaaatcaacaaatgtcactttcaaaagtggctttctcataattgattctttttataaaaaaaaaaaatgagacatatattaatatatataacaactttggtgactataagctcttagagtaaaacaaagtcactatattaaattttgagaagaaaaataatcctggaaaccttaatgttttatgatacaattttacacatagatatataattacatactttgaccagacacatattttttaaaaaaaaatctccagtcagtggctatttgataaagccactaaaaattcttgaccaattttgtggccactatattgcttatagtataaatcattcacaatttggatcataggttttattcatcaattttgtccaaaaaaaaacttaaaattttgtcaaaaaactatagtataaaataggttttgtcaaaaaaacttaaaattatgctatttgtgaaaatttctcttttatctatttttaaattactttgttaattaatagtgctatattcttaattcttgtataaaaatgtgttattcttgcaaatcaccctctaatttttctgatatattttccaaaataaaataactcttcatcttcctcactcactctctctctactccactcttcatcaagcgttgagtcatcgccgtgttgttccttttccttccctctctagcgtaagctccagatttcttctattctctgttttcacagtgaaatctctcgtttaatgaattttttcgattcccctatgcatttcgtgatttaacgcctttactcacttgttacttaaaaatatatttttgatttcgctaggttccttatcatgcatgcgtcactctcttagctcaattttgtaaatgctgtatcactttcgtctcttttgctttatccagtgtcaattttgttttgtttgttaagttgttgcctagggtttctcttgctcgtgggattgcctagaaattgagtctcttttgggccttattttgttcttcttctctgtttttgtaacattctttttctccaggtaaagcaggtacg

SEQ ID NO: 9192 - DNA, 3000 bp, Unknown
  misc_feature (1)..( 3000): cDNA_ID_3609923_gDNA_ID_1972020_Annot_ID_178048 3000 nt of promoter + ATG
gtgtgggtttaaaataaaaaatggcctataattaatctagtgtctgactttgttctatgtataactttttttacattcatagacccttgtttctattcttaaaaaactttatatgataaaacatgcaatgatcatatcatacgtcttatccaaccagaatacaagagtcttgacatcattctcaatggtttttctaagcgaacctgaagtacacacatcaatacacgcctcatatcacaaaaaaggatgttattttgacaattatatcgtaacacatgttaccatctatgcatgccttcaaacatcaaagtcaattgaaggaaacacacctctcagttgtcggtgacttcccggatcatgtaaagatgactttttgaaaaccaagaacatcattgcccactccaaagctgttacctctcattccaaactcgatcgtaatcgccatattcaagaaatacgtacttggagatcatgcacaaggctttttaaaaatagaccgaactttactagttactatctaccaatcaggttatgaaagtaggcaaaaggggaagggtcaaggcccatgagacatattttccaaatagacactaaaaatgagccagatttttcaacaacacatttggtttaagggctcaaaaaatatttgtcaacacccagttttaaaacaaaagaaaatagtaaattacaggcccaaatgtttttgttgccctatagatattagtatttcttaaccagtcgctgataattattgatgaatagttgagagacgataaagattgagctgtcaggaatacaaatcaaacatgatattgttcgtttacattattactcaacgaacattcacgtttccaaattctgatatcttttctaatatttctccacatgtagcatatcattagttactgtttaaaaatgagtaccaaaaacgtgaaattattacaataacgtataaatgttaaatatttcgagcaatcaatacttgtcaagactcattgttagtaatgcatcactataattcattctttttttgtcttggtcaaacatgtatgaagcgagcagagtctatgaatgtcatattatagacatacgtatgcggctttggtcgggaccggcccaataaaacaatacacatgttcaacgggttcttccacgtgtcaaacttatgttggctggacggtatgtgactgtgcattgtggttacgtttccaaaatgaatacgtaagaacttttcctaaattatgtcttttgcacaatactgtaagtctgtaactatggtactaaacattataatatcgaattggaaacatttacatttgagaattttagtgtttgttggcaacgaagcatgtgagatcacagagaagcaatactcatctctgagctgttcaaacagttttacatgtcagcacccaaatatagtcactatattcaaaaacaaaattatttacttgcattcaatgctagccttttttattcggtccacaacaaattataaatatttgtatataagaaaaatcagagacctgattttgtaatgcgtggcttgtcaatttcaagcaacacagaaaaaagctaactaagcaaaaaacaaaaaaaaataacaagtggctggttgatagaatgtatctttcatcagtacataacactgtttttttgtcaacgtaaaacagatttttataacttttgtttgccctcaacttttttcattacattttctggaatatcgcatggttgaataattaaaagttaaaaatgatttttatgaagcacggcattatactatatagtcagtcccaacgaaaatgactttacataaagctgtcaattttttctccaacggtcagataattgtttcgttgaatagtcagttttttttttactattttactattgggctttattgggctcttacaattttatcgatttttgtttaccgtccagaaagtggaccctgtgggaagaggaaaagaaaaaaaaagggtcaggttttttgtctttatacgagagcacatcggtacgttccagaacaaccctctctagtctcctccatcattatctttatttaatagtaaccctagtacaaattaccaaactattcaacattaacataattattcaacattcaccatcatgaataataactagttgagaaaaacgtaactagactagtttgatctgtcaacataaaaagagaaaaaagaatttcgtgactagtaaagtttaagaccattcacaaatgatcattgaaattattagttctaaactcttagtttggttatctatttggttttgattcgtatctatttggttattcggttttttggttttaaagtttagtattcattcgactattttgaaattttggttcgtttttttttttttttttgaaatttaatatccattcgattattttgcttttaatatttttaaatatttcaattattttttgatattttttgaatattgttactatttaatatatatttttaaatatttttaattactaagtatagaaataactaatatttttgaaaataaaattatattttggatattttagatcatctaaaatattttagttaggtactaattcatttttggttattttgattataaaatttaatatctattcaacaatttttaaattgttgattcaattcggttctgtttttttttttcatttaggtttagtacatttggttcagtttatttgactctcagtttatttgcctaagccttgaaattaggtgttaactattggttattctagttgaaatttgaaataaagaaaaaactatacgttatactattttattttcttagcaataactaaaaataaatgtttggaaacgttaggcaattttattatattctatcgttgttctctataaatgaagtctcgaccacacacttggtagctacacacgagaaagaaaaagctcacaactttaacctttctggagagagaagaacaaaagagggagagggagagaaatg

SEQ ID NO: 9193 - DNA, 3000 bp, Unknown
  misc_feature (1)..( 3000): cDNA_ID_3045000_gDNA_ID_1972020_Annot_ID_178051 3000 nt of promoter + ATG
tacttgtctcctctaaacagcccaggaagaagatgggaaaagagctcaactgctcacaagaagtctgcttcagcggatttcataaatcttgtgaacatcaagaaagaaactcatgcgagccaaccagaggaaaatactgatattcaggtctgcaatctaagcaaagaacctgatgattctatccaaccaatcgcaagtgaacctaatgagaaaagtgttgacattgaggatgaaactgctaacgaagataacatgttttctgcaggtaataatatttctgtctcatagtaaggctctctgttttgagtaacaataatttattttataacctttcttccaggttctgcagatgatgtgatgattcccaatgagctagatgaagttccagaggaagcaagctctacattgattggtgacttatcaaaagttgaagctcaggatgaacagagagatagtataaactcgaaacaggcaagtcattttgattgacccctagaacattaccttttttgtatggactttaaaatgaggaaatggtggaagacttaaattggttttgctgcttctttttttctacagacctctcttgaagagagccaaccaccactgtcttcctctgtggcctcaccatcccactgtttagctcaaactgaggagtgcaaatcagctattactgattttccggagtggtcaagcccaatatcagttcttgagccactcttcgtcgaagatgatataagcccagcaaaaatgcgatctcagtctggtatgtagaaaaagatcccaacatctactactagacttggattctagtacttagttcttcaatattgactcatttttacaactcaggtgaagcagaggtgcaaccgtggtgtatccacttcgatgaaaaagatcctgcacctacataccgagaaaattctgtgacaagtgacaaagaattggtgtttaagtatgtaaaagctgtcttggacgcagtagactcagacatcgaagagctctatctaaaggcgcaattctctgaccagcttcttgaaccagcacttatcagcaatataccattctgtccaaaccagctttgtcctgaccatgagctcctctttgactgcatcaatgaagctctcatggagttatgctgttgcccaccttgggcttcgtttgttacaccaagaaccagagtcttctctaccgtcaaaagcatcatccatgaggttcaagaagcggtttactggcatctcttgccattgccactccctcacgccttggatcagatagttagaaaagatatggctagagctggaaactggttagacatcagatgtgacattgactgcattggcttcgaaactagtgaactgattctcaacgagttactcgaagagctcatcctcaacaatactgagcactctctggtttcacctgagttgaagacggatgggagcatccttattctagaaaggtcttgaaagctgaaaactcttttcttaaagacaaagccattgttgatacactctgaacatagtctcactgtcaccattgctaattttttttagcacagaaccatgtagatagtttgtattactcagtcagacaaaaacctcacggagctcctgtctgatcagaaactactgagagggagaaggaggaaatcagatcctttcaaagaccagaccagaaactgttagtggtggggtcatcagagaatcactttcaaagacagtcttcttcctataggctattatatagtatatgatttattattttattttagagtgtttgtgtgaagatggagggatgtgatagtgtttgtttgaaatcggtttgtgtaacattttcagagtttgacataacaatgtattatggattaggagtatgacaaattcaaagtttttgttgttcatgaaaacaaaaagatataaattgggtatgttgattactagacatgaaactagaaagttttgttaataaaacctaggaagagtgttgtaaattgtagtctaacaatggtgggttgataacaggacaggataaatatcaatggagttttttttaagtaataggaaagaagcagtcataacacaaatctgtagagatttttactcaatggagaaatgaattttatggatcatgatatatgtatataaagttttggataatgtttttgtagttgttgcactttatgccctacttagtgaataacattttctttgatgggatatggttatgtggacacaatggacagtacacctgataaagatggattttaagaaattaacaaaactgaatgaattatatacaaactgataaataataaagggtttattctttttaatataaatatatttattttaatagttagtaaaattatttcattttgtttttgtaaaaattatgtataacacttatatataaaagatgtataatgcaaacaatcaacatgtcacttatatgttcttgttttagtattgatcctttggttacattattatgtgatatacaagcttattctatatgccattataaatgcttcttggggggatgcttgtaccatttagtgagtcaatctccgatctaatataacgaactgaacgataaaaataattattatcctttaaattatagtcgttgctatttaatatttcttaccttcattttcttattatctcacgttctttgatttgaataataaaaagcgaatgaaagtaatagataatattaaataataacggtaatttaaatacaaaaccaattttttattttatttttattttaacatgattctaaatactgatgaaaaaaacatgaatctaaaatactttcaactataaaatcaagagaatcaactctctctcaagtgctcacaagatcaacacaattaccaacctgcaaacaacacaaacacagtagcattctcaagctctggaacattaggcaaaggtctctctgctacacgagggtgtcgaccgaccctttagcaaaagagataagggctttgaa

SEQ ID NO: 9194 - DNA, 3000 bp, Unknown
  misc_feature (1)..( 3000): cDNA_ID_2038467_gDNA_ID_1972020_Annot_ID_178050 3000 nt of promoter + ATG
ggaccttgtgctcaaatttttgttttcagaaaatttaaagtgttagttacaaacttttaaaattttggacccttattgcaaaaatatcaaaaaatttagatcttaaaaccttgttaaaattagaaaaaaatggtggatccagtgctttagcactgcctctaagccgagcctgcttatacatatatgcagagaattttgcactatttgaaacgcaccgcattgtacagttcggtcaccattaaattgtaaatgatataaattgtgataataatacggtttagatgcttagaaactccacgttaagggaaaaattgcttacagtgtcactaacttcgtcagtggtttgtacccaaaaaaaaaaacaattcctcagtgggagagagtttatgtcgtcaatatctatttgtcggtcgataagtgccaacctcaaaaaacaatgacacgtttgtatcaatttctgaatcttaatttatactataaaatagtgtatacgtttgtacgcgtgctattgatagataagtggtaactatgtgtgttttgtgtatgtaaatgtataactatggtcccgtccctgactgaattaagttgcttaaagaaaactcaactcaagtaactgagcatggtcaagatctattcgattaaattttgatatatataccaaatggtttcgacttttgctaattgctatgccacatgaatcagacaatgctagctaattatttctgttgtaccataaagtgcttggctttatcagtaaaccccacataacaacattttgcttaacggaaactttaagtacgagttctaacattcaattatgctctgtttgattagattcaaacaaataaatagtttcttgatattgtaaagttctatttgtgtatttaatatcatatataagttttttttgcgattcaaactcgagttaagatagagacgattgacgtgacgttacaatatatgcacacgagtcacaacaaaatattatatctataatcgacggttgaaacaagaactctagctaatgttttggttacactcggttttcggacatggtttagaaaagcacaactcttccttaagagaatgacaaaacgtcgtcgttaactttagattaatgacttggtcaatgaaaacaatcgcatttggtgtaataatctcaaatactacgtgttctccatattccataaccagccaagcaaaagcaccaatgaccaattacgtctctcctctttggccgcgcccactcaattcttataatttatctatttgcaccctctttctctaaaaagttacaatttgacccctatagtttcactttcacttattcttataatttatctatttgcacctttttcctctaaacgttacaatttgacccctatattttcacttttattcatacaagcccattttgtttttctctctgctttcatgctcgcagacaacaatcctcgtcactgccatgtctcaaattcagagctttgagagatcaattatttaccggtgaggctaatgatgaaggctgttgaaaaaatctctgcaaaatacttttcttccatgtaaagcttctaactttttctctctctctctctctctctcctctgttgtttctgtagagaggaatagaagatgatgggcccattttccaactgtgattgttctctttatatttctttctcctgtggaggctagcaaaggccacgacgttgtggttgtcaaattggcataaagttttccacttttttactctgattttttctcccatttctctctcactttttctttgcctttgcccaattcagagaactaatggctttgtcggtcatcgatagataaacaaaatttaatctttatctctctctttctcttgtttgtcaaaagatgcccaccaacacagaaatgaggaaaaaaagatctcttttttatttgaatgttgaacagtaagaagaaggtttattctattctattgggttgggttgttcatcaactttggaaatttaaagatgcattttttatgatccttttttctccgcctttgttgttgatttgatcgtgtatgattacggaagcttgggggggtttttatcagacagaacctggaaaagttgtcagatgaaacaatgtggcttggagattggatcatcaacttttcctctgttttcaactttataagctatcattttgcttaatcttcttcattctcttctctcggccttggctttgaagaaatctcaattttcttcttcttcttcttctaccgttttgtccggcgatcagagctggttcaggagaaaccttaagtcttggtatcaaaagaaagaaagttttggaatttacctctgctgctgcaacttgcaacactttttttatatatattggatttttctatggctttgctcaaacgtaagcaaagcagatgaaatctagctacaatcgctgttgcccttgtatgaagtttggaatttaaggaattcaggagaatctaagaggtactttcttgtactttcctcttctgtctttttccaatagggaaaggtatcttatttgctccattagtctgtatctctcaggctttgtgttctcttagttctccttaatctttgccttattagttgaacaagtaagcaaattataaaaggagtttgctttagggaactggtagaggatcctttacttcttacttgttatcttaatttatttctcaagaattccattgcagtgtttaggaaggctaattctttcttctctttttaagtactcctaagcgtggaaattttttggtcttgttctcttgttgtttgttactcaaggatctgagattgttgtccataagtagaatttaccggagttgtaatttctatatctgaaactcattattgtaccgttgtgtgtggtgtgtcttatagtttgctgcttaatagttttcttgttcttcttcagcatttctaaaggggcaacgttatagaaggttaggaaggagcatttgtatagaaagtc

SEQ ID NO: 9195 - DNA, 3000 bp, Unknown
  misc_feature (1)..( 3000): cDNA_ID_2038484_gDNA_ID_1972020_Annot_ID_178045 3000 nt of promoter + ATG
aaatcaaaaatttcattatttttataagattcacgcgtagacataatgacactaaaccagtcaacaagttaaattagattatctagcttaatcaacaagcaaatcaaacgtttgcttagattctcaagttacctccaaaacacatcttacactaaaccaatcaacactcaataattcaacttaactttaccctataatcgaccaagattggataaaaagattggaacagtaccttgcagagagacatgaaatcatgatcagaggttcgatcaccgaggccgagatcaggtgattcgttaccaaactcttttaaaatggctaacctcttaagatcaccaacaagaacaccaggcttcttcacaaatccagtggctctattggttttagggttaacttcaatctctgttcccaaaactttatcacctccaagataatccttcacaaacgcctccaccatcacaatcggattcgccgtcactaccacttttctcttacacttatcaaacacctcaaaactgtctttcctcacatccgccgcgtaaaacctaaacaaagttcatcagaaaaaaactaaagtgatctactaacaagaaaacactctatgttagatctcgtaccgtggaagaactgcgcgagagacaagttcgatatcgcggattttgagaccagcgaatgagatgaagatgaggatctggataccaagagattcggatacgaataggtaagagataatgacgaatggtaacgagagaaggaggattagtccacgtaaaaggcttccagcttcaacagcgacgagcatgaagtaagggaaggagcttcttgagagaagcagagtcccgtcaagatcggcggctatcgaatcgtactctccgtctctgcattccgttattggagggaagttttgactcttcttctccggagacattttcactcgctgtgtgtgtgtctctctctctcactctcgttaatggcagttctaaagaacagagagcaaaaataagaagacaagagagggaacgttatgttttaaatgcacctatattgaagaccgtaatattaattcagtgggttatatctataatctatatctatgtgaatgaatatgatatatatatatatatatgtatatgtcattaactatgaaatatccactaagagcgtaaagtgtagggccacatgtcgaattcattatatgaaaatgattatatgcatctatacatgtggtgatattgttgacacagtcgaattgtctataatctttttagagactttgtcttagatttgggtttaattatttagttgaagtgaagttgttagaaaagttttagatttaatgtagcttagatatcaactatatattggtttagttactaaaccaatatatagttgatattagattttaattgcattactgttgggaataatttaaatcttggagatgatattgaataaactctgttaaatttcttaacccatcaaaatagggaaaataataaaggatattctagaaagctttatgaaagatcagtgttagccaaaaccgacaagaaccggaccaatacgggccgtaacctcattctagaaacgatcttatcatttcaatagaggcggtggctcgagtcaaaatcccacgtggattagggtcaagaagacctctctataaaatgtaggactaattcgacacaaaggaaggaacaaaatcgaggacaaaaccgcaaaacacacgacttaattttaaaacacgactataatttatagattaacttgttatgccttgatttttgtattttgcaatcgatattttgaccaataaaaaaattatattcgattatttttatatttttttttgtagaatgtcacaaattgattacttttgtcaaaataattagttagtgtaaaaatatatatgaccacaacaacaacaaaaattcttcgttgtgcaagttaggttgatcttgttctcactacttgagcagttgagcttaatttgtttatttgaccgttgggagttgcaccgctttgagccgcacatttatgctcattaaacatatttataaaaaaaacgcatgaaagtgtttgaccagagacaaagtgtattagaaattcactaggcttacacaaaaaggcatgttgagctgtattagaagacccttaacaggcctccatactagtcttgaagatgggccgaaattcactaggcttaaagatgcgccgatattcactagtcttaaagatggcaccacagatggctccgagacattgcataatcatgtagaacactgctctggtcagagacaatttccgagccaagaacagaccaaatgttacgaagaatggattatataatacagtacagtatatggttttgccttcttatatatgtccacatcatttaaaatcttaaaccaaaattgaataatttaaataactcataaaacttttatatgtatgcttgtcttacattcaaaatgcgcattatcactagtttaatatttctataactgatcagtttttaattggttgacaccaaatgaagtggtcactgacgctataggattctattgggctgcatattaaagtttttttaagaattggaacttttaatattatctagggttgaaggaactaaaacgcctgtcctactgatgtaaggctagccctaacctacatgtatctcaagcgtccaaatttacgttaatacaattttcaaagcattgtttttcctctccttggagaaagtacatgcaaaatcaaaattaatggctccgacttttcgaatcaccgcaagctactatctcttcgagttctggttataatagtacttgattagatacttcttataaggcttaaaagccaacttaaatgctattgcagtaaagatttcattccttcttcacttcactttacgaatctaaaggatatatttagttcttcttcacttcaactaaaaggctaaactcccaaaaaaatatttttatctctctcaaaacttgaaat

SEQ ID NO: 9196 - DNA, 3000 bp, Unknown
  misc_feature (1)..( 3000): cDNA_ID_3045007_gDNA_ID_1972020_Annot_ID_178040 3000 nt of promoter + ATG
agcttttgcctctccagttcagttagtgcttcatgtttttccaattgtttggcccgagactccaagtcccgcatcttacgatccagttcatttcttagcttctctttatcatataggattctctggatatggcgaagtgacatctgctgcatcttctttgtttctgagaggagataaagtacaaaaaatagtcagataccctaaatgctatatgagtcggaaacatatcagtgtgtgagtaaataccttcagcaaaagcttggtgcaagttttttttctcatctaggaccctttgcagtgacattgccgtcctgttgtaactgtgttgggccttgttcagatcttcgtttgtcatatcaatcatatttgaaagtacgtccagaagagtgtttctatcctgcacattgttttgcaaaatatctgaaactgttcttagcgttccctccttggagaggtactcacctattggaccttgagattgaaagtcgtctgcacgtgcacaccaaccataagcctttgactctgaatctccactcctctcagtccactcttttttgcaggacccttgggtctcaaattccttttcaagctctgtggcagcagcaaacccactccagtcactgtcaaacttagcaataaccccaacaatcgaatcttgttcgacccaaaaggcattcacttcaacaggcttgaatttggaaagggtctgcagccaatatactgaatcaagtagaagctccttgtcatccgtttctttcaaagggttaacaacaatccccatccatggccagacatagacgttatgaggatttggttcagtctcgtctaacagaggaggaacaaccggagggcgtggaagaggttctgcataaccagcaagatcattctctaaaaacttagctaaagcaagatgattagacttctgtaaagcacttctggtggcagaacctttggaaacaccagtagcatgtgcatgcaactccttgtacttgtaatcttgcttcttcttgcctacacaaaaggggcatctgagccgtccattcaccttcaccttgtagtaagtctcactgcgtaaaaggtggtagggtgttttagaatactcctcaatctctgactcgctgatctcagactcttcatcagaaatgtccatcgtacctgctttacctggagaaaaagaatgttacaaaaacagagaagaagaacaaaataaggcccaaaagagactcaatttctaggcaatcccacgagcaagagaaaccctaggcaacaacttaacaaacaaaacaaaattgacactggataaagcaaaagagacgaaagtgatacagcatttacaaaattgagctaagagagtgacgcatgcatgataaggaacctagcgaaatcaaaaatatatttttaagtaacaagtgagtaaaggcgttaaatcacgaaatgcataggggaatcgaaaaaattcattaaacgagagatttcactgtgaaaacagagaatagaagaaatctggagcttacgctagagagggaaggaaaaggaacaacacggcgatgactcaacgcttgatgaagagtggagtagagagagagtgagtgaggaagatgaagagttattttattttggaaaatatatcagaaaaattagagggtgatttgcaagaataacacatttttatacaagaattaagaatatagcactattaattaacaaagtaatttaaaaatagataaaagagaaattttcacaaatagcataattttaagtttttttgacaaaacctattttatactatagttttttgacaaaattttaagtttttttttggacaaaattgatgaataaaacctatgatccaaattgtgaatgatttatactataagcaatatagtggccacaaaattggtcaagaatttttagtggctttatcaaatagccactgactggagatttttttttaaaaaatatgtgtctggtcaaagtatgtaattatatatctatgtgtaaaattgtatcataaaacattaaggtttccaggattatttttcttctcaaaatttaatatagtgactttgttttactctaagagcttatagtcaccaaagttgttatatatattaatatatgtctcattttttttttttataaaaagaatcaattatgagaaagccacttttgaaagtgacatttgttgattttgcaattttccatatagtttgtgaatttgccatttttagttaataatagataccagttaatacgtggatatagtcggttagatttgtttttaaaatttagtatttggtttaaagtacatattttgcaaaaacattttatatatacatacagttttaagtgttcaaaatgacaaatcctcaagattttagtaaaaactaatgacattgttgtacaattttagtgcttaattttagtattttagttattttatgggctgcactttagcaataaatgtctctttgttttcacttttcagcagttggaactttgaacaaatggaaacaaaaaaatgtagaagacaattttatttttaagcccatcaaaaatacaaatgagattgtaagcccaatatattaaccaacctacctttttcttttgtcagctctctctatttctctaaaggtgacgtcatcttcggcggtaacggctcagatattttccacaataacttccaataatacccctgccattaaccaatagtacccatgtttcctctttgcaacgtgggggtagattcatgaaatgagaacagaacggaggttccaacgagtagaagatgatgtgccacgtgtcactatatcgacccccctttcctcttccttccttccccaatagagagggattttcccgcttcagcgtctctcagtctctctctcggctttatccaaaggttccttcgtttactccgcttctatggaagaagcttgaatccttctctcttcttcttctccttcttcccttgacatttttgttctgagaagcaacatg

SEQ ID NO: 9197 - DNA, 3000 bp, Unknown
  misc_feature (1)..( 3000): cDNA_ID_3087810_gDNA_ID_1972020_Annot_ID_178036 3000 nt of promoter + ATG
tcctcttcttcttctcctcttccttcttccaccaccatctgtacaaagcaaagttatcatcaaaggaaaccaaaccattctgagtttcaaagctattttccggcttggtttcttcagcaccaccaatggttcctccaattggtacttgggtatctcttacgcttctatgccaactcccacccacgtttgggtcgccaatcgaatccgacccgtttcggatcctgactcttccactctcgagctcacctccaccggatacctaatcgtcagtaacctccgtgacggcgtcgtttggcagacggataacaaacaacccggaaccgatttccggttctctgaaaccgggaatctgattttgatcaacgacgacggttctccggtttggcagagctttgacaatccgactgacacgtggcttccggggatgaatgtcaccggtctaacagctatgacttcgtggcggagtctcttcgatccttcgccggggttttactctctgagactgagtccaagcttcaacgagttccagcttgtttacaaaggaaccacaccgtattggtccaccggaaattggaccggagaagccttcgtcggcgttccggaaatgaccattccttacatctacaggttccatttcgttaacccttacactcccacggcgtcgttttggtacatcgtcccaccgttggactccgtttccgagccacggctgacgcggttcatggtcggcgccaacggccagctgaagcagtacacttgggatccacagacgcagagctggaacatgttctggttgcagccggaggatccttgccgcgtttacaatctctgtggtcaattagggttttgtagcagcgaattgctcaagccctgtgcttgcatccgcggtttccggcctaggaacgacgccgcgtggagatctgatgattacagcgacggatgccgccgtgaaaacggtgattccggcgaaaagagtgatacttttgaagccgttggtgatctacgctacgatggtgatgtgaagatgtcacggttgcaggtaagcaagagctcttgcgccaaaacttgcttaggaaactcttcttgtgttggtttttatcataaggagaagtctaatctctgcaaaattttactcgagtcgccgaataatctgaagaattcgagctcgtggactggagttagtgaagatgtattgtatatcagagaaccaaagaaagggaattcaaagggaaacatctctaagtctataattatattgtgcagcgttgttgggtcaatctcagttcttgggtttacattgttagtgccattgattctgttgaagaggagtcgaaagaggaagaagactaggaaacaagacgaagatgggtttgctgtgttgaatcttaaggtattttctttcaaggagcttcaatcagctaccaatgggttctcggataaggtcggacacggcggttttggggcggtgtttaagggaacattaccgggttcttctacattcgtggctgtgaaacgcttagaaagacctggaagcggggagagtgagttccgggcagaggtatgcaccattgggaacattcaacatgtcaatctcgttaggcttagaggtttctgttcagagaatcttcataggcttcttgtctatgattacatgccacaaggatccttgagttcctatctgtctagaacaagccccaaattgctaagctgggagacccgtttcaggatcgcgttaggtactgccaaagggatcgcgtacttgcatgaaggatgcagggactgtattatacactgtgatatcaaaccggagaacattcttttggacagtgattacaacgccaaagtgtctgattttggcttggctaagctccttggacgtgacttcagcagagttctagccacgatgagagggacatggggctacgtggctcccgaatggatatctggtttgcccatcacgacaaaagctgatgtgtatagctttggaatgacattgctcgagctgatcggtggtagaagaaatgtcattgttaatagcgatacactgggagagaaagagacagaaccagagaaatggtatttagagaatgtcttttacttggaatcaattgtaagagagaaaaaaacatatacattgaatcaatgaatcccttttcaggttctttccgccatgggcagcgcgtgagatcatacaaggcaatgtggactctgtggttgactctagactcaacggagaatataacactgaagaggtgacgaggatggcaacggtggcgatatggtgcatacaagacaatgaagagataaggccagcaatgggaacggtagtgaagatgcttgaaggagttgtggaggtgacggttcctccaccgcctaaattaatacaagctcttgtctccggcgattcataccgaggagtgagcggcacaagctgtagtgaaggccatggctgttcggatctcaatacaggtttgtctagccctggctcacggtcgtcttttggtagaccttctccttgatcaattttgtaaggtgatttggtcaaaaccagccttaaatgttttaagtgttgctctctaagagggtttaattagtttaaactgtatttgttggttgtatgatatttgacttaatcgacattaacagttaaaaccatggattatgtctttcttcttagtttgaaagttcttgtcactttgataatcttctaatggcatatatgtaaattcttacagaatgtattgtatgagaatcattacgtgattgaatcaataaacccatgtcgatactttaaactatatgaacggtcacaataaacccatgttctctcttcttctactccacggctaaccttaatcttaggcaaaccagaaacacaaattacaagaacaaacataaaaaagaatctcttgtcttgtctgctttcaatcctcatgtctctaatcctccccaagtagagaaatataaaaacttagacaaatattgccacaaccggtgaaa

SEQ ID NO: 9198 - DNA, 3000 bp, Unknown
  misc_feature (1)..( 3000): cDNA_ID_3051180_gDNA_ID_1972020_Annot_ID_178030 3000 nt of promoter + ATG
tcattcattaactcgctcttggttgcttattcaagatttatttgaatggatggtacgaatgtaacatgtgcagtaaatattagatttaatgtcttagtgagcattttgcaataaaaatctgtggatttcatgtttattacaaacagtttcttataaaacatttccttcattattcattaagaaaattaattaagagcacaaacatttccttgttcgtttgccctagacaaggcaataaatcatatcctagagaagcgtaatcgatcattcgattttctttacctaagcgtacaattgaatgttttcttatattatttcttccgttcctttgtcttattattccttaagtctatgttcttacttacgttcactctttttttcttggttactcggacagattccaagtttcttattctacaagataaatgaatcttggttaaaatcaaacgtggaggttgtgaagaaatggacaagacaagtcagttgcctgatgaattgctggtgaaggtattatcatttcttccaacaaaagatgctgtaagaacgagtcttttatcgatgcgatggaagtctctttggatgtggctgccgaaactggagtacgattttaggcattattcagtttcggaaggccaagggttagctagatttattactttgagtctactaggacataaagctccggccattgaaagcttgagtctcaagcttaggtatggagcaattggatcaattaaacctgaagatatctatctctgggtttcacttgcagttcatgatagcaacgtccgtgagttaagtctcaagctttgtacttttgcggagcgtccaactaaattgcccaaaagcttatataaatgcaaatcgattgtgatcttgaaactgaaagacgagattctcgttgatgttcctcgtaaggtatgtctcccctccttgaaaacattgttccttggacgtgtgacttactcggatgaagattctcttcaccgacttctctccaactgccctgttcttgaggatctagttgtggaacgagatagaattgacaatttggggaaattgagtgtggttgtcaagtccttgcagagactaaccctaaagatgtcttgtccttgtcatcttgatgggattatgatgaatactccttctttgaagtatttgaaagtcactgatgaaaggcaagagagtgatagtgataatgagagtgatagtgatagtcctcgatacttctacgattttgaagatatgcctaagttggaggaggcagattttgtattgacattccaaaatatcaaaaagttctttaaatttgtcacatctattaagcgtctttcgttatgcttgggagtctacaccgaagaggtaatctgtttccatcaatctatcaaacttatttttgaacaatattcttgaagttgaatcttttgtcatcttatgcagtctttatatcatgagggtcttgtcttcaaccagcttgaacaattgaagatatgttcatgtgattcagattggtcaattttactttctcggttactcgaaagttctcccaatttacgagagctcgaggcttacgtgatagaagtaagtttcttcgttagagacatattccattggttcaatttactatattgtttaagccaaacttctcatgtttgatcacaggatcatccagataggcgtgtggatctaccaaatcagtggggcaatcagctgaattgtgttcctaaatgtttgttgtcgagtctcgaaacgttcaagtggagtgagatgtatggattgctgcagaaccagatggatgtggctaaatatatcttgagaaatgctcgatgcttaaagtctgcgacaatcttttttccgacaacctatgctaaagaaacaagagatgagatgatcgaggagttgtcactttcttttcaaggtccagagacatgccaagtcttcttccattgaggatgtgaatcataaggattcaaacttgcatttccatagacactaccctccatattacaatggttttttatttgcagcaacttgatctaaacttaaggtgttttttttgtctttgttttttttgtatactttatctttgagcatactatttttcttgagacattggctttatctttttctgagatcttaacaaataaccgaactttgaagagacaagacatgacatgaacttttatttgcagcaacttgatcataacacaagactcaaacacaagactcaaacacaagactcttcagcttatagatcataaagtagatcaatagcacaaaaagatatcaattagaagatcagtcaacaatatagatgttgtagaaatttgcatcctaataaagttcattacaaagaaatgacccaagtttcccacacatatccgcatcaaaaaaacaagtgccataacattgcattaagattcatattcatattaccaaacagagcacttgcacacatacatcaacacaaaaccggcaagaacatcataggaacactcatttgaaaaaacccaaggaatagattcgactatgtaaacacaaacaagtatctaggaaaatcaaaaacataagtaatagaagaatatgttaccttcaaagaagaacgagattttctcagcgctctcaaacccgggttctcaaacccgaaccggaccggaaccggaccattacccatttaacccgacggtttacccataagccgagccctaattttttcaaagaaaagggccctaaacttttcgtcttctcgcttcccttcctctatctcgtcttctcgcttcccttactctatcccatagaaaaaccctgaatttggtttggccaatgatgtcaaaactcttcattgatacttaagaaagttttctccattgttcttcttatggtctcattcacatttggtaagtctcttcaacgattttggttttgtgagcacttacttcttcttacaagaattacatgtctttgttcaggttgtaactgttgatctgtttctgtcacaaa

SEQ ID NO: 9199 - DNA, 3000 bp, Unknown
  misc_feature (1)..( 3000): cDNA_ID_2038555_gDNA_ID_1972020_Annot_ID_178018 3000 nt of promoter + ATG
ggttatacataacaatattgatattaaccattcaacttcttctacgtgaggaagatatctgttgaaaatcacactttcactctcaaactacctcttccaacattcttttgaggtcagcactctcactctcttgtcactctgttttgcttttgttttctttagagagaaacaagaacacgtttaagagcatgatgtcttgataataaaacttgggtgattctcttacaagatacaaacacacatacttattatagttttacttgaaacacttacacacacaagcatgctcttaaacgcataattaactctgatttcttgcaagctactctactacatattgggactctaacaacaagcatgctcataaacacaatttatgtttctttttatttcctcacctactttgcagtttcaagatgcagaatctcttaatttttttattatagacataataacttctgtgaaagattgtaactaaatgtatatgttttattttggttgcatttggtacttgagaaagaggaactagtgtcaccagaataactcaaactgcacgtaattatcataaacaataaatatacaatttacaaacatcatttcagaatccattttgtttaatgaggttgaacctatcaccatataagctatttagaactcttgttgaatatgtttgtgaatccattctattgtgtgtttctttgttttgtaataactctggtcatgagttttgagtagagagacattaaaaaaagaagcacatttacaaaatcctaaaagttcattacaaccatcgaccaaaaggtttgttagacaacttatcttaatcttgttatagctaattctcacacgagaatccaaaagactaaaaatccataaacgtagatagaaagataaaccctaagatagataacaaaagagggcattacatccttagattaaccctatacaatccctaagatagcttcttcttcttcttcttcttagttggtttgagcaagcaccgaagtcacatccttcaaaacatccatctccgccaacaacaactcacatttcttagcgtccacaaccttcatcttctcttgaatcttcttcttagtctccagagacaccttgctccacttcttcttcacagaatactcatccaaaccgagattcgcgataaccggaacaagaaaagactcctcaaaccactccgaatctgctccaagaatcacttgctcatcttctataaccaaaggtttctccaccttcttctccttgctattagccttacccttaacaagaatagattcatctttcttcacaggagattcaacgttcataccatcagatccccaaatcaaaacagccaaacccaaacatttcttatcatgattcgattcaccacttttgttcttccggttaacaaaatacttattctttaatcttctaatcttgtcaaagaactggacatgactaacatcaaagcttatagatttcttggcgatatcaaaaaacgcattcttatgatcccaaggacttgtacctgtctcagctttgaaatcaatcactgcctgtagaagagagatctcatcttcttcactccatactctctgaggattcgcctttttgttatcgtcctctttcttaactcttttgacatgcatgtcccttgaggtgcttccttcaccagctcgcttcttccctgacttcaccgccggtgattcagcagcaccttctttcttcttccgcctggttaagacgaatgactgcttctctgagtcatcagaagaatctgtcttagaattcacagcggcggaaggagattttagggttttagaggaaggaactgtgacaggatctttgggtttgctttcttcagaagaagacttaaagatctcttcagaagaactctcaacttcgcttgaagaagcggttgctggactttccaaaggagccattggattttcttctttcagattctcgggtatgagtaccaagtgggaactgaagggacaattttagggtttgtgagttgcgagactttttatttttttacactgtaacatctcttatatttaagaaacaattaaagtaaataaagctcaacaacaaaaactaattaagcccaacaaaataaataaaccatcatccttatatgtaacactgtaacatgggaaaaaaaaacaattttttgcccaaatgtataagaaatttgtataacaaaattcatactagattttcttgttgtaattcttggtatacaaaatgaaaggtttctttgttgtaaaacaaaaatatatgtactaaaagtaattttacaaagtcgctttatatttttacatttagaaagatcatttgatcaagtgggaaacctttattgaaattaacaaagtggaaaagattgtaagtagtgaaatttagtgtcatctatagacaaaaaaaatgtaaattagaatttaggaatatgaattcggttaggattagtcgattaggtttattgagtaaactcaataaaaattactgtagtaatacttcagtactcggttcggtttatagttaccgaactgaaaccaaacgattattctaatttaattgaagttaccaatttttatcttaagtttaattaaaattattgaaaaatatgaactctctcttacagtaaaccgacctgaaattggtttttggttccaatttgacaccaatattttatcttgaaccaaatcgaaatttatgctattaaaattgaaccgagccgaactttactttcggtctacttcggttcaagaaatttcaatccaatacatatgaattctgaaagtcctgaaccgaaccagagtgtttaaccacaataaaagtctcttcaatggtctcttcttgagtatatcaatggtctctcatagtttcaacaacaccaataaactgtcatcttcaagttggagtttattacactcgttccttcaagaaactgtaccgtcgactttcagatttagccatttaggacttctcaagattttgaaa

SEQ ID NO: 9200 - DNA, 3000 bp, Unknown
  misc_feature (1)..( 3000): cDNA_ID_1818559_gDNA_ID_1972020_Annot_ID_178019 3000 nt of promoter + ATG
ctgattttaaataacaaaaatcttaaatataaatcttaaaacaaaaaaaaaatacaaaaatgatattttgataacatgagcattatatgcacatatatcaactgattttaaataaccaaaattttaaatatagatattaaataaaaaataaaaataaatgaatgatgttttggtaataggaggattacatgcatgagtcaactgttgtttaattaacataaatcttaactatagatattaaatgaaaaatgaaaatacataaatgatgttttggtaataggaggactacatgcacgagtcaactgttgtttaaataacataaatcttaaatatagatattaaatgaaaatacatgaatgttgttttggtaataagaggactacatgcacgagtcaactattgtttaaataacataaatcttaattataaatattaaaataaaaaataaatacatgaatggtgtcttggtatcaggagcactacataggcaagtcaactgattttaaataacaaaaattttaaatataaatcttaaaacaaaaaaatacaaaaatgatattttggtaaatggaccactatatgcacatatatcaactgattttaaataacaaaaattttaaatatagatattaaataaaaaataaaaatacatgaatgatgttttggtaataagaggactacatgcatgagtcaactattgtttaactaacataaatcttaattatatattaaatgaaaatacatgaatgttgttttggtaataagaggactacatgcacgagtcaactattgttttaaaaacataaatcttaattataaatattaaaataaaaaataaaatacatgaatggtgacttggtatcaagagcactacataggcaagtcaactgattttaaataacaaaaatctttaatctcttaaaacaaaaaaaaatacaaaaattatattttggtaacaggagcactatatgcacatatatcaactaattttaaaataacaaaatttttaaatatagatattaaataaaaaatgaaaatacatgaataatattttggtaataggagtacttcatgcacaagtcaactgttgtttaaataacataaatcttagttataaatattaaataaaaaataaaatacataaatggtgtcttggtaacaggaacactacataaacatgtcaactgattttaaataacaaaatcttaaaataaatattaaaataaaaatgataatacatgaatagtgtcttggtaataggaggaatacatagaaagatacactgattttaaataataaaatatgaaataaaaatacataaatgatgtattggtaacataagcactacatgcacatgtcaactgattttaaataacaaaaatgttatgttaaaacaaaaataaaaatacatgaatgatgtcttggtaagagaaggactgcatgcatagatcaactgtttttaaataacagaaatcttaactctaaatattaaaacaaaaaggaaaatacagaaataatgtcttgataataggagcactatatgcaaaggtaaacatgtattttttctgcttccctcccattcaaagccttaatcaatgaagttttggctaaaagaatgatctttgaccgatggagtattgtgtcgcttgatgtgatctttttacattagaattgtggtcatttgtctcagggaaaagaggagctatacaatataacaagaggtccttcttgaggtggtgaagatcataaagaagcacggttacgttccttttgtaatattccttggatctcgaaatcgagtacaagttcctatcatgctaatggcggagatggatgaaggcattttacattgtaatctgttcatttaatttggattgctttcattgtttcatttgtttgacatacatagacactaatagttgaggattatgtatttacaacaataaagtgttccactacacaaggtacaatcgatatatatatagtgttaactctcatttgtgtatatatgcatatcagtttgtaggtgttactatgatagtagtacatttattaatttataaaaatttatacgtaaaatacaatattaattttttaaaaagaaaaattttaatttagtttttctttatgttttattgtttgtatattctgttagatttttttttattactttttttattttttctctgtaagatattgtgcatgtatacgacgttaacgtgagacttaatccaattttttattacacaaatcttaacaatgatttttcatataaaaaaagttacaaaaccaaatatgacggatcaaatacgcaaagagttatgtgaatacaaaagagatcacaccaactatactctagaaagagttgcaattatgacttgaacaaaagtttcatataaaattagtctttgaatgtatgctaaagatttatgattattaattttatgatattactggtaccatatttttacatagggatttcaaaaaaaatattatcttattatcttatcgattttggttaatttttacattaccccgatttgagaccgacaaaatttattaatttatcgtgtaatatgttttgttcaaataccttttaatatctatttaataataaaaaaatattcaatcagaaatggataatatataatataattatttacttaaaatatatcagcaatgaatcttaaaatgtagaaaaaactaaattttaatttattatataaaaaaggtagataaaatattttatactattaagtgactaaaatgatagatttttgcaagagcaaaattgtactattgatgaatattaaacagtagaaaaaaagatgaaagtgtttgttttgttatgaatgttgagaaaagtatggccaagtgttactcatcctattttgcttttctttttctctcgggtttcactttttaaaggtcgtgaagattgggaatcactgctctgcatgcgccctagaatcagcaagtctaaagcaagcaataagcatg

SEQ ID NO: 9201 - DNA, 3000 bp, Unknown
  misc_feature (1)..( 3000): cDNA_ID_3040588_gDNA_ID_1972021_Annot_ID_178071 3000 nt of promoter + ATG
ccatacgtgtgctggtctagacagagaatccgacagaagcagcatggcaaaaaaaatcctcagataatctccaaaacaacactaacttgcttccaccagaccatcaataaatacctgatcattatcaagaataccacgtgcaaaaacatgcttctttgtaacatttgcagacaacaccattataggttttgatttcatcataactcagtggcctttcacaatgtttagcagaactctaagaaaatactcatcttccattttccttggaacatagtgaatgcgacttaaagaaaaaacccttggatctctttttaaacgccttattttctccatcccatgtgaaataggccggaatttcagcatataaacaatctctagcacacttaccattctttccaataacattttttctattcaaagtgagccaagccataaactgagagtcttcatttgctactcgttctagaacatctttaatgttagactttggatcaaaataagctggttgttttccttctacatgaaaagataatttctagacaggagttgatttatgttgaattggatatttaaatatcctccaaatagcttcagatgcggaaacgtatctgcaaacaattcatcatgattgacatgaattattgattaactatcacaccaaaccaaattattaagtaaaaaacagagtaataagctaacctgcaatcaaaccaatctttgatctcattcttcttcttcccagctgaaccttattcttgcccaggagtttcagattcaccacctgtagtttgcttaacaagctcaacaatgaagacaactttgtctggtccgttgttgatctatttgaataagtatttaactaggggagtcacacgcggcttgcgcggccaagcaattttgtttgaaatcaaaataaaaaaagattaagcataccacattttatgaaattcgaagaaactttttttaaacaaatgttcttaataacacctcctcaaaaggatatgtcatataatatttagatctaggtttactttatttgttaacaaaatcaaacatataaagcaaaatactacttataagataatacgaacattagttatagataattttaggacattagttttacataacaaaccaaaaccaagaggtcgaatgatacgaacattattttgattactaattgattaagtcaaacaacacatgaatttagtacacgacagcataatgcacactttcaatcttttgaatcggtagaaaccgtctcattagcttcttcaacggccaatctaaattgcaatgtaaacaaaaaacacattaaacacttttaaattacattatttgaagttatataaagcagtaaactatgcaaaataatacatacatctctcaaaattctccaacctcaggtatatccggattgatatccaccggctgcatttactagcggtttgaacaatatttcgtcctgccgttatataattatctatgttatcgtgaagatgtcagtacaaagatcatatatttttttgtgaataagagaattacctgaaaatctatgaattctccaccactgtaacacgcatacaattcgttaacccctcgctgttctccattcttcattaaattgttcaccaaaacccctgattgcaacacattccataacattgttactgaaataatttaacatataagtcggcatgacaaatattattataaaatataaacatgcttaaggctttctaactaaaaacttactcatgatcttgaatcttgaatataagtacaacaaaatcatcccctctgtctacttgggtcaagataacggagttcactagtagcaacaacaaaaccaatcaagccttgcaaaaaaaaggttatttgataagatggtgacaaaatttcaacatatttccaaatgaacaaccagataatcttactaattaagtagttcttgtctagactatcattcaagacctcaggaaatgctacatcagaaagagtgtgttcaagagtatcttttggtggaatcgtgtccagaatagtcaattcttcaaaaacgatctagtaatcgtgcttggtggttcttctatcgtctatcacatgtttcagccgaaagtgatgaatagctacccaatcaccatatttgaatttggagtcaaatcgaatgatatctttatatttgatcttgacctctattctatgatcttatacataagatttcataaatagttgattaaaaaagcagtaaacaaaaccacttttacaatatccgtaagaaatttagtaaaccatgcatacccgcacatcagccaaaaccatacaaaccgaacgatgatctctatctaaccactctcgccatgtgtttaagatcttaactaggatagaccaacaaagtttaatagggctcagatcgccgacgtcctcatccatatctcaccgggacttgctaaacaaaaaccgaagaggtgtaaacgtttcctttataaaattatgagtctaagcaaaaggcattctcttacttataatagtcataatatataataaacgaaaaacatttttaccgtacgattataatttccaagactacaatctattcaacctttttactatgcatggtctctttttcctatgcatcgtctctattatcaattcgaaaattgataaaactattatcgatacgttcacgagtctatatacaggaataaaacatcaatcatacgaatggtgggaggtgctattccctttcgattgcaagatttttctctcaaataaaaattatttcaataataaaacatagttataagatttggaaattctccataatattacaaaagatcaagcatactgtctttaaaacaaagtatttaaacattcattgaacatcttgtacttgtatcttccgaaccggagcatattgaattcgtagcagcccaaacataagcggaggagagtgtactacatataaaaatttaagaagagaaggccgccataatcgagaga

SEQ ID NO: 9202 - DNA, 3000 bp, Unknown
  misc_feature (1)..( 3000): cDNA_ID_2181154_gDNA_ID_1972021_Annot_ID_178084 3000 nt of promoter + ATG
cgctagaagcatctcttcctttcagaaagtcttttctgttcctacgggatggatgaccatgaggaagaaatctacggtgacaatcaaaccagcatgtcttccgtccattgggtagataaaaagactttgtactttccatgcaaacaggacaagacaatttaccatgagtagtccatcctaataacatgttatacgccggaaagtcgctaatcgtccacagtagtactgcttttagattaaaattctgactcaatgaaacatcgtacgcatcgactccagtagaccagaactcttttaactcctcaataagaggttggaggaagacatcaagactagctcgaggatgatttggaccagaattcagaatggtaagaaataagtactcggtattcatgcacataccagggggtaaattataaggagttaggatcacaggccacaacgaatgattacgagacatgccaaatggattgaacccatcagtacacaacccgagataaacgttacgaggttcttcggcaaactcgggatgtaacccttggaaatatctccactctgctgcatctgaaagatgattcatttctccctcctttgattggtgctcagcatgccatcgcattgccgcagctgtcttatggctctgatacattctcttcaaccggtccccaataggtagataccacatacgactatatggtactttggttcttcgacggtcgtccttaggcttccatcttttcgcgccacaaaatcgacattgatcttctttttcgtcttctttccaagatagcatacaattgttctgacaaacatcaatcgtatgatatggaagtcctaaattgcgcattaacttctcggtttggtaatgtgaagtggttgcctggtttccttctggtaaaaaatctgtaaacatttcgcaaacggagtccaccaacttttcactcatattatactccgccttgttgtgcatgagtcgagatgctaaggataattacgactgcccttcacgacaaccatcgtacaaaggattatttgcatcttctaacaagtcgtagaacttatttgaatggttacggaccggttcttccacattctgataactatcatcatgacgatagttatcatcataccccacgttaaaattaaatgcatcgttcaccatatccacatatggatcttctacaatattacccacttcttcatgattctcactaaaatacgtcctattcgtgtaactcgttcctatatccatattcatttcttctccatgcttataccaaacataataatcaggcataaatccatgactaaacaaatgactactaactcttttacccgagatgatgtgtttttcattcttgcatacactacaaggacaatgaaatttacctcgactactctgtactattggctgactattagcgaatgtcatgaattgctcaactcctgcaacgtattcggctgacaaattccccgtcacttcatcaaatctcttgtacatccaatctcgatagaaaccgccagtaccgccataattgtagtttcccgccattatacaataaaataactagtattttttttttctctttgatgttgttgttgttttgatttgttggtgaaagaagagttgcgtgaacgtttattatataggccaatttttgtgactaatttacgactacaactaaataattaggtgtacctacttaccaatgcgaaacatgttttccatctactttatacgactacggtgcgacgtttctacgactacaggacgactagacgacttagtcggcctgtagtcgccatattagcgactaaataaaatagacggtagaatagtcgttaattagcgactaagcaacgacaactatatcccttcaataatataatcgtcaaatagtcgtcacttgccgacactttgccgactgcatacggtagtcgtaaaacaacgactatgtgactacaatttttcgtgttgtcgcaggcgagtcgtaaatccgtcgccaactagtcgtataatgttacgactacgtttattgtcgctgattgtagtcgtcgtttacctgttttcttgtagtgtatgtcaatcacgtataaaacattcttattcttagttagtaacgtacgtgaaaatataatttgttttgttgtaacaaacaaacgaaactaacatcatagattttaagtaaacaaaggttcagactttttttttttttttaatcatcccattacattaattgaaaagaagagttgcagaacataaaacataaaacaaaagaaaacataaaaacagagcataagaagaaaattgtctcattgcattgcattcatcttgactttttttgttaagtttttgtttttgtgtactagatttatttaattatacatgtgtcataattaaaaatttatatatgtattaactatataatattttatttttgtaggtgtgagcttatttttctaggatatttgtgttaaaagatagtgttgcaacgttagaacacaatatttctattgttctttgtaatttggagaagatatttccaccatcctcttttgatgtcatggaacatttgcttatacatttgccacacgaacctcgacttggggaacctgtacaatttagatggatgtatccttttgaacgatacatggaccatttaaagaaaaaagtgaagaataaggcaaaagtagaaggctcgattgtggaacaatacatcaataaagaaatttctacttttgctacttattatagtgaaactttttttttgtatatattggctttttgatgatagcatggctgttgcttggaataaccggagatgatctaacctcccttaaagaagaaaattttgcaaactggttggaaaaaaatgtaaaaacttacttttaatttagcggattttaatatttgaattttcttattgtaatagaggttattttatgcgttgataaatatgtggtggagaatactttaagtgagaattcatatccaaaatg

SEQ ID NO: 9203 - DNA, 580 bp, Unknown
  misc_feature (1)..( 580): cDNA_ID_2181175_gDNA_ID_1972021_Annot_ID_178092 3000 nt of promoter + ATG
ttcttcattttgaagataaaaatgaagcaccattggagaagatttctctatcttttacttcaaaatgaagaaaaatgtgaaatttaaagcaccattggagatggtctaaaaaagaaatttctttatgatttttttatcggtaaaagaagtaaatgactcaaaaagctttaaacatatcgaataattatgacccaaccaacctaaacggatcgcaaaattacacaagcccattttattcgggtcatatctaataaaacctaaataaaacactttctcactttttctctatggtaaaacagatcgacgacttttttttttccctttcttccttcttcttttagagaaaacctaggtaaaacatatcgtcaatcttcgtcaatgccatttgacaaaaacagatctatattcatttctcttatatttcttcaaagtcgatcttggtaatatttgtcgaaaactaagatattgggtaagttaaaattcgagttatttcattttgggttttgtgattgaaattaattaaagtagagtaactcgaagtgctaatccaaatgattttgtttgtaggtctggagtaatg

SEQ ID NO: 9204 - DNA, 3000 bp, Unknown
  misc_feature (1)..( 3000): cDNA_ID_2181156_gDNA_ID_1972021_Annot_ID_178085 3000 nt of promoter + ATG
aaacaaaatgcgacaaatagaaagcaaattacaagacgatcaacccattagcaagacaaatcctcacaaatttgatgtaaacataaccctattatagcgaagaagtggttcattttaacaagtattggaactaaaacatattagagcagaaaatttccaatctactgagaagacaatctctagtaccacacgtaattttgatcagaaaaatccgtatttcgaaaaagaagaatctcatcttaacaaaggatggaatgaagttaaactggaaatgctgaagcttttgctgcctcctcgaaatttgaaggatcgatttggctattggttaagaggaaatatttatcttatactctatttattaagataaaaatagtatgtcgtttacataactttcttcattttttactgctttcaaaatctctgctatgtagcctcaatgtcaaaattgttgttgaagtattatttgttaaaatatatgattgggtttgtttttaatatttgctttgattatcgctttgttaattaaaaaacttgtgaagatatgtaattatgattttgacacaagttgttaatcaaacacatgctctgttacgtaattataaaagaatgcagagagaagcattcttcttctctctttgtatagagattataaaagagaatgtgatttttaatggccgtcaaaatatctggtggtctccgccgcatctctttcaagcgtgaggcttgttaaaagtagcataaagtatgaacctcttagtaaagaaaaaaaatccttagaataaaaaaatccttaaaactgtagatgtatcaagaagtctttaaacaaaagaattaaaaatctctaaccaaacgttaaataaaaacaaacctttaaaatttttaatagaaaattagtcagatttttcatctgttgattcgatatttgagccataatctttttcgtctgatccgacttcttcttcgtcttcattatcatcaagatcttctacttgatcacgaagatcagtgagtgtctttacttgtaacgaatcgacgatgacatttggaccagcttttcatgttgcattgctatgaaatctaaattttgattaagcaatatttttcctcttggttgtatcacaactgttgcgttccattgttgatcatttttctttgttttccgtggatacggtacatagcatacatgatctgcctgagagactaaaatgaaagggtcatatttcccataagactttgcaacgttaacatcgattatcccagaacgatttattcgtacaccttctccaatggttgtatcataccgatcacatttgaacactacaatgtgtagatgaaccggtccatgataatgaatttccagaatctctctcaatactccgtaaaaatcatgttctccacttgatttagaagataatgtgtttttcacacacaaaccaaatttagcattctttttgtctttctcatggtcatatatgtgaaatatgtaaccacgaaaaagtacataggccaagaagtaactttggtcattgaaccataggagagagtctgcaaccattttggatatgaattctcacttaaagtattctccaccacatatttatcaacgcataaaataacctctattacaataagaaaattcaaatattaaaatccgctaaattaaaagtaagtttttacatttttttccaaccagtttgcaaaattttcttctttaagggaggttagatcatctccggttattccaagcaacagccatgctatcatcaaaaagccaatatatacaaaaaaaaagtttcactataataagtagcaaaagtagaaatttctttattgatgtattgttccacaatcgagccttctacttttgccttattcttcacttttttctttaaatggtccatgtatcgttcaaaaggatacatccatctaaattgtacaggttccccaagtcgaggttcgtgtggcaaatgtataagcaaatgttccatgacatcaaaagaggatggtggaaatatcttctccaaattacaaagaacaatagaaatattgtgttctaacgttgcaacactatcttttaacacaaatatcctagaaaaataagctcacacctacaaaaataaaatattatatagttaatacatatataaatttttaattatgacacatgtataattaaataaatctagtacacaaaaacaaaaacttaacaaaaaaagtcaagatgaatgcaatgcaatgagacaattttcttcttatgctctgtttttatgttttcttttgttttatgttttatgttctgcaactcttcttttcaattaatgtaatgggatgattaaaaaaaaaaaaaaagtctgaacctttgtttacttaaaatctatgatgttagtttcgtttgtttgttacaacaaaacaaattatattttcacgtacgttactaactaagaataagaatgttttatacgtgattgacatacactacaagaaaacaggtaaacgacgactacaatcagcgacaataaacgtagtcgtaacattatacgactagttggcgacggatttacgactcgcctgcgacaacacgaaaaattgtagtcacatagtcgttgttttacgactaccgtatgcagtcggcaaagtgtcggcaagtgacgactatttgacgattatattattgaagggatatagttgtcgttgcttagtcgctaattaacgactattctaccgtctattttatttagtcgctaatatggcgactacaggccgactaagtcgtctagtcgtcctgtagtcgtagaaacgtcgcaccgtagtcgtataaagtagatggaaaacatgtttcgcattggtaagtaggtacacctaattatttagttgtagtcgtaaattagtcacaaaaattggcctatataataaacgttcacgcaactcttctttcaccaacaaatcaaaacaacaacaacatcaaagagaaaaaaaaaatactagttattttattgtata

SEQ ID NO: 9205 - DNA, 3000 bp, Unknown
  misc_feature (1)..( 3000): cDNA_ID_3040547_gDNA_ID_1972021_Annot_ID_178082 3000 nt of promoter + ATG
aatagattaagggttttgctgaatatacacaccaacaagatgatcttcttagaaaatatttttgattaaaagaaagataggttctcataagagattacatgagcttttgtatggttctatgataagtaattgatgtaacttgatgaacaatagcttagcagcttctataatagttggtatttgtaaactactaaaaaaacacattttgtttatgtgttttcttctttcaacatgtctaattcgtttttttgtttgttttttttcggaatttgataaaaatctgataaccaacacgtttaaactaaaattgaccgactcgaaccgaaattaatttcgatttaaatcgactaatttttttgtaaaccgaataattcgacctgtttaacccgatcattggcgtaatatattatatacaaaaataaagttggatatctaatattttaatataggtggagaaaatgcagaggttatgcggcggagagtgggagttaattaatatgatcaacatatattcacgaaataatgaaaacagccaagtgttgttttgggaaatgaagctaaagacaaaaatgaaagccatgggaacaaagtctatatattatacgtatttttttggtggtatgtaaaagtagagacaactggagaaagtggaggatttatgtggcgaagggcaggaactggtttataaaagtagtgcaagaaaaaaactcgtacatgattaagaaaaatatccatgaattaatagggaaaaaacaaatacgtgattagatcaaaaaatttattataagatttgatctgtagattacagttaatagggtctcattcttttgatatgataaaaagaaattacagcctgtaattgttttagggaaacaagtaaaacatgaaaaaaaacatgtagttatgaatgagacctactttatatatttaatccggattggtaaataatagaagttttaaaaattgagctacccaacgaatcaggcaatcactccttaaagtattttgccattatttagtttctttatcatttggactgttcggcttttaaacaaactataaattttggacagtacagtacccaaatatttataattaggttgagtttataattacccaaacatgtaatttatagaaatagagtgataatgatatacacatggattaatattcatacaaatatttatatttaatttactacacataaatattctttcataggtgttgatttcttgtgagaatgatcaacctttacagtttacataataatatagaattcttcgaattttgatttgtgattatatacgataactagattttaacccgcatggtatatttttttataataagtgaaagtgtaatttgcttagttacttaacattattatataacctattgttttgtattttgtgaatgtacaaaccttttacatatatatatatttattgtataagtactctattttaggatttaatctttcatacgatgggcaaaattttattagtatacattataatgttagatttatgatttttttatttagtattaaaatttgtaattttatattagtgctgtaaaaaaaactgatgctgataacatattaaaataagatttaaactgtgtcattattttgggttgatgatattataaatttgtattaatatcgatccaaacccgttccaccatataactcttttgaaatattatttttttataagtttaaatattaataatgttttacaaagtttaaatatttcaaaaattaatacttttttgccttttatgtaatgacattttgtgtaattcttagtaaaacaaaataactctacaaaatttagttcaactttttttaatatagataatgttataaataaatattttgtttaatcaaaatttgtgattgatattacttgggtttttggacttcatttaatagcataaattgggtagttttgttcacattatttgaaacaataacatcaatttaatctatatatacatttttagtaaagattttgagttgaaaaatcatttatcaatttcctaattaaatgtttagttcctacaaattcaatcaaacaagatattttctttaggacaatgaccaaattgtttatgaacaattaagatattgcactaattacttgcttaaaaatggatattgctaagtactacttaaatatattgcatattgactcccttaaaactctacgaaattcgttaatcattatttattacttaccaaaatttgatacacaatcttaactaaccatatctataattacttgattccaaaatcattatagctttaatgaaatcttaccaaactttaatctactcttatcaattttctagaaaacatatcagttattaaagttgctttaattccgtttacctcaaacaaacacttaatatatcatatgatcttacatttggtatagtaaatatattttgaaatatacttcattcatactcaaaattcttcctaatatcggtattgtgttatcaatctttaccaagtactatattctccatctaatttaaaatgtaaagtaatcttgcattccaaagatattttccgatttgaatcgcatcatcaattccctccattcctcatttatagcaatgcagtttcctgtttcacatatatcacaattaaattcttaaaagggttatggcatgccattaaaatgtcgccaaaataagatcacattagctagaatatctttcaaattttgcatgagaatcaaagcaaaatctaaatacagcaacttattaatttattatcacttatgatcctcaagcatattcctctttctgaaccattccaaatcattctgtttctaaagaagttacgcttagaatctttgaaaatctaggtttactagcttgagtcgcctattataaataaggttgtaatatcattccatttcatcatcacctacacagcaaactatctacacatttcactacttctacatctctgttttttaagaaatg

SEQ ID NO: 9206 - DNA, 97 bp, Unknown
  misc_feature (1)..( 97): cDNA_ID_3040614_gDNA_ID_1972022_Annot_ID_178094 3000 nt of promoter + ATG
atatttatatatatatatatagaaatagagagttgaccgagtcagtctttaacaaagtctcatcttggttgtgtcatattctttgaatatttccatg

SEQ ID NO: 9207 - DNA, 3000 bp, Unknown
  misc_feature (1)..( 3000): cDNA_ID_3040645_gDNA_ID_1972022_Annot_ID_178102 3000 nt of promoter + ATG
ttgttgataaatactatcggctgatccggtaagtttcggtagaaacagaccgaagtatttcagagtggacttctccccgaaggaccaccacactgtctgtcctgagtttggaatgctttccgactaatgccaagggtaataatttattaactagaaatatacttttaagaaaacgtataatccaacttattttaaaaaatgtttagaagaattgaaaactacacatttttgtaagacagaaaaacatcaaataacaaaaggataaccagtgaatccattttgcaaagtagatatgatatcacagaggcccttgtatttcttatattgttaattcgatataatgaaagtgaatgcaccatgctagcttgttttggataatctacatcccatgatttggtgaaaacatttatttgtgagcttccttttagcttataattgacattattaataaaaaaaagttataagacagaatacaaacatcaaataacaaaagaagaaacagctaatcctttgcaaagtacatatataaatcacagggacccttgctcttttggaatcccatctttggactatctttgatgatttggtgaactaaattaaactgcagattgaaagaaagatatctccaattggtagtttctaaaaaaaggccttagataacgctgatggaacctttacatagccaaaacttggtcggcaatgatcctcaactttttaaacatgaaaaccgaaaaaaagaaagccaatggacgtatatctagcaacgtcaataagaaatcgattatccttttccaatgttatttaaatgacaaactaaaggcagtggtagctactttttttttcaaacattagatactcatacgatgcggtcattgactgttttgcgtaggttaacaagactagtttatctggtacaaaaatgaccacctaatttctatcattataatacattagaagatctcttttgtgaccacgaaattcttgagtttgcggcacatgtgttctttgagtcagggatgataaaatattcatactttttgcaactaacctcctccgactgtcagaactaaagctcgggatttggtacaacatcccctaaaccatttatgtaaattaaagaaaaaaagctctggctaaaaacatctctacgcataagtcataagactcataactcatacttataaataaaaacgaaaacaaaagaaaaacttatgcaaacactttattgtatatgatgacccgttacataatatagattctgcacaggttttagattttttccgataatacgctattttacacggtatcacactattttattaagtaattatgatatatatgtcacatctaattattgatttcactaacgttatcttcttccaaaaccaaactattattaagttagaaatacaatcatgcaagaatttgtcgacaataaaaaccatgcatgatgcattgaataaaaaataatatcaagattatttccatccttgaaacatctcatatcaagagtttgctttttgacactagctgaaatcatgattacgtcaaaatttttttcacttttattcgaatttttcggcccgcacgaaatcacaaagttacaactttactttttagctaaaatctaacatatgcaatatacgttagagtttgtatgtgtttgctttgtttcttacaaaagaggttgacaatgttgggtttgtgtcctactcttgtcttgatgccagttgtctaaatggaaaaataacaaaagtaaaaaataaagaaatatgaaaaggacaaaaaatagagaagcaaccagtaagaaactaataattgcgaaaaagaaagaaaaataaaaaagagaaactaataattgaagaagaaaaagagtaataattatggaaaaaattgaaagtaacccatgtggttttatgcacacgtgcaaccttcttactctcttgtgtttgtcttaatgagataaaattagttttaagtatgtacagtatataactaaatgactcactatttaaatacttatacatcaccaaacacagaattttaaagacttgaattcagatatatagatacacatcgacagtcattaatgcaaatcactataacacaacatatatggttcaacatttatttaatatattttcttataaaatgttttcttatacaatgtaagatactttttaaatatgcagtccaaaattatactgacaagaaatttgactttcttaaataaaaatacactcaaagccgacaaaaaaaattgtctaaattttggaaacaaaattaggtacttaattacatagtttaatatcactttagcatatttaattaaacatgatattttaaaatatagaatagttagtacatgttgtgggaaaataaaaacatagcatagtaaacaaaaatgatgtgattataaatctttttaagtttgaaagcttaatcagttttaaagtataataatcttaaaataatattcaaatcacaaaaaaatcattacacttttacaaaaaaatatgtatgactctattgaaacaagagtaacttattttttttttccgttacaataaattaaacttttcttgaaaaagaatagatttgatacttttatttgacattactctcacaatttttttgaactggtgaattaattgtgtttaaacttaatcgatttattaagctatcaaaaattttaaattttgaaccaaaaaaacagcgaacaaaataaatttagcaaactcggtggcataaacgttgggagcgagaatcttgatttttttttggttatttaaagaaataaaagtattaaattgtacgtttatactattacactgttttagctacttagcttaaaaaaatcatgtttttttataagaacataaatacgagctgagagagagagagagtacacaaatttgtttcacattcctctaaattccaaacaaattgtttatagagacaccaatcttcttcttcttcttcttctctgacaaagttatg

SEQ ID NO: 9208 - DNA, 3000 bp, Unknown
  misc_feature (1)..( 3000): cDNA_ID_2181227_gDNA_ID_1972022_Annot_ID_178106 3000 nt of promoter + ATG
aaataaaatcgtctaacaataaacacgtacaaacatgtatcgggtattcacgatttgcaaagtagtgacttttcatagtttgattcgtacacttaaatttgtacaacacttttagtgtacagatgtaagtgtacgctgtgtacatttatttatttgtacactaaaaatgttgtacaaaactaagtgtacgaatcaaatagtaaaaaatatacaaatatatgtattatataaaaaaattgagatatgttgttaaataataaattgaattgtataaatttgttataaatatgaatatttattatgctgtacaaataaaagtgtgtacatataattaattgactattgataaaaatgtctatgtaatatatttaaaattattagcaaaatgcatatcaaattatagagaaaaatatatagatttttatgtatctgaatcaatttaaaaaataaattcatattgataagcatttcaattattagatttgagaggttataaaaaataaagaaaaaatatatatgtatattataaaaaaaaaaaagagggtgcgtgtagaaagtagagagtagagtgaaaaaaaaatcaaaggcccctatggtaatttccatttctctttctatgtcccactttttttctattacacagatttctattagagtaatagtgtaatgtacctaattctccaattatgaatagtaaactccctatatttacaattaagttctgaaaagtgactattttgccaacataccctttattttaatgcatggttttcttttgtcaaacattaatttcatacaacgtttaccacgcattcacggtgtccatagttcacttttcaacttaaatatatagataaactcaatcaaatggtaccacatagtgagaaaaagttgagtggaccaatcaaaaccaaaatttgtttgtggtgaactggtgatgtggggaataaaagagaggttgccgacagaagtgtagtttttgtccttcggctaatcaattattctgctttaccatcttttcctcacatactttgattctcaaagatttagatgttttctactttaatcatactacttgattgattcatttttgataaatataaaaccggatgaatataccgactggtttaacgataaccgaatttggtattcaaagttcaaatcaagtgggccactagtattgatgaaaattttaacattagtcaataccaattatttatgatcaagagaacaacttacaaaacgagcaagtccacttgttactgaaagcatggatatgtcggccaataatagctagaaacgtatgggtcatattttctcaaaaaaaaaactatagtactaaatataattataatttgtctccttttatattcttttggagaaataaatgtgggactaatactaaacaatgaatatgattatatgagtttatcaaacatcatttttcaacttccaaatccctcgctaactttgaatgcaaattctataccttttcgttatacattagaatgactcctatattctaatgaaaccattaagcaatagtaaccatttcaaaccaaattagatctagcaccattgaccattagttaattatactatggatatagtacttaggaaatataaagatcgagagatggagagacctggagctcagttgtgacagggtactcatccatatcaacgtagttcttattgatagagtccatgatgagtttgtcacactctggttccatccatgtagtcacaaaagaagctaggttaagccttgggttaccatcaagcatcagctcatcttttatgatctgatacgcagcgtctttcggtatcgaattctcaccaatctcataccttttttcaatcaattaaataaaatacatcaacattaagaagcaaagtattcaaaatgttttcaatagtcatttggttaatttacttacttgggaagtgtagtgcgaacatagcgagatccgaacatggtgcagacagattcatcattcgttgcggtttttgtcaaaaccatctttgtttctgtttagtgaaagagaatctgaggaggaagaagaacacaaagagacgaatatatgaagagacgacgaggctgcgtttatattgaccctacatatttgctgtctttttcctttatatggagtatcattattattttattttttgtgagttttatattatgtcgacgatattcgctcgtaaaatatcacaagatcgtaaagatatgtagaacgatttgatttcttacctattgaaaaaaaaaattgatacccatgagatatacactttattagattagagtagattgtggaagctccttagtccaatggttaaataaaaatttattaatatttctacattaagaggtttgaggttccatatatgttagtaattttttgtaaaaaatgttgtatataacgtaaagttgaaatttaatgaataattttgccgtataaaaatacattatttgagtccagcaagcctagcgaaaacaggtggtagtgggtaaaaaagaaggttgtattcgttgcagagagatacagtatgtacacttaaattacatatatgcactaatttacctaggctttaaaattcacaaagtggaaaaaaaactttaatttatcaaaatgagattctctgaagtttgtgtgatgtcaaatcgattaaaagagattctgtaaaacactgcgttttactgtgtctatccaatttttacagtattgatactgaagggggatttacgtcagttaattttaaattgagagatttttttgactaaattaaccttttatatttggctatttgccaagcccagcttacttagcccattaaaatcacatcgattagtctaaccggatcctggcccattagattgtccatcaatccgatccgacccgacttgcaagtaagttagaaaatgtgtagcttctccgtcctcttcttcgttactacgaaaaaaataatacgaaacccaaagaatccacaaaaatg

SEQ ID NO: 9209 - DNA, 3000 bp, Unknown
  misc_feature (1)..( 3000): cDNA_ID_4257552_gDNA_ID_1972022_Annot_ID_178108 3000 nt of promoter + ATG
gcgatggataaacgaccatctaaaaatgcataagttttgttttaatgtattctttttgttaatttctaactaaattttagcacatagttataagccttttatatattttttaataaaactaaataaatgttttgtccaaattttgcttaaattaataattccattttctactagacatttttatataatttgtatgtaatatcatatatttgtaatattatgtaacacagaccttacctaccacctaacaccaaattgttgtatttttagaaagccaatatacatctaatagatcattatcttagaaatatccttttatctcattctggaaacttcttaccataacagaaaataaacaaatctcattccggaaaacgctcataaattgtccgaaagccctaaaaatctgagtctcgcattaagtccaaacactttcatttgtctcctttcgtcaactccacagagatctcctcatggctccaattgctgtcggcgatgtcgtaccagacggaactatctccttcttcgatgagaatgatcaacttcagaccgcctccgttcactctctcgccgccggtaaaaaagtcattctctttggtgttcctggtgctttcactcccacttgcaggtacaaagtttcaacctttttcatcatctctcacttaatttgctttcaaagttttgatctttctttttcttgttctcaatacagattaggttttgtttcttcagatttatcattctaattagttgtataagatgtgggatttgatggtaagatgatggatctttagatttgatttgagaatggtgtttttgtttttttgtgaggttagcatgaagcatgttcctgggttcattgagaaagcagaggagctgaagtcaaagggtgttgatgagatcatttgctttagcggtgagtatgaatgatatgcttttgatctctataatgagtttgagtatacttctgaaacctctatgatatgatatgttcttacctattattagattcgtttggtagttggtgtccctatttgtaaattgtagagtatacaattagatcagttagtgtatttggctgagtctgcttcttgtgcaaatgttttggcagacgtttatatatgctgcttggttttatagtatttacgccgtcatttggatcgattgttgcagtgaactgttcatcatatgtatatggtttgatatcaggtctgttcttaggtataacctgtactatttctgacctttgtgtttgtgtctacttctgaaatctgatctcttgctagtcaaacatgtgaaagctaggctaatggtagttggtattcataatagtaaattgtagaagagattcagagtattggttaatgtatttggttgagtttgcttgatggtagactgattcaaatggtttatggcattgacgttatcacttggattgatatgttgcagtgaacgatccgtttgtgatgaaagcatggggaaaaacatacccagagaacaaacatgtgaagtttgtagctgatgggtctggagaatacacacaccttctcggacttgagcttgaccttaaagacaagggtcttggtgttaggtcaaggagatttgctctgttacttgatgatctcaaagtgactgtagccaatgtcgaatctggtggcgaattcacagtttccagcgccgatgatatcctcaaggctctctaagaaatgtaccacttgtgttgtctatgtaaaccgctgtatgtgtagtagaggattctatagcttgttctcagacattaaccaaggttgtaataaagcggtttcattgtgacttgtttggcataacaaagtatttggttttgttgtttttctgtgcgttgattaatgaaagatgtgactcattgacgtgaacatttatgccaaattttgccattgttgttcttgactatggtagacacataccaaaaagttaggttacctgagtttctggtaagtatagttgctatattgcatttataatgtacataggcttctcacacattatcaaactttggtaagtttgtctctattttttttaccgctctatcttttagccttgctcatcggatatatatgtccgatgacgcttatcttgattgtgtaagcgtatgaccctttttttgttttgtgcggtatctaatgcttatcttgattgtgtaagcgtatgaccttctatttgttttgtgcggtattcaattcaacatgttgaatttgaaaataatagtaagagaagtacaaattgcaaattatactaaattgttataagattgcaattcaattttagcatttagagtgcttattgaaattagaaaagtataggatccgcgtgtttatcatatgggcgggctaggatcaaataggtcgaatcacgaaatcaaataataactaatcaggtcttaacaatgtttttacgatagatttagtcttaaccattcattttgtttggtatgtaattaaaagctaatcaagggcatattctctctctattcgattgtattctctagagaaacgattttcatatatttcctaatcaaaatagcatatttgaattattaatttgtttccctcaataaggttacgaatatgatgcattaattttggatttaaaaaatcttgcttgctcacgaagaaatcagactcaatttttatcgtcatacaatgttttccaaaatatgtgtacatgttcttgcagatgagtctattagtgagggttacttaaacaaaatgttgtatttttggaaaaaaaagtttatttttagatattggttctagattttacatccaatttttgttttaatcataattttagaaattctattatattttttatggtcaaactaaaattagaaatctattaatgatttacatcattccgtaaagcactataaattgtcctaaggcctaaatacattttcgcactcaagtcaaacaaaactcttctattttcctctgtcttcaaaaccacagagatctcttcatg

SEQ ID NO: 9210 - DNA, 2658 bp, Unknown
  misc_feature (1)..( 2658): cDNA_ID_2181242_gDNA_ID_1972022_Annot_ID_178112 3000 nt of promoter + ATG
ttccctaataattttcctaaacttttttctgtttaattctatttaatttaattatgcattgaaattagagacatttcttcttctcttgcacttttacttcggtaatctaggatacgcttgctataggattgtttaaccgggggtatacaagcgattgatctcagctcatcaatacagtctcagcctcgcgaagcgatcatgttgagaggttctccatgaaatatttatttcaagccacagtttatactgtttggagggaaagaaacggaatgcgtcataagcagtgaattgataagcaaatacgaaatcaggatcgacgatacgacgctagctatcatggttggctccaaaatcaagtttaatcacaagaaatctcaaaaaatttatgtttttcaatttgtttgtatcaaacacataacactatttgtaaaaacgttagtttttctttaaatctaatttaacattatttaaaaaaaataatttaattatgcaaattaaaacgagttcatataactatttcttttgttctactcattataattctataaagtttattgtgtgtttgattaatctttgtagattctaactctaaatgttactgcctaaaaccgaaaagttaaaagatgtaaaagcctagaggagtgaaacactgaatgacgtacggtacatcacatcgacgacttacgatgaagggtttgtgttttcgtccgcccttaagaatttgtttacttgtgcaggaagcatccagaatgtaaacacccaaactacacaaatcaaaatcaaaaccaaaaccaaaacattcccgctgacaatcttcgtcaccattatcaatctcttaagcatattcaagcatcttcttcttcacaactatcttaatcctctgcaacacattctttgttgtctcctcagtgacaatcgcctcaaccctttgaatcaaacccaaaacgaatctgaactctgtagtacaataccaccataattgttccactacagcgatttcaacatccctaagagctttcccaagaaaccctaattccattcctctcttcaccgatttcaacatctcattcgcaagattctccaccaaatcaacacgtgtcgtctccaacaagtgaacagccgcacagaaaccacccacaaacgctaaaccccactggcccgaactatcttcctcgttgtcacctaaacgtttcaagatcgctggaagaagattctccatgagaggaatcaaaaactcctctccatccaaaggcatcgacaagctcttgaacacggaaaccactttcacaaactctgattccgctttagacgagataaactcacgcaggtcataccacgtttcttcctgaatggtgaatatctcgaaagcgacacggttcacgagcattgaaagaatctttaaactggtgtccgagacaacttgttcttcaaggcatgatatgagtataggcgagagtatgtgaaccactgctaaattcaaggaggcttcttctatgatgaagataacgtggagacatctcatcgcaccctctctgatctcgtatgggacgcgtggctctttcgaggagtagacacgcatgagcttgagggagaagcatcccgggtaattggcgacgcagaaacaaaagaacttgatgtctttatcttctggattctccggtggctttgtgagggcggcgatgaattccaccgtcggttcaatgtgaggatttgcaagaagcttgaaggcggatttggtgaagtcttgggaggttggttgcttcggcgacttctgattatccatgggaaggtaacagaaagttccgggagatcaatagagtctataaaacggttgaagaaagaaaagtatataactgctttatatatagatagataatgattcttatatagatagataatgattcttctgattatccaaacgcacgatttgttaaactctttttttaattcttatatagatagataatgattcgtaagttttaatttttctgttagaattttttttagagtttaatcttctactaattagttgccaaaaaaaaaaaaaaaggtattaaaatattcttagttttaaaaaaacataaatcataaatcataaatcctagatacatttaaatgacaactaaaattaaaagaaactttcaattacaaatatatactaccattaattgaaaatttcttttctttaaatttataaaaaaagaagcttatctgttctttgtttaattagttgtcatctgttgcaagccaacaataagatgaagtgtattatcaaatttgatgaatatataaaatatatttcaaaaacagcatatttcttttttacaatttattaaatatatttcaaaaacagcatatttaaattctccacccctcccaaaaataattaaattaccatcaaatattttagaaaatttcattaaaattactacaaaattaataaggttttctaaagaagactaaaatcaaattgattttatttcttgaaagattttatcttttatatatatatatatatatatatatatatatatacagagattttatatttttacataataatatattcatagaaaatactctcaagccctaattggctaatttcattttccctcaaagtccaaaactcttcaaatctctttgcttctcagcctcatg

SEQ ID NO: 9211 - DNA, 3000 bp, Unknown
  misc_feature (1)..( 3000): cDNA_ID_3040626_gDNA_ID_1972022_Annot_ID_178109 3000 nt of promoter + ATG
aatttcagtttcttaaaaaaattataaatatattcaacaaaatattatgaaaaagatgcaacattttctattttgttatgttaaagagagataatcctcggatgaaaaagaatcataattaacctaaactaactgttatttaggaaattcaagataatgatatagatagcaaagtatatacatgaatactacagagctaaagaatgcagacagatattttgagtttacaaaactaatactacaaataatatatatttgaataaatgatcaatatagttatatatatactatgtaatatgaccaaaaaaagaatatactaaataaaaaagatgcgatcaaatattttggatgtatgaaacgtagagctaattttgttatttgatttatgttatgtaactaggaacatatgtatttatacttatcctccatatgttggcaatgaaacagatttttacacttttacataaataagagaaactgggccaaaagacaaaacatatataaatgattaaactttttgcatccctattttcatagtcacatgtatatatataagatggaaacgtatttgttgtgcctcctcctacagagagagggttgaaggtgtttcattgcatgtggagttaaagaaaggttgcttatcgatgccgagtttctgggctaatgataggacagatatgattctaagaaatgtaattgcatttgagcagtgccagcatggcataataccctttacctcgcactacatacaattcttaaatgccctgatagtttccgacagagacgtcgagctactcagcgaaaaaggtacaaacatcactaaatcaatacatttaactattaattaacatatatgaatgaaaaatatgcatgtgttgctggaacataggggtggtaatgaacaatatgggtcggccaagcttggtggtggacatggtgaacaagttaaaggttggtgtgtacgaaggatacacctcccaatactatgacatagccatagatctcaaagctcactataaatctcgaagaaagaggtgttgggccaccctcagaaaagtttacttcagcgacttgtggaccggcacagctactttagccgccgtgcttctcttgcttttgactctggttgggacggtggcttctgtcatccaagcttacgaaagcttcaagtaactatatatgcttttataattcatacaaaaacaaaaaaaaaaaactatatatgcttttatatcgtccaaaaacttatttccaagttttcctcatggattatttatgtactttggtgattgattcttgatttctctaaagattgtcttttaacacggaacaagtctacgaaatttctacattaacttttcctcttggccaaacgtctatggattattcccatgcgacgaaccaaagacttgatacccaaaaccagaaagatattactgtatgtatatataaatgttcgcaccaacttagaagggcaaaaactaagtacgcattccaatagacacaacattaatggttacgtagtggatgctaattaagagtgttcagtactgtctgtcgattgacaatcacaaacgttcggagggcaatcattgacgttctgaaccgtcaatttgcgtttggacagaacctatggtacaaaacaggccacagtgcgagtttgtttccacaataaaatgatgctgggattatggagaacaaatcccagatttattattgtgaaataagagattttgttgtctcccgtgtaagaattaaacaagataatattttgtgcatcttgccccatatactatatatttatcgaaaaggaggtaccatcataattttactagctgaaccattttggatagtctttagctggagagacagattttgcaattacttccatagttataaacataaaaaagcaacccataaaaaaaatttataaaaaaaaatcatataaatttttttgagtgtatgtcaagtaacattttgtgcttgtaatatattttttcaaatttgaaaattttggatcctcacttttggatctcaccattggatagctcaaaataaaaaaaaagttcaaaatgtctaaatttttgcttttctattatacaaattgtaaatcttggttggatcccaatttttgaatccaaccattgaagttgctctaacaatataactttcaaaagagtccaaagaaggtccaagaataaaaaaacaataggaataagctaaggacacgtgtttgcttccacaacctttaacacataccagagattctaaatctggttaatcggaaacttcgccaaatccagcaatgaatcctttttttttccaccaataatgacaattatgaattttgttttagtgattccaaaagaaaatcacgagaagattgagatatgaattacgactaagatttttatataatttgaaaaccatagtaaatcaacgataaaaagaatgactattaaaacaatagttttaaagtggtatacgcggttgtcgagaccccgactaagttctagatactcaagcgatggataaacgaccatctaaaaatgcataagttttgttttaatgtattctttttgttaatttctaactaaattttagcacatagttataagccttttatatattttttaataaaactaaataaatgttttgtccaaattttgcttaaattaataattccattttctactagacatttttatataatttgtatgtaatatcatatatttgtaatattatgtaacacagaccttacctaccacctaacaccaaattgttgtatttttagaaagccaatatacatctaatagatcattatcttagaaatatccttttatctcattctggaaacttcttaccataacagaaaataaacaaatctcattccggaaaacgctcataaattgtccgaaagccctaaaaatctgagtctcgcattaagtccaaacactttcatttgtctcctttcgtcaactccacagagatctcctcatg

SEQ ID NO: 9212 - DNA, 3000 bp, Unknown
  misc_feature (1)..( 3000): cDNA_ID_2990855_gDNA_ID_1972022_Annot_ID_178107 3000 nt of promoter + ATG
tcctgtagaaaatctgtggacaagaaaattaaagaagaaatgaaatcatcagattcactatacataactctagagaaagaatgtaatgaatatactacaacatgtattgtgtacatatagggttcactggtcttgacgttttcagcattttaaagaataaaacataaacacatgcatacaatgcagtgcttggttctgaagttttaggttactgaccaagttcctgggaaattgactttacgaattcataaactagccaatcaaatctgtattctggaaatatctgcgaagtggaagagaaaaaagaactctaagaaacaatagacggctgcatataatatgcagcctataactatatgaatcagagatgcacaaacagttcatgtaattgcatcattgatctcaactaacactccacagcaacacaggcttaggtcacaatcaccggcaaaactaatgaaattagaaagaagtaaaacaatgaagtcctcataatctaacaatgcatttcgcaaggcagcataaactactgcagcacactggaaatattatccgcaccagcagttccctgccagtacttttaataaaagacgaaactccaaatttaaagcctcaaatatttaatcaaaaaatcatatttccatcaaattcctagatcagttagatatatgatgtcacacgtctgtttcttcgtttcatattttatgaacagcttgtaagaaaacatattttgtttcaatctaacttcatgttctggtacagatataaagcaacaagaaaatgcaggcacctttgcgactgattttgaaaggaatgacattatcattgtatctaacatcatgttctgcttcaatccagggtattgcacctattttaacaccaaaaatgaaaacttggtgattcttgaagttgttgcagaaagaacataggaaattaaaacagttattgttatgaggagttaacctttactgctacttcctggtggttcttcaatacagcatgatgtacttgagcaatagatgctgccgcaattggttcctcatcaaaagataaatatctgacattttaactaatagcaatgtcaaaacctcttccaaaaacagacgtcaaaaaacaaatctgacatttaactctaaaagacttacatctctgtgagattttgacccaagttacttgtcagaacttgctttatttcttgaaagttacaaggaactgcctacaagataaacaaattaggaatagaacaaacaatccgaaaatgtttacagactcaactataacagtattcttaccttgtcctgcaacgaggaaagagccaacgagtactctttcggaacgagcttcaacgtagccacaaactgaccagctttcacatagaaacctttattactttcacacagtttaagaattcgtttagcagaccgtgaatgaacctacacaatcaaaacgaccaaatgttaccatatcacatagtactagtgaagtatactgcaaactttaaacaagcaatcgtatcactactctaataacttgccttcaccaatgacgaataagccgattagaatgtaattcaaactacaagaaaatcggcctaatgccattgataactacaattccatgaaaccaaaacttaaacacgaatgtaagatatgtaattgtacacctctgttaatctctgaagatactcatcggaatctgctggtaatctacgcaaagtatacttgtaatcagcgacagtgagagtgatctacaagtagagaataagagattcaatgaatgaattggaatgaggaaatggtgaaatcaatagagagataaggaagatacgaacggagtagatagcgcgagaagaacggacgacgccttctacagccgtcgctattttattggaaggtgagtctcggaagatggacacggcggtggcgctgccagtgacggcggttagagctaggccggcggtgactgtgaaagcaaagatcggagacttggatctcccgagaattttgaatttgcggagaatctccatttttgtggattctttgggtttcgtattatttttttcgtagtaacgaagaagaggacggagaagctacacattttctaacttacttgcaagtcgggtcggatcggattgatggacaatctaatgggccaggatccggttagactaatcgatgtgattttaatgggctaagtaagctgggcttggcaaatagccaaatataaaaggttaatttagtcaaaaaaatctctcaatttaaaattaactgacgtaaatcccccttcagtatcaatactgtaaaaattggatagacacagtaaaacgcagtgttttacagaatctcttttaatcgatttgacatcacacaaacttcagagaatctcattttgataaattaaagttttttttccactttgtgaattttaaagcctaggtaaattagtgcatatatgtaatttaagtgtacatactgtatctctctgcaacgaatacaaccttcttttttacccactaccacctgttttcgctaggcttgctggactcaaataatgtatttttatacggcaaaattattcattaaatttcaactttacgttatatacaacattttttacaaaaaattactaacatatatggaacctcaaacctcttaatgtagaaatattaataaatttttatttaaccattggactaaggagcttccacaatctactctaatctaataaagtgtatatctcatgggtatcaattttttttttcaataggtaagaaatcaaatcgttctacatatctttacgatcttgtgatattttacgagcgaatatcgtcgacataatataaaactcacaaaaaataaaataataatgatactccatataaaggaaaaagacagcaaatatgtagggtcaatataaacgcagcctcgtcgtctcttcatatattcgtctctttgtgttcttcttcctcctcagattctctttcactaaacagaaacaaag

SEQ ID NO: 9213 - DNA, 3000 bp, Unknown
  misc_feature (1)..( 3000): cDNA_ID_3040641_gDNA_ID_1972022_Annot_ID_178103 3000 nt of promoter + ATG
caacaatatttcaatgtagacgtaactgtcaaccactttgaaatgtaagtaacaggtgtcagtgagaatattgtgtcgcaaatgtcaaataaatgaatacgtaatagttaaagattcatttgatcggggcttactagtttagtaggacccttacaataaattagataaaatcatttatgtgaccgctaaaaattatacgtgggagaggattttttttgtataaagatgggcaaaagtagggtatgcattgttcatatagtgttccctttagactaagaaacatacacacaagtcacaaggccatgttctttgttaggtgttatattatccgaggatgtgaaaatacgagatgtcgggatttataattcccctaatgaatccaaaactttatgtatagtttactgttcggagtttattgaatgtcgtatttatctaattttctgaaccaattcttaacgaatccaaacgtataccttataaccaatacggtccacatgtcgtttaggttactacattattagaacgtaacttacacaaagaaaatcgaaaacaaaaaagaaacttgcatgattacgaagttggcagtgaattcttgtggttagcgtaatagcgtgatccaccatgccccctactttgagcatgatggatcacattaaaccgacgctgaaagaaatttaacggctaagccgacgtcgaaggaaattatggaccatgcgtcaaaatttgtttgggagcataatcacaaaaagaaaaggagaatcgtaagaattctgaccgaaaaatattttaagggggtcactccatgaaattcaaagattttgaattctttctccaagaacaaaccgggaaaaactcgaatctatctaccaattaaaccaaaacactatcgacaattgcaatatatgcccatatttgggattttattttacatatcagcaaccaaaaataggggttctgcacaaaatgcaacttagttttttgttaatggacacccattccccaaatcctcttttttggaagactttttatggacccattgcccaaatgttctcggatgcaaacagatctttaccataacttagaaggctttcctactaatatccaacatatcctttttgcttacgagatatatggagtgggccacttgtttgggctcaaaatatatatagagtaaaaccaataaggctatgtgtgagatgattgaagaaatagcttactagtggcccactccatatatggggttttaagctttgtagttagtacaacataaacaaattgtacaaaatcatgtatgcagtatgaaaagataataaaacgttcgtcatatctcttagaagctctctttcaagatatctcggaacatataaagcttgaacatattctctataaatatgttagggcctatctacaacctaactttgtttatcacttgccatttacccggaagcaatgtcaacaatttctacctcataagttttcggagagtatccagagtctgttagtatttgtttgttgttctattgtttcaaactggtggtgtagacgtgtagtgagtgataataaacacaagaagtttgttatcaaaattcaggaaccatatatttttctatttgtttttcaaaggcaaagaattgtattcaaaggccaagaattgaattgaaactcgaaacgtccacatcgaaatggtttggataaactgctaaatgttttaaatgactgtttccctcttgaagagtcttttctttgctagccgtagaaaataatccatctgattcggggccaaggacgacacccccggactcctaaattcattttttttttttaaattttttttttttttggaagttaagaatgaaaaacatatccccacgtcaaagctcatctatattctgaaactattagagatatcatacgtgttaaattaagagcgattttaaagaaaacattagttctgaatgaagacgtgtgttcaatggatgaaatgcgattcagttcaaaataataacaatatatatatatatatatatttatttatttatagatattcatatatatatataagaaaatatatagatatggtcatatggatatggttgtggacttgtgatgcgacaaaaaaaaattgaacaaagtggatctggttaggtggccagcatcttttacggaagggaaaagttggatatattacaatatttttggtggaccatgagcaaccccaccacaaagtgcatgtgaagtgaccacttttctgcgagctgatccaactaatcaataatggtaacaaatacaaaaaataaacgctctaattttatttcagtcaaatgtttttaataattttccatgtccgaaaactttaaaatcttttattattactaagttaagaaaattgcaaatgtaagaattatttgtttctaaatagataatattaataccaaattgatattccaaaacatattattttcttgtttgatttgattgataatctattaactgataaacaacaatgatagaaatatgttctctaattcttcttctctagcattcaaaaattcacatccaacaaaaccataaattttgtaattttagatacaattttacactaaaaattaataattgtaaagcttgtaattatattcccaaactttattctataaattaaaacttagcattcatattgttgaatatgacttttgaattttgttagtgggacccttttatacaataagtggcggctacaacgaaaaatcaaagtagggaccaaaatgatacaaatcgtaataacggggtcaaaataacataatccaaacttttaaatagcataaatacaacaactctcaagacctgtacaagctatttcacctacttcatcactcatcaccagcttcgcatcttcttctccggcttgatcttctctcgtttctagatctccgacgatcggaatatcaaatccgatcgattaattctgtcaatcacacaaaaaccgaaaaccaaaaaaaaacc

SEQ ID NO: 9214 - DNA, 3000 bp, Unknown
  misc_feature (1)..( 3000): cDNA_ID_3040602_gDNA_ID_1972022_Annot_ID_178100 3000 nt of promoter + ATG
acatcaaaagaggaggttcatgtccgtaaaaagataaatccgcgaatcaacggagtaagctcaacagttcttggacaatggagaaaattcgcgcatgttattggcttcattcctatgcttctattgatgcgttgtgttcatcgaggtaactctaacaaaaacagaggcagtgaaggttactcgaggcagcctacgagaggagattgtaacaatcggggaacaatactcatgatggaaaatgctgtcgtgagaagaaaaatttggaagaagaagaaagagaaaaatatggttgacgaacaaggttttcggtttcaagatagtttcgtattgaagaagttggggctttctcttgctatcatcttagctgtttctaccataagtcttatttgaatactgaggttcaatatatcatatatggcttttcacttttctattgtactcccatttgcctaggtcgtatttactctcatttgctttttccatttctctaaagtcgtctaaacaaaactagatttggttattttctgtttatgtattaagtgatatgatctctccgcgggttgaacgatcagtcttctgtctggtttttattattattattatgtttgcatgcacgtaagacggtaagagcagattatacgaacattaacaatttagccatcttgtatttcagtattttagtcactatagatatgtgagtaagtttatagtcattttcataataacttgtttattataacgattgctgttccatgttttgcaatgtatagatcatcaaaaattactatcgagctattttgttcttgaatcttgacagataatatttaagaataacctatacggttcaaactgtcggtttcaatattaaaacaaatgtgaatggaagatagagagaggaaaaaaacctctcttacaaaagaatctaggtgcgtcagagaagctcgccaatctcatggagccaagatttgctttcctggctcttaatagtttgtatggatcggcgattgaaacttcattattctctcccaaacaaaacatagaataaacgaatgtgtctaacgctgagtgaagaggactagacggacttgccccgtcataatatgcatattacgatacgttgcaacattaacaatgtcgtgagtatgcatatctcataacataccaaatatcgatacgtttcaacattgaatttttaatatcttagtcattagcaattaataattaaatcttcttttatatgaacaaatttatgatttacaaaaaaaatagatgttatgtttccatggatcatgttttcaagcttgaccgaaaacaagctgctaaaaagtgtcataaaagtttggtactagtacaactaggattttgtaactctagcacaagaaccagttcaaaagatgattatgcatactggatttttatagatattgttgattcttgcatggcaatcaaagagtttggcagctaggtatacctttaggggtgatgtcgacacctctcatctagccttacttgctgaagtataactacaattgaatctcactccccctaccagaaactgtttccttcctcatcttcattaggatcagatcggatcacaacaacaaacttcgtcgaactcaaccacgatggacagtggtggctgaggttcgttgcctgttttagggttgaagattgagatgcgttaagtgacttgtgagactttaagtaacacacaacgacataatttagggtacttgggccttaatgggctggattggagtgttacaatatacaaagttcatcggaagtttaggtttattttaaaagatgttcaatgtggatcctaatttcatgcgttttaaaatactttaaacataaatcccaaccaaaaacaaaaaactcccaatatcctttgaaatttacaaagttctttgaaagtttaggttatttaaaacattgttccgttgaaatatggatccattaattttcatgcgtcttggtaagatgtatcatattatggatatggctttgagcctttgactttattcctactttaaagttacaacttaaatcccatttaaccaaaaaaaaagaaaacaagaactcccatatcctttgaaattcaagaaaaattaatgatacagttggtatatatcattaacaataattacaacaccctaaaatgattataatttgcgttatcttttacgatctcaaatcttggagtcgagattgtggtaatggggattgggatgcacgtggtgatacgtaatgggtgtagacagaaaatcacaagaaagcgaaagtggtaactattgaaacacaaagtgacaaatcaaataatagtcgcgtgctttcttcacgggtcacctcctctattgttctcacaatcaatcaaaacctcactttccaaatattttttatatttttctaattttttttttggttgtggtaagaaattatttcattgtgttataaacagcattgagatcgatttttaaatttcttaaacggaattaaccagaaatttatacatttatttgtttttcacatgcttttgcaaccttgacacaagtttcaatctgtttgaacttccatctataggaattggagagacatagggataatgaatcaattgtccgtataaacactatactaaaatgaatacaaaagggtattcacatgtatgaagaatgtgaaatagtggttgcatatacatttacacttgagtgaggatgtccagtgaggcaaatattccatctgaattccacaattattcttaaatcaaactaaaaacaaaaagtacattccaacagaattctagcatatagaaaaagtttatttatttttgccaacaacaataataaaatatttctccctatcactctccactctatctctctccctctatggaaaacccacagatatttgtcttgtgaattcaagaagagccaatctaaattcaaaaagggttaattgtgattttgtcttctttcttcatcaccattaacagtgataatg

SEQ ID NO: 9215 - DNA, 3000 bp, Unknown
  misc_feature (1)..( 3000): cDNA_ID_3040610_gDNA_ID_1972022_Annot_ID_178097 3000 nt of promoter + ATG
tttcctaaaagggcttcattcgaggagttagactacgagtgtctcatccagaggggagagcctacgccctcgatggtggcacgcatgttccgtattcaagacgagcatgatccaatctccttaaactacacatcgggtaccactgccgacccaaaaggtgttgtgattagccaccgaggagcatatttgtgcacattaagcgcgattattggttgggaaatggggacctgccctgtctacctttggactctgcctatgtttcattgcaatggatggacgtttacatggggaaccgcggcgcgtgggggtaccagtgtgtgtatgaggcacgtgactgccccggagatctataaaaacatagaaatgcataacgtgacacatatgtgttgtgttcctacggttttcaacattcttctgaaaggaaattcacttgacctgtcacctagatctggaccggtccatgtgcttaccggaggttcaccgcctcccgctgctcttgtcaagaaagttcaacggttggggtttcaagtgatgcatgcctatgggcagaccgaggccactggtccaattttgttttgtgagtggcaagatgagtggaataggtaataatcatttgtactatttattctcatgtatacggtataagtttccctttgcgttatcgtttaccaaaatttaaaaggtcttattactcaattgaaacagattaccagagaatcaacagatggaattaaaagccaggcaagggataagcatcttaggcctagctgacgttgacgtgaaaaacaaggaaacgcaaaagagtgctccgcgcgatggaaagacaatgggagaaatcctcattaaaggaagtagcataatgaaagggtatctaaaaaatcccaaagctacatttgaggcatttaaacacggatggctcaacacaggagatgtaggtgtgattcaccctgatgggcacgtcgagatcaaagatcggtcaaaagacataatcatatcgggaggcgaaaacattagtagtgttgaggtcgagaatgttctttataagtacccaaaagtccttgagactgcagttgtggccatgcctcaccctacgtggggtgaaaccccgtgtgcgtttgttgttctagaaaagagtgagactactattaaagaagatcgtgttgataaatttcagaccagagagagaaatctgattgagtattgccgtgaaaatctgccacattttatgtgtccgagaaaagtggtgtttttggaagaactgcccaaaaacgggaatggaaagatccttaagcctaagctaagagacattgctaaaggtttggttgttgaggatgagatcaatgttatagctaaagaagttaaacggccggttggacattttatttcgcggctttgatttatacttctccgacttatatatttgtatgtatggttgtcgattgaagcacttcattgagggtccttaagagagtcattcaataattataaaataagaaacaaccatagataatacttcatccgttttctattacttgcccttctattttttttatatataagtaaataataagcttaatatatagggattgtttaagggctatattaatacatatgtctcaaaaacttgaaaattagatatttacaatagatagttaaatattaggtaagcatgaaagagaaaaaattaaagccataattatcctttttattttgttttatttaccaaaatgtcattatctcaaaacactatttattaccagatactgtatgtatgatattgttcatcaattgtttgacgatactattcatccgaaatttacaacactatttatcattagattgcataaaacatttatgatttatgtggataactatttaattaacatgttaactagtatagtattgtgctaaatacagataactattttataaacatattaactaatatgtatcacgataaatttatatatatcgtattaaacaatttaccatatcatacaaagtaatatgaaataatcaatttaaaattataataacatattatactgaatataacgtgctaacatattaaatatctgaataatatttctataaatatggtaaaatagttgatatatagtaaaattataagaataattgatacatggcatatatggtaaattaaacaaagtaagaaggacaataatggctttaatttttttctctttcatactaacctaatattgaattatcaatgcatatccattaatattttccattgtttaactgataaaatttatcataaatctgcattataaataaaaaacgagaagaaatatacaaaaaaattgggtgtgtttttttttttcttctcttggcttattccacgtttcatgctttcttttcccctcattttcatcgaagttcttttttttattatgtatttgttcaaatatgtatatttaatttaattttcaactaaaagttaaacatatgagataagcatgttagataggatttttatataccaataaagacacttaaaatgatcataaatggtgtcttaattattgtacatgtttaatagcttcatgtcccaatattatatacctaggcagattcagtagatataaatgtccactaagccaccctactcttaacatgtggagtaatcgctttttcttgtttggcatgataattttataattaaaaaaaaaactaattttaaatattttgttttcgcttttttaaatataccatccattcttctaaaggtggttcctctaacatcatcttttgattatagactcaaaaggaaagtgggatcgtgatatgttttctatgacagattccaaaactttaggcatggccagcttgcaattcatttattattcttcgaaaattacttttatattgcataatagcaattatattttgaggcctctcacaatcttctatatatatatatatatataatgattatgcatgtccctattccctcacatatacacatacaagatg

SEQ ID NO: 9216 - DNA, 3000 bp, Unknown
  misc_feature (1)..( 3000): cDNA_ID_2181198_gDNA_ID_1972022_Annot_ID_178099 3000 nt of promoter + ATG
ttctgaaactgtgtgaggcaggggaagtagttaagcttgacaaaggtgaacaactatctcaattcgcggcgcatttcatcagcgatactgatcaacctcagacttgcaattttgcaaacttttttccacttagtgaaggaacacctcttcaggtgccaattattatctttgcatagttctaaacctaaccaaaattgataaccattacacattttgatatgaggttgtgctggttttgtaatcttgaataagcgagcggagtggatcaaattccttggagcgtttacaaatcttgaaactaaagccaatcaagtctatgactcggttagtgactatttgtgattctcttagcaaaatctgcctacatggtctattcttgctgtttataaagtatgttatggaaactttaaggttaaagcaagctatacttgcttgtctcaaatggctgccaacaagacaaaatccttcaagccgattgtagcctggatgggatatgatcaaaatgtaagaaaactttcttcttcttcttttttgtcaagggttgtctctagctattttaactgttttgtttcttaaaatacgaagataaatgtctgtttatggtttcaaactcataacgcataattgttttttcaagggaggcatgtggagttttactaaggaatcacacaagctaaaggtacgcatttcaatatttgacactttcaattattcccttaaatgcttgggaaaagctttggaactgaacatgacaaacccatacacaacagtttgtagaagatgctggtggtgaaaatatcgacaagtctattaacaaggtctcttacaatgtctctgatcctgatgatttggaagcactccatgccattttatgtgtaagctggtcatacttgttttgctttcatctttttgatgaccaaaaacaaacttcttttgcttagcctctacaattcgattgttcagactgtggatgctgtgatcgatgaaacgctatcatctgaccctcaaaactacacacagacaacgttcttggcgaacataaacgtggatgataactcttgttttgcgtttcttgctaatcaaagcatctggagatatgacaaaagggtcagaaacagaacaactcttggtaagaaagttataagacattgttttttttttttctgttgatttgagctaaaaaccagtgtcttggaaattgtgaatgagtagactggtatgacggagcaatctcgcaaccaaatcttgtactggctgacattgttgaagccttgtttccaacgggaaactatacaacttcgtacttcagaaacattgctaaggtaacaaagtctaatcaactctatactttgacattctaaaattttaaagctcgtcatttttatttttttaatcaactctattcaccccgtttggttgtccaaacactccaaaccactcgtatcatttttcgtctattataagttgcataattttgaccacataactacacatggcagggtgaaggagtcataaacattagtccggatatgtgtgatagagacgcatcattgccgttagttccttcaattccagcttgtggatgatttttctatactttcacagctcaccaagtattccccaacaaacgtcgaatgtaatatttgacaatgatagttgttagagattttgatttttgtccaagataactacgaataatgaattagaaaaaaatgattagactattatgacaatgatatattatgtattatatatataatttgaacgtgaaaataaggtctcgaacacctctttgacgacctcaaatgtggaaaaagcttgaatgagttcaatacgaaatttgagttgaaaggtgattctacaccggaaaatcttttttggttgaaactcaacttcatactatactgtccaaatttcaataaatttgcatggtaagtaagtttacatcccagcagatgatcttttagatgcttttgcatgataatcatatatcattattttgcttacttgcatccaaatgacaaccaaataagataaaaaaaatacccaaaacacaaaagaatgataagaaaagaaaaaactaaagaaacaaaaagctgaaataaaagttataagaaggtaaaaacgaatcatcatcagtcaccatctggatttaaattgacgaaaaaaataatttagctctgttggatttattgagtaaatgaagagggatacaaacagtatggatcaaccttgtcggtcagtagctgagataaatcgtggttcgtggaaatcactcaattccaaatttttttgaaacctgaccacaaaaaaatgttgagaaggaaaaggacccttgcaataatttcctttcaataattgcaagcgacagattatttttatttccaaaattagccgcgttttacatttaggggtgttcctatttaataaattttcatgactttaataaaatcatagaaaaatgaatgaatgaatggttttaaactatcttgtaaattttctcaaacaatttttttattttgatgatatttttcattattttattttgtgaagaaaagtatataaagttataaaccaataacacaataatttaatttattaacaatcataaattctttttgttttaattgaataacaaaaaaagttttgttaactttataaaagaagaaatccaataacttaagattttagattattttttacaaatattaaactaatatcaccaaactttaccaaaattttaaaaaatcttgattaaataacaacaaattctacataacatttaagtcattaaaactttatttaaatcacacaccaataattaagtgacaaattatttttcttactttttagttttagccacgttttacatatagttcttaaaatatgacttgttgattctcattatttttctatatatacattatatctttgtgtatcccttttcccacacataaacgttcattaaacacaaagaataaccagacgaagaagaagatg

SEQ ID NO: 9217 - DNA, 3000 bp, Unknown
  misc_feature (1)..( 3000): cDNA_ID_3040606_gDNA_ID_1972022_Annot_ID_178098 3000 nt of promoter + ATG
ctgcggcccgtgggggtactagtgtgtgtatgaggcatgtgactgccccggagatctataaaaacatagaaatgcataacgtgacgcatatgtgttgtgttcctacggtttttaacattcttctgaaaggaaattcacttgacctgtcacataggtctgggccggtccatgttcttaccggaggttcaccgcctcccgctgctcttgtcaagaaagttcagcggttggggtttcaagtgatgcatgcctatggtttgaccgaggccactggtccggttctgttttgtgagtggcaagatgagtggaacaggtaatcatcatttgtactatttattcttatgtatacagtattaggtttcacttatcattatcatttaccaaaatttaaaagttctttaatttattgatattattaagattaatatgtcactcttattactcaattgaaacagattacctgagaatcaacagatggagttaaaagcaaggcaagggctaagcatcttaggcctaactgaagttgacgtgagaaacaaggaaactcaagagagtgttccgcgagatgggaagacgatgggagaaatcgttatgaaaggaagcagcataatgaaaggctatctgaagaatcccaaagctacatatgaagcatttaaacacggatggctcaactcaggagacgtaggtgtgattcatcctgatggacacgtagagatcaaagatcggtccaaagacataatcatatctggaggcgaaaacattagtagtgttgaagtcgagaatattatttataagtacccaaaagtgcttgagactgccgtcgtggccatgcctcaccctacatggggagaaaccccatgtgcatttgttgttctagaaaagggtgagactaataatgaagatcgtgaagataaacttgtgaccaaagagagagatttgattgagtattgccgtgaaaatcttccacattttatgtgtccgagaaaagtggtgtttttggatgaattgcccaaaaacgggaatggaaagatccttaagcctaagctaagagacattgctaaaggtttggttgctgaggatgaggtcaatgttagatctaaagttcaacggccggttgaacactttacttcgcggctttgagattatacatctccgacttataaatatgtatgtatggttgtctattaaagcaccttagcttcattgaaggtcttaagagagtctctcaacaattatgtatggttgtctatatatatagtaatgataaaattgtgattctccattgatggacagtcaaaacattgaccaaagtaatcaattatgtacgtagttattaaaatgacatttaaaatttaaaatttcttaccattttttatcacccacacatttaaacaaaaacaatattctccaattcataattctagcacgggaaacattgaacatattattaggcaatgagagattttgatctcgtccaagattaccgaggaattaattatgcatggcaattctgagttgtgactaccatgttttttttattagtcttcttttatttacattaatcatgtgactacaaagttgccgtttatccagttctaaaagggagtgaaaatgaacttaatcaaataccaatataagccacgcaattcttgaatcttttcgaagttcatgaagacgagattgtatctgaaatccttacctgcgaaccaactggatgtggatcataatagatttcaggttattttaaaatttcattttggttaaccgatcagtttggatgaatccaaaattgaagtggatatggaaactggatgagaaggtagttacctaaaagttaggtttagaccgagtcgacttgaaatgagccggttcagatattgtagttctacttagatcgaccaatcatttttaatgcaaaacacaaactcttcagaataattgacaagtgcaagggaccggttgatgtccacttgacctttcgagttatttatcactttttcagaagtcaagtggacatcgcccggcctctttagctcgtcgattcttctcgatagtttgtgtatttgcattaaaatgatcggttgatcagtggaaatagtttatattcatcaccttttgggtcagtctttaagacgtttagtcagtcacctcatttcttctacaattatcgttgcactttatctacgcatcagaatatcataagttcattacttttgtctttaccttttgatctgccggttgatattagttgaaacaccggaaaatcttttttggtaggaaattaaacatcactggctagttgaaactcaacctcgtactatagctatccaaacttcaataaattttaatggtaggaaatttacatcccacattatgttttagacgcttttgtatgatcctatatcattattttcttcacttgcatccaaatgaaaaccttacaagataataatgctcaaaacacaaaagaatgatacacaaagaacaagggggggggggggggggggggggggttggtggggagtcgaaacaaaaggttgtaagaacatcagtcacatctggatttaaatttgacggagaaaaagaatttatttcttaatgatttatgagtaaataatgatggatacaaatgtatggatcaaccttgtcggtgagtaacagagataaaacgtgttcgtccaattctgttgaaacctgaccacataaaaatgttgataaacgtaaacgcctatttatgtagaattaaaattgagagattttttgttaaaaaaagtaaaggaagaggaccgttgctataatttccttttaagtaattgccataattgagcgacggattattttgaattcccaattttagccattttttacatctacttccgaaaaatatatgacttgtttattctcattaattttctttatatactatatcgttgcacatcccttttctctcacatcaacattcatttaacacattacacaaagtagaagaagaagaagaagatg

SEQ ID NO: 9218 - DNA, 3 bp, Unknown
  misc_feature (1)..( 3): cDNA_ID_4305304_gDNA_ID_1972023_Annot_ID_178121 3000 nt of promoter + ATG
gaa

SEQ ID NO: 9219 - DNA, 3000 bp, Unknown
  misc_feature (1)..( 3000): cDNA_ID_2181300_gDNA_ID_1972023_Annot_ID_178136 3000 nt of promoter + ATG
atggaccgcaatgacttgtaatctgattctaggattcaatatcggagttattccataccctgagcaatcatcaagttcatgttactttatatcagctggactgatcaagttcatgttatcttcaaatcagttgtatttatatatacacaccttttcatcagagctaactgtcatcttctgtgaaacaatcacttgttcttccctgtttttgtaagtattacctacaacccatgattacgacagataaaaaatctgaggagttaatgacatcagagcaaatcaaagcaagattgaaaatatgatcccaccaccatcactttcagcagacgaattaaactccccatccttgaagagaatgagccttggccccttcaagccttctccatcctcctaaatcacagagagaaaaaacttcaacaaaacgcatggtcaaaaggttttaaggagatgacctagaggaacctgtaacttccaacttacatgttcaatagcgctaagtctaaggtcatttgtcgtgaatctctgcagaataatggtagcatgtcaacaacagtgtattgctcgagaaatataaagcataaagagaatgataaaacaagactgagatctgaaaacttggcacaaaatcaacagcatgctgaaaacagatgaatccagagattgaagactaaggaacacatacaattttggataactcttcaataaattctctacgacctgcaagaagacaatcggcaatggaaaatcaaaacaaatgtcagatgaaaaaatcccaagaccaagacaacttctaacaaaagcaagcgaatttcatgtgaatcaatctaaaatcaaagcaatcaagcatttccacacgatcgtcaagtacaatgaaatgaaaataagaaggagaggagacgaaactgaccaacgggagtgatgctcttaagccgattcgatacgaaaataagcggagcgaatacagatatcgatagcagagcgaggatcaaaatcctctgccatcgacgaatttgtttcatgaatctacaaataaaaaaaaatccccaaatctatcttcctcgatgactattcttatcacatcaaaccctgaatcgttctccaggaagaagtagcaagagactcacaaatctcggagatatcctgcttgatcaacaagcaaaagaacgaaacgtgaagaacttagggtttctgggattgcttttctctagtgggagattctattcctcgcttgaatttctggatttggggtcggagagaggagttttagattcagagcttcttcatgcatcatcgggggattgtgctcacttatatatatttaattaacagaaataatcattgtttaatttgtgttaggtctctataaaattaaattaatgttattggtcgaacgaattaatttgtttataactttatagtatatagttttttgggtgttcgtgttgacatgtcaaatgttattagggtgaaaggaagcagtgatgcggatcaggtgcgggcaggtgtacatgtgaagacatgtgattatgccgttgatgaagctgtaagtaatttaatgtgatcagtcttctttgcaaattttatcaatcaccagtcagacgaagacacgtggataaagtttttcctccctcctcttagaagacaagaaaggaacttcagtctcatatcaatggatgattagcctattattatgaaaaagatatctagcatgtcggccaaaaaaaattatggcataaatagaattgtaacgaaaaatgacttttgccgattctgttcattatttttcaacaaaaatgttaactggttaacgaaaaatgtttaactaagtcaaatgggtgttaacgttgactatggatgcttttttttttttgagccaagtaagattacattttgggttttttctttatttaatgaagttgttggcaatttgcttaattcgctattggaacgacgggtcttttcatttattatgtgtaaaatggtggaggtagattatggagtacataacactcggtttaataaatcatgacagtatcatataaagatacttaatatgcgcaaagctttgaatgatcaaaatcgctagctagtgtatcatcaaattgttgccgaaaatcttaactttgacgtcggttaaaacactaatcagcataggacacataaaactacatacgtacatatgaaaatttctctgtttttcctaatcaccattcatctgtatgctactaaaaatcgaggtgtcaatattgaaagtttgaaaccttattagccttcatgcttcgattagcgaatgggtacataagccttctacaggccctttggaacaaaacctcttatctgatgttatctcgtaccccattatacgaatgacgaatcgttacatttggtcgttgattcgaatgttccatattcattgattaatgtaaacgaaatccattattatagttatacaaatcatttttaccatcatctgattataatatgaagagttcaccatcatttacttttcaaaatattaggatagcaaataacaatttctcacccaaaaagttgaaaagaaatttatgtcgttcaactttttttttttacaaaactcttctttcctaattagattaaccaaaataaagaatgtttgacctagttttcctaattaaagtaacacaaagattttgacccaaaaaaaaacgtctttgagcgctcgttttcttgtcgacgagagagctcttaagacagaacacaaagataaaaagagaaacccttgttccaataaaataaaaagaagtgacacatcgcgtctcttaaattttaatagacgacgacggccacttcttgtccgaatcgtacgtcaattcttcttccatctctctcgcaccataacatttattcttcagatcaccagcgaccgagcgaaagaaacgacacttcttcgccgttttcgtccacatgcagttttggggatagcacgttgtgagtgattaagcccaacagataaagagaaag

SEQ ID NO: 9220 - DNA, 3000 bp, Unknown
  misc_feature (1)..( 3000): cDNA_ID_2181294_gDNA_ID_1972023_Annot_ID_178134 3000 nt of promoter + ATG
gggtatggaataactccgatattgaatcctagaatcagattacaagtcattgcggtccatgttgattagtttatctaaggaatagaaaagccaagtttcactttccatcaaattattagatgtttcatgattacaatttattgggttttttttgtgtcagggtcaaattctaccaacagtcaaccaacttgctaataaaacggatttcaagccccctttatctaagggtgaaaagaacacaagggttcagcccgacagagcaacagatgtgaaaacgaaggagatcagagacaaaattattcaagctaaagcctacctgaatttcgctccacctggaagtaactctcaagttgtgaaggagttgagaggtcggctgaaagagctggaacggtctgttggtgatgcaacaaaggacaaggacttatcaaaggggtaagcacaactgcttgattcaaaaggagaacataccataattgcattcagaaatttgctgttacaactacaaccttttagtgccaaaagtcgtgctgtttaagaatattattttagtaacctctgacatgattgtttctttcagcgctctccgcagggtgaagcccatggaaaatgtgttatataaggctagtcgtgtctttaacaattgccctgccatcgctaccaaactccgtgccatgaattataacacagaagaacaagttcaggcgcagaaaaatcaagcagcgtatctaatgcagcttgcagcaaggaccaccccaaaagggcttcactgtctctcaatgcggctgacatcagaatacttttcactggatcctgaaaaaaggcagatgcctaaccagcaaaattattttgacgctaatttcaatcattatgttgtcttctctgacaatgttttggcttcttcagtcgttgttaactctacgatatcttcatcaaaggtatcatgcatttcttatacaaatttctacttggttatcattatatgttatacctaattttagagtgtcttacactatatcttctcatttacttccgccacttattaatgtggcttctgattgctgtttgcaggagccagaaagaatagtcttccatgtcgtgactgattcacttaattacccagcaatctcaatgtggtttctgctaaacattcaaagtaaagctactatccaaatcctaaacattgatgatatggatgtcctgcctagagattatgatcaattactgatgaagcaaaactctaatgacccaagattcatttctacactcaatcacgcacgcttctatctcccggatatattcccgggtttgaacaagatggtactcttggaccatgatgtagttgttcaaagagatttaagtagactgtggagcattgatatgaaaggaaaggtggttggagctgtagagacttgtcttgaaggtgaatcttcatttcgatcaatgagcacatttattaatttctcagacacatgggtcgctgggaaatttagtcctagagcttgcacatgggctttcgggatgaatctaattgatctcgaagaatggagaatacggaagttgacttctacatacataaaatacttcaacctggtacgctatatacacacacacactctactgcacttgctctccctatggaaataacactgtagccatattcaaagttttcaaatgggttcttagatttgttgattcgtcattatatatgaaaaagattgtaataattattaggttttaggttggctatatcgaggatgaaaggttttgaatttagaacacaaataacattgctgtaactagcaaagaacataagcaagctagtgctaaagatcatctcctagaagaagaatggttacaagcaacaacatatcttgtctatgtaatgggcgtaaacctaacaatggttttggggaatttgtttttttggcagggaacaaagagaccattgtggaaagctgggagcttaccaataggttggttgactttctataggcaaacattagcattggacaagagatggcatgtgatggggttaggtcgcgaatcaggagtcaaagcggttgacatcgaacaagcggcagttatacactacgatggggtcatgaagccgtggttggacattggaaaagagaattacaaacgttactggaacatacacgtcccttaccatcacacctacttgcaacagtgcaatcttcaagcttgatacgaaaaaaaaaaaaaaaaaatctggcaacttaggttcagtttcagattctttttgttaaacaagctactcaagcatgatatcaatgttatgattagcttcattctttatcccacatcagtgtatatcttggttcttcttttttcacacttttcatcagagcttaatattacttagactatagtgacaggctgacagcaacagattgttgtcataccttggacttggcccaatttccttttttggcccaccggtatgaataaaaagagtgcggttttcagttcggttcggtttataagcgtaacgatgacaaaccgatcggtttgttttaattcttgactttaataactaaaccctaaatcgttcttcttcttccgcatcttcctcactcgattagtaggttctctcttcttccaatctattcccaacttctcacttttccgtctaatcgttgtcttcatcaccatctctccgagttcccttcgagaccatcttatcttcaatggtttaggtattgcccgattttagatagttttgttctctcgtatagttatgacaatggcagatttttgtacgctctgcacatgcttaatcttgaggattgggctattattacgtactatgatttaatgaattttagatttgaattttggaacttttgatgatatgcatgttaatgaccaagaatgctccgaatttgtctgattcgttattcgaattctacttctttgattgtttgtttccaattttccatgcatctgacttgtgaattttgaacaaaattttcagaaatg

SEQ ID NO: 9221 - DNA, 3000 bp, Unknown; identical to SEQ ID NO: 5864
  misc_feature (1)..( 3000): cDNA_ID_4262256_gDNA_ID_1972023_Annot_ID_178142 3000 nt of promoter + ATG

SEQ ID NO: 9222 - DNA, 3000 bp, Unknown
  misc_feature (1)..( 3000): cDNA_ID_2181315_gDNA_ID_1972023_Annot_ID_178140 3000 nt of promoter + ATG
aagatcaccttctctttcatatctcccaaagaaaaaaatattgccaaccaatcatttacctgaaatttcttcatccactaataagattcagctgaaacaaaaaatctccatcattacccgatgttatcttctggtttacaagtctctatgcaaatccttgagagccatcaaaggtctccaaaatcacgccgccaaagaaaatatgtgtgtcaggcgagtttgtttcaaagattcaagatgaagccttcacacaacacctcccaagttcaagttctgcaagcaattcagaaaccactttttccattgagattgtttctatcagctgcttgttgctcctcccatcctttatcatcccttttgaaagaagattgattctagatgactctgaattttcagccaggagttgttcgaaaaacttctcttcatcattgagtttcgaggccttcatcagatccaccacctgatgcctttttgcaacatttctacctgctccacagcccattgcagttgctgctccaaccgcatttgcaattgttaaggtattaacaagcggcatgttgcgtatataacctaatgcaattgcagccacaaaactgtctccacatccaacagtgtcaaccacttccacctgatgatgatcatgttttcgtaaagaaaattagatcactacacaaacttacttactctatgatacatacataataattcaattttcaacaccttgatgtgaatgccgaaaatgaacgatatttatgatctgtaagcaggtaccttaaacgcaggtgccactgagacactagatttcgtcactagaattgaaccctttgggcccatctttacaatcacccatttcgttccctttccgttcctcagaatttcttgtcctgctttaacagggttcctgatgccagttagagcctccacctaagtaattcattaaagaggtcaacaataatttgacacagtagagaaattttcagcattagcgagagatgcacaatgtacctcctcagatgttagaagaagaacatcactcattcttaagaaatgagcaagtgctctacgctcatcaggagttcccttggacagactctttccccgtggtccaggatcgaagaagatagctgtcccaactttggcagcgtaatctatcgttgacataataaaactagggctgaaatcgtcaaagtcataaccattgcagaaaagaacttttgactgtctgattgccatctttacttcatcagataggtcagtgatccaactgaaagcaggttcctccttgaaatcagctcgactaaaaaaagagaaacaactagagagaataagttcctatagtagtaaacaagaatattacccatcagaaatttgtttcacaaatagacaaaagaattaggaataaaatgggacagaaattccctgagtcaacaaattcaaagaactaggcattggaggcaagtatgacaatatcacccactagcgtttgtctcaatattagaaacaagatctctaaacaagaaagccatatctttctagacatatagcattaagaacactatcagcaagaaaaatattccgatagaaaatctggtatctacacttttttgtttccaaaaaagttctatcaaatgaaaagttatatttctaggtccccatcaccatccccatcacagttcatgaatgagatgatgcattcactatatacccttagcaaccgtttccccacataaaccagctctaccatccatagatattatcaagttttggcgtggcaaaaagcagtacctgcaaaacccatgcctctgcaaaggatccacaagaacccagcaaatgagagtttcacagaatgagctggtatctttttcatttgttcctccattcaatgcaaccgtacctattccttcctcatgaagcacatcaagaagaaactcaccatagatttcatccccaacgtgaccaatagcaacacaatgaagccccaatctagcagctgctatagccatgttacagttgccacctgcttcccagtatttctataagcaaaacagggaacatatacttcactattaacatcaacagactcaacaatactttaaccttaattcaactgaaacgagaaaacaaagattcaattttctcatcaaagagattgagctaagaagttctttcgatcaatccgaactaaggcagaacaaattatacatacaatgttcgaaattatcaccattgaaacactaagaagcagttaaagtcaagatttagaacccaaaccttatctgggggagacatagagagttcgtccatgagggccttgcgttctccacgagaaggagggggcaattcgtgaacactgagaacaatgtcgacgcagagattacccaaggttgagacatctataggtttctcgaccaccgcgacatctccagtttccccgaaagaacagatggaggaggagccatcggcgtatataaccggagatacatcagcggcgctgctccggcagcggaggcaaacagagctggtcacatgagggactctagcgaatggcgggaggagaggattagggctttgggtggagaaattggagagggataacgcatagtgaggagagaaggagtgaaattttagggaaaaagcgtggtgatacattcagaaaaacccaggaaaaaagaatgaagaagaaagagagttgattttgaatctgcttcgtcgttctctctcagcttctccttcgtcttcaatcttcttgaaatgagatactttattgttcttcaccatttgaggaagaagaaggaaggctttcttgttctgtggtaaactaaaccggagtgaaattggaatatgaaattataccgaaccgggtttgatgtggttatttaaaccgccttgaaattaaaacgggaggttttataagaaagggtttttcatctttacctgatttatacttgtcgacggcggacaccaacagctttcttcatcgtttagagctcacttcaagcc

SEQ ID NO: 9223 - DNA, 3000 bp, Unknown
  misc_feature (1)..( 3000): cDNA_ID_2181311_gDNA_ID_1972023_Annot_ID_178139 3000 nt of promoter + ATG
cgtcttgaagatagctttcctcctcaaccttccaccatgaatctcagtttcctgcttcatttcactttcattacctactatatcctcctcatcatcgccagattgagactcactgtcagaaccttccggcaaagagtgatacgcatcttcagccttaagttttgtttctgaactggcactagtctttttgccaaaaaagttaatgaatgtcttatctagtttctcatcaacagaatactttgtgttctgcaacgactttaccaaatcttcaccaacatctctgccctttcctgccaaaagaaaaaatgtcacaatcagagatgctagagctacaaaaagtgagcaaaaactattgggtttctatcatggagaatgatgtaaaccaaatttaaaatatgtagaaattctttaaacatgaaatgagcaagacactcaaaagagactactgcagttacatacagaccaagcatatgacaataaaacaccataaaataacctttattagtaggttctccctttccatcgtcagttttagagtactgaacttggtgactatttatgttgatgtaaacagcatctttgtcatacacaagatctccaatcccggacataggagcatagaaaagcttatccctgtccctcagcccttttttcttgccagctgaaggtaaaggacaaggatcagttaaagcagtcaccccagctacaatgaagtcaccaactccagcaatatgaacctgataatcataagaaattatatcagatgcatgttaaacatgaaagaaaggtaaactgtaacagctaagataccattttgcacacaaaatcattccactagataaagaagcaaagaaaatttcagtacaacacagaaggtatacaaatttatgctcctcctcttagaacttcactcgatgagagaactagctacgtgtgaatacaacgggttactttaggtagttctaaatatatgtgaatcgctaagaatctatggacgaataccagtaaggaagactgtatatataacatcaaattgacatcaaatcagctcatctctaggctcaatttaaaaattggtcttttcccaaaatattgagtattttgcgccacatactgctaagcaaacaaataggtcaaggattcaggccatagaaaaaggttcagatgaaccagtatctaaggacagtgatgacataccttcatcctttttttgaagttacaaccacgtaggtaaccaaacacagtgatatttctatcgcatttcttatccatctgaactttctccggaggggtaacatcttcaaggcgatcaaccaacacataaggatgtgctgttcgccatgtcaatggctgaggcttgataacaattacaaagcgggcgaggttgtgaacttcacgcggcgtatacctaccaataaaagataaatcaaaggtgaacctcagacgctccttgcacatgtcattcatgttggtgatgcaccaattcagatacttacttcccatgaatgagaccagataaataaaacaatttagctccatgatatatttcagtccaaaaccgatgcttgagatgatgttttgtttttctcagcttcttaacatcattgaacttatcaaggtgagtgagaacacccataactctaggaaatccatgcacttgcataatattgaggaattcaaaggtttcctgagggtgaaacagattaaaagacagttcacgtgtcaaaccttagttgtttatcacaaaaaaatgtagatcacaaaaaaggcccaacagtgatcttgtatacataagaaagattcttcacaatctagatcattatggaaagaggagaaagctacagaaaaatagtgtctcaccatctcaaaaccataactcccgtctacaacaagtagggctagatcagcaacctttgcacaatccaccatcgcattgatatcattcgggcactccacaaattgaaaccttctctgtttacctaaatccatgaccagccaaaatgagagcaggagtaaattccaaccctaaaattcaagatagatgcatacacaaaaaaagaaaagaagaagaagcaataaacaaatacagcacagaaccttgtacaatggtaataggtcctcgaacctcgggtacattctgttttgtaaattccttcacaagagatttaatcacgagagactttccaacctacaggaacaatcaaaacttgtgagaaaataagcaaaaccgagagtgaaaatgcaacatcagtctcaaagacagtactcctggggggccttgaaccacgacgacgaaaggaggagcttcgccataattacgatcaattttcggaagatgaagccgcttttgctccttctccgcagcgtgatgttttgctttcttcgcatgaacaaccgatttaacaccaaacgcctgcagaaccaagtaaaatcgattgttcctataaacaccccaatcaacgaagaaactcttaaaagacattgacaaagagaggacaagtaggagtaacccaccttaaggtttttctgcttgtcaacggagattccacgcttcttcttatctagttcagatttcttcctcgcggtaggacctgatttgggagtcctgtgtgacctgtgagacggcatcagttcgtcggcggccatggcttgaagtgagctctaaacgatgaagaaagctgttggtgtccgccgtcgacaagtataaatcaggtaaagatgaaaaaccctttcttataaaacctcccgttttaatttcaaggcggtttaaataaccacatcaaacccggttcggtataatttcatattccaatttcactccggtttagtttaccacagaacaagaaagccttccttcttcttcctcaaatggtgaagaacaataaagtatctcatttcaagaagattgaagacgaaggagaagctgagagagaacgacgaagcagattcaaaatcaactctctttcttcttcattcttttttcctgggtttttctgaatg

SEQ ID NO: 9224 - DNA, 3000 bp, Unknown
  misc_feature (1)..( 3000): cDNA_ID_2181307_gDNA_ID_1972023_Annot_ID_178138 3000 nt of promoter + ATG
ttgagtctgttgatgttaatagtgaagtatatgttccctgttttgcttatagaaatactgggaagcaggtggcaactgtaacatggctatagcagctgctagattggggcttcattgtgttgctattggtcacgttggggatgaaatctatggtgagtttcttcttgatgtgcttcatgaggaaggaataggtacggttgcattgaatggaggaacaaatgaaaaagataccagctcattctgtgaaactctcatttgctgggttcttgtggatcctttgcagaggcatgggttttgcaggtactgctttttgccacgccaaaacttgataatatctatggatggtagagctggtttatgtggggaaacggttgctaagggtatatagtgaatgcatcatctcattcatgaactgtgatggggatggtgatggggacctagaaatataacttttcatttgatagaacttttttggaaacaaaaaagtgtagataccagattttctatcggaatatttttcttgctgatagtgttcttaatgctatatgtctagaaagatatggctttcttgtttagagatcttgtttctaatattgagacaaacgctagtgggtgatattgtcatacttgcctccaatgcctagttctttgaatttgttgactcagggaatttctgtcccattttattcctaattcttttgtctatttgtgaaacaaatttctgatgggtaatattcttgtttactactataggaacttattctctctagttgtttctctttttttagtcgagctgatttcaaggaggaacctgctttcagttggatcactgacctatctgatgaagtaaagatggcaatcagacagtcaaaagttcttttctgcaatggttatgactttgacgatttcagccctagttttattatgtcaacgatagattacgctgccaaagttgggacagctatcttcttcgatcctggaccacggggaaagagtctgtccaagggaactcctgatgagcgtagagcacttgctcatttcttaagaatgagtgatgttcttcttctaacatctgaggaggtacattgtgcatctctcgctaatgctgaaaatttctctactgtgtcaaattattgttgacctctttaatgaattacttaggtggaggctctaactggcatcaggaaccctgttaaagcaggacaagaaattctgaggaacggaaagggaacgaaatgggtgattgtaaagatgggcccaaagggttcaattctagtgacgaaatctagtgtctcagtggcacctgcgtttaaggtacctgcttacagatcataaatatcgttcattttcggcattcacatcaaggtgttgaaaattgaattattatgtatgtatcatagagtaagtaagtttgtgtagtgatctaattttctttacgaaaacatgatcatcatcaggtggaagtggttgacactgttggatgtggagacagttttgtggctgcaattgcattaggttatatacgcaacatgccgcttgttaataccttaacaattgcaaatgcggttggagcagcaactgcaatgggctgtggagcaggtagaaatgttgcaaaaaggcatcaggtggtggatctgatgaaggcctcgaaactcaatgatgaagagaagtttttcgaacaactcctggctgaaaattcagagtcatctagaatcaatcttctttcaaaagggatgataaaggatgggaggagcaacaagcagctgatagaaacaatctcaatggaaaaagtggtttctgaattgcttgcagaacttgaacttgggaggtgttgtgtgaaggcttcatcttgaatctttgaaacaaactcgcctgacacacatattttctttggcggcgtgattttggagacctttgatggctctcaaggatttgcatagagacttgtaaaccagaagataacatcgggtaatgatggagattttttgtttcagctgaatcttattagtggatgaagaaatttcaggtaaatgattggttggcaatatttttttctttgggagatatgaaagagaaggtgatcttacaacattagtgataaatagttcacataaagagaagtttggcactattttctgtttgtcttcatattgttaaagtcgttaagatgcgatagtttggtcgggattttgtggaagttatgttagtaccaaacttgaagatttacttcaatccgaggagttttgtgttaatttcgccaatcaccattaataatgtagaacgtatcaaaatctacaaaaacaaaattacgtcatcgtagacgcgttgaagtcattaacactaattagtaaatcatggattgggccaatgtgacctcgaataaagtaaataaatcttaggcgtttataccaatgagatgctatttccaacttaagcgacggatatgaaatgaccaacatacccttaaaacacctaacaaggttacagagttacctttttaacctgatgatatcaatcctgtcgcctcttcttctcctttgtcgagaataatatttttctccttgaaacagttaaaccctacactcaatttcttacccgccaaattccttctctttcaatgtgcgattccctttaattgtgtactcgtttctttaattgagtttcaatggatttagagtcttctcaaatttttctattgtaagtttcaaaatcctcctttttttttgtttgtttgcttttctgcaatttgcttctgttctctgtttcttatattcgaaagcattggattttgggcttgtttgtattctgctgaatgtgcttgcatgatcaagttggtaaattttcgaattgggtttgtttttgatgatgttttgtctcctccatgcattgtcttttatgttgacaggtaattttctaaaggacacagcaagaagtgagtttcaggatcttctgtaataatctgattagattctgcagtgttttcttttagttattagaatg

SEQ ID NO: 9225 - DNA, 3000 bp, Unknown
  misc_feature (1)..( 3000): cDNA_ID_3040653_gDNA_ID_1972023_Annot_ID_178137 3000 nt of promoter + ATG
gcacctacaagaaaagagttacgtaatggttctttggctgagagaactgtgaagaaggaagaatcttctggggatgagcttctggagagcacaagctcacccgacactcttaacaaattcactcagaataaaagacagtcaaagaaggtgatcactgaactactctattttctcgtaatgacttcatatttgacatgatttggttacatatttatttttgtttggtacacttcaaaagtaaatattcagtaaaaatatttgatactgttattggtctcacattcatttgagttattttgttttttgcagtcatgtaaagagtccatctccaataaagaaaacaaggatggtgatgaaccctgggattccaaaatggattggaaacctttgaactttctggttgaagtggcaaatgggacaaagcccttgaagtcttctgcttctcaagggtcaggttcaaaatctgagcacgcgaatgtatctcgcaatcaatttcaagggagtaaaaccaaaactaagaataaaaagagaaaatgtaaacgtgaggatgacaagagtaataatggtgatcctacaacatcagaaactgttactcctaaaagaatgcgtacaactcaacgcaaaaggtctgccaccactttaggcgattcaaggaatttgccacaaccagatgagtcaagtgcaaaacaggagaggagaaatggtcccgtttggttctcacttgtggcgtccaatgatcagtgagatttttgctctcatatctgaaactatttcctttcatgatctttctctctttcttcattttgtttctcttctcttggtatattgacaagggcttactggttacagggaaggaggaacttctttacctcaaattccagcaaattttttgagaataaggtaggttacagtttaggtattctttgttttatatatcctgtgttgtcgctgcatcttacatagtccctcatttttctgttatgaggaattcttttgttggggaagataatccaatgtctcattctgtgatagggatggaaatacaacagtttctttcatccaaaagtacctcatgaggaagctagatctcgagagtgaaaatgaggtaagggtctttatatgcactatggcacgagaaaggatagaacgtttgaatataatggaacttatatgtttggttgataaaaaatggacatacttatggtttatgttcagatagagataaagtgtatgggagaagcggtgatcccaacgctgacgctttacaatttagtggatctatggctccagaaaagttcaaaccaccaacggtttgctgcattggtaggttcttctgcaaaggattttacgatggttcttgtctatgctcggaagctaccagagtgcaacatgtaaaggactttaaagactcatgttgttgcagaagaagattctgtggagacagggtaatcttttcttttcggtttatggaatctctcaaagcattacaagagagaacattactagaactacaggagcagtcgaatgtgttgtgaaattagtattaatatttttttctatagacgaaatatacactcatgagtcgcttttctgtgcaagaaaatacaaaatttgtttcccttttctttcttcttcttctactatgtgtcctctctggacttgcatgtaacattgttgtcactttctaatcaaatgttgtagtttaagatgttttagattgatttatatgcatttatttgggtactacatcatttctatggaaactaaggttttcaagaattactgttcaagtgttgactgtggatgacgaatgtagtagaactgtgatgacctatatggaggtagaaaactaccaaattaactacataaaacttatctgacaaaagacgaatgaagttcattatcactattttgtgttatcgtgagtaccactatgtggtgacaaccatcatgcttaatatgagtaacatatttatataacaaattgttatgatgttcaaaaaatgttacgagtatgcaatttaacagattctttttaattcatgctttacatatagccatgatgcttaacgatatccaaaagaaaacaaaaaaaaatcattgaagagattgcacctagactagattgcctctcggatgaccttgtacatgtgttgctcttaagaaacgtaatctatgcatcataactaaaggaaagttatacatgtgttttaatatcaattaaaattggttgattacatacttaaactagtaaatcacaatctatgaataatccggactctttttaacatagacacatgacacatcaacaagtagtgtgcaacatattctagaggatggtcatcttaggtagtattcattcaaatgattttggatcaaaaagtaattgaaatcccacgtttattggttcggttcactccttgattagtcaagtttcatattaacataattttcatcgaaattctctttagcattattcgaaaaaccaaatatactgtaatactagcaagaaaaacaatagttttgacatatcttgcttcataaccgaatatctcattacaaaataatccatttttcacgtttagataatcaaacgaaccctcacagaattttctacacaatgcaaaaaacaaaaacgaatttcatcgagtatatcacgagttatggtcaaatgaatcgagtctaaaagcacaacaaatatgaccaaagcatctaatccacatccactaacttactcatcccaccatctacactccttctttctctgccgtcgataaaatttgatccaacgattaatattcaaacctgagaaaagagtagcgatccgcgtagtcattgttttaaccaatcagaagccagatatgaattgccgtctaatacacatctaactatataaatcggacgtttccaatgatcctcttcacaatcctcataatcactttcgaaattacatttacgctttcttgcaatcaaattttccgatcttaagttcagaagacg

SEQ ID NO: 9226 - DNA, 3000 bp, Unknown
  misc_feature (1)..( 3000): cDNA_ID_2181266_gDNA_ID_1972023_Annot_ID_178126 3000 nt of promoter + ATG
attctatgggtcttaaagacaaaaggctacaaaatgttacccagtttttttacaatacgtcattgttcagcagttgttggtactcgtctactcacaaaaaggtctgatgcctactccagtactccaatacctataagcaaagaatggaaaattgatggagcaattatacgtaagattaagaacaacgagagatataattatgattttaatgccgaaaagaaagtaagaagatcatcagctattaaaacaccaaccctcctaagctcaactaacccattataaagttagactaccatgatgggtgagcattgatttgtttacccatcaatttatcacatcagtggtcaaatatatagaaatcataaaatccattattcctgcatattcaatttctcccttctacagaatatgactcgttgacatagtaaaaaaccaacattgatagtattttatatgctgtattaagaagcattatacatacgctcatagttctacaggtagagtttaccttcaaagctaacttgtgtaagcaactattggcttcttagaacttggctcactatttgtgagggttcatatcattacccctcttctactctacacactttagtttcggggaactgagatgctaatgcagcagtactttattgttattctcttctaaaggtcaccagggtgacgattgtaccttatagactatgactatgtttaactcacctactcaatgacggcgctcttcacgtctcatctcaactcgaaatttatctttaatatcaccctgtgagagaatgtgtctattattagaaacaagataaaattaactccgagaaatgaataaagaacagaaagataagtgaagctgtgtacattagttctgcgcactagaactggattctcatctttgatccgtttccagtttgcaccatacctgaatcacaaaagaatgcatcaaatcaatagaaatgcatgaaagatattcatctaacatctaggagaatcttcaggtttcagtacttttcatagcctttgagtacggccagcgtttctgcagtactccaaggaagttttggccttctagcaccttctgaacatcggtttcttttcaaaggagacacgacaattcttttacgttttgatttattaatcctttcaatgtcatcgcccatttctccatctgaatcatcaatggagtcattccactaatcaaacaaacaaaaataatgtgaaaaacaaactcatctgaacaaacaagtcctatgttatacagttgcatgaaaagcacattatattaactcagctataactccgaaaccgaacatgcaaagaaatcaattcagcgagtcctacacaatactaattcccaccgagtgcagcgggctggtcagacaatatgaaataataggaaaagatcaaagaatgaatcgggatagtgctgagaaaacttagttaatctgtgtgtattgggtgggtattccatcgacctagctatttaaacacaggaagtctgaagaaaaaaacataaatgatatgatgaaacaattagaaaaagaagcaaatttacttcataagtgtgtgctgtgctacgtggctccatcaagctaggccttggtgcagcgtttgttgcagaaggattagcaacatcgttttcttgttctgtaatcgtctcattgtttaaatttgaaggtcttcctttttctaaagctttcattagctcgattttactagctctcagctttctgagcgctctgtcaacaactgcagatggaatgggattgaattgactgggtacatatacagcttttgaccctccagaagtaggtctttccagttcagtatctaagaggctctctacaacaaaaggaatgcatcagaccctttcagtatccacaaaagcacaatcacatcgtaacaaagtaaatagagatgaaagaaacaaagttgagaaagtgtagaccttggtcgtcttcttccatagcttcagacgcctgactgttctgattacccacgccctctcttgcttcaaccattgattctgtctcttcagattcttcactagattcaatctcatccgattcatccatgttgagattctctaaaacaagattgggattcaaatctaaaacaaccttcctcaaacaaaccaaagctttgtctcttgtatcttcatccatcagtgtcttacaagccttgtcgtcagtgtgggccttccataatcttcgacagcatttcaagaggtcaagagtaaccaaacaactaaccttatcgcataaaggcataatcctaccgagccatatcgttttgattgcttcggtgtaagccttttttgcatctttctcataagcgagacacttcactgtgcactccacagctactttacaatacgcttccgtgactgatttgggtactttagaaccttctttgtgtaaaatctccacaagattctctaatcgctcgagattcttctcttccacaataccatcctcaatctccatgaaaatcccttcgagtatagcttccttccactgcgagagtgccattgttgctaaatcaaccaagcaatgtttgggctttttagagaaatcagtactttctcactcgccgattccgtctctcgaattgggttacacaggaaaggtcaattaggtttgtaacacttcaaatttccaatttttcacttttcgattttcttccgattacagaggcgaaaacgaagcgatggaagaaagaaccataactttttgccgtttccatctttaaaaatagaaacgcgtgtcgttttatttactataaacggctcacattcaatatccctagggagaaaacggcaagatactcactgcttctaactttttacattttttaataaacgaaaaatcatcagaaggcatttgcggcggaatcggattcattgggtacagagaagcaagacctaagaagaggaagctgcagcagcagcagaacttgttcaccagtcgctatcttcttctcaaaacgagaaca

SEQ ID NO: 9227 - DNA, 3000 bp, Unknown
  misc_feature (1)..( 3000): cDNA_ID_3040670_gDNA_ID_1972023_Annot_ID_178130 3000 nt of promoter + ATG
tctttcctcaacgcttcgtttaaagctgtaacatcaaaaagcaaatattgaagaaatgcaccaaaatgcatacaaagaaattagcttcttttttttttgtgcttaccattacgaagctgagcttgttgttccattgcttgcaacctaagtttcagctctgtgttttcgtttgctagtccatttgtgtctctctggatcaatcaaaacaacattgaaatcaagatctgtctatgtatgtaaaacagaggaaagaactttcctattctgttgggatcaaacgaggaatcgccgaatatggaaacctggtagagagtaagctgagcagagagagtggtagcttcggtttgaagagattgaactttgcgctcaagttcttgaatgtatcgagcttttctctctttggatcgagctgcagattgtcgattcgctagaatcctgtaatcaaatccctaatttcattgcaattcttcaattctgtggaaagagaaacaaatttgaagaagaagaagaaggaccttttggcgcgtttgggatcgatgttccaaagctcagagagtttttcaggaggcatagctttcttagcgtccatgatatcaccggcatacatggcgcatccagcgtcaacggaattgctgtgacggtggcgaggacgagaggaaggaggaggaggaggattagcagcgccggaaacggagttggaggagagggaaggattttgaaagggattgggattagaggtgaggctatcgacatcgatgaaagaagagaagagatcgtcgtcggagggaaggtcgtcggaggaaggtggtgcggcggaggagaggggatccatgaacatgaacatggacatatcgtcggagcgagatcggcggtggaaggaagaagatggaatcggatcggcattaggaattggatcggaggaggggataatagtggcgccgggctttgggactggtggaggatctgatttctccatttttttaagagaatctgagagatgaatgctttggttgtgtgaataattatgattattattcgcaattgagaacaatgtcaatggagataatgatggagatgaagaagacgaagctctttctctctctctctctctctctctctctctatcaaatgaaatgaaatgaagagcgtaggagagaaactcgactctgtgaggagagagaagtgacgtcactaactataaaattgcgaaattgagttgatttattaataattaaaaagaaaactagttgatgaaaagtaaaaggcacattggcacgtgaaccatcgcagcatcttgtctccctcccttttttttttatttttttttcctttttctttgtattttatttaattattcgatttcatgatttaaatttgtttaactttaaatcttctttgtagcattcattacaagattctgtagttgcttcaacgaaatttattaatttaagctgttatggcattacatctccccacgtctgagtgtatatttttgtatctttgagtcaaaattttaacaagtaaaaaataggcagaaagccttgtatgaactgagagtctgagagaatgttttgtgggataataagttggtaacttggtatggaactatctatggattgggaaacaagtaaaattcacttatagtgaaaaatacttattggttggatctaaatcatacggaggccttaattatcaggcccatacaagaagacaagtattgttttgttttaagaaatcctcgagcatataatgcgcctgtagtggacaggaggatgttttgggccttctcttaaattggcaattgggcatcactttgtttaccggtcaaaataattaaaaagatggtcgtattgatcgctttaagtaataagttttttagttaagtctctctaaattgtcttaaacgcaagtagtggaccggcatcatttaatagtgattcaaattaaaaacctaatgatgcttacttttaccagctaaagtttcttttgtcttttttttttttgttttattattatttatcaacatacttgtgaattgtgattctccctttttttatatataaataatgaacatacttaagatatagtttctcccatttattgtcacctaacgggtattttttaaaaccaaattctgttggaaagttcttctctaaacataaataatatatagctcatgtctatgctttttaatagtgcccattgtatttcttttcttatttgagtaatttattccagctgtttcttttttttccctctcgtaatgatacgacatagtgacatacatcttctgtttcttctttttttgttcaagaaaatcataatgactacaggtaattaatcacacttctacaaatcagttgataatcagcaccattttccaataaaagtcgatactttggaaaatttcgtgacttttagtatcgtgggggccaaaatgcacataaagatacgatatcgatgaccaaattgccatatactatatgattccaatataccaatgattgctactatttgctaatggtatacgtttttaaattttaattaatacataaaaaaaaaatcaaggtgggataaaaaggtaactttattgacaatatttggaaattcatcgcacctggcaagagatttacctactgtcattaaaaaaggattaaaaaaacgacaaaaaggtcaaagacaggtcagacaaggaatcattaaacaaaggaagaaaaatagcaagtagaatggttttgacggaagaaggtggtgaagttatggcggcggcgcaacggaaacttatgatgacgctcttccgtcggtctcatccattacctgaaatagtcaaacttagaaaatgtcgtattatcactcttcaatgctcccacccaataccaactactttcctctttctttgtcttgtgtttcttacttggtcatggccttttccttctaaactctctctctctcgagatttcgttttttccttgggtctcctctgtttcctcctctctcgat

SEQ ID NO: 9228 - DNA, 3000 bp, Unknown
  misc_feature (1)..( 3000): cDNA_ID_3040666_gDNA_ID_1972023_Annot_ID_178132 3000 nt of promoter + ATG
ggaacggttgtggcaattaaaagagcacaagagggatcattgcagggtgagaaggagttcctaactgaaattgaattgttatcgagattgcatcacagaaaccttgtttcgttgcttggattctgtgatgaagaaggcgaacaggtactttgtccaaattcctcttctggttgatgtccaaaacgtttatatgtatctcttattgcttgtattgttaagcgtgcagatgctggtttatgagtacatggaaaatggtactttgcgagacaacatttctggtatgttttacttcttcactgagtcatctatagtggtgcttgttctctatgtgaatcagcaaagactacccaccgatgttcactgttcttaatgtgaattctttggagatgacttataagcagcatagatgatattgtgtgcttttaagttcggctctattcctcgtgaataacaatttacatacaaatatgtgttttggcagttaaattaaaagagcctctagactttgcgatgagactacggattgctttaggttcagccaagggaatcttgtatttacacacggaagctaatcccccgatatttcatcgcgatatcaaagcaagcaacatattgttggactccagattcaccgcaaaggttgcagattttggactctcaagacttgccccagtacctgatatggaaggcatctcacctcagcacgtgtctactgttgtaaaagggactcctgtaagatctcattcctgcattgcttctctaaagtttttttctcaaactcatgactgagagttatttgtcgacttgcagggttaccttgacccggaatatttcttgactcatcaattgacggacaaaagtgatgtatatagtctaggcgtagtgttgttagagctctttactggaatgcagccaatcacacatggcaagaacattgtgcgagaggtaattctgagtagataataagagcgtgtgttttccttttaggcgttatataaattgtgtggaatgtttgtttctgtcagatcaacattgcctacgagtctggttcgatattatcaaccgtggataagagaatgagctcagttccagacgaatgcctcgaaaagtttgcaactttagcgctgcgatgctgcagagaggagacagatgcgaggccttcaatggcagaagttgtaagagaactagaaatcatatgggaactgatgccggaatctcatgtagccaagacagcggatctctctgagacaatgactcatccatcatcgtcatcgaattcttcaatcatgaagcatcattatacatcgatggatgtctccggctctgacctcgtcagtggagttgctccctcagttgcacctagatagaaactttcttcgactcatacaccatacactgtttctttgattattcagtgtgattttgttgttgttctttctttgtacaggaaaaatgattgtaagcgatgtaacggtatatgttgcagacattttaatatgtctgcctttgtgagttatctgttccgcttcttatgtgttttgacttggatcatactggatttttttaccttcgaatcaatataacagtcttataattatacgtacactttcccaatgttatacaaccaataataataccaaaaaacacattacaaagatttggctcaattttgttccttattgaataacatatacatagctaattaatatcataaatactccttcgttgttgtttaacataaatatggcttcactaggggaacgagcgagctgcttaggtgcatggacattacttcgttggtcgaaccaacgagcttgccaccaatgaagacggctgggaccggctttgaacaccctagcctcataagagccttctctatctctcggcattcagggtccttatcaatctcgtggatcttagggttaacaccaagatcttggaagagaacttgaaccgcataggacaaacaacaggagctcttggtaaatataaccacccctttttcggacgacattctcataactttgtccattatcttgcataaggtgaagaagaagaagtatatggattgaaaggagtagctagagtctcaggctatttataacaggagggaagaataactgaataagaatccacatacagagatcacaagaagatcgttgaaaatgttcccaagtccgactttattatatatgagcaagatgattcgacgagaccgaaccttttcttcggcagcctttacccttttgattgtaaggaccaataatatgaatgatcattccatatattttctcttggatacaaagatgcggtctcaacgatcctcctacaagttgctaaaaagagagtgtattcgacgttgaatatagatagatagatgcttcatacttttggaccatttgatttattctgcagattccatgaatatcggacataaggaatcttggtgacccaaactatgcaacaagaaaatcaacttgcattcaacttttcatagctattccaacttggttgggtctcttaaaggcaaaagagctcacatatttttgtatccttaacaaatcttgccgtaatgttgtttcttttgttcagattatggttttaatgtttaatcaaagcttgtacaagtgtaacgtagtatacacataacgtaatcatgatcaaagaagggcaagaatcatatgagaccaaaaaaataatgacaagccaaggcaatgggaaaggaaaacaaattcagaaaactgaaatgaagatgaagaagagcagatgatggagaagagaatcagattgaccataacagtggatcgagcttgtcagtcgtttttcgtgccatatagatatgatgagaatcaaagaggggtatacaacgtgatgattttgaagggtatagttgtcattcttcttactgtagattctgattgaggggtaggtaatttgatttcgctgtagaaattgattggttttgggaaatattcaatccaaggatagtgtcgagcaacc

SEQ ID NO: 9229 - DNA, 3000 bp, Unknown
  misc_feature (1)..( 3000): cDNA_ID_2181290_gDNA_ID_1972023_Annot_ID_178133 3000 nt of promoter + ATG
gaatattttacaaatcttgttttgtaagtgtacttaaaacttgtattttgctgtgctttagggaagctgttaaaaggagaaaagcttcctaaagaagaagaaaatttccagaaagtgtacgtcaaggctccatcatttctttcaattcacatgggtgttaaagcagaggttctccctccagatacagattgccatcattttgtgctcgaggtttgatagtttcctactaagatctattcacttgccaggtttatagttattgaatagcgactttcgttttgctgcatccgtaggacgattggaagaatctggaggagccttatggcagtattttcctcagcattccaaccattcttgattcatctttggctccagatggtcgacatatacttcacatatttacaacttcgtccattgaggattgggaggtaaggctactaatattattgctattttccttagctgtagaattatcctattgagtttttattgatttgctcatctttgtttatcaattcgtctatattttggtactagggactccctccaaaagagtatgaggcgaaaaaggaagatgtggcagctagaataatccagagactagagaaaaaattgtttccagggctcagttcatctattacgttcaaggaggttaggcttgttctttattcccctactattttacatgcacattgtagaaatggtgatagtaggtctgcatgatatgagaaatctgtatctgaaacccatgagaataagcctatgccttatttgggtatttagcctgtatatctaaacgttttttgaggcaggtgggaacaccaagaacacacagacgatttcttgcgagggataagggaacttatgggccaatgcctagaggaaccccgaaaggtttattaggcatgccattcaatacaacggtaagctaaagaaagagatagatagatagataacatcaggtttagttagttctggtggtgaatggttttgctaatgaaagaatggttggactaataataggctatagatggtctatactgcgtgggggatagttgttttcctggccagggagttatagctgtggctttttcaggagtgatgtgtgctcatcgggtagctgctgatattggtgagaaaatgccatatttttgcaatatgttaaatagaatgggttgattattatgagcataagaagcaatcacttttgtgttttgatttttagggcttgagaagaaatcacgagtacttgatgttggccttcttggtttacttggttggctaaggacactcgcatagatccaatacattatttccttttcttctttattatgttaatttctattgttttactatttcttcatagaattttacttttctttattttcttatttcctcgtttacttttttctagttctatataaagaagaccttcttgtaagaaatacatctcataataattttcttaagaagcatagagtttttctctcttctactggattatagagtttctggtggattccagaattttatttttcaaattcatagcttgtagacttgtaaaccgatataggtttggcgcttgcattttttagggtttttcgaccgcgtcagatttgtgcatgggaaaggttgattcataaaaactgtaagcccattaaagtaaagcccattgttaactctaaattatcttcattcagagttatatcttcattcattcaggaatttcgaaaccctagtcaattatcgagatcgatccaaccaatttttttttaaggttaaaagtttttgattcgtgaatgatgatggagcctccgcctacgaaggagattgctttggcccctgtatatgtgtattgggacatgaagaggtgtccggtccagatgactatgatgctcgtcgggttggtccgtgtatgaaacggattttaaggaaattaggctacaatggtcctgtcaccatcactgctgttggctcactagcaaaggtccctcgtgacatccttgaagcggtttcttccactggaatctctctttatcacgagttctacagtaagcatttctcatccttattccctttttattccctttattagataaagagagtctctctaagtatatagtttctgaaacaggtcgtaaaagcatggtttcgtgtttccttggccatggtatattgaatccacgtccatctactatgatggtcatatcccgtccaccagtgtacattcctccacgcttctattctaatattagccgccgacgtgaaaatagatacaactccattttcccgtttccacttgagtctcctcgagaagcctcctccaccctctggaaaaagtttcttttagctgatccagggccacttgatgaggaggatagctgcagtgaaacgcctggacttgcctcctggctttgctctgtgtgccgtcgtattggttgtggtccaggtattgctggtcaaggcgttgataattttatcacgcatatctctactcgagaacatgaactcaatgtaagctaagcatccttgccactagtttaactatattccctttctcagttgttcttttctttgcctacatttgaccctgtgttgtctttttcctcgcagcgtcgaggctgtattaccccaaaaggtgatcgcaataactccagattgaaagagagagatatgtgtaaagaagaacataagaaaatgatataatgagaacaattctttttaatccgtaatgtgtgtgactgccaaatattctcaaatgatccaccattttcatgattttttggctgttagaaataaaacgtttagaatttgtaccaaaatacggggatggatttaaacaatcaattgtacgttaagttcaacacatttgaaaatgatttatacgcatgcatcatgagcattattgtattattgtttattttatataggtccctttatatattataaaagagtgcaataaatttggttacgactttgaaactcatcgagctttcaaca

SEQ ID NO: 9230 - DNA, 3000 bp, Unknown
  misc_feature (1)..( 3000): cDNA_ID_2105733_gDNA_ID_1972023_Annot_ID_178127 3000 nt of promoter + ATG
tttttaggaaaatcttcttagatcattttgtttttgcattgacattaatatctgactttttgcaggccagtatagcaaaacttgaaacttctttatctatgtatggtgataagctagagcttaaagtgtatggctttaatgagaaaattccagctcttctatcaaaaatcttagccatagccaaatccttcatgccaaacctggagcgatttaaggtatgtgaatatttgcatgtatagttgtcatatttttaattctccttttatcttaaatttcaagttttgtgtcattttcttatcctcatcatttcttgatttaacttctttttctttctaaccttgtaggttatcaaagaaaacatggagagagggtttaggaatactaatatgaagcctttgaaccattctacatacttgagactgcaactcttgtgtaaacggatctatgacagcgatgaaaagttgtctgtactaaatgatttgtctctcgatgatctcaacagctttattcctgaactccgctctcaggtaacattctgcatcagtgtgattcctgttttacttaatacacagattttgtgactgttctctggttttgtttaaattgggcaaaggtcatgtaatacctctgttatgttttcagatatttattgaggctctatgtcatggtaatttgtccgaagacgaagcagtgaacatatcaaacattttcaaagacagtttgacggttgaaccactcccaagcaaatgtagacatggtgaacagataacatgtttccctatgggtgccaaacttgtgagagatgtcaatgtgaagaacaaatctgaaacaaactcagtagtcgaggtaaaaaggaaacagtattttcttgtgataagagtcagccaagaagagttgaaaacattgtactttcctcgggtataatcatggttttgaattttaacctgcatctgatttgcagctttactatcaaatcgagcctgaagaagctcaatcaacgagaacgaaagctgtgctggatctctttcatgaaatcatagaagagccattgttcaatcagttgaggttagtcatcacatgtttacctagtttttttaatagatcaaaattgtattcatgtatagtcacacatatatatacatattttggatataggacaaaggagcagcttggttatgttgtcgagtgtggccctcgcttaacgtatcgtgtgcacggtttctgtttctgtgttcaatcttctaagtacggtccagttcatttgctggggagagttgacaatttcataaaagatatcgaagggcttctggtaagtctgtaatcaaaaagaatatattgattttttttgttaaatctttacctcgctccacatatgttaatcggactgtaattgcaggaacaactggatgatgaatcctatgaagattaccgaagtggtatgattgctagattgctggaaaaggatccctctctcttgtccgagacaaatgacttatggagtcagattgttgacaaaaggtaaggatctcaagggtttgaagttatgtgacctgtagtatctatagaactttcaatgatttacttggatccatatccacaacggtcactggcgaatgaaaatggagttaactctctcacaggtacatgtttgatttctcccacaaagaagcagaagaactaagaagtatacagaagaaagatgtgatcagttggtacaaaacctatttcagagaatcatcacccaaatgtcgtaggcttgcggtaagggtttggggatgcgataccaatatgaaagaaactcaaacagatcaaaaggcggtgcaggtcatcgcagacgcagtggctttcaagtcaacttctaagttttaccccagcctttgctaatgagaagaaacatacaaaagagttttgcttcgtcttcccttttttttatcttttatattttgattcactcaattttcttcataccctcattggataggttatacttttgggtgacaaacaccaaaaatatccctttttgttacgatttgagaatacgctttttaaattattatttttatctggtggataatttgatatttattgattagaaaagcattatcttatacaatgtatagatttcatttacccaaaaagaagcagcaaaactaaaaaacagacagaaaaaaaaagttatcaatcgataaaaacttacttcaaataaccatcgaaactctcactaagaaaaatcccatttggaacaattttctccttaatgacaggtatatgtccactggaacaataaatgaaaagaaagtataaaatgacctttgattgtacagtgaatgtcttacataaataaccaacggtaaaaaatcaaatgtgaacgtggatcatgaatagcttgtttgataattacgattatatcccgcggttaatttctctctggtagggcctatcaaacgtagaaagcgaaaactatctttcttcttcctctctctcactatttttctctgtacggtggtgagtgaagaccatcaaaaattgcagaaaataggcttaatctgaatctcttctcctccgtcgaagttttgaattctctctggttctccaattctcctgtgagtctctctctctctctcttccctctttctccttccttatgttctccttgtttcatttcgcgtctcttgaattttgccttcaactgatttctttgatctctgtctcataacggcagatctagggtttatggcttctggctttcaataaatctccttcgttctcccactcttttatctaacgagtttctattttctccattttgcttcagctcgagctgccttaagcttcgcatttacgtttacgttatgcacgaatgaggttcgttttctccagatcgctcttgttttcttcacgttttactgtctaccgttatcattccttgtataatttttggtggattagatcatcgtagatcgtgattgaagaagcgagagataaattaggagagcgaag

SEQ ID NO: 9231 - DNA, 3000 bp, Unknown
  misc_feature (1)..( 3000): cDNA_ID_2105067_gDNA_ID_1972023_Annot_ID_178125 3000 nt of promoter + ATG
taagaaacaagtaaatatattacttcaaaattcagagacaaagggttatatctacaattgaaaatgattaattatcccctgcgtccaacttacttaggggaaattaagtataaataagtatgtgacaagataccttctctaaaccagagtcagtgagatgtatggacatgccgaacacatatgctagagacgagcggttgattccatcatccccaacaccagcagacagtgaggttgcccaacccttggctttgaggaatgaatgcagacttcctctaccctctaaaaaacacaatgtgataaacaacatccttcaatatggacatgcacaagcacacttaataaaactttatacaaaagataaaatcgatgtgatttctcaccatgtcctaatagatgtgctaggtagtcttccggcttcttcacataggcagagcgaagaggagggagagtccatgtcaaatcaagtatatgaacatctttaaccgcctctaggcgatataacttaccgcctttccaaataggaccttctgcctccagagttggcctgattttggatccgtttttgacatcaccaaatagttctacaacccaactttcaagcatgtcgagagattctgcaagatattaaaggtaaccattaaactacaataaactcaaacagtaaagacaagccaatatttaggaatgaatataaagattttccaagaatcacagccagatcatacacctagagaattttacctcccccaatgacaacgagcttcatcagtccaccatggtaatattccttgtataatttcacaatacattcccgtagatcaaccccattttccattgcaccacttaagctcttcttgttaccttccagagcacatgaaggacatattaacaataaatcctctcaagaatatcttaaatgtggcaagtaaggcacactgcggtatccttaccccatgcaaacctattaaaaggatgaccctttgcagatgtatagcactgaagttgttgcaggcgacatgcatcattttggagggcctggttaaattctacaaatttggattttgttagcaagacacttttaactatatagaaagatttatatatctgaatgttgattggagatggatcttttgataatttcaaacaaagaaataagagtacgaaacaagcaagataaacctgaatcaacggccaggacttcccgttccatagcttcagtcttcatgagcggtgcaacaaaaaactgagagaatctaataataacgagaaaacagttctaaggtcaaataagcattttgaataagaaaaatgaaaaggaaaagattaaacttaacagaaagctcaaatattgcgtacggaatttttttacaacaactggtataggaaagacaagtaattacataatgacgaccaggaaggataaaaaactatgcatcttccttacaatgataacaatctctgggcatgcataccgacataaatatcgactgccttggtaaattttacagcaaaatgacgtttatctagatatgtgaagtagcagctcaagcaatttttgtaccttttcaaggccccttgaagaaattctctcttgacttcgaagtgatagcatgtatgctccatttctgtgtatgcgttagaggatccaccatgcttagacaagtaactatcatactgcaagaagtcaaaaccggaagaattaaaagatacatcatgctaacaaaacgaagtccatatccattatatccaagctccgtaaagattcattgttatatctaatcattctaactcggttagtttcttgattcaaagatagaaaattctaaagtaagcagaatacttatttcatatgaatctataaataatgccaaaccattgaaaccatagaaaataatgcaatgcttacttcattctcatcggggaactcagtgctacccataaaaagcatgtgttcttcaccaaacataaacatgagagtgattcaattagtaaaaaaaatcagaagaagtgcattcaaaatgtagttcaaactcatagaaagaagaaaataccaagaaagtgagccaggccttgtgcctccggaggatccaagaagcttcccattgaaacacacatagctgcagcagcctgagacacacaacacaaaatatactagtttaaaaatcaaaacccgatacaagaagaaaacagagatatagcttttaattgaaaacctttttggtctgatgatcccctttccctttcacttcatcttcatcctcatcctcatcttcttcatctccttccccatcttcctcatcatcttcatcatcatcatcatcttcagagctcccgtcactatcttcttcttcaccgtcctcgtcatcttcatcaatttgatccggaacagagccttcggggtaaatatctggatcgtgaatgagcagagcacacaatccattctccaattcaatcactctgtataacctccgatcgtttggtgacttcaccactacattgtccaaagccgagacggatttcattgaagacattgttctcgttttgagaagaagatagcgactggtgaacaagttctgctgctgctgcagcttcctcttcttaggtcttgcttctctgtacccaatgaatccgattccgccgcaaatgccttctgatgatttttcgtttattaaaaaatgtaaaaagttagaagcagtgagtatcttgccgttttctccctagggatattgaatgtgagccgtttatagtaaataaaacgacacgcgtttctatttttaaagatggaaacggcaaaaagttatggttctttcttccatcgcttcgttttcgcctctgtaatcggaagaaaatcgaaaagtgaaaaattggaaatttgaagtgttacaaacctaattgacctttcctgtgtaacccaattcgagagacggaatcggcgagtgagaaagtactgatttctctaaaaagcccaaacattgcttggttgatttagcaacaatg

SEQ ID NO: 9232 - DNA, 3000 bp, Unknown; identical to SEQ ID NO: 7942
  misc_feature (1)..( 3000): cDNA_ID_1809791_gDNA_ID_1972024_Annot_ID_178156 3000 nt of promoter + ATG

SEQ ID NO: 9233 - DNA, 3000 bp, Unknown
  misc_feature (1)..( 3000): cDNA_ID_2181363_gDNA_ID_1972024_Annot_ID_178166 3000 nt of promoter + ATG
ttgtgaaaaaactagaagtaatatctatgaacaatttgaataaaaggaaataggttgatttatttttaggaaaatttattagagtaacccatattttatacataatgacccaaaaggaatgctaaaaatatgagttatttgagtaataattatacctaaattatccttgttttcctttgcagagaaaaacaatattacagaaatgccattactatttaattccagcaaggcaataaaaccacatttatttacgaaaatgccatcgtcgtttttggtaaatctgtggctcttgttgcgacggatttgttatcgatcacagatttgttggtcaaccacagattttttacaacagacttgttttgtaccacagactttactgtgttatgttacgccagatttttttttttccggagattttttaaccgtgactgatttgtttcatatagtctccacagattttatttaaatttcaaaagtaagaatgttgaaaccaaatctgtcactgatttgttttccggaccacagatttttctttatggtggcaacagattttctatttgcacccaaaaatctgttgtgttataacagatttgttaacctcgaaaaatgttatataggcatgacagagttgttttgtgtaatcacagatttaattaacttgttaacaaatctggtgttttacaacagatttttgttaaaaaataaaattactacacagtcacataatgataacagatttgtttttagtgatgacagttttgtttttcagtgtcaaagcataacagatttactcatgtcaatgttatggccgatttgtttatgactagaataacctttttagtaataacagactttttttggcagatttatttttaaaatttcgaaattttttgttatatgagatttattagttagccctcaattaaattatttccggtttgattgtatgttaaatccggtttgactggatttttttttttttttttgaaaacgttacgacagacttttattagccgacagatttttctgaaatattaccatatttgagtcaaggaatattctcgtaacgcctagggttttcaatgaaaaaaactgccattgtcgttttcttttttcttctgtaacgcctaccaaatctaatttcaatacaatccattattcttctacctattcgagatcttagttgcttcatctttgatacaaattcgattcccttgtttattcgattctctctttggtatggatcaagtaattctcgtgtgtggtaaatgggtatatgagaaaacgagatggctttttgtggttgatagtacaaaaggttgccgtgtacttgaaggtaatagtcaaaccagttatgatgatttcatccaaatggtgtatgaggattacaatatcgagaatatcaaattgtatcaccacagaaaacagcccaccaaaacctactaatcctcataattcaatagtgataacatacaatctgccattcttaaacaatctacgacaatattactttaattgataaaaaataaaatgtggaaaatgatttacgagctacaacggattgataagaaatagacttttcggtgttactcgaaaacatgatcttaacttttcggtgtacaagaactggaaaacacgagcgaaaggctttttaattttacatactaaagttcttaacttttggtttgcccatttgcttagtacgttcctttacaagctatgacaacaattaatttaattgataagaaatagaaatgtggtttccataaccggatttctgagttttgttatttttacatttgtttatttatttttattagtaatttttttttttttaatcaaaatatagttttaatactgactgaggttaaatagtgttttaacttaaaatatgagtcataatagttagtcatcgattataggagtcacaatagttatttctattaagattagagtcagtctaagcaattttcacttatttttacgttggtgaacatgtttgtttacatgaacgagtaaaacttcatagtatcttaggaggtacgggacaacgacattttgtttttattaatattctcttaatcattaaaaaggataaacatgtttaacatagtacatgtcagtaaatgaaaacatagttaagtaagaaaattctacagatatttacaaatgtttattgaaaaaaaaagagagaagacaactctattcttggaacgattcaagttttgttttgtttaatctaaacgtacacttaggtgatgatacgataacatggtgtcatgatttgataagaaaaccactttagataatttattgaaagcctgattagctttataaacacacatatattcccccatcaaaatattctacttttccctcaaacaaacaaatattgatcgtactttgttcctttaatctcgaagttgtctttacgtaatatgaaaacataacataactctcttgatattaaatctaggtctagaactcatgcgaaccaagttttggaagagaataaaatgaacctaagaatatatcaaaagatcaaaaatatccaaagaatatgcaagagttagaagtgaatcggagatcaaaaagctgtgactgtgagtaaattagacaatatatcctttccttagagaagaaaattagtgtaacgaatctaaaatataaaaggaatatgaataagtaaaatattcaaaaaagttgctaaattagttaatgtttaaaattggtgaatccaaaattgagagaagcaaaagacggccgtttggagaaagagaaaatttgggaccctctactaagaaaagtatcttccaaattagctgtccaacagctccgaccagtctgttctcttttgctcttctcacacacacacaaacataacatctcctccattttctctcttctctctttttataagaactcttcttcttcttcttctctctcaattccatctctctctctctttctagttcttgttccctttcgaatcaagtgatc

SEQ ID NO: 9234 - DNA, 3000 bp, Unknown
  misc_feature (1)..( 3000): cDNA_ID_3040713_gDNA_ID_1972024_Annot_ID_178174 3000 nt of promoter + ATG
acaatggcaaacgttttcctcatcagtagcagaaacagaagatcaatgcggacaacaacagaatcaaaacccaagaatcttacggtgaagagatcagattcatcttcagactataactactcatgcaagaaacatccgaagcacagacaatctcctggaatatgttccctttgtcttaacgagagtctctccaagttgtctagtgagttttatgactatagctcaagcatgagctcgtcttctttggctaaaacgatgtcgtcttgctcctccgcttcttcggaatcagaatcagatttttcttcgacggcgatatcttcttattactcttctgtctcctcttgtttatctcctctgcaacatagatacagtgagatcgtcgttaataagaagaaaaagaaacatgtcaagaaacaaagcttcctctctagattatttctgtaattatttacaacatttttgtgttatatattcatttgtgcttctttgttttttttcacacctttttaacacacaggagaaaaactagaccaaaaaaaaaacagagtaaaaataataatcacaagacgatacaagtaatggttatttcaaaaacaaaatatttacatcccaattacatgcgtttggtttctaaaaaaatagaaagattttaaaaaatgttaaagaatgtaattcaactagaaccgatttaatataattttcttgaattcacggaaaatgtgattaatttacagtggcattttgtgattctatatgtaaactatgtgaactttcatttttacttttacagcaaacagagaatacagacgaaggctgtgattggttggcacatgacattacagttggcaatacaattaatgtacggtaagaggaaaaagacgtgtcacgcttcatttattcaggtttggtattagagctggtcaaatttaataagtagcctagccataatatttacacaaccgcaattaagttacttaaacggcactactaatcaataatctacacaagccaaatactagtatgaaatatcataacaaaatcttcatcccggaaaagcttttccagaaagtaatttaagtggaaccatgtaatgtacgtttttaaaattaatgctttaatttttccaagatatccagcacttgtaatttactaggaacttgaaacgcttgatgacagttcactaatctaccttgaaacttgtttgctacattgaatacgggctttggtaataaatcatcgtatttatgtttttgattaataaagcaagaatagattaatggaagtagtggctaatgatgttaggaggaaagagcgaagttaggaggaaatgatgagtgttgtacagacagacgtacaagtgaagtggccagttcatgtctgagcagtgatctggtgtgatctactctcagccgttttccacgaacattctctctttctctcccacgtgacgtttgtatgattcttctctccgtacatatcaatacagttacaaattgacgctattggctactttgtaatactagattttcttataaatatgaatatatgatattgtgattttggtgaatttgaattcgtaaaacattaaagtgaattaagtacaaactatggagctaaccgttttttttatttttgttttttcctggcaaattgtgtggataagtttttgcaatccggccctaagtcatttcctttaaaaaataatcagtctcaccttaggaatgaaagttaaacatggtttattaacgataaattaatccgttgtaattgctatagtcaatatatatacagatctttaaaagacaagacatattacagatttacctttgtatactaaataaaatataacttcaaaacagacatttttctttagctattattatggtcagactcaaagtcaatttcttatataaaaggatccaatgcttagtatagcagaagctgttcctgagatggatccatgatttgtgtgatgatgaataaaatattctctaaaatataactatattctgttttcaatgttgttaaatgaagaaacaaaaaagctatagatttaattaaccaaaaaaatgcatatagattttcatcaaaaaagaaagaaagcaaaaatagacgtagcattttaacaaaaaaacaaaatagaagttagcagatgcatatcgtaaagaaaatgataaactaaaaaatgaaagaaaggaagaactccatgtgatataacttgtgagcactatgttcattgatcgttatcgccactaaaattgtcatctcaataatcgttacaaccactaaaaactatgactcacaaaacacaacacttttaaaatttatttgatcatatactccttaaagagaaaaagtgtgaatatcattccaagtctcaagagtgtctaaattagctaaataacatattttgatgtgatatagtaccattttaattgtcaccaaaattatatacttaaacaatttttcaaaacgttaaacatttctatttatttattttaaaaacattttacatttacattgatgatccacaatttaaagtttcaaactaaatcttgaagttttaaactaaatcttgttgatagcactaaattatgatatactataggttacgaacggtgtccattgacaaaattggaaatcgtctccacgtataataacgcacctctttctctagaacaggtcaaacgtcacgtgacccttctctaacctttttagcttcttaactcttaaaatagaaaacaagcgaaaagaccaaactaaactttggaaaaagatcgtcgatttttgggcattcatcatcgtggcattgattgattgattggcatctcatactttcctttttcggctaatctctactcccaaaaatagaaagtctcattcactcaccaagcgaaaacagaacaagaagaagattcaagatccgttttttctgattcttttctttgacgagcggtttgcttttcctgaatgtttccggttggatctttcacataagaa

SEQ ID NO: 9235 - DNA, 3000 bp, Unknown
  misc_feature (1)..( 3000): cDNA_ID_3040710_gDNA_ID_1972024_Annot_ID_178176 3000 nt of promoter + ATG
ctgaggatttggcaagtctaacggtaaattctccggaactagtggtggaacgttctctagttgtacatagttctctagttgatttggtgtccaatctagcggcgaagtcaccggtagaacgttatctggttgtagattgttttgaggatttggccagtctaacgaggaagtcaccagaacttgtggtggagtgttctgaaagttaggaaagtctagactcattgacggtgaagtcgccggaaccagtggtggaacgttctctggttgtagattgttctgaggatttggccagtctaacggtgaagtcgctgaaactaacggtagaacgttctctgattgtatggggcagtctagactccataacggtgaagctgccgaaacttgtggtggaacattctctggtcgtatattgttgagaggatttggcaagtctacactccctaacagtgaattttccggagaacgttgaactggagacaacatcaagctcggagagagtggaccgttcagagattctggcaactgccaatataaagattcgtccggtgaagtcacctgaactggtggaggaatgccctcggatagtagatcggtcatagaattggcccaatctaatgatccggacggtaaagtcgtcggaagtggtggttgttgaatgttctccgtttgtagattatcaggagacataacccactcaaaaaaaccgaacggtgcacttgtcggaactggtggtggtgtaatgttcgctggaactggtggtggtgtaatgttcgctggaactggtggaggaggaatgctctcttgttgttggcactcatcaccatttacgaacaggggaggcaacatagacccatgtaactgttcctggttcatatcgtcttccatcactcgcgcttccaccgaatctttctctcgaggaagagacggtggagacggaggtcgagtgttgagtgattcaaccgttgaggtgatcatgggatcggtcatagtcgggaccgtaggaaatcgataaggacgttgtgtagtaatacgagaggcacttggtgggctattgttaacaacgaatggcggaggacgtaacatgtcgaaacgacgaccacaggttgagccggtgaggcgatgaaccatctccttaaaatggtgtttgtggattttcaagatcaccggctctttagctttcaattttgatctctcagaggaaacattgttagtttggtttggatcaagatccattgagaaactttgaggtaaattggtaattttctggtttcttgttttcattttttcttattttgcttgtgcttcatctcacgaattaaccagatatatatagcaaatgttcttcctatcttcccaagtcccattaattagatttccaaaaacatttggtttgaaaatatgtagtgtatatatagcaactatattatgatttctgttttattttatttttactatttaggtaatcttttgaatttaaattaggaataggacccgcgaaaaattacgcgcgaaattcaaaactttcagttatcttctaatgattaattaattatttataaatttgttatataatagtaaaattaattcttagtaaatataaattaaaattttgaaaactagatagtttatttatatcacttaaagtaaacattttcaattaccaaatgagctcttttagttttcttttacatgaactgtttttcaaaaatattaaattgttcccttttgaaattaataagtaagtacaggtcataaatatgttttgagaggtaataattaaaataaatgaaatacttttgtttgccaagtagtcaaatttactttttctctttttaattacttgtttatattatttatatatagatataaacaagtaatttacttcattaacataagtgttgaatataaagttttggaaaccttttcatgtttacttgtttatatggaaaggaagtaaaacaagaccctctttatcaaacaaaaaaaaaataagtaatcaactaaacaagacccatccagcgattttttgtttttcaacttcgactgttcaatgcttgtgataatattaaaattcccgaatcacattgtacatatatgattctgacttcatgactttattactgttctaagattgatgaacttatcttcaatgctcattagtaaactgcaaataacgtaacttgcactttcttatttggaagaaatactataaattatgcacttgatattgttattatgaatctctgaccatgtagtaattgtgatactttgctgtccaaaacaatttatagatatctaaaaagagtgatcgacaagaacattcgtaatagattgagtataattcggagtggcggagagatgaagtttgtgggaggtattcaagagtggtttgaatcaagacaagcataaaaagatctagttggtttttactgatgtcttttaaaacaagtatgcattaagttgtagaacaagtttattttttttgaatataatttcacactaaattaaaaaacaattgtgtctgaaattttaaaatcttttaatgcttagaaaatactcatgtatatgggaaaaatcatgatggggtgatcaaattaagaatatatatgcagtcttcaaaaatctagagaccatgacttcacacatatactcgaactaattgaatatcttgaatattagtttctaatttctcagttttagtaacatatttctcttaagttctatttttgttaatgctcttattgaaaaagaaaaaaatgtaaacacatgttttgactctagaaatgcaatgtcatacctttaaacacatgtacaactctattgtatatgtcgcgtgtcactctagtaaatatgtatcgttgattaaaaaattcatactaaattccatatttaataagcgttgtagcagttgaaaaatctttaaaagataagatacgaagaacaagagccccctctctctctctcgtccactcacctattgtgtatctcatcatcaccatg

SEQ ID NO: 9236 - DNA, 3000 bp, Unknown
  misc_feature (1)..( 3000): cDNA_ID_2181407_gDNA_ID_1972024_Annot_ID_178179 3000 nt of promoter + ATG
ggtgcccattttcctttacccacattaactccaacgggcttcgtcaacgttgccggagtcgtcgtcgccgccgacgccgatgaagcagctggtgtttttgggtcggtttgcacggcggagatccggaaagaagtgggtctggagacggcggaggagaagtttggttgacggtggttgatcatcgatgatttgaccgatgatagattcatgcttccattcataagcgccattttgataaaataaaataaaaagttttgatttttctgatttgggattggtgttaagatttcgacaaatgtgtgtgtgaaatgttacacgaaacctgagaagtgttgagatgagaatttgagggttttataaacgaaatcggagatggtggtggtgtttggtgaagaagaaggctaatgtgttgttgtagttgtggtaggtaatttacttgtaagggtattattggtaattccatgtttgcgattgttagaagggtagatttgtcaattttcattcaaacgataaccggctaacgtgtccgtaatcaaaaacgtatccggtttagcttcgtgttgaatgggcatgtctttgccgctaacgttcggtgaaattcttataatcatgtatactttattttattgatttggagactcaattgtattataaaacaagtttttcttattaaaacgaagatttttcaaattttattttacatgtgtcgaaattgaagatattaggtcgaattgtaatgttttttttttgacatctttgtattgttaagttattaatgtttaattctgaaaaactaaattttttatacgataagaatataaagaaaaaagatgtaattcaattaaaaaaagtaactaaaactaaaagaaagttatattgaatattgaagcaaaattagtatgggatattttatagagttatatcaaacattatttattaaaagtttttttaaaaaaataatctttaaccgcgtatagtctttataaatataaacacggcgttggtcgtggtcttatatatacaaatttaagatggtcatggtcaagattttgtatatttagttatttataaaagttggtcgaatgttgtgttatattaaaaaaaaacatgggtgtattaatttgtacatatttgaaatagtaataaattaattacacttataagtagattgattgataagaataagttaataaccgatcgagattaaatgagactgagtaaagctagcttatctcacctaacacccgtcgtaaatgacggaaccccacctttctaatttcgccaactcccacatttgttataatcttatttattgttcatttgtaattgtttatggtttcaaagtctattcgatttctacatattatttattaccaaactttttttgttggtttgttatattagtattgatttgtaagagttgtttaaatctcatccaatccgtggtataatgcattcgtgtgtgttattaacgattattagttctatatttgtagactgaagactgaaaaactttccgttcatatgatcatgccttctcgtatacgatcaaggaccacattcaatggacatattcttggtatttgttatagccttgtaggtattattagtaaacgtgttatgcagacttggaaaatagaatgaaaatgaagagcatattctttcgtgttattctcctatagatcacaaaatggaccgtcgatgtgataatgatctggtgaggtagaccctacggagtcttgttcttcaatatgttggtggaaaggagagagagagagacacacacaaaatgttaggtgtgttgactttggggttatgtgcttattacaaatatatatactagtcattagcaacgtcagtaattatacttcttgtaatttcatgaaattttgtgttctttgcgactttttttttttttctgtttgtttgacagaagtcagaaataatgtgtcagtgttcttgttttctttcaaggaatccactagattaaaagtcacttggtatattagaaaatatattagggcaagagttaattacgaatattaattaatgtggtgttgttaagacttaagatatataagacagttcaagcatagttacataccaaatcgctagatatgtttccatctctaattttctactgatttcaaggccatctgttcatgtaatgttaagtaaaaaaaaataagttctagcaacgttacatgttttacatatcttccacgcgagagataaaactgactttcaacatttaaggatcataacaattactccatgttgatattgatgtacgacgaaatgtagcctcaactacaaaataaacggcagaattaacgtatttgataaacaacggcttattggattaaataaagaacgagcttacactggaccctagggatattgataatctgatactaagatttgatgggctaagaaactccattgggcctagtagtcatgctccctaaaacaggtgacaatttttattctgaatttctgacgcttcatctcatgtttgcggcacattagagcaggtccattgggaagaccttatgagtttcttagaagaaaactaaagaaaaaaagtcaaaaattaattcagaattgtggtattaagcaaggttcgcaccttgcattaggtgttttttggtttttaaggttcgtatacgtgtcattctcttattggaagactatacaaacaattttttttttccttcgttgccttctctcctccttgtttgctccgaagctctacgcttctcatcttcgtctcccttctgcaaatgatgaactctcttctcatcatcgtttctcatatcatcatcgtctctcgatccgtcacgatccccatcaagttttatcacgtcttcatcaccggtagatcaagcggaatcggtgaaattagatacgtttcatgagcttgcggcgaatgagatgatgcgttgtgcagagcacggtggagaacggtgcggaggcagtgagcaagccggaaaataaaaa

SEQ ID NO: 9237 - DNA, 3000 bp, Unknown
  misc_feature (1)..( 3000): cDNA_ID_2992732_gDNA_ID_1972024_Annot_ID_178178 3000 nt of promoter + ATG
aggcaatctagcttcattcctattatctaaaccagccaaaaatacgacaaccatcatgataccaagcctacagctctaaccatttgagtccacttctaaagatatcacacatcaatcttgcttgtttcccttatattctgtctcaaatagaagtatagagacacattaccatttgttgtcgcaagttctccgaagtatctcgcacgtatccaaccttctgcccccattttttattttccggcttgctcactgcctccgcaccgttctccaccgtgctctgcacaacgcatcatctcattcgccgcaagctcatgaaacgtatctaatttcaccgattccgcttgatctaccggtgatgaagacgtgataaaacttgatggggatcgtgacggatcgagagacgatgatgatatgagaaacgatgatgagaagagagttcatcatttgcagaagggagacgaagatgagaagcgtagagcttcggagcaaacaaggaggagagaaggcaacgaaggaaaaaaaaaattgtttgtatagtcttccaataagagaatgacacgtatacgaaccttaaaaaccaaaaaacacctaatgcaaggtgcgaaccttgcttaataccacaattctgaattaatttttgactttttttctttagttttcttctaagaaactcataaggtcttcccaatggacctgctctaatgtgccgcaaacatgagatgaagcgtcagaaattcagaataaaaattgtcacctgttttagggagcatgactactaggcccaatggagtttcttagcccatcaaatcttagtatcagattatcaatatccctagggtccagtgtaagctcgttctttatttaatccaataagccgttgtttatcaaatacgttaattctgccgtttattttgtagttgaggctacatttcgtcgtacatcaatatcaacatggagtaattgttatgatccttaaatgttgaaagtcagttttatctctcgcgtggaagatatgtaaaacatgtaacgttgctagaacttatttttttttacttaacattacatgaacagatggccttgaaatcagtagaaaattagagatggaaacatatctagcgatttggtatgtaactatgcttgaactgtcttatatatcttaagtcttaacaacaccacattaattaatattcgtaattaactcttgccctaatatattttctaatataccaagtgacttttaatctagtggattccttgaaagaaaacaagaacactgacacattatttctgacttctgtcaaacaaacagaaaaaaaaaaaaagtcgcaaagaacacaaaatttcatgaaattacaagaagtataattactgacgttgctaatgactagtatatatatttgtaataagcacataaccccaaagtcaacacacctaacattttgtgtgtgtctctctctctctcctttccaccaacatattgaagaacaagactccgtagggtctacctcaccagatcattatcacatcgacggtccattttgtgatctataggagaataacacgaaagaatatgctcttcattttcattctattttccaagtctgcataacacgtttactaataatacctacaaggctataacaaataccaagaatatgtccattgaatgtggtccttgatcgtatacgagaaggcatgatcatatgaacggaaagtttttcagtcttcagtctacaaatatagaactaataatcgttaataacacacacgaatgcattataccacggattggatgagatttaaacaactcttacaaatcaatactaatataacaaaccaacaaaaaaagtttggtaataaataatatgtagaaatcgaatagactttgaaaccataaacaattacaaatgaacaataaataagattataacaaatgtgggagttggcgaaattagaaaggtggggttccgtcatttacgacgggtgttaggtgagataagctagctttactcagtctcatttaatctcgatcggttattaacttattcttatcaatcaatctacttataagtgtaattaatttattactatttcaaatatgtacaaattaatacacccatgtttttttttaatataacacaacattcgaccaacttttataaataactaaatatacaaaatcttgaccatgaccatcttaaatttgtatatataagaccacgaccaacgccgtgtttatatttataaagactatacgcggttaaagattatttttttaaaaaaacttttaataaataatgtttgatataactctataaaatatcccatactaattttgcttcaatattcaatataactttcttttagttttagttactttttttaattgaattacatcttttttctttatattcttatcgtataaaaaatttagtttttcagaattaaacattaataacttaacaatacaaagatgtcaaaaaaaaaacattacaattcgacctaatatcttcaatttcgacacatgtaaaataaaatttgaaaaatcttcgttttaataagaaaaacttgttttataatacaattgagtctccaaatcaataaaataaagtatacatgattataagaatttcaccgaacgttagcggcaaagacatgcccattcaacacgaagctaaaccggatacgtttttgattacggacacgttagccggttatcgtttgaatgaaaattgacaaatctacccttctaacaatcgcaaacatggaattaccaataatacccttacaagtaaattacctaccacaactacaacaacacattagccttcttcttcaccaaacaccaccaccatctccgatttcgtttataaaaccctcaaattctcatctcaacacttctcaggtttcgtgtaacatttcacacacacatttgtcgaaatcttaacaccaatcccaaatcagaaaaatcaaaactttttattttattttatcaaaatg

SEQ ID NO: 9238 - DNA, 3000 bp, Unknown
  misc_feature (1)..( 3000): cDNA_ID_2181414_gDNA_ID_1972024_Annot_ID_178181 3000 nt of promoter + ATG
tccgaagctctacgcttctcatcttcgtctcccttctgcaaatgatgaactctcttctcatcatcgtttctcatatcatcatcgtctctcgatccgtcacgatccccatcaagttttatcacgtcttcatcaccggtagatcaagcggaatcggtgaaattagatacgtttcatgagcttgcggcgaatgagatgatgcgttgtgcagagcacggtggagaacggtgcggaggcagtgagcaagccggaaaataaaaaatgggggcagaaggttggatacgtgcgagatacttcggagaacttgcgacaacaaatggtaatgtgtctctatacttctatttgagacagaatataagggaaacaagcaagattgatgtgtgatatctttagaagtggactcaaatggttagagctgtaggcttggtatcatgatggttgtcgtatttttggctggtttagataataggaatgaagctagattgcctttggttggggtgtttgtggctacaagtttttggtttttgttgagcgcacacaaggtgtttgataaaatgtcaaagagaaaaacagattggatagatgcaaaattgttgttggctaaagaatgagtaacagatagcaagtaggatttaagtttaactttgccttctatgtgagagctttgtgttgtgtaattgtcatgtttgtgtgtctaggtgtgatggatgtatgggttctttcctctccttagctgcgtatgatggctgcagcaataccagcaacaacccctgagaaagatttcaattccttacaaagttatgtatgcatgtcacaattcaggccaaacacaaaaaattctgtacaaggacaagcaacgcaagagaatccaaaatccgatgaaggagatattaaaacaattggaaatttgtgattcgaggttcctgtgcgtgtcaaattagctatgttcttgtaattgtcattttttgtttttttttaagaaacccacttaagattctaccattgggaaataagattgaataaaaactctaaacttccatttattcaaaatataataatataaaattttaaggaatccttaattaaggtgtttcaatgggggtgctcttaagagcatcctcaatgggaggatttaagaggtttcttaggttaataaagggatttaaattaaatgtttaatgatgattttagcttagaggccctcttaccttagaggctctcttagaataggtgtggaggtgacgtggcattattctcgtgtttcttcttcctcctcctctctctctattccgcgatcgaagtgaaatcggaacaaataattctcttgtccggagtttctataatcctttcaattcctctacttataattcaattttctctcgttaatgtatctgatgcttttgtatacacaggttccattcgataaaatagtttttttttccaggtaagtttcatgatgattatgtgttctctcttttatatttcaattgtaggatatatgtaattgttttgtgtcatgggattgatttgtgttaatgcgtttaggaacattcatgggattgatttgtgtcatgtagagagattgagtttgcctaaattagctcatgacttttttggtgcatgtactctttacattacatagttctctaacttctgtctgtgatgaaacgaatgaatccgatcattcttctgtctttagtttaacgaaagagatacaaaatatagtgatgtaaccactatgttaatagctattttgtcttatatttttatctaagctcatgcagcttaatcttatatggtgatgacaaatttaacaattggagacaaagttgtactttatttccagccatgtggataacctcccattgaggatggtctaacatcctcgtgtttcatactaatcttttttttgttatatttagcttatccaattcgcttgttctttatcatccgttcaaccatttataccgtatacgactagtactccaccaatttatttcataattgcaaatgaaaactcgagtcaaacccaagtccaaaagggcaattcgaacttggttattgtatccaaattttgaagtcaaagccatgcatcaacttggttacagactgtatccaaattttgtttgtcacggaacgtatctttcttctttgtcacggtgtatttaggcgtgggttttgcactttttgtggttttctttctttggtgaagttcctttaatttgacatatggaatagtggaaaaaaaataaaaggacaaaaacacttaaatttcccgaacaaggacaaaaccttaatagttccaaaattattaaatttcacagaaagttagaaacaaccaaaggtatccgtagaggttaactttaaaggaaaataaagcaagtggtccactcccacgtcgatagtcaacttattgctcttttcgacataatttacctccttattaaatctccttggactagtataactttctaagtatgcttatatctttcatttaaaggcgaaaatttgaaatctgttaattaagcagacactaaattccagattaattattcggcacaagacaagcaaaatagataggcacatgtgccttggaagatgaagatatacttggaacgtgatcatgatctggtgccacggaaacctatatattttgttgcacgtatccctaaatgattaggtccattcggcatatctggcattgtagattttctgcagtacgctcaacttgtagatgaacattatcttatattaggtttttatgaattttacacataaatggaaatcccgggctcatggcaggttttggatactattcacacgtgacgtaatttgtggacaaccaccaaggccaagaagttattagtttggtctcttttttcttctcttctttcttctcttctttctctataaaatggcttatttcaaaggcaaaccaaaactcacatttgttcattacaaaaagaggaaactgacaactgatttcgcgcaagagaaagaaaa

SEQ ID NO: 9239 - DNA, 3000 bp, Unknown
  misc_feature (1)..( 3000): cDNA_ID_2181388_gDNA_ID_1972024_Annot_ID_178175 3000 nt of promoter + ATG
tagaaaaatgagctattgacaaaaacaagagaatctttttggggagataatataagaagagcaagtgactctcactctctctctctcagatccctccatcattgttcaccatggacaaggcttcaatcactgaaggaaagccgattcgatgcaaagcagcaatcttaagaaaagcaggagaaccattggtgatagaagagatccaagttgatccacctcaagcttacgaagtcagaatcaaaattttatgcacttctctatgtcacacggatgttactttctggaaactagacagtgtaagtttacattatatcgcaaaaagtcaacgcataaatctatagttcaaaaaactcgatttcacgaacatttttattcttccagggaccgcttgcaagatttcctaggattctaggtcatgaagcagtcgggtgaatcttcatttacttctttaattttcattcttgatcttcaagaatttgtctaatttttttattttcttgtctaacttgatattgtaatcaagtgtggtcgagagtattggagaaaaggtagacggatttaaacaaggcgacgtcgttttgccagtgtttcatcctcaatgtgaagaatgcaaagagtgcatatctccaaagagcaactggtgcacaaaatatacaaacgattatttatcaaacacaagacgatatggaatgacttcaagattcaaggactctcgtggagaagatattcaccatttcatctttgtctcaagttttactgaatataccgttgtagatatcgcacatctcgtcaaaatatctcctgaaattcccgttgatatagcggccttgctcagctgcagtgttgccacaggttagcatcttcgtttcatatttgtgtagggttggttttgataattttaactttaacaaaggttttaaaaaaaaactagtataaattaagggtgtgtgatataaataactactacagtttttacgagtttgataatggactttgtaggacttggagctgcgtggaaagtggctgacgtagaggaaggttccactgtcgttatctttggccttggtgctgttggactagcggtacatttatttcaaattaatataaactatatatgtgatgattttgtttaactttaacaacaaaataatataaagatcttgtagtataaagtaatttgtaaaaagttatcgtaaacaggttgcagaaggagtcagattgcgtggagccgcaaaaatcatcggtgtggatctcaatcccgcgaaatttgaaataggtttgattggtctaacttttgcaatattttggtttacctgatttcctaatgaaatcttactaattagaacactggttaaatttacatgattcgtatttttaatatatttaacagattcaaacaatatcgcaacacaagatatacgaatttgaattcaaaattttttatctgatccgaactccaattgtttggagcagatcagatcacacacatatatgtctatcctacatatttgctcatattattaccatatcactttttaaaacaaacttataactactgatgtgtgagtaggtaaaagatttggaatcacagattttgtcaatcctgctttgtgtggggagaagacaattagcgaggtatgtcttcaaagctcaaactcttataaaaactttcaacattgtaattcgaaccatgctgaaataaactaatgtaattgttggaatgataatggaaaataaggtgattagagaaatgacagatgtaggagctgactacagttttgaatgcattggtttagcttccttgatggaagaggcattcaagagtactcgcccggtacggttttaccggtttctatttggtttagcatcattacatggataaaaccgaaaccaattttcttattgatttccttgtagggatcgggtaaaacgatagtattggggatggaacaaaaggctttgccaataagcttgggtagttatgatcttctcagaggcagaactgtatgcggcactttatttggcggtttgaaacccaaacttgatattcctattctcgtggatcgttatttgaaaaaggtatatattagttatatatagtttgtgttatcatttatatataaaaagttgaaagttatgattatttgattttagtatgcgatatgattttttttttatatatataaatggcaggagcttaatctagaggatctgattacacacgaattaagctttgaagaaattaacaaagctttccatttattggctgagggaaactctatccgttgcattatatggatggataaatagtccttttatcttcatttgaattttcttcctagttcttctatgtcccaaaacatagtacttggtaacagaaaataaaaaaataaaaatctaccaataaaagaaatttacaaagttatcttcgatgtccctttgttgggatttgcttctattgctttggctcttgttttttttttttgttgttgtgtgcaagtgcaactattgctttggtttatatatgccttcttcaatgattatatatggtgtgaatcgtgtgatccgttcttatattgtgttcgtttccaaaatcatattttcaaaacattattgtaataaaagtctaacgtaagtcacataaaatcgtcatctcctaaccaaaagcctaaattttagttccccaatcaatcaaaagggcaaaactccacagataaaaaaacgatttcgttggcgaaaattttgatttccaaatcccttttatctgatcagtggagagcttattgggcctaaagcggacttagtaaaacaggcccaaattatgttagaacaaaacaaaacactgtcgttttgtcggtaaggacatagccagatagagagatcctggagaaagcttaaacctaacaatttctctcagagtgttatcatcaaaagattcttggtctccgatccagtcacctgaagattctccgagcttcttttgaccacacactttcaatg

SEQ ID NO: 9240 - DNA, 3000 bp, Unknown
  misc_feature (1)..( 3000): cDNA_ID_3040720_gDNA_ID_1972024_Annot_ID_178168 3000 nt of promoter + ATG
cttatatatacaaaatatttgtgtgccaatgtgattaccattcaatttttttgctatgtgtgtaaatttgaacttatattagtctttttctactgtggttgtgtcaagttttgttcctttcggaccgttattcttggttcttttagacaattagttaaagcggttaatacattttaacctgattttgaatgaagagaaaggcagaaagataacttgctaaaaacataactaacagtacaactagatcagaaatacagtttccttttctgacggaccactattcttcattttatatatcacttctagagattatttctgacattttcaaaatcgtctgtgcttcattgacgacatgaaaaagggaaaggcctgcgattcgaccacttttgctccaccgttggggtctccaattattttgcgcctctcaaaaattgttgtaaatctatagtatccgcacaagatttgaggttaaaggttgctagctttttttttgagtcacggactcacggtggacaacattttaatctggtaatataatgtttctgcattaatcaacattttaatctaagatgtgaatgtgatatcatttggttgaaatgaaaaattcgttcttgggattatgatatttggatatactcggagtcgactataagtctatagttatcaatacctttcttcaggtacttacacatttgtacgtccgactctaaatactatagattttgctgaaaacataatttgatatagtatacacgtaaaatgaaacttatcagcttccgatatgtcttccgagaaagaagatctgatctagtgatctgacaactccgtttagtctcacttggccacaaaatgccaaataattaaatgaagcagtattgaaaaatcaggatcttatgtcgaaagctgacccaacaagcacacagtatccaaagaaaaagcctgtctaaagttacaaaaaggacttattattatcacatgtatgcaatttgcgtgtataagaatattaagaactggagtggagtgaccatgctaataatatctagtgcataggtaggggcacatgccatgcatggaccaacaccacaacaaacgaccatgagatatgaatggcacacatgtacattcccttccaaaaagaaaaagcataaggcccattaatcggcccaatattcttcgcctgcacaaaaaaaaaacctccagatcgaaaaaaaatcgagaagcgaatagcggaagaacagaaaaagggaaattctgagaatcaaatcggaaaggtagaagaatcgagtcggaaaaatggaaacgacgaagagtaacagcagcgagtccgatgtcaacgccaaatgggacgcttgtctcgatctcactgctcgtcgctttgtctactcttccctcggcggcgctttcgccggtcttctcttcttcagttcggtgttttccaatatcccccactttattcttatgattcaattccgttcacatagtgttgattactgattaggtttctgggtagagaaactgagaattcatgatcatttagggttttgagtgttgttccgatttgaatcatttaggatttattaggtttaaatggttttttgtgttttgacgattaattgttgcgttgtgtgccctagggagtccggttacgagatgggcgtcgattgcttttggtgctggaattggtattggttctgcatacacagattgttctcgtgtttttgatgcgtcttcttcaacttcagctactttattagcagctcccaagagtacggagacttctgtatctcaggttagtcggaatctagttttgtgggatcgttttgttcgtaacagttgaagttagaaaagatgctaatttaagagggtttcatagtagcttagagggaaatatgatttggaagaatggttacagatttgtgagaacatatgcatctttagtttttagctcttaatagttcaatattctgaccattgacatgtaagagttttgtcgctgttgatcttacgagcaaagaacaaatgcctgattgtattgtggcatagagtatcacgactggactacgtattggaaattaatgattagtaatcggatatcttacttcatcactatcatagttagcaagttactaggtgttttggtaggtgcaaacatgtttaatcttgttccaatgtgtatgcatttggtcgaaagcaaatccgttcatgtttctagtcatcgaagtccttacaaagtagaatcaaattagctgagtgtgtctgtttttatcttgttgattgattacaggcagcagaagagtgaagacaacgaggaagcttggaggtaaaaaaccaaacattgatagagttacattacgaaatggtaattgatcttgcaggacaaggcttttgagataacgccattgttaaaaaaaaacttttgcttctcagtgtggttttgtacactgatgtcaaaattgttaatgacccactcattttttttgttttgaaaaatcttatgttcttttacttgagaaataattcctccggtttgatttgtttgcctctactgttccttcattcatcaaataatctcctcacatatcgactaagttacaggttttaaggattaatgatatgtttttagctgctactaaattgactgatcgagtagttttaacaactcaatccatattttatctaatttataattttagtgttgttatttttttctgtttttgcggccttaaattaaaaatatacatataattaaacaaagccaccaacgcgttaacaggcatggttattcactcatcttgatgacctcaattagaagcctttgaacggctcagattgcatatttgtagccgcgtcttagcttaatctattgccacgtgtttccgataattattttcttaatacttaactgctacggaaaagtcataattaacactctatagagcttccgaagaacgacgctgcgacgagagagactaatagcagaggaggaagacgaagacgaca

SEQ ID NO: 9241 - DNA, 3000 bp, Unknown
  misc_feature (1)..( 3000): cDNA_ID_2181359_gDNA_ID_1972024_Annot_ID_178165 3000 nt of promoter + ATG
gcattccttttgggtcattatgtataaaatatgggttactctaataaattttcctaaaaataaatcaacctatttccttttattcaaattgttcatagatattacttctagttttttcacaagttgggcaacactaaactaaaactttctagaaatcttctatatgtggtcttgaattaaatctttttgataacagagatatgagatcatgaaattgaaatcattatattttatcacaatccaatcacataggattattacatggaaacgactaattgttttcttttttttttgccggcagaaacgaataattaagagatcctcttaattagatgacaatatgacatgtaagaatatatgtatatagagagaaagagagagcatattattgcataaacatattataaattagtcttttcgttactaattctttttcatttcgctgcaaaacaaaaaaactagaagattcacacattaagcatttaaaaagtaaaataccatatgaaatgagaggatgacacacatataacagactgcttcgcacgtaaagaaagcatcttatgatttcgtattaataatgtatacatatttggacccgtattgatgcgttgtaatctaaacaaaacgaaaataaaaatcaattgttactttattatataaaatataaattaaatattttaaatttgatattaacagtgaaatttcatgagattggagctgtcacaagaactattaggattacagtttaatttaataagcagcctgattcatgtaggcctacacaacacacctcatcgttacaactcctcatatgggccattacaataagaaaacatttcatatgttactaattgaaacgcaatattttatatgaattatatgttacatgtcaaccaaatacacccactaaaattatgcaaatttattcaactccccttcattcctttgtatatgcattttactctcttttgcttttgtttcaataactgattaattgtattgttttttttattatgtcaatatttcttggtcaggcactgctgctaacgtctaaaacccataccaaatcactagctttgctgaccaattcattgtgtataatcaaatttcttaaactaggggaagtaatattttaagataaaagatagtagaactagaattgatccactgcttgaaaatgtatatgaatgtaactaaaaaagttaggtagcataatctcgtgggatcggagaacttatctgttaattatattctttcaggtagctttgaatttgtcaaaagctaaaagtaggccgagctgtttggttggtgtgtcatttgctggtggtgccgtcttattatatactccactaacaaaatattggatttagctgtgtttatttcttttgattctccaataaagaattgttagttatattatatactatgtcgttctagtttcttaacaaatgattgatggccaggtacaatttagcaatgattatcaaccattattgggatttttaattttgtataagagatgtctatgtttaactagtttcgtcaatacattatttacacaaaaaggtttaaaatcacagtattaagattatgagtgaaataagaagttatgttaataaaagaaattaaaataataggaaatagttaagtagcaaataaaatttcatacaaatcatactaaaggagaaaatatattgaaatggtagaaaaacgaagaacttgagaataaaaatacaaaattgtttaacagataataggagtacaaacaaattagactaattagaaatgcatagaaaatatatgaggttcttagaaaaacaccattatagaattctcaactccaactaactcaactaaaaagagaaatcatattcggaaatattgtcggaaacaacacttaagtttgttcgaaatgaaaattgtcgaaaattaccattaatcgacatgtgtaaagtttatgaacttctaacacatttctaatgacgtttcaacaaatttccgatgaaggttccgaataatgtccaacaacttaatttggtaacgactaatgtttatttcatcaaaagttggaaataaattggtcacaaatttttgtaggtatttttctgaccatggtcgtcaaaaattaagattgttttcttctagtgatatagcaatcagtaaaggcaattgctccctaataacaacgtgttatgcttaaattagagaaaaaaatatattgtttgtaggagaaagataacgagagaatagcagtttctcctatgaagatttactcgctctagagtcaaactttagaagctttgactcgactcgttttatggttggccgttaccaaacctttattgatacagtattatgaagtggccatcgcatcgcaaaacttcatagccaagtgttagataattccacttgttacaatttttttgtctatctctctcttacttaagcatgatgattttggtgataaaaatttctagaattattctccggcggaattgtgagaatgcaataaatatttcacgaacgtcgctgattttaaagtgatgatcttcttcaccctataaatattaccgaggttaacgttgatgatatcgttgaaacttgaacatgtcattgtagtattatctatgttactagtggagaaaacttccactaatttcgtgttacaaagggctatttattacaaaagattatgttcaaaaagagcaaaaaaaaactaagtaccacgaactaaaagaggaaaggattctctcgtccccaaaatgttatctctatattcaatgcaattgccaatgacttttgtttataaggaaacaaatacgaccataaataaaaatgataaatgttccacagtgatgcgagtaacaacaccaaagcatctctatttttgttttcttcattcacaccaaaacaagaaatcaaatttggtttgattgattgatacaaaagacttcttcagatatttacttcttcatttggagaagccgattaactgaaatg

SEQ ID NO: 9242 - DNA, 3000 bp, Unknown
  misc_feature (1)..( 3000): cDNA_ID_2181347_gDNA_ID_1972024_Annot_ID_178162 3000 nt of promoter + ATG
tatataatttatttatttgtttgtttagcaattgagcaaaaactattcttgtaacgctttttcatgtttgacatgttgatttttgttttttgtgacacgatttgtaatataatgatataattattagctttttaatattttttaaaatgatgaaatttactttgtcacacctaaaattgataaaattttgtatttttttagaaatctaatgttaaattatattaaaaaaaaatgcaaacgtttatacatcgaaatgcaaacttttcttaaaaccgaatcaaaatatggttcaatctatctatccttgactttgttgtgacgcaaaccacacttaaagtcctccaatgtatttttcttcccctttcattgttatggtgctcaagcggtttctcatatttctatcaatcagcttgacaaatttctcttttcttgatggtttttctccgtgtcttctatcattcctttcacgccaaatagagtgtatcgtgttttggaacacataccttagtataaaccttttcgttgtgtctcggtttttgttcgcaagctccctcatgatatcccgccatttttcagtgaacttgtttgctaggatcccccgtgccagctcctcccacacctttctcgaatacggacattggaagaacaagtgctctcttgtctccaaaggatcttggcataagacacagctttgatctgcattttggtttcattgaaacatcctttcccctgttgctaacctgtttttcatcattaaccaagtgacaaacccatactttggtgtagcgtacttgcaaaatttcgtacttgcaaaagaagtttctacgaacttaatgatgacggaaaaaaatacatatgaaacactctacataaactagtattaaaattctttatctgcatggttgttccttaagatagttagagatcatttttgggaagtaaataaatttccactaaaacttaagacattatttgaaacaccggtacaccggtatagtgccttctaaagaacattcaatgttcaagacttccaagtcataatattttttgtttgactttaaaagagaggaatccatgtaaatataatttattcgatgtttgtttgtatcttttcgtgagcttaaagatattacatatctcgatcctttcaatattgttaggtcatgatgccatttatcgatcttccgcatgtcacgccgttcagtctaggcgtgagtaccaatcctaactcctaaggatacgacatcatagcaacttagcaaccatgtatgataaaatggttcacacaaattatttaggcccgtatttcggccccttttgatttcgaaatattttgggcctataaaaaagagagaatgtttgagactcgagagtagtaagaaaggagagaacgcaggtttttttttttaaatgaatgatttcagagaacgcaagttatacacgtactacacgtataacacgttcctcagcaagacaacaatattatcttatcctcaagtggatgcaaataatataaagattttaatattcatttactacatcaacccccaagaacaaaaaatgtcttcaacaaacaaatctacaatcaacgaaacaaacgtaatcaccaaatatgaatcaatcagcagtatgctgaaaattgttgccaacataatttaagcatgcgactttcaaaaactcgaaaaattgtcaacaatttgagtaatccgaatttttctgtttctattacacatgaaaagacaaagtaacattcaaaatccatctcatctgcttggcgcgataacatatctgataagacttttttttgtgtgtccaaagctgataaggtttccaactttatcagaatcaatctatatttgactattcaaaactgaaatacaggagattatttctgctatgaacaaatattattttgactatttgactgatctatcacaaacatcttagccaaaaaataaaatttagtgaccacagcttgagaaaaaaggaaacattcgtgtagaatgtattttgctgatttgtggagagtatagtcttgtgctgtgaacaaatacattcatattaccctgcaacttgcaagtaaaaagaagttatgaagtgacagctaatcaggagataagaataactcgatcataaatacggaacaccgcaacaagcggaccaaagagcatgcaagtagccactagccaagtaggagaaagaaaaatatacaactacataataaatattccaaattaaaaacttattgatttagtctcagcatttatacaaatgtaaaatgtttatacaaatgttgtctattttttttattgttaacgaattttctaattttgaaataatagtgatcaattatgttgcttttgtgactaaaaagtaagtgaatttacaaataaaatgatacgtcaaaattatggttagctaagcctaagtctaagagcttgaatgatatatggatttttggtcgatccaacccaaaaacatctaaatattctatcaacatttatactcaaataacaattgtacatcactaagttacatgttttttataacttaattttaagaataagtcgtgatcaatcaaattacccttgatgttgacttttgattgaaaaaaatgacaaaaagaatttgctgatacaaaacaaaacatggcaaatatctagctcgtacgtgtatcacttgtccaaaggaagtatgcgtattattgcgtaataatacaataatatcggaaagttatataaaataaaaatacaaataagataatgtaattgcatacttattttttaacgcgtatagtacactcatctcaaatgccaataaatatacagatacacataaaagaaagactagaaagtttagttacccaaaatatcataaattaatgtaatcgtgttcactagttgcgcaagacaaagagatcttttagcttaaaaatctcatttaggcatttaccctttaaaaagttttcacagagattctcaacctctattggtgagagaa

SEQ ID NO: 9243 - DNA, 3000 bp, Unknown
  misc_feature (1)..( 3000): cDNA_ID_2181355_gDNA_ID_1972024_Annot_ID_178164 3000 nt of promoter + ATG
ccttgatttcctctgaagaaactggacgaataagcctctcattcatctgatcaatgacttttgcttcgaacccaacaaaccagtgagagaaaccagaaggattagaagatttgaacaggttggagaagtaagcagtcgctacctcaccccttagcaccatcagagaaatgctcacttccattgatatccagaagtttgtcaatccgattcttccccctattattcttcacagaattgtgaaagaacagagtattacgatcaccacaatgcatccaagtttctctactcttttgactccaaaaaacctcttcctcccagtacgccttagcaagctccttcttaaggtagaaaatttgatagaaccttggagaaagagccgattgttcctcctctagagctttttcaatcttgtgaatgttttcttgggagttcagattattatctctcttccacccactgagagcctctacacttcttaagtctgtcactaacacaaaggtcattaacaacattcagggggtcccacgactgcaagatggtttcctcaactctaggcttatgcagaagccttttgtcaaaccgaaactgccctttataagaatcttgagaagccatcagtttaagcaaaacaggacgatgatcagaaccacgcatctccaaaaattgttgattagaagcagggaaattcttcagccattccttattaccaaaagctctatccaatctgctctggatccacaagtcataccttctccctgcccaagtaaatctattaccagtactcgccaactccaccatcccgcaagcttcatgcatttccttgaaaggtttaaagtaagactcacatctcttcgggccaccaatcttttcctcattatgcagaatttcattgaaatcacccaccatacaccatctttctctccttccaactccaattatgcttagtctttcccaaacaatctttctttttttaaagtcggggtcaccatacacacaagacagaaaaaagttcaccgcaccaaactgcacttgaagatcaatcaaattcttatcagcaaacttgatatcgatcttaacactttccttccaaaagatagctaaaccaccacaccttccaacaggctctatagaatacactctatcataacctaaaaatgtatgcaaatcaacaagaacatctctactattcatagtctccatcagaaacaacatctcagggaaatactttttacgcaattccttaagacgagggaaagccaagtcttgagaccgtcccaagccttgacaattccagctgataatgctcattgcgcggtgggcaatcccccctttgggatcacctctaagggattgagttttgtggattttgcagtgctagttccctcatcaactgcctttcgtttctctttagcaccatgactgagacctttcttcaactcttgtgatgcagcaagacctgaagccggtaaaggattagctttcctctgattcttagttggcctttttcttgcctttgctttcttaggcttaattccggataagctaggttcaaagaacccagctttaaaaaccgccgaattatcctgaaaaggctgagacaaagcaagaaaattggcatccacatcaaaggcattagggccagcctgatttaaattccacgaatgtgaagaacttgaagtcccaccctcttcacgcagattgggctgagctaatacttttccaacattcctcaagttaatcccttcatcagcatagctaaagaaaactcctttgtctttagacaagtccagatgaaccacaggggctggttcatgactcagcattgactttctcagaactggatccttctctacttctccaacagactttttcaccttgttaatcctcagcagcttctcagtttcatcagagaccaaaagatattgtctcatcccttctaaaacatctgcagcgattctcggtctgcccgtcaacttgtcaatcccaacttgatcctctcttaaaaccccaaacaaagggtctgattctttcaaaacagggggtttcttaggtctctccactggtttaccagagcgtcttgccaaagcagcatcttgtcttgcttttatgaggacagggcaaacatctctctcatgagtcaaacgttgacactcatagcatctcttttgaacccgctcatactgaaaacgcacttctagtttatacttaaacaataatacgtcaaaataaaattttcaatttttagtttcccttaagtttattcataaaagtgtttatacttattatacatgtaatgtgacgtttttaactgaataacagttaaagggtcttacgacggttagttaaattataaacaattttaagttatacactatttaattactttctcgactcatagtactttctttattatacaggaattgtggtatataatgcaactaattttaacaaaaataaaataaaatcatgatagcacaaaatagtaatctaaaatcattatctgaattaacacgatttaaaaaggattattacactaagaattaataacaaacaattactaaaaaaaaaacttttagcttatttaaaagatgaaaattagcttgtatggatcgtgtcatttaaatttagtagctaataaaccctaatagttgacttttgatttctgtaagataaaataacgaaaacagtgatatatagacatgaaaccgcatgtttattggttgttagttgtaactttagattatgtaatcatattagaggattaaaatatagctcgtgaatcacgtccatttaaaattatgatagcagctgtacaaatcataaaaataatacagctcctcataatcaatcactcatctgactagactatataaaaagaatatatacatatcacaatctatttatcgtgttcattattcacgcagcaaatatagctttaatatcaaaactaaatataaataaatacatatagcttaaaatccagtttcctccgacaagaaa

SEQ ID NO: 9244 - DNA, 3000 bp, Unknown
  misc_feature (1)..( 3000): cDNA_ID_2181351_gDNA_ID_1972024_Annot_ID_178163 3000 nt of promoter + ATG
ggcttagcctcctacttgtatgttgcaaagtcttacgtctctaaaaggctcgacaccagttaaacccaaaatctctcgtttaaatatcgcaggtactctctttccctctcttgtgtaatttttgaatacacaaatcattactgtgcaaatgtatacttttcatgtctggtatatcgtgttgatcatgtggctcttttgccaaatccatcgcatctttcacgtccctaccattacatggctcaacaccagtaaatgtatattttttcatgtttggtgtatagtcttttccttatcgtgtatattatccagctgtgttccaagctaacttccagagatttcatcttaataaactaaaattgttgaataaaaaataggttaaagagtttctaaccacgttatgaataaccaaatatgatatgaaagtagatacacgttgactttttttttcttagacttgatctacacggcgatacacatacagcctggataataacaaaaacgccaagaacccaatggcagtgaaagcagcaagcaaccagtaaaaataatcgacatgggctctgttcaggttagtattgaaccagctatcgccgccatttttcccggtagcccaattaatcacagtgattagaaaaccgctcaagaagctcgcaagacccatcgcactcaaagaaagtgcaagaccaatactccttagctccgtggggacctggtcgtagaagaattcttgtgtccccactagtgagaatacatcgatcatcccaagtagtaaatactgaggaacgaaccaccatatggacattgggatggttgcgtccggtctatccacaagcccatgttctttagccgtctcgagccgtttcatttctactaacgctgcaaccaccatatttaagctggagagcaccattccagctcctattctttgtagcattgtgatccctgaaggctttttggtaatcaatctagctaacggaaggaaaacacgctcataagttggaactgagatgaaaatcgataaaccgatgagtgcttgaaaagaagccggagggatctcgaaacccggcaagatttttctgtccaccgtaacgccttgttttgtgaagaaagtagcatattgagcgtaaggaatcgtgctcactactgatgtgatccatatcggaataagcctaaccaaagccatcgcgtcttccacgtccctactactacatggctctacacctccttctcctggtagcaacgcttttgctaggaaccttagtaaaaataaagaaaactttatactcaagtcacaataaaccaaaactcaaaagattcaagacttgtgaacttactcaagttgtcctttacatttcttgtacgaaccaacttccaactgacctgaatgtgttaacttcagtttccgattcttgaacgccaccaagaaaactctaccgatcctcgcaaaagcgttattcttcccctcgcgatctcctcttggatatctataagtttttcttccaaacaagaagagagcaagagccatgaccatgaacaaacaagggataccaaacccaagagcccaattaacattgtcttgaacgtaaaccaccacaataatcgacaaagttattcccgcggataaactcaagaaccaccaattgaaaaacgatcctctacttattctctcctttggatctcccacatcaaactggtcagcaccaaaagcttgaacacatggcttgtgtccgccttgtccgatcgccaccaaatacagagaacaaaagaataatatattcacccaaaaaaacggtttagcagaagcgttgcggttatgttgacgttgctccgataatcccattaggattaagatagaggataaggtcaatagtcctagtccctgtaacaaaaatcccctcaaattttagtgaaaattctaaaatgttatcaagatattgaagtaagagacaagaacgttattacaagtatgtagatgagggaagcaacaacaatggtacggtaacgaccaagataagcatctgcaatgaaagctcctaaaacaggaagtatcgaggcggttcctgaccatgtgttcacgttcacggcggcggtggctgttgattgtccgagaggtccggtgaggtaagtaattaagttggaaccaatcccaaagtaagcaaatctttctccaacttccacacctaaaaaaccacaccaaaaaaataaaataaaatgtttaaaaaataatggtttatgagacaatttacaaatcacaaaaactgttctttacctataatgtaccaggcggatctccatccgccggtggaagattttccggcaggaagtccacggtggtcaacggagtcgctgacggaatcttctataagtgcagcttcttcttcggctatcgccattttcttgtcggaggaaactggattttaagctatatgtatttatttatatttagttttgatattaaagctatatttgctgcgtgaataatgaacacgataaatagattgtgatatgtatatattctttttatatagtctagtcagatgagtgattgattatgaggagctgtattatttttatgatttgtacagctgctatcataattttaaatggacgtgattcacgagctatattttaatcctctaatatgattacataatctaaagttacaactaacaaccaataaacatgcggtttcatgtctatatatcactgttttcgttattttatcttacagaaatcaaaagtcaactattagggtttattagctactaaatttaaatgacacgatccatacaagctaattttcatcttttaaataagctaaaagttttttttttagtaattgtttgttattaattcttagtgtaataatcctttttaaatcgtgttaattcagataatgattttagattactattttgtgctatcatgattttattttatttttgttaaaattagttgcattatataccacaattcctgtataataaagaaagtactatg

SEQ ID NO: 9245 - DNA, 3000 bp, Unknown
  misc_feature (1)..( 3000): cDNA_ID_3041090_gDNA_ID_1972029_Annot_ID_178197 3000 nt of promoter + ATG
ataatgattaggaaatgatgcaagtatattaatctcagtattaataatagagcaagtgaaagcctctatggagaactacaactaaacagacagttactaaacattgatcactcagaataaagttaacaatatacacgaaaaaatgttcctaatatctcatgaagaatacactgaagggaaaggatgctatatcatacctttcatcattagaagcggttctatatgaaccatttgtgagccctctaacaccaaactgactatcacctttcagtgtccgtgttctacgtgacagtggttgtgagctcattcgactagctgcaacagctgttgtcgttggtacttcatcatctctttcatatatgcttgacgcaactgaactgcagcataaacatggtcaagaacagaagattgtgcactgaaagaagtgatgaggcaaacaatcaaacaagcaggccactagatccgaggataaaaagcagcacagcttctgaaatttgcttatagaattgcaaaagaaacctacctgtattcacctctattgtataggtgtgcatgcaaatcatctagaattttgaagaaaagggctccccgcaacttagttagctcagatctgacatcttgaagagcaccaacctaggttaacgtaccaaaatatctatgagttcaacatacaagtgaacagtagatcccttggacagagatatttctaaagtcccaacagaacttcgatgatcccagatcctcttcaatggatttattacaaaacaatcctagagatcaaattgataaatgaatgggaagacccacaatattcccatgacaatgcatttgttaaaattggcagtaagtaaattaccgtttgaagcccctcacgctccagcattagagacgactggagatacacttgaatagcagcgtaaaactgcttatcagcaatgagcttctcaatacgagatggaacctgttcaaggtttcaagaggcagggtcaccattttcacatcagaaaagcagtttcttttaagtaagccaaaatgaaaaaaaagtaagtacatatatcgggagcatatcaacaaaagtaacatcagagatacagagatgatgaatgaagtatgaaacttgatagcagcgcagatacatagcaagcactgtaaactcaaaataaacaaagaaatgttacagctaatccaaccaaccttggcaatgccctcgatttgatccaaaagtgagatgatgtgccgcaatgtaacagaacggtaccacaactgatgtaattgtttattgcgtgcacccaagctctgtttcgcttctgctaaatcgtgcttcaagtcgcctatcttttcagtggactcactgaataatcgcaagatctgatgaggaatacattgaaagcagagcaaaagaagagagataatcaaaaccaaggtgttccacaaatgaaattttagtagataaattacaacagagggtactattccaaaaagaaaattctacatgcagaaaccatagaagcagccatagttagtatcaatattagatttgttgtatctttggcaaatgaagcgtgcaatatggaagtcaataagcggtaacagaggatgctactttagaataacagaacgaactatccaataaaaaggaagagctaacagatattagaaacctgtgaatagttttgaatggccttgttgaaaccaccatgataagcatggacaacttcatcaacaacctcctcgacaacatcactttgttcctttaatatatgaatgtcagcttcacggtcttttgatgtcaaaatatgaacaacatgtggtaaagagtcaaatcgtgcagcagcccagctctcatctattcttgccagctcctccctaaggtactgcaataaccatcaacactcaggcacatatacacacacatgtactccaaaaccaaatacataaccaaatcaagagtggtggtaattcagtcaatttcttgtctagccatcgtacaacttcttacaattaactccaaccccgaaatgaagagatataagaaaaagaaccgttatacttaaatgtccctataaatccccaaggggatgaaagaacaccatagaacaacacaattcctcataagcccaaacttcaggttttccaactcaagtaggagtctacgagtgaggaaagtgaacttacagttttatccgagggtacaggcaaaccattgaaaatccccatgctggcgaactcactccgattggcttattagagccgaaatgaatgttcctcagcacattccaatcaaagctctctgtagctgaaagcaaaagtccaaaaccccaagacgagttaaacacatacacgagctagagaccgcgatattacgcagttcagtacacacaaagaagctagtggacccaacggcgaacatagaattcaagtcaggagaacaaaatgtgaacaattcaatcattactccttcagcgaaagatctgagaatcataattcgaattacatgaaaaattcaactgatgacgagactatcggcgtatacaaaaattaatcaaacactacgtctggaagtagatctagagagaaaagaatatcgagaaacaaattcgatttcagctgcgaatcttacctgggatacgaatccacgctagaatctgatcaacacgttcccgatcacgaagagaaaagctaaatctcgagaaaatggagaagacgaagaagaaaaggtaaaaatctatacgatacgcgtttgttttattctccttccaatttcttcttctaattttccagacttttcttctctctctatttttttttctttttctgttttactttttccttgttttctgttttttcccaaataataatttaaaaatcgtgggaaactaaatcatcaaaaagctcttcaattaaataaagataaagttaatccagtaaccaaacaatccttttcttcttcctcttctcatcgatcactctcctgcagtttctacggcgacggaaacgatg

SEQ ID NO: 9246 - DNA, 3000 bp, Unknown
  misc_feature (1)..( 3000): cDNA_ID_3040859_gDNA_ID_1972029_Annot_ID_178223 3000 nt of promoter + ATG
gctcacagacttgactctattacagatatagtagtaaccattcattctcactaaaaccctattcctgccgtcagattgaaaatgcaaaaaatccaattcaagatttgactctcaaaatctcaagccaagaaaccaatctgcacaaggtaatgccaagtgaactttctgattatgttttttctcattgattgagattgatcctttcctccaaaagaatcaatgctagaaaaattgcagtttcaacgagacccattgttgattgtgtgcgatatgtttaactttctggatataaccaattttcatatttttgctggatatgattgcaggatgcagctgcagaaaacaaggagaaggcaaagctaaaaatgagactcaggggtatgcaagcacgcttagatgcaatcagtctacggtacaagcagtctgtgcaagaatcagaacttatgaacaggaagttcaaagaggcatctgctaagctaaaggagaagttagcatcaaaagcactcgaagttctcgacctcaagaagcaactctctgcttcttcaagaacaatgtgatgagcttacatcacaactcttaagtagttgattcacggctagtaaatgtcttaaagctgtaaactgttaaatgattaacgtcataatcacagagaactgatgtgattatggaagagtccaatacatatataaattatgataggtagattaacaaattacatggagtttatgctaaagtaattaagaggagaaactaagggcattttggtccaccgctcttggtcttccagttgttatagcaaggacatacttgcttattgccataagtacctgggggcacacacaagcacttgttacaacatttgttgcagaagaacaaacacggcttcttgtattgtgtattcgagcatctatctccacaccttggcccgcactctaataaaggtggaatagcggatttagtttcgcattcagcacaaacattaattaaaaactaggctagtcagtgggtttaccttggggttgaagactgccttgagtagtaccgtactgccaaaatcaacaagaagatgcaaaggatgttaaaaaggttttgtagattcgatgaaactctttttttgagtagtgatgaaccgagaaactcacttgagagttattgtgatgcggcagttgtggttgcgactgtggtggttgtggttgtcgagcaggagattccaagtatataggctgtgttttattcagggacgtataagataaagttgataaatgtgaacatagaggaatagagtgttgaaacacttacatgcatatgggcagacagaagaagatgtaacacaacaatggagaaaacaatgatgctaagttttgttgccattttctgaaaacagaaatgattgtaatgaagctcaggtagattatatattttgcagactaagctcattatgaacaaatgataggggtccactatatatagtccaatttccaaatactttttaatctagaaaatatatttctcctgtcactgatttttttgcaaactagaagagtagaagccattaataaaattattgtctaaatatactcttgtttttttataaaacttttcaacggtctaacgataatgaaattcatggattgaacaaccaatcactaatcatatgtaaaaactaaaaactaattttaaaatacttaattactgattaaacaccagaattatgtaagatatactacatttcccctaaaaaatatctgaagttgtgattttgtttatgcatggaatttgtataacaaaaagtttagtaagtacaaatatagacttcatgttcccaatcttggacaagtgaagcagagagccaaagatgtgataacgaacgaaacgaagaatagcacatgtgtgtttctactgctttctaaccctatctctttctcgtgactccacttttttcccttatactatttgttttaaatcttgtgatttgtttctaaacgttcttggagacgaattttgtaagaaaaagacacgtggtgagaaattttgggattcgaagtagatttctctgtaggcttccccgtgacctaattgtgattacctgccaagccattttgcatgttcagaattgttttgtttggtttaaaatgttcagaaagttcttgtgtctcacattgctgggcctcttcccttttctttgtcttgggcctttaactttttcttctttatttctgtatccatattttgtgttgggcttaggcccaagttgtttgtatcatcataaaaccaaaagtcattaacatgaaaactttttgacaaaatacattttacatctgatatgcaaaaattaagatttggatttttgttaactactttgatattattaactgtttgagacaaggaaaaaaaaacaaatatttattatttaattgaaaggctttaatttagttaaggatgaggaagatgaagatgatgatgattcgaaaatgaaggtggtggatactgcaaatggctgctgagtgctgagacactctcgaaccccacaaaccctaaggatctcctccgaagatttccactattactggaagtgatatagatacgttgcaacaaagaagaccacacaaaaacgttattgagcagccgtgaaatcgatttaccaattgaagcttccccccatggttggtctctatccgtctcttattctacttttcgggttcagctgttattgattgaaagatttaaactttataggtatttgtgttcatcaattgattctgtttgcttgcttcgaaaattggttgtggctgaacatatatatcagtgttcctttctctttatttgatttctatctatatagtttctccaatcttagcatccacattgttgtcactttgagagtactatggaagcttaaagtagacaactttattgaggttgaaaaatgcatgaatggaaagagagaacggacttaacaacttatcaagtatattttggttgcagatttgactttccctg

SEQ ID NO: 9247 - DNA, 2750 bp, Unknown
  misc_feature (1)..( 2750): cDNA_ID_2181517_gDNA_ID_1972029_Annot_ID_178222 3000 nt of promoter + ATG
ttccagactttagaaatcggaattgcaggctcagacatgcattagatggtaccatcaaatataatgattaatcagcatatattgttaaccatcgagtgatctgatttttctgttaagtgctaattgctcgaaattggaaacaacagcatctcacataagtgctacattccttctactgacttatttttcacgttacattttaaatcttaggacctgcattagctaaagtgaaacagcaacttacctttccttttgttcctgcgacatgaataacttttagttcttttattttgtcttccaggtccaaaatctgtatttctcaaaccaaaacagcagacaaattcacagtattaaggtaaaagtcttcaacggaaaggataaaacaaattgacttgaatcacaacactccagaattctcaatggccagaggcaacataagtcatgatctctcaacagagaaggcccagataagctcagtctaaagagaagaaaaatctaccaaattccatgatcatttgagacagttcagaatgagttatctaacatccatgttgcactacaatattgaaaatattctcaacggtctttgtatgatataatttttatttcattagagcttatgcttacactagacagaaccacttaatagcgtttgactgtaaatggctgtatcaccttgagatatgtgacgacttgttcaagcttgtcacgatttcctttagtaggtgtgcgatccccacggtttcgacgagaaataagagtcgacagagcttccatggcatcatcatatgaagataaagctggattatctgccttgtcttcctttgaacccatattaatggcagctttctccacaacttctattgaattgcttgagtacctaagatctaaagacgccaacagagcaataagaacaccatccccaggcatgaaacagacaagtctaagcagagtggtgtatataacttactgttgttgaaataaacacggaccccagtgcccaaaggtaaactgtgaaagcccctcttagttttagtgaagaaggattttcttttgtcacaaaagaatggaactccaggtgctctgcactttagaaaccctttcccacaaacgagcatcagggaaagtcaaatctgcaaccaaaatatacttgataagttgttaagtccgttctctctttccattcatgcatttttcaacctcaataaagttgtctactttaagcttccatagtactctcaaagtgacaacaatgtggatgctaagattggagaaactatatagatagaaatcaaataaagagaaaggaacactgatatatatgttcagccacaaccaattttcgaagcaagcaaacagaatcaattgatgaacacaaatacctataaagtttaaatctttcaatcaataacagctgaacccgaaaagtagaataagagacggatagagaccaaccatggggggaagcttcaattggtaaatcgatttcacggctgctcaataacgtttttgtgtggtcttctttgttgcaacgtatctatatcacttccagtaatagtggaaatcttcggaggagatccttagggtttgtggggttcgagagtgtctcagcactcagcagccatttgcagtatccaccaccttcattttcgaatcatcatcatcttcatcttcctcatccttaactaaattaaagcctttcaattaaataataaatatttgtttttttttccttgtctcaaacagttaataatatcaaagtagttaacaaaaatccaaatcttaatttttgcatatcagatgtaaaatgtattttgtcaaaaagttttcatgttaatgacttttggttttatgatgatacaaacaacttgggcctaagcccaacacaaaatatggatacagaaataaagaagaaaaagttaaaggcccaagacaaagaaaagggaagaggcccagcaatgtgagacacaagaactttctgaacattttaaaccaaacaaaacaattctgaacatgcaaaatggcttggcaggtaatcacaattaggtcacggggaagcctacagagaaatctacttcgaatcccaaaatttctcaccacgtgtctttttcttacaaaattcgtctccaagaacgtttagaaacaaatcacaagatttaaaacaaatagtataagggaaaaaagtggagtcacgagaaagagatagggttagaaagcagtagaaacacacatgtgctattcttcgtttcgttcgttatcacatctttggctctctgcttcacttgtccaagattgggaacatgaagtctatatttgtacttactaaactttttgttatacaaattccatgcataaacaaaatcacaacttcagatattttttaggggaaatgtagtatatcttacataattctggtgtttaatcagtaattaagtattttaaaattagtttttagtttttacatatgattagtgattggttgttcaatccatgaatttcattatcgttagaccgttgaaaagttttataaaaaaacaagagtatatttagacaataattttattaatggcttctactcttctagtttgcaaaaaaatcagtgacaggagaaatatattttctagattaaaaagtatttggaaattggactatatatagtggacccctatcatttgttcataatgagcttagtctgcaaaatatataatctacctgagcttcattacaatcatttctgttttcagaaaatg

SEQ ID NO: 9248 - DNA, 3000 bp, Unknown
  misc_feature (1)..( 3000): cDNA_ID_3040862_gDNA_ID_1972029_Annot_ID_178221 3000 nt of promoter + ATG
ctctgcaccaattacagaacctctcattgtttctgtcgctctttcttcttcttcttcttcttcttcttaaaggagaagtatctatcgtttcttcgtgttcctcgggattcgtttctactttactttcgaatccaaacaatggatcaagtaagcagagtgagagagtggtcttcagcctttgagacttgtcacgtcctcacttaatctacgtgtcaaaacagttttatttagatgagtaatatcttcagaaattaatatctttaattttagtaatatattattgttttttcgttttttttttcttttctctattgctttaaattttgaagtttccatattaggacgattcggagattatgaaattgatttgaatatttaagttatgaattatgatactttcttgaattaattctatctcgtaatctctaaattcttctaacgattcactgtttggaaacttaacaatcacaagttgaaaaagaatattcgttgacaaaataattaaggaaatactttagttgttgaccaattattttggacatgtatttaactgatatatatcctattagatttgaacaaagaccaaaccattaatcacgagttgtataaattacaagggacacctatgaatccaaaaatccatcttcaatcaaataagtgaaaaaaaaatggagaaaatttcagcattcttcgtcattctcttccttgtctcgtcgtgtaagtaatttatgtcaatctcgatatatcaaacacttattatggttttcaatatcattagtccttaatttgcttatactattgaacgtatatatatacaggcttggtgacaatgagtgttggagatatatgtcaaacggatagagattgtgttgagattgggattccaagatgtaagagaacaggaaagatgccgatttgttacaacggatattgttgttgtatctgttctgctaaaagacttcctgcttctactactcgaaaacctccttctccatcaacctcaaaattagtctgatctgatataatatatttatgcatgttgcttttattttagctgggattaaagtagttaattaggactacttcattacttcactattatcttcttcacacgcatctttcatctacaatgtatttctattatcaatcatccctacgactcatacatacactgacgagctaagttaacatggccaattggtttttaaaacctaaatattatatactaacattttgcaaaaatggcagtagaatataagaaaatagaaaatggtacaagaatcttatatattcaaaggagcaatgaaattaagaacatgccttttgaggaatctgacaaattagaccattgtttttctttcacaatttaatggaaaaattattgtgcctcacatgtcctagcattaatggtataaatgaattttgactgaaaaagctgcaaactgagtaaattctcaaatctaaatgcatctttatgcaatttatttaatttaagaatggattatatcagaatctttattattaattacttcatactcaaaatttcatcttttcttcgttagaactacagcttattcagcttaaaaaaaacactaattcccaagaaaacaaaagatactcgtaaccctagaacaagggcaaaaagagcttcataggcatagcaaaaacaagaaaaaaaaaactttgaaaaaaaagaaaagggaagatcaacgctggagatccatcattcgtgagaactcagtgaagcacacaaaaccatcaccgtcctcatcaacatctgctatcatacgcttacaatcatctaacgtgcaccgttcatctccgatggtcgagaaaactcgtagaagctcatcagccgagatcaaaccgtcacgatccgcgtcaaagaactcgaaagtctccttcagctcagtcgagtcacgagccggatctaaagagactacacgactcgcaagctcttcaagacggatcgtaccgtcgccgtcgcagtccacctctttaagcataacgttgatctcctcctccgtcaaaggatcaggacctagccggctaagtaacgactcaagatcgtgtctagagacagctccgtcgttgtctctgtctatcaacttaaacgcttggagaatctcgacgtaggaataaggagaaggaacctccgggagaatgctagtcggggtaacggaaccgccaccgccatcaccaccggagtttttacagtcttggccggaagatgaggaagcggatccgaaggaaaaagccgtgggggacttagagacagtggaacgatctttggatctgatgaagaaacgttttggaattagtttggcgagtttcatagtgtgaatttaatgatttgatggagaaagtgaagacatatataaatggggggagtgataagtgtgagagtttacctattggcaatttcctggaagtttcctactcaactttaactttatcgttatttcatttatttttttagtgtaactgtacttagttagattaaccgaaaagtacgagttttagttgtctttagttacgtgtttcaaggatctttttttggataaattatatgcaaacattgaatatatgtattctaaagtttatcgattcataatcctcaatcatactaattaaacaattacaaacatattcatatgctttggttagaagttagatttatccaaaccttgtttttcttttcttttctttctgagacgtacattattacacttgaacaaatatccaaactttgaaacattaatgaaattacaatttatcataatcatagttcaaacttcaacaaggcgtagtattttaaaatagtttggttggggaagcgcgattgtctggtgtattaactaaccggttcgatacggtttttgaaattcgatttttttttaaggtaaactagattttgagagggagggaaaactaatttcgaacacctgagaaagagatattttaggtcttactttgttcgccggagaagattatcggaga

SEQ ID NO: 9249 - DNA, 3000 bp, Unknown
  misc_feature (1)..( 3000): cDNA_ID_3040874_gDNA_ID_1972029_Annot_ID_178210 3000 nt of promoter + ATG
ctatatgaattgcattggttttaattttgttccaagctttttgtttgacaacagttttgatacttcggaaaagagaagtaaataaatataaacataggaagggaggagctacatgtctactatttttattttataagccaatcagagcgtttcatgtcataccccactctcacctctcgggcaatttcacacccactctcaccaatcgcgtgatgagcgcgtgtatacgttttctgtgggttctaacccaccaaatggcttgttttgaaacacactcgctcctttaaaaaaaagcctcgagtgcgtgatttcagtgtctttctcctttaattccaattcaaacccaaccgaaatcaattgaatttttcaaaaccatgtaaaccgaaccgaaattaaaacacaaacgacaaactagcaattgtcacttccactattgatccaactccgacgaaccagattgataattttgattcgattccacacagataacatatagtccaaaccaaacgcaattcataagagagccaaattattacgctatgttcgaagcttttttaacttgccacaaatcaattcacaaaataagaaattgtgctcagaaattttcagaagaattctcgatcataactttatgcggtggtggtggctgtgaatagccaacggagattgctccatgagaaattgaaccggcatcgccgccggtttcattgtccacatagtaactccgattgctgtgcgagtttatctcagtctcccttattgcggtaatggtgaaaccagtccacatatattttaatcaatggattattgggctttttatattaggcccattaaattcatccggcttttaaataaaatgagttttgtgatagtccgagaccattgcattcctcagtgaatacaacaacattatctgtcttactaaatgtaaatgaccatatcaacaaaaaaaaatcgacttgtttgtcaataaataaaaattcctcgatttccatattcatataaaagaaatagataccaaattgttggcaaaaacaagcaaataatacatatttgtggggagagaaacaaaaaaaaaagctacactttaatagaaagctaataacatattgttgacttatgataacttgtaacgtgacttcacacgcgtagtagtattacttaaaacttaggtcacgtgaactggatacttatgaaccgagtcaccccacgggttacccaccaatgactcgttagccggaatcgttctcaatgctctccacacaatactattacatttaaaacccgacccaaacgccaactgccaaaccctatctcctcgtttgacccgacatttagcctccacgtaagccagctcgtaccacagcgacgagcttgaagtgtttccaaagcggtgcaaagtcatccgagacggctcaagatcaaactcactaagtccaagacctttttcaaccgcgtcaagtaacgctctaccaccagcgtgaatacagaaatgcttgaaacatagtttaaaatccggaacatatggactaacctttaaccggaaaagcttactctttaccaaaaagaggataaaccggagtttttcagataaaggcaaaacaagcggaccaagtgctgttagattcgtctttaacgtgtcaccagcaacaaccgttagttctttagagagtgcgactccaacgatacctttactatcttctttttgttcagcacaagtgtagtgtttatcgctagagcctttgtgagtccttacaatatgagtcaattcgtacttagaccggactcggtcttgactccggtttgagagcataaccgcagcgccacctactcggaatagacagttagggactaacattgaccggtcgttgcctcgatacatgcttagagtcatgttctccgtactaacaataactgcgtaggtattagggtttgcctttagtagatttgtggcgaggtccacggagattcctaaagaaagttcaagaagctatgaagagtggtaaactctaaaaggaaagatagaaactggggagttggctgataaagatggacagtaacgattgcgtaatataaatttatcggcctcgtcaagccccggcgctgcatcccataccggagagattgtaagttttgacgtcggttttaagcttgtaccggtttacgatcatggacgagagagatgggttagggttaaacaagctgcagtttacgatgaagattccgacttctctcggttcgattccggttttcttaaatagtgagttaagagctccgaagatgactaattcggattcatgtctcgcctcgtacattgatggagttggtggagaggttaacatgcaacgtggggagtacgtatcgtctcctaaaccggaccggtttagtatcctcgtcatgaattggattgtttcttcggtgtagagttgagcgcctttggccatgttgaagaacgtttcggatgagattttgcaagaatccgtgggttggtgacatgagaaatccactaggtaaaccggtttagaccgggtggttgagtaggcatagaagaagatggatatcaggagtaaaccgatcttgaccggaaaaggagagaagaagtcatggtgaaagtgaagtagatcaagttcaaagagagatagaaggatgagtataagcaaaagaagcttgaaatctgccattgcaatgaacatatgagaaaatattgggcattgggtgggttttaatttataagcaacgtaccttaccaatatttatgatatgaatagagatggcgttaagcgcgtttgtgccgcggaaaatgtggtctgcgttttaaggttcacctattcaaacaaaattcagagacatcgaaaatgaaaaatccttaatggttttttttgggctgcaaatcataatcggaatttatttaattgaagtacaagaactttgggccgggtgggtttgagtaacccggcccgacatgagtacccgtaaaacttgtttgaagcagaagaaaac

SEQ ID NO: 9250 - DNA, 3000 bp, Unknown
  misc_feature (1)..( 3000): cDNA_ID_2181472_gDNA_ID_1972029_Annot_ID_178209 3000 nt of promoter + ATG
agccagctaacatattcagttaaccctccagcataaaaatattcactatacacgtccctttctggatcatcatcctccttttttagagagattgtaacctgcattcaatatgaacctcttgattatgacaaaggaaacagtcgaacactagcttctgctaaataagaactcactaaaacgagcaggttaagaatgctccgtgaagcacacaaatcaaatatcacggctgcctatacctttggattgagaaaagcaagctccctgatccgtccagcaatagtgttatggtcgaattgaattgcagttgtgaatactgattaccagtttgtttcagaaaagataagttagtcatcaaatcctatctttgggagggtacaatagataagtacggaaaacaggcaaaaccttctttgtcaggccagaaccggatgcatgtcccttgagtcccccttgactctggtggtaggacatgacatgtaagtgttgttacgggctttccacgagaatacttctgctgaaactccattccatctctgcgaactataacctccaatgcctgtgaataatgggagctccataattagttgtatgcatattatcctaatagactcctgatgtcttgccaaatataacagtttcttatagttgaaagtatctgaaattgatagccccagcactcagtacagaaccattccaggatctttctcatatgatatcaggtttggacattagattaactttcacacaaaataaagaatttgcaataacatagcaaacccttcctatacgatcaaatgcgcaggatctaattatcattacaaacatgtgacagaggatattttcaatttagcagaaaaggcaacaatgtactaacggttacaacacacctctgacaatgcattcacaaccgataaacctacgccatgcaatccaccagacacgctgtacccactactcttgccaccaaacttaccacctgcatgtaagacctgcacaaataaaaagcactgattaattgcaggaccaaatgttaggataacaaaaacaaaaatacgtgtgaatcaacattgagacaaacatagatagctttctacacaatatataagtataaggtgtactaatagatgtttgtcaagtggcagtaccgtaaggacagtttccaaagacgattttcccgttgcaggatgcaaatctgtgggtatctgcagacagaaagcttgtatgaataaaagtgaccaaatgcattttgatattagcaacaaattttacttctgggatgaaagaaagctatatacaaaataaataaaaaaaacgtaaatgaataagatagagcatgattgacatatattgtttactcttggtgcacattagatataaaaccggaagctttgagaaaaatcagctaggaataccaaaattggctcctacacataactacagagtacagaatgccattgggtgccacttaacctttctcttgcatctcggcataagaaaacaatatccatgttttcagttacaaatatacgcgaagatgagtaagtggaacaaatcacataccccacgtccattgtctgaaatgctgactgaatcatctgaatgtaaaacaacgtcgatctttgaagcaaaaccagcttgggcctcgtcaattgcgttgtcaaggatctcataaacctaagaaacaacatgtattgggaaggatataaccagttgataggagccagtcacgaccaagaacgtcaaaagaaaaaggcatttaccagatggtgcaaaccacgagatccagtgctaccaatatacatcccaggtcttttcctgacagggtctaagccttccaacacctaatacaccatagagaatttaagatacaataacccaaaaaagtgaaactaagagattcatagtaggaattttcaataactatagaagaaaacatcgttccaatgatcgagtacacaaacataaaaacagcaaatcatctaaaaaagcaagaaaacgaaaaagatctttagaggaattacttggatgtgctcggaactataatccttagaggtagagctctcttggagagactccatggtcgatgacataaaacttttaggtgagaccgcatttctttgtacaagtctttgactaaaaacattggctaactgaaactttatcctgaaaccaaatgtgaataatggttatactaccaacttttgcttcagactatggaagcgaatcacatagctaaatgttaatagtaaactaaagccctgaaagtgaccaaatacgaaaaacatttttgaaggagctgaagaaagcaattgactttcacttgaaaagtagtataacataaaattcccaattccgagaaaacttggaaactatcagcaatcgcgtaaaggaatgatttttatcatcggaggcaaattggtattgcttcttctattcaatcttcatttcactgcgtaatttccccggaaaccaaaaccggaaaagtgaaaagaagaaatgagctaattaatacaatacctgggtgttgaagagctgagagctgaggagtgacggtgaagtgaaggatatagagagtgagagaagagacgaggacgaggacgagaagccatgagacgaaaataacggagaagataagagtgttgtctctgaactagagccatggaggagttgatggtgacagtcaaagacatgttttcttctgcttcaaacaagttttacgggtactcatgtcgggccgggttactcaaacccacccggcccaaagttcttgtacttcaattaaataaattccgattatgatttgcagcccaaaaaaaaccattaaggatttttcattttcgatgtctctgaattttgtttgaataggtgaaccttaaaacgcagaccacattttccgcggcacaaacgcgcttaacgccatctctattcatatcataaatattggtaaggtacgttgcttataaattaaaacccacccaatgcccaatattttctcatatg

SEQ ID NO: 9251 - DNA, 3000 bp, Unknown
  misc_feature (1)..( 3000): cDNA_ID_3040885_gDNA_ID_1972029_Annot_ID_178202 3000 nt of promoter + ATG
gttacaccattgaccattgttgtcttactgcttctgtgttctggatgtatcggttcacagccatttacatgaagctttttaagctgttgcaggaggagtcccatatcgattgcagcagcggttatatacatcataacacagctctctgatgagaagaagcctcttcgaggtatgttccattcacattttgtgaactgaaaacagcctaacatcacggaaactgtaattgaaattttgaacctgcagatatatcagtggcaactggagtcgcggaaggaactataagaaactcttacaaagatctttaccctcacctttccaagatcataccagcttggtacgctaaagaagaagatctcaagaaccttcaaagcccttgagtgtcttcctcttctaatctcttactcgcaaccataccttcaagtttcgattgggattatgggttataaagttgttttgtccagaagtgcgactggaggcacgcttgaacaagagttttacagtagatttgtatcactttttcttcataaggtactatacattgttgaattaatgagatggtatttctagttgatcataccattttcagcatcatgccactgacctatatattaaccccgctaattaaggcaacggtttaaagattgattaatgtttacttcttaacaaaggaaacagagtagtatctcattgttatatgagtaaaagagattaatttgtaatgttctatcgccggtccacaagcatttgaagcagtgcaactgttcaagatatgaaaatttttaagagctaaagatttctatgggtaaaggaaaatggttccaatatatatacagaaacgcttttacatgcatggtttctagtaaattaagattacttcgcatagaaaggaaaagtgatttctgagaaactaataactttcatgcagaaattaataaagacataataaaataaacgaaaaagacaagtttgcgcatcattggtgtaagtttacctaccacaaggataaaatggaaatctacaatctttgctagagattggaccatgtcacctatatgctcatttttcatcttctattcaaagtaatgatcaaatcatcattttttgtaacaataaaattttgaagtcatcaagttttttttttaagtacatatattcttggttcagttatatccagaagaatatatatagaagaaagtaaaagttacatgtgagaatcctgaactagtttgaaaagctgcataaatgcatcataaacatgccaattttgtatctagagtattttctgcatacacactctttggatcgtaatctctaaaccagctagaatatgaagaagtgataattcaaacaaatgaaattttcttcgttaaaaagaactcaaacaactgaagttagtccatcaacccgtaaaccagtttaccgttatatatataagaacaccttttatataaatcattcgagagggttggtatttatcttaatttgtttttaagagatgtataaattaatatctaaaattccatgatttagataataattattatacaaaccctaccataagattggtgagaggtatgactttggttggtgaagaggaggagcggaaaagactttacccaaatcttaccaactctatccattatcaaattctttaatatttgcatgcatttagtttatgtgtttggtaagcttttaaccagatctataggagaattatacgtacttaacttccattcccattttcaatattctaatttttctcatcttccgtatatgaatcgtcgattatgtataaatcattagtcacgaggctaaattcatgatgtctttgtagttttgagtgttgtccacttaactccatgttttggattccaaatttccaattgtgtagtttcaagttctctaatatctccgtccaaaaatattccaaattaaagccgatttagatggagttatacttttacccattttaattataaataacggtaaatgaagacctttttttataaacttaattaaaagtgtttatttaaatcaattcataaatagataaaaatcaacataaattaaaaagatcgaccggtgtgttgcctaaaatgtctaatgtaattaggacgaaccttggatcagcaacaaacacacaattaatgcagataataaatgagttgtatacttgtattagcttttttaggtatatgaccgttcgacagaaatagtagtcgtgtgaatgcaacaatcgaatgagttatagacacacaaaaagacctaacgtattcagattctataaaaagatacctacctggtggtagtaataaatgacattctatcaattatacgatctggataagatttggtataggagctatatattaatggaattactaagttttctgaaactacatgtcagaaccatttcatgcaaagaaagttgattacgaaaaaataaagttttatatgattaagaaaattaatactttgtaaaaaaaaatgttaaatatggatttgtggtcttcctcacaccagaccaaacatcatgtccctatctctggcaaaatacctgacgctcgagctcgacaagtaaaagaagactcatatacatggaagacacgtggtgactatattgtccgtccatattgcaattaacatctgacggttgtggacacatttcaactaacccgactcgttcgttctcaccaactctttgcgtctgtctatttaaaacctccgatgtcgctcacctttctctcaggaaatttatttgctattaaatttcctttttatttctccctttactttttttataatcgcaaaaacaaatttcaatagttcttgtaagcgcaacgtgtaagtagagacatacacacatttgtagtgttttgttttgtataataacatcatcgcatatagagaaaagaagttaagacgaccgtatatatcgttttgaaaaccgggtcggataaaaaaaaaccggtttctttaaccgagtcggcgcgcatg

SEQ ID NO: 9252 - DNA, 3000 bp, Unknown
  misc_feature (1)..( 3000): cDNA_ID_2181450_gDNA_ID_1972029_Annot_ID_178204 3000 nt of promoter + ATG
ctgctaaaagaggattcgtcggaccaccgacacgaacaggatcattatcaccggactcattagcgaaagtacgccactcagaagtttcatcgattgagtgagattcaagcacgagaccacactctgaacaaactgtatctccggcggaatggtcaaacacaacctccgtgtgcctcttacagtccgaacaaaacgcgtcactcatagcttctctttctcttctcacaagaaaaccccttttcactaattggactttgattactaaagattgttactttcttcttcttcgtctttttcctcgtcgcgccttgagcttacttactttttcaacgatttgttttcttctcttttctttctttttcccgaaagatcaaaatttgcgacgataccgaactcggcagtatatcaaccgtccacgtgtctaatgaggatcgacggctaatatgatagacatgtttttgtttgttcagacttcttcagacccatctatctataatagggctctgaaacaaacccggcccaacgttttgaagccctatattgttttgggtctctaaatgattctttttacttttatgttcatgcacatcatccatacggccataccacatgagattatcacacatgggtcataagtcataacacaccaaacagacacagtatatgatacacaactttggataaaaataaacatggacataactaggcaaataccaattagcaatctcaatattgtaagacatatatcgcatatcatgctctcaaaataccaattaggaacggattttaggaagtgaaataaataatatccaggctttccacaagacttattatataataatgattgacttttatgaactttcttaaactaaccctaagaactcaagttttgttttcttatgaattctataatataaaaggtataattatgtcatatttaattaatacaatttatttatacagcaaactcaaaattgacatatgaactaacacacatgtaagcaaatgattaagacaagtgtacgtattaaacagatgcactatttttattttggtcgatacccatgaccatgaggatatctcttgtttctttgtatttttaaaacatcacattttaattattaagagaagaaagttgtttcgtttcgtagactataaaactcaacaaagaaaatttccggtcatctgaatgtattatgcgttactcatgatcgtcaaaaagtggatatggttaaattcgcaatccctataaagcaaagtctcggtctccaatgatcatctttgcgtacttatattgcagttcatcgatcattttttccaaaaaaaatcataattaattgtctcaacatgtaacctaaaaagattacacgagggcaccaaaatatggacgtcaataatttagtgtcaaaaactttggtaaaatattggcatcaccatcattatttctcattctgtttaatgtatatgacagtttatatatataacccttcttaatcaatgaattttatagatcttattagagacttagacctttacatctcttcgaacttggtctaaaagtgggtcacaatactttatattgacgttagaaatttctacataacttgaactatacatgaatttagattatacgatagaagataatatattcctaatctgctgaacatgattaatcaatatcatattcttcttttttatttttcattcttaatattctagaattttcgcccaccagtttttctctttatgaaattcttatttaagtattttttcgcctaccaacttttttattttcccttgggtctatattttgtattaaacgtgttatatatcaaataatagtgcatcagaaggtggcttttggcaagcaaaaaaaaaaaaattaatactagatgttgtttgtagttattgatataatgacatgtttgtatgtatttgacctttaagaacgcctccataagctatttgatcatttcttccttttcccatgacattctccgcggtttttataatattaaaatgtccaacaatttgaaattctttattcttaattggtcatccctatgagtagattggtctcatcaattatttataccaatatataattttaatcatactataaaacaaatttttgtttcaatggcatttgtgctatatatgacaacttaattttggattttattgtgttgaaccataaactagtcttggatcatgcagtctttcactgattttttaaaattgttttatttccggttcaacctataaaattgttaagtctaaaataaagatcacaatgagctggacctcagataacataagactccagcgcgccagaaataatacattgaattttgtttgagtcatcatatacactaacatagaaaatatttggtgtccaataacttgatttaacttaaagcagtttctcttttcatgctgattaagacataaattccacttaaggaagttgaacatgtcactgataggatgatttcaactaatcacgagtataaagtaagacgaataattagttattttaccaaacatgatttaaggataaaggaatcttgtgatgcaagaaacatatataagcctaaaagatgaatgatgggtttggcctaagtccctttctcgttctcccacacgtctcctcattcccctttctaagaagatcgaatacatcccaagacttagtaactttctctctcttaaccaacaataccaaattacgtctctctcttccaaagaatagtatgcgaacgtctctctctaaataaatactctgatttcaaagctaaaacttacaacaacacccacaaaacttctctctcttatctcgtctacttgatctctctactctctttcctctctagctacttctctcccttacgtctccaaggagatagattgacaaattctgttcacaaaggaaaaaagttcctctgcatacgtctctctctctatgttcttcatttatatgacttgaataacaagtaaagg

SEQ ID NO: 9253 - DNA, 3000 bp, Unknown
  misc_feature (1)..( 3000): cDNA_ID_3040878_gDNA_ID_1972029_Annot_ID_178205 3000 nt of promoter + ATG
ttggaattatcttgttgaattttcctctgcatattgtttggtttgactttgatgatcgttggtgccaaatcctcaagttgtattattattaattcaagttgaaagtattaaaaaaagtcaaatttttaattattctccctgctagcctggtttttgagtatatactgatttaagaactccaaattgcaggaccaaaagagtttacttcacttttctttagtcttcagaattggagggtaagttcaaaggtttttctaatggtttgatgataattgttggtcaagaatgttgggagttgttagctcatgtgggttttgtttggtgttgcttctttggaattggtttcagtctatctttgagaggtttgataaggacagaagcggtagaatagatacaaacgagctgagagatgcactcatgagccttgggttttctgtttctcctgtgattttggatctgctggtttcaaagtttgacaaaagcggaggcaggaacagggctatcgaatatgacaatttcatcgagtatgttcattcgtttcaacccccttaccttttcttactctgtaacaagtataattcatcactgattctggtttattttccattgatgtaggtgttgtttgactgtaaaggtatgctattttcatggcttgggtcgtcacattctcatgcaattctaccatttgaattattcaagattgttcctttacaatgtgtctaatgtatgttatgttttgataaaaaataatcgcaggggctcaccgagaagttcaaggagaaggatacggcgttatcaggctcagctattttcaattacgagaacttcatgctcactgttttaccattcctcgtcgcttgagtgattgtttttttttttttttgttgaccaaagagattgttttctaactctattttctttgtgagcttttggatattttatttgttgtctttttatctttctccggtaagattcagacgtgggtcttcttttcatatgagcaaaaccttagtaaccaatcttgtggaataagtttgaatggactaagagcccaatatttccaattacagtaacgacagcatttgtgtttcaaaaagtgaaactcgattttcttaagtttcgaggccaagtaatccaaatgggtatgaagaagccaaaatcaaatctattacgtacgcaatggtttaggacgaagattgttgctagaaaatgtattttaatattaacagtagtcgttcattgcatgagtaaatgattaaataattaaaatttatatttattaaaatataatatttagcacagatgatctagtgtatcttaatagttggtgaaaatgcaaattttcatggttcgcattatttataaattttttgactcaattaaagaaaaatgagtaatttctttcatcactcatccatattttcttgttattctactacaattagtttgaaattcatattaacattaacatttaacataaatgttgtttttagatacaattaaagtgataatgtaatagattttcccgttattaaagcatagaactcttacgatctgacttttaattattttttataaaaaatatcgcacatgtagggtcgcgtgcaattgacgcgatacgttaaataaatttgaaccgttgatttaggtaaagaattttttaatccaacggctgagcaagactaatttgaatatgcaactctagatctctttggacaaagtttttcaatgtctcaaaactcaaaacattctatgagtcataaactaaaaccatcttttaaaacttactcatagatattttaaacttaaatttatttttttaagtattttttagatagcaaagaaaatataaataatctggtgaatttagaaaaaaatatcatgggaaaggtaaatgtggcatgaaaaattcaattctaaaaacatatggaagacattttgatcactaatcatcactttttagtggagctattttttcacaataatttatatatgagcgacacaaaatgcattaatttagtactattcgttattgaagtctataataaaaaatggtctttttgtattggttagaagaagttttctttgtctcatcatcagttatatcaataaatgttagtatcactacttttacaaatatgaaaaaatattatttattctgttttaacaaaaaaaattttatttatcttgttttaagaatttcagtagaaaaagaagaagacaatcccatatagctaaaaaaaatcaaaagaaaaaaaccgttacatttttggaaaaatatctttaatgacgtttaataggaataaatcctctacaattctctacaaaatacaaatgattggtgaatggtgaaccccttataaaccatttaacaaaaacaaaaaccttaaaaaccctttaatactttctatctctttctaaattttttaacaaatgtaaagaaatctaggatgcggtataaactatgaaaatcgtgatgattagttaaagatgatatttatttcccaaaattagcataactaacaaatttgaaatccaatgtaattaaaagattattaaaactgctttgcattaccatcttcgagaaatcataagccgttgacacatatgcgaatcggacggataagattagttcactagatatttgaattcaaacacagtaaaagagttaacgttacaattttgtccgcttaggttaggatccgaacctaaatacccgaaccagaaaacacaaagaaaacaaaggaaagaaagcttcgaattataaagaaaacattctaagcgattcaaagaaccagaatcagagaagaagaagaagaccagacgagactctcttcacattttctagggttttgatctgttgcccagaaggaaagaaacagagtccataattggtaacttcgatttctttccttggctgattctgatgtgcattgattttgatcgattagtcaacttttttcgttttcaggaagataaacgagaatttggactctaatg

SEQ ID NO: 9254 - DNA, 3000 bp, Unknown
  misc_feature (1)..( 3000): cDNA_ID_2181461_gDNA_ID_1972029_Annot_ID_178207 3000 nt of promoter + ATG
aagaaaatcgagtttcactttttgaaacacaaatgctgtcgttactgtaattggaaatattgggctcttagtccattcaaacttattccacaagattggttactaaggttttgctcatatgaaaagaagacccacgtctgaatcttaccggagaaagataaaaagacaacaaataaaatatccaaaagctcacaaagaaaatagagttagaaaacaatctctttggtcaacaaaaaaaaaaaaaaacaatcactcaagcgacgaggaatggtaaaacagtgagcatgaagttctcgtaattgaaaatagctgagcctgataacgccgtatccttctccttgaacttctcggtgagcccctgcgattattttttatcaaaacataacatacattagacacattgtaaaggaacaatcttgaataattcaaatggtagaattgcatgagaatgtgacgacccaagccatgaaaatagcatacctttacagtcaaacaacacctacatcaatggaaaataaaccagaatcagtgatgaattatacttgttacagagtaagaaaaggtaagggggttgaaacgaatgaacatactcgatgaaattgtcatattcgatagccctgttcctgcctccgcttttgtcaaactttgaaaccagcagatccaaaatcacaggagaaacagaaaacccaaggctcatgagtgcatctctcagctcgtttgtatctattctaccgcttctgtccttatcaaacctctcaaagatagactgaaaccaattccaaagaagcaacaccaaacaaaacccacatgagctaacaactcccaacattcttgaccaacaattatcatcaaaccattagaaaaacctttgaacttaccctccaattctgaagactaaagaaaagtgaagtaaactcttttggtcctgcaatttggagttcttaaatcagtatatactcaaaaaccaggctagcagggagaataattaaaaatttgactttttttaatactttcaacttgaattaataataatacaacttgaggatttggcaccaacgatcatcaaagtcaaaccaaacaatatgcagaggaaaattcaacaagataattccaaaaactcaaacctagattgttgaagcaagacaatcttctagttctagaaagcgcaaaaaaggaaagacctagaacaatcaatttgagatcagtttgaaagaaagaagaaactgaccaatcttcctgacattgctgttggtgaatagatacataaggagatgaacagttcttatgctgaagctctgattatacgaagatagagctccttgaagctccttatcatcgatgaatccactattgtcccgatccgcagcttggaaacaagccacaatgttcggatctgttccgggaggaaacgccgacggaaccagagacgcaaacggacttccataagaagcttgcggaggaggagctccgtaacctcctccatgtccagactgctgcggcgctcctccgtaacctcctccatgtccagactgctgcggcgctcctccgtaaccaccgtagtcggaaggtccagacgatggatgagcaccgtagccaccgggagatggagatccgtaggaggcgccgtgaggtttctctttgtgcggcttattatggtctcctggaagagacgcgtacggtgctgacggtggtgcaccgtaaggagcgggctgagctccgtagggaactgcgtacggtgaggaggctgatgatccgtacggaggaggaggattgctgccggatgatccgtacggaggagggttattgccggttgatccgtacggtggctgaggaggtggtggattaccgccgtaaccgtaaccttggcttgatggaggataaccagacatggtgagaagaagaagagaagctttcagagagatcaacgaagaagaaagtgaaaaaattagtttgcgaaatttggaattatgatataatgaagaaggaaattagctaagtcagatattttggggtttggattattacgatgaagccattagttaagaacgaattagctctgtacgcgttgaggggtgaaatcgtaattttaagatgatatacgcggctgacgcgtgacgactgacgcgtcaattaaaatgaacgaaacggctgaggcccattaatgaaatgaaatggcagacgaaaaaacaagaatgtattgagagccttgaggcccagtatattagtttttttcttttggtaggaggcccagtatattagttaattatccaaataattcatatctcgcacacatttttctttatatcatgaaaagtgaaaactaagagaaacgttaaaacttctaatttcgtgatacatgccatcaaatagccactaacaatctcaaaatcttatataaaccaaacatgaaccaacaacaagtccaaaataaataaaccaacaaggcaaaaagagactcccaatagaatacgtaagttgtttttagtattatacatttttgttaataaaccaaaatgtacagacaaaatctaacaagttttcatgattttacgaatcacaagttttagatataaagtataatataaagaagttctgagacattggcctagtcctactaataaagaataaatctagacttttggaccattttttggtaaagagccgaattttttacctaatctgggggaaaaagattttgtttattaaattttattttcctctttgattatcataataatcaatgtaacacaaatacaacagttttatacataataatttcaaaactcctaaataagattagtcaattcaacttttctcaaatatactttccaatttaaaaatacattaattagtcaactgcacattaattaatatatagatttcaacttaataatacattaattatcccaaacaaataatttgtcagttcaacatatatttatatatctttaaaaaaattaaaaccttcgtttttttgtaatccatctgagcgcttcaaga

SEQ ID NO: 9255 - DNA, 3000 bp, Unknown
  misc_feature (1)..( 3000): cDNA_ID_2181458_gDNA_ID_1972029_Annot_ID_178206 3000 nt of promoter + ATG
atatataagtaagtataagtctataggttaagatacaaaaatgagttaagtgaaaatatcagtctttgagcttcatctaaacctgcgtttagtctctccataagcaaccaccccgagaacggttatactgtacccgccaattcccatcaccgttaccgggtttcggaaaagcaggatcgatatcacaactgcaaccgctcctttagcatttccaaggacctgaaacattaaacatacacatgtttgatccaattaggcactcctctagttttgtttaagttcaaaatcttttcagtatttttacctgcagggtaagtgcgcttgtgtgcttggtaaccagaaagtttaacaagttggctgaataagccattacagagttaaccagcagaagtatatacatgtacttatgttgtcttccgagtgttagtgtcacactcatcacgtccggctccataaaaattgtgacaggcagaagagcaatgacggctattggagacatgtacagcatcaaattcatcgaattcaacctttctctgcaagaaaacttaacgatctgttaaaccctaagatgagcattagtagcttcagcttcctactttgcttatccaactgtagttgcagaaccttttacattattatagcatataataaggttttctgattcattgagtaaccaaatgcaaaagaaaagttaacggatttacccctcggaagaaagtaagatgccttgaagaacagatttaaaagctcttgctgcagtagcactaatgcacataatgaatccaaaccagtgaaaacctggttcaccctgtaaccacaaaggcagacccagagcaggatcattcaatacagaaatcccataatcaacaaacaaaacattcaatagctaaggcctagcaaagagatcaaataattcacagaacaatgtagaatgtaagaatggcaatagttacaagaagaaagtctgaagctttagataacacatgactggaataacgcattaaaggatgaagctttagataagtagataatacagccacagaggactcaaatttgtacttgacagggaaaattgaatttgtatactgaatgtaatcacattcatgaaactaagcaaacctattttgggtttcagacacatacgtggaacacaaacaatcatcttgaatggctctaaactaacaacaaatcagacatcacaatctacaggtaaaagaacacatatttcaaaatcggcagaatcaaaatcaacaaccaaagacgttttcattacgagaattgtagagaaaaagacgtaccccactggcgataacgacaccggtaacaacggggacgagagcgccataagtgacccaagcttctctcttaaaggtcatgatataagcgaagagtgcagtgaaaaacggcgtcgtagcaccaacggcttgattaaaggagacagggagataacgaagggagatgtttccaccgacgacagaggcacaaaagacaatgctgagagtcgcaaccttgagaaactgagaacgagatttgaggtattggagagggacgagcttgaggaagacgatggagacgtagctgaggatagcgcaagcggacatgtgacacattgtgaggaaaatagggaatttgaatccgtaattggagaggaggaacttgttgaggagaagaacaccgatgttggaggtgtaccagagaatgattaaggatgatatgaagagggtttgtttcttcggagaagatgaagaagacgacatgtcggatttctgatctgggttcttcttgttcatcttcgtcgtcgatgagatcgagagatttggttgttttttttggtgggagaaagacaggagaggaattagctccttacctcgagcatgggacgacattcttgaagcgctcagatggattacaaaaaaacgaaggttttaatttttttaaagatatataaatatatgttgaactgacaaattatttgtttgggataattaatgtattattaagttgaaatctatatattaattaatgtgcagttgactaattaatgtatttttaaattggaaagtatatttgagaaaagttgaattgactaatcttatttaggagttttgaaattattatgtataaaactgttgtatttgtgttacattgattattatgataatcaaagaggaaaataaaatttaataaacaaaatctttttcccccagattaggtaaaaaattcggctctttaccaaaaaatggtccaaaagtctagatttattctttattagtaggactaggccaatgtctcagaacttctttatattatactttatatctaaaacttgtgattcgtaaaatcatgaaaacttgttagattttgtctgtacattttggtttattaacaaaaatgtataatactaaaaacaacttacgtattctattgggagtctctttttgccttgttggtttatttattttggacttgttgttggttcatgtttggtttatataagattttgagattgttagtggctatttgatggcatgtatcacgaaattagaagttttaacgtttctcttagttttcacttttcatgatataaagaaaaatgtgtgcgagatatgaattatttggataattaactaatatactgggcctcctaccaaaagaaaaaaactaatatactgggcctcaaggctctcaatacattcttgttttttcgtctgccatttcatttcattaatgggcctcagccgtttcgttcattttaattgacgcgtcagtcgtcacgcgtcagccgcgtatatcatcttaaaattacgatttcacccctcaacgcgtacagagctaattcgttcttaactaatggcttcatcgtaataatccaaaccccaaaatatctgacttagctaatttccttcttcattatatcataattccaaatttcgcaaactaattttttcactttcttcttcgttgatctctctgaaagcttctcttcttcttctcaccatg

SEQ ID NO: 9256 - DNA, 3000 bp, Unknown
  misc_feature (1)..( 3000): cDNA_ID_3040893_gDNA_ID_1972029_Annot_ID_178200 3000 nt of promoter + ATG
gcataacatcatcaactgaattgttagagagctattgggtcaaaaatagaattgattattcctcattaatctgaatctggatataccttaatgttaagatagtcgctgattgcgtccagtataaattgaatctcatcttcatgaggttctggaagtgaagtgattgaagtattagagtctgtagtgcctgctactgttcttcccaaccacggtaacataaacacaacgcggccatccttagttttagggactatcaaccccatgccttcaggagaatagtaatcaggcagcacgatgtgtacaccgctgcttggacaaatcattggttttgtatcttcatcaatcattttcctaatggaatcacagaacggtcctgccgcattaacaactacttttgcatagctgttaaattcttggcctgtcaaattgaaacatctcatcaaaaactgcacaaatcatgacagagcagaggtatactgaattgcacgaaattgctagtcgttttacctgtgagattgttacgaattcgggcaccaattattctcttagtagcatcatcagtaataagcgagacaacctcggcatggttgagaactgccgcaccagctaacgcggcagtacatgccaaacccacattcagacgtgaatcgttcatttgcccgtcataatacacaacagtacccctcaaattcttgtctttccctttccttgcaagagtggggaagagctcaatagactcttttgcagagtaatatctggacagatgcaataaccgtggtccagcaaccaagtcatacatcttcaaccccatccagaagtagataacttcgaaccaatcaaaacaaggtgtcatacagggcagagcatgacagagatgtggcgcattctcaatgagctgtttacgctcctcaagagcgtgaaatacaagcttcagctgtccataatcaagattgaaaacagctttctccaagtaacgaacccctaagtgtaaacgagcactaaatcaaatggtgtatcaagagccgcaaatgtaatacatatccttaacatgtatgttccttcaattattgaattaacaaacaaaaacacaacaatgagtggcaaaaaccaagtaactagctacaaattcttcaatataatttcgtcaattgaatggtcataccactcaattccaactagtaaactaagaaatggtttaatattaccagacaattcagagagcttcttatacgaaattcggaaatccacgccacatagaaaattcaaaaattaaaagtacctccatgaatcagctttgtagatcgcgaagaagtcccagaggagaaatcctcgcgctccaccaaaccaacacggaggccacgtgtaacagcgtcaagagcaactccagaaccggtggctccaccgccaatgacgagaacatcgagcggatcagaagcggtggctgcaatcagagcagactcttgagcagatcgagacggtacagaagcggtgggatcaccaagcctacgcctcaacgaatctagaatcggaccacctcctttgtcgctggaggcaaccgacggagacaggtagacagcgccaccggatgcagcggcaattacggcagctccggcagctaaacggcgaatggaagcgagagacatggaatttaggagagatttagagattgggtgaagaagattgcgttgggaagcgagagacgatcatgggaaagaagaagaagaaaatgattgcgaatgatatcaaaaaatggaaatagaaatctctgtaatggaaactatatcgttttaaattactgtttcaccctcacaactttccatacatagaaggtaagtgaagtggggatggtttggtcatttcatatgaatagagagttccgagttctaaggaatggtttgagtgggctgcaagagatttttcttataggctttgtaagtttttgattaaaaactgttttgtacaaacaatagtgtttttgattttttaagaaaaatagaagtaatttgtgcgagttaatttaataaactagactaacaaattataaaattgaaaataattatttcaaaatatggaggatttgcaagtgagtttttgctagttcttaaaatgtgcgaatcttgctctcttaagattggaaatgtttaggaatatagtcagtaagacataactaaatatttgatcattattagtattaaaagagttaagccatactaaatatttgttttaatgctattaccgtagagggtatttctctattgtaaataaactatattaattaaacttctgtataaagattacaaattaattatcagaaaaatgaatgaccgtaacgaaataaacgaaaaatacaaacttctctctgattaaaaaaacaaacgttagaaattgtgattatttattgtctcgatttaataagagattcttgaatttaggtgacaaatttaatcattaattaatcatccttttaactttatgtaatttgtccatcagacaaagagatggatatacgatgtcgtaatagccgcatcttcttctaatcaccttttttaagattagtttatgtaattaaaaaaggttaagtgtgacagtttgggagaattaccagaggatgaaggcgatctcagacatccatgatttgcctcttttgtcttctttaccttattcgtctctcattctttgaatcccctttccctttctctcaatcttcctcacttacatttcttatctcactccctctctcactttctccttcaatgttctctcctctgcgttttcacgaaacagagaaccttatcgttccgtcttcgtagacattgaaatcgatagagaggtgattcattactttgattcgcgatcggattctgatcattactctttttcaaaaatcgatagattcttctccgatttcgtaacaccgacacgaatttgtttttggctttttctggtttttgcaggtgttgatttgattaggtttaatattgattcggatgaagggaagag

SEQ ID NO: 9257 - DNA, 2147 bp, Unknown
  misc_feature (1)..( 2147): cDNA_ID_2105228_gDNA_ID_1972029_Annot_ID_178198 3000 nt of promoter + ATG
gaattcacctcgatagttcggatcctcagtaagatgcccaaaggtatcgagatctgtgctccaaaatacatacggaaagagcattgcaactttattcagtaacccaaaacctaatctctttatacaatcaagctttctctgaggtaattcgggaacaaatttgatggatccgttcttaaggacaccaaggggaactgtacacagcaccatatcaccctcatacacttgatttccagcagttaccttgacaccatttgaaccatatctgattgtttggacggtcttctcatataatattggtacattttcagccaaagcctgaaccagccttccatttcctccaggcagaaagcagtgatctccacccatatcatatgggtcatcttgatcccagaatgcaagagaaagctttgatactaggcccgcatttgcatactccaagttagcaagatgccagttaaacaaacccatctcctcggtggccacatcattcccagaaacctgcctgaatgtctcgagtgctgccccaagggagacatccatggaaacatcacccatcaactgcctaagtttacttgccttgtctagaagctggttaaacgctacctcaacctttatatccacatctggatcaaccggcttaccatccaccctataaagaggacacttgtctcgtaccttatagagagaagaaccaagctgtctcgctataatccctaaaggatttcctaatgttccagtcaaaacactcccacctaaatccgctgcagcacctaccctattagcttccatctttttggtataaacccgtccaccgggtcgtttcctaccctccaaaaccgtgactttgaagccaaacctcatcagttgcctagctgcagccaacccagataaaccagcaccaactataatcacactagacttgcttgactgagcaggaaacttatctttaatcgcctgtgctattccaaaattgatatatccatgtgtaaccaagtaattataagccgaatctaagagactactacaatgtttaggaatcgaattaagaaacatctcctttgtgacccaactagatatattttctcgccatttggatataatgtggttcctaatcaaaatgtaattgacttgttcaatgcctccaacaataggcaccacaccgaattcaatctcttcctcggtaagcgaatcagcaggaaacccagcagtgagagcaagcaaagcttcagtggtagcttccttgttaatcgtaatgatctcatcaccaatcccaggataacttttcacagtctggtttgatccattgacgacctctacgttaaatctaccggaagaagaagctgaagatgacacgaaattactgttaccaggaagaagacctacgttagggacgggaagggaattaagcgaagacattgagcgctgagaacgtcctctccttcgtttctttggtgcggagaatgagaccatctgctcaaaactagggttagagattgaggtagagatcgaattcggaaatggattcaaacttgtttcggtattggtgtttgagctcgactgtggaggaggaggagtagagaattgagagtgagaaacagacggaacataattatccggtggattcatcgtttccgtcgccgtagaaactgcaggagagtgatcgatgagaagaggaagaagaaaaggattgtttggttactggattaactttatctttatttaattgaagagctttttgatgatttagtttcccacgatttttaaattattatttgggaaaaaacagaaaacaaggaaaaagtaaaacagaaaaagaaaaaaaaatagagagagaagaaaagtctggaaaattagaagaagaaattggaaggagaataaaacaaacgcgtatcgtatagatttttaccttttcttcttcgtcttctccattttctcgagatttagcttttctcttcgtgatcgggaacgtgttgatcagattctagcgtggattcgtatcccaggtaagattcgcagctgaaatcgaatttgtttctcgatattcttttctctctagatctacttccagacgtagtgtttgattaatttttgtatacgccgatagtctcgtcatcagttgaatttttcatgtaattcgaattatg

SEQ ID NO: 9258 - DNA, 1451 bp, Unknown
  misc_feature (1)..( 1451): cDNA_ID_3040936_gDNA_ID_1972047_Annot_ID_178236 3000 nt of promoter + ATG
gaattctctatatagtttttcataaataatttctgaatttcaatatctttgtatgagagagaattggtcattccatgtgtgtggtttggcctttgtgggacatgttcgattgaagtattcctaataattttcaataattaacaatttcttctcttaatagcatagataaatgttgaatttattttgttaataaaattaaccctgatgaatacaacaattttgaatatgtcaaattagaccaattcaaaatataactatttgctttctttcttctcataatgtttatatatcccactttagtaaatggacccccacgaagcacaccacagcatactcttttttattctttccagtttctaatggtttacttatatactcttatcattttctaattgatcaatttgtcatttattggcttatcttcttataaatgttttttgtgttagttgttgatatctcattttcttgtccagtgaattatagcatttcaatgtgtccctcatgtcgtcaatataatgttttattttccttgttatgatccatatcttcatgtgtggtccatcttcaaataaagaatggattgttactactcttatcgtttgggctagtttttataattagacacaaaatttgtaactttcattctttttttagtatttaacacaaagtaatttgatggattagtctaaataataaaggcaaaaagttaagtaaatgtcaaaagagatatggcatatgtctaatcataaccaatgaattgcatggttctatctaaatagcaaccatatcatcccacatgccattgtccaccttgtctatcttaggaaaacactttgtttgtaactctattgtactctttgaattatgaaatctatgtaaacccttcttattgtgggggacaaaggctaattttaatggtctgtccacttctgcttgactttgatacataaattaggggtggctcatgtcatatctatgagaattaggtacaaaagagttttcaaatgagcaagttgtatttttattcgattagccgtcgtattatgtcaaatataagttaaaaatatgtaaaagtacaaaatgtagattatgatattagggatgaattgagataaaattacctataatttattactacgcataataaataatttgttacgttaattctcatagatacgttatagccaataccgaacccctatttaagtcaaaagtacttctaagtattttttagcgtaaatcaatttttatgaaaagcaacaattaagattaatgtagtaatctagtaatcgttaaaaaagccactttgttagtattgcttaatactctctctctctctctgttcccaaggagatgaaaagcttcaatctcaaaacatagcagctctctcaataaaccaaacccaaatgcaagctgtgtagagagaaacggagtgaggaaggaaggagatg

SEQ ID NO: 9259 - DNA, 3000 bp, Unknown
  misc_feature (1)..( 3000): cDNA_ID_3040971_gDNA_ID_1972047_Annot_ID_178249 3000 nt of promoter + ATG
attcactgcagatctatcagagagaagaatccacatatttccgaagacaagcttggcgacaacattaaactgcgtttggcgatcaggtgctcttgtccacaagaaggcgtttcaaacgctagttttctcgttacgtatccggtgggcgtccgcgacagcgtttcaagcctggcggttaggtttaacacaacagaggatgccattgtctctgcaaacaacaaatctggtgtggttccactcaagcctgctctcatccctcttgatcacaaaccagagaaacaaggatcccggaaaagaaatccatccaagaagaaacggtcaaagatgaagctcatgatcgctgtgagcagcgcgattgctggagtttgcggtcttgtcactctcatggtgtttggttacttacactggaagaaagagacgcagattcaaacgcaaacgcaaaagtggattagcaacaaagaccccgagacgcggcagctgagtctgagcatccgaaccacgagtgacaagaaaatctcgtttgaagggtcgcaggacggttccatcttggattctcacaacaccgtcggcaccacaacgccccgaaaacccgttctggagatttacgcgtttgaagagttagagaaggccacggagaatttcagttcaagcaatcacatcaaaggttcggtttatttcggttcgctcaaaggcaaagacttggctataaagcaagtcaatgcagatgaaatgaaaagattcgatttcgggcttctcaatgatcagtcacactactataaccacaatgtgattagggttcttggaacatgttttagagaaatcgatcaagattcttatctggttttcgagtatgcaaggaatgggtccctgtgggattggattcagaacaaattggccatcaagaatcaattcatcgagtcttgttactgtttcttggcatggaaacagaggatcaagatatgtcacgatgtcgccatcgcgttaaagtatatgcatcggatcaactacgtccacggcaacatcaagagcagaaacatcttcttgaacgaagatctcagaggtaaagtcggaaactttgggatgtcaaagtgcgtaaccaatgaattagccacagaagagaaccttatagagagttcactgtctccagcttctgacatatttgcttacgggataatcgtaatggaggttttgtctggacaaaccccagatatgttgcttggattgcaagaagtagagacaacatcccttgggacacaagaaacttttgtttccgaatggagtagattaagaaggcttctcggggacaaggaaaagctgagggaagtgatggacagcacattgggagagagctattcggttgattctgcgtttgaaatcgcaagtattgcaagagattgtactgcagaagaagccgagtcaaggccgagcgcggttgagattgcagagagggtttcaagattggtggatgacgatgaagatgaagaagatgaggcagtaatagatagagagagtaccttaatttcagagagttcatacaagcctttggtaaagaagagtagtataatagattaaaaatgatatttgtaactaatgaatatgttattgcatcatggccctaaactcatcaaagttgataattccatccctattaatatcgaattgggaaatcataacctcgcagtccttgagacttttggactcacccaacaaactaagcatcctcttcaaactttttggtgtgatgccttcactctcttcatacaacttgaaagcttccttcaaatccttctccttgtctgcctcctctccttcttccaccaacttcacgaagtcctcgagctccaacgatttatcatcagtcgactcctctggatttggatttgtagtatcttcttgatcaactactgcacgtttgccagacttaatagcgtcgacgcatctttcgattgtagaaacagataccttgccttggtggctcttgtcaaagcagctaaagactcgttgatactcatcacgtttgttaacgttctcactcttcatagaagatcgatgaagaagacttgagcgagagataggagaaaatgattatagtttgaagactattacttgttcagtttggcaaaatatatagaagatgaaggagagacgtttgaaaaacgttgaaatataagaccgtacttttaacacatgcggattgtggacttgttgatttgtttacggcgctacgtacaaaagaagaaacgctttgttcccgcggcttctatgttgacaagtttctatttctgtttttattatgaacaacaagtaaagttcatcgttatttcgttactaaaatattatatgacgacgaagtttccgttgacgttgactagtcttctataaaaagaaacttgtcaggcttcatgtgaataagtatctttactttttatttatttctttgggtggttaacaatggttgacaatttcggtcgttgaatataattaggtgggccaagtctgggctaagagacgtttgggccttattaaacgtgtttcagtgttgtccattcaattctcactcaaataattatctgagcgacaaataggaagcggacatgtgggcagtggcaatttcgtggattcgtgagtaaaggagtggcaatcaattaaaaaagaaagaaagaaaagagagagtgtcagctgtcccataaacctcggccctccgtctccgttcaaacccctctctttaagctctctctctttctgtggctattctctttctctctttctctctgaatccgccgccacgccttcaccatggcctggcttagccgcgtgagaggagtttcgccggtgacaaggctcgcagcgattcgtcgatcttttggatcagcggccgcgttggagtttgactacgactccgatgacgagtacttgtacggagatgatcgccgcctcgcggaaccgaggcttgggttggatggatcggggccggatagaggagtgcagtgggtgcttatg

SEQ ID NO: 9260 - DNA, 3000 bp, Unknown
  misc_feature (1)..( 3000): cDNA_ID_3040952_gDNA_ID_1972047_Annot_ID_178259 3000 nt of promoter + ATG
tgtaaaacgtttttccgtcaaatatgatttaaaaaaaaaaaaaaattgttactaacggctagtttacccccaaaaaaaaatgattttactaacggaggagaagtgtttcgaaaattcgacaatgattaagaagaaagttagatcaaacgaacaggatcacaggaagaaggtacaacgtgaagcaatcaatgaggctaaaataaaatattgagaaatttgctcaaccatatgatttcattaatatataataatgaataacagttctatcatataaataaataatttataatccaccacatgacaacagatgggttttcccattttatttaactataaacagtattttgctctcacagatccacaaggacaagcatattcaaggatgttttagttcttaaagaaaagataaagagagaccagacgcatagtggtaacttggtctacaagttagagtggccaagccggagaaggacacggtgccacgaagtgttgagaacccctcttaggttccacaccgactccacattttccggttgaacattcgccgccgaatcaacctgcacatttccacagttttctattaactcttgtcagaagccatttatattagctgagcaagatgttgaggctttaccgctttggcgatgacctctgtagtctgtgaaacatcaatggtggcttcaaacaacacccatgcccatttgtcactggagctgtgttctgagatgtactgctttcctggttcctgcgttctagaagcttccacccagtttttgcctccatccagggatatgtccactctttctatcccgcgtccacctcctgaaaccgcatatcctttgatacttacctgcaattttttttttttaattgaattagctcttgctttcctacattggtcagatcagattaggtagtgaattccgcgttctaacctttccaggcttcaccatttgcacatcctccacagagcagattgcactctgttaacaatgataaacgagtatggggtcaagactcaagacaaactaatgttcatttacaaattctactatctgatcaaattcataaggcaactggtccaaacaagtaaaattttcagtataccagtagaaaatatgatcagtcgattcatcaccatcatcaactgttttcatggaagaatacagaattacgaacttcgcaagaaaattggaaaatcttaattttgtagcgcatataaacgaaaaacgtcattacaaagtcaagtattctgtaagaaagaagggaaagttgtatttacctgaacagggaaatccatttgcggtctcctagaggaccagttgatattatcccaattgacagagggtggaaacattttgtaatctttttgcatgaagaatccctacatcacattttgatccaagtcccttacaatgttagaacagtttctgattgctaaaaagagggtaaaagccggacactttagttgagacctggctttcttcagcgatgacattgatggaatcaagccatttgaccgaacgagcaccaatcacaccagggacaaccacccttaacggaaatccgtgatccctgttcagggtcttcacagaagaaacacgttttccaacaaataagcacatttccgagtactcactcatactcacatgtcaaacaagtgatgatttaaacacaagtgagactaatttaggagagcgatatcaaacctctccattcatctcataagcgagtagaacatccgcttcaggatttgtggcttgacttagagtgattgacgccttataagggcccccattttcctcctagagatatagaaagagcatagacttttcatgggaattcataacaaagcataaaaaggtggaatttattaatatatatctaccttacagcgatcaacactaacgaactcaacatgtctggctcctaaattggtagaagcagtcagctttggtatccccacaagctcaagaacatcggccagtttcgccccaccccagacagctgaaaggcaaattctttcaagacaagtatgtattgaaagcatgggaatgggagaaagagagacgaaccgttgccaatagcagaaacatcccatccaacacctctaacattcctaactttgctcatggcagtccttctgttaccggcacactgcattgaaacaaaagtgatgttaaattaaatgtggagaaaaactaaaggtagaagatttactcaaaggaagaatgaacctgaagagtagcagtaacattgtactttgggagggacctgcaattttgaggaggaaacaagagtggtgcttgatggagagatacaagatcaaagttggagaatgtaaagagaggcaaataaataaaggtacctgatgtctttgataaagagctttctcgggttctggatcaatccagtaagggtgacggagtagctggtttggcaaaagaaatagcagaaatgagcggaggaggcaaaattgaagatgaatgagagtgagagagagacctttgaaggtgatcaacaatggggatgggaccatgatttcgcttgtagaaaaggtcgacgggagtgacataagatgagactaaggccgagcggggaggctcggcgttgaaaggttcctgcggatcacccaaatttagatgccatgaagaaaaaggctatatcagactagtgactgattcgattggaaagagagaagaagaagaagaagaagcttaccttggcgttgaccttgagagaagggtgacgaggtggttcctgcgagtattccgaaggacctctaattccaggcattcttctttcgaggaggagataccgaggaaatgacgattgagtgctttcctttgtgacgtctctctcttcttcaaaggaaaactatggaacggcgtcgttttaggtttgcgtctcttaatttgtggataacagacagagcccaaattgagcccaaacaaaaacaaattgtgagagatggcggtggccaaacttcacggcggaggt

SEQ ID NO: 9261 - DNA, 3000 bp, Unknown
  misc_feature (1)..( 3000): cDNA_ID_3040948_gDNA_ID_1972047_Annot_ID_178266 3000 nt of promoter + ATG
tcacaatggttaagctgttctctcggaatgttctggttatgtctgagagaagaccaactcggtcttctgctgataattccagctctaaaccctgaaagtatgtttcatatgcacaatctgtcttgagtatatcagaaatcgatgcagaacagaatgtaatttgagccaagacagagaattttcacattcctaattggttacctccgatgctctcctctcaatggctgcttccagacattgtatgacacgttcttgctctgcttctgagtttatgggaagtccatccacatgacggatgtaaaattcctgcagcaaaacactcatattattgttagaagagagatcccaacagacggccgttgagtagttacctgataagcctccactggttctgtgctgaccatgccatggaacaccacatactgcatatcagtcaaagtacagactacgtcaaacacaagctttggtctatctttggacctcatggtaacaacggtataatccttctcaatgttcattagtgtgacactgggccttgacgccgatgtccttgctcttttgactccctcgtagtccctatcatcaaacatgatctgatgcaaccgtctctccctgtgtgtatcagaacaagagaagactgttttcgcagctcttgagccgctgtttgtcctcactacattgcacagcagctccttgatggtggaaaggcgaatcgggtcagtaatggcagaatgagttgaattgtccgtgacatgaataaccgctgcagctctggtgttgtgagtccatatctcagcgttcacaacgttgcagtgaaggtctgtgagaacagcagatacttcagacaagagaccgggtctgtcagttccagcgagctcaatggatgtgtattcgtcagtgggcattacaccaactgagcttctcaaaggtggaatgaaccacccagcgttgctctctatcctctgcgcaatgaattcaacaaacgttttacacaaagaaaaaaacctgttgaaaatgaaagaaaaaaagtgatgaaatacattagaaaccttttggatatagtcaaggacttgagtgtctctgatcttattgccatcttggtcgatgactttgaaaacgtccatgaaccaacctccatcggaagagatgtaagctttcttgatcacaagattcatatcagtgagcacttgtactacttccaatagagtcccatgtttgttcacactatcaaccttttatttagcaccacaaacaaacagggaactctgttttctcaaaatctctttgtttggtacagaaccacttgaacaatttgaagagacagatttatttacctgaataacagtggcatcgtcgcttgcgttgttgtctattacaactctgtatccaccatgaaacatacataaataaagatgaatgttttagcagctggaatctttacaagggtatagaggctcacaaacggagcatggagaaacagaggacctagaaaacaataaaagagtatggagagaaagagaaaaacctgggaggattcattctcctgatgagcttggcatattcatcatcatccatggttgtagtatgtatctccttggtgatttggctgcagcagaaacccagaagagtgtgagtcctccaatttctgaggaaaattcctaaaagagagagggagagggaagttgaaggaggataaaaatggtaggccaccggaaccgaaccttgttttcattagttgatcgagcacgtgccactaaagattcttagagatgacgtggcacgggcacagcaacttttagattctgttataattgttcgaatactaccaaaagtcgggtgaagatttggggtcaatttgatgatcataaaggggattatattctccttctcaagcaagatgtggtatttactagtataatagatcattcgttatcttgaggtagacctctccgtaacgttcacaggtgcatgaccaagtaacaatttgattcctttccagcataacgtcatgttggttgcaaaaagaaggcaaagtagagcaagcaagcaagcaaagcatttttcttattttatattttgttgcggattccaccacccacttgaaaaattgacatgtcacaatgatttcgtatcctagtcttttattatttaacactctcacaatcccattactctacacctctttcattaagtcaacacacggttttcaaaaatccactaccctcccaccacctagaatcttttgttacctaccaacaccctcctttgttctctttatatattggtccaactaaatcaataagggaaagcatccttttggttggaggaattgctttcattctcactctttgtgtgttgatcaatggactagctaataacaagttcctcctctatatatttcaaaagaatggaacagaaacataaacgaaagacagagtacctgatgttgatgattcattgtctgtctggagctcccaaatgccttttatgcttacatattcataaccaacaacggctattaattataaaccaaaaacacgaaataagtttgtagcaaagtgaaattaggaatcttggagatggatccattagtagtaggataataggatatgatggaatttggttggggaacagtgataacttacgcttgcttccggcgccgggaaagttggaaaacctacaaagtacagaaatggatctgggccttgaagtgggctttttattaaagaaaaaaatacatctccgttatcaatcaccatcttcttctatctacaaattaaagaaggtaacaacagaacgtggtggatcatgtggttaggcattaattatttgctttgtttcgccgttttggtaacacacagacacagttccggtaagagcttttgcagccactctttatagttatttagaattggcgatcgaatcaatctcactccctccctcccttaagtcttgttgaatctgctgaattgttttataaagagttactttggcaaaatg

SEQ ID NO: 9262 - DNA, 3000 bp, Unknown
  misc_feature (1)..( 3000): cDNA_ID_2027099_gDNA_ID_1972047_Annot_ID_178265 3000 nt of promoter + ATG
gagggaagttgaaggaggataaaaatggtaggccaccggaaccgaaccttgttttcattagttgatcgagcacgtgccactaaagattcttagagatgacgtggcacgggcacagcaacttttagattctgttataattgttcgaatactaccaaaagtcgggtgaagatttggggtcaatttgatgatcataaaggggattatattctccttctcaagcaagatgtggtatttactagtataatagatcattcgttatcttgaggtagacctctccgtaacgttcacaggtgcatgaccaagtaacaatttgattcctttccagcataacgtcatgttggttgcaaaaagaaggcaaagtagagcaagcaagcaagcaaagcatttttcttattttatattttgttgcggattccaccacccacttgaaaaattgacatgtcacaatgatttcgtatcctagtcttttattatttaacactctcacaatcccattactctacacctctttcattaagtcaacacacggttttcaaaaatccactaccctcccaccacctagaatcttttgttacctaccaacaccctcctttgttctctttatatattggtccaactaaatcaataagggaaagcatccttttggttggaggaattgctttcattctcactctttgtgtgttgatcaatggactagctaataacaagttcctcctctatatatttcaaaagaatggaacagaaacataaacgaaagacagagtacctgatgttgatgattcattgtctgtctggagctcccaaatgccttttatgcttacatattcataaccaacaacggctattaattataaaccaaaaacacgaaataagtttgtagcaaagtgaaattaggaatcttggagatggatccattagtagtaggataataggatatgatggaatttggttggggaacagtgataacttacgcttgcttccggcgccgggaaagttggaaaacctacaaagtacagaaatggatctgggccttgaagtgggctttttattaaagaaaaaaatacatctccgttatcaatcaccatcttcttctatctacaaattaaagaaggtaacaacagaacgtggtggatcatgtggttaggcattaattatttgctttgtttcgccgttttggtaacacacagacacagttccggtaagagcttttgcagccactctttatagttatttagaattggcgatcgaatcaatctcactccctccctcccttaagtcttgttgaatctgctgaattgttttataaagagttactttggcaaaatggaaaatccggcgaagagagtgttgatgacatccaacggcgacgaggtgtcccgaaacatcgctttccatctagccaaacacggttgcaagtgagtctctcattttgtcttctttcctcctatcctgtgtttcttcttctagccccgatttgtgttgtggttgactttggtgtctatagttaaccttcaaaaaatgcaatgtactgttgctaggttggtaatgatgggaaatgagggttccctaaggagcattgtagacaagattagagattccattgagggagccttccctgccgatgttatagcactcgacatggaatctgactctgaagttgcttttcatgccgctgtccaaaaggcatgggaactttccggccatttcgatgcttttctcaactcttatacctaccaaggtttaatttgcttcttgtttttcactaccctgcctttgatgctcttgtgtgttgatcattcctttattcaacaatctttctttcttgcaggaaaggtgcaggacattcttcaagtctctcaagatgagttccacagaatcacaaagatcaatctcaccgctccatggtttctcttgaaggctgtagccacaaggatgaaggaccatggatcaggaggctccattgtcttcatggccactatcgccagcggagagagggcgctttaccctggcgctgatgcctacgcttcaacttctgccgctattcaccagctcgtccgggtatgcatcctagctcctaattagacacatcgcgttcgtaacttgaatatgtttgttgatgattgggtttcaggcatcagccatgagtctcgggaagcacaagatacgggtcaacatgatctctagagggctgcatctggatgatgagtatacagcttctgtgggaagagaccgagcgcagaagctggtcaaggacgctgcacccctcggccagtggctcaacccggacacagacctctactccactgttatctacttgatcagcgatggctcacgcttcatgacaggcaccactgtcttggtggatggagcgcagtcccttacgcgaccccgtctcaaatcctacatgtgatcaatgcctagtattattataattctatgttgtgtgtaaaaagtgaatatgaatcaagtttgaataactatggagggatgaataatccatggaatcaatgattatatacttttgacaagtatagaagaaagcaaagagccaaaatagtcaacaatctcaacatcattcgagctcattgtttattgaattcaatcaagtttggtaggtgaacctcaaatacacgtgatattggatattatcttggaaaccttgctaatccaaattgtaaatcaaataagaaaagaatgattacctcagagatctagatgcatattgattcttgaccaagaaatatgtttgaaatttgaatccattgaaccaaaatttgaaggagttgcatatataataatataaatcagaatgatgtagccgccacacctttttgtttccacaaaactctttttctgtgatggatccgctaatgtagccatattttcaatatatatcactttctctggcatcttcgctaccgtgtacgtctctctttctctccctcccctccttggcttttttcaagttcccaccataaacgcagagggagttaagaaatg

SEQ ID NO: 9263 - DNA, 1045 bp, Unknown
  misc_feature (1)..( 1045): cDNA_ID_3040944_gDNA_ID_1972047_Annot_ID_178270 3000 nt of promoter + ATG
ttctcttgactattctccataatgcccacatatgacattaaggcccatgggcgtttttctaatgacccattaaagcccttgtctctcaattcatacaaaccaactgcctcttgttgttcccgcgctgtttaaatactaactatatacatatcgccatgaatcattattaccttcactatttaattcatgcaataatcactatataaaataaaattttgctactttcctttttttcgtctctcgactttaccgtcaaagtttgttagatctcatcattgacattggacgtccattatctatttgagtatttctgatatcgattgtttattcctctagtgaatgtaattgcataaggaaacactaaatgtggaaattgttgacaatacacctgatgccacgtattatgcagtttgtatattattgctaatttaatcaaacaaaatatgtatatctatgagtaggtggccacgttttttcgatttaccatttgctaacaccccctcaacctcctaagggttcactaatggaatttgtagatgtcacgttttccaaccaaaaaaaaacaaaactttagttaaaacgactagtatatatgtgctaaaccaggagtttgaattattattaagcagattcatattttggaaaagaacactgaagtcgaatgatcgttcgattctttcctttgcctataaacatttaacatccgagaccgagttcactccgcagccgtctaatctttttagcttgggatcttgaccgtctacgatactcgtcttgatacatagctcggagcttgtccggctttgtatcaagcaatcgtgagccctgtcaactggtatataagccaattctcaatctcctctctgcaagatccatttttttatttattcatgcatttagccttgactctgttttgcttctacggatcttcgtttcaggtgtgcgcactaagcaagcatactctattatttgtcgaaatcacaagagccagccagtctctctgagttctatcacaatcttcttcttcagagcttattgagtaatg

SEQ ID NO: 9264 - DNA, 3000 bp, Unknown
  misc_feature (1)..( 3000): cDNA_ID_2123597_gDNA_ID_1972047_Annot_ID_178267 3000 nt of promoter + ATG
aaagtgatatatattgaaaatatggctacattagcggatccatcacagaaaaagagttttgtggaaacaaaaaggtgtggcggctacatcattctgatttatattattatatatgcaactccttcaaattttggttcaatggattcaaatttcaaacatatttcttggtcaagaatcaatatgcatctagatctctgaggtaatcattcttttcttatttgatttacaatttggattagcaaggtttccaagataatatccaatatcacgtgtatttgaggttcacctaccaaacttgattgaattcaataaacaatgagctcgaatgatgttgagattgttgactattttggctctttgctttcttctatacttgtcaaaagtatataatcattgattccatggattattcatccctccatagttattcaaacttgattcatattcactttttacacacaacatagaattataataatactaggcattgatcacatgtaggatttgagacggggtcgcgtaagggactgcgctccatccaccaagacagtggtgcctgtcatgaagcgtgagccatcgctgatcaagtagataacagtggagtagaggtctgtgtccgggttgagccactggccgaggggtgcagcgtccttgaccagcttctgcgctcggtctcttcccacagaagctgtatactcatcatccagatgcagccctctagagatcatgttgacccgtatcttgtgcttcccgagactcatggctgatgcctgaaacccaatcatcaacaaacatattcaagttacgaacgcgatgtgtctaattaggagctaggatgcatacccggacgagctggtgaatagcggcagaagttgaagcgtaggcatcagcgccagggtaaagcgccctctctccgctggcgatagtggccatgaagacaatggagcctcctgatccatggtccttcatccttgtggctacagccttcaagagaaaccatggagcggtgagattgatctttgtgattctgtggaactcatcttgagagacttgaagaatgtcctgcacctttcctgcaagaaagaaagattgttgaataaaggaatgatcaacacacaagagcatcaaaggcagggtagtgaaaaacaagaagcaaattaaaccttggtaggtataagagttgagaaaagcatcgaaatggccggaaagttcccatgccttttggacagcggcatgaaaagcaacttcagagtcagattccatgtcgagtgctataacatcggcagggaaggctccctcaatggaatctctaatcttgtctacaatgctccttagggaaccctcatttcccatcattaccaacctagcaacagtacattgcattttttgaaggttaactatagacaccaaagtcaaccacaacacaaatcggggctagaagaagaaacacaggataggaggaaagaagacaaaatgagagactcacttgcaaccgtgtttggctagatggaaagcgatgtttcgggacacctcgtcgccgttggatgtcatcaacactctcttcgccggattttccattttgccaaagtaactctttataaaacaattcagcagattcaacaagacttaagggagggagggagtgagattgattcgatcgccaattctaaataactataaagagtggctgcaaaagctcttaccggaactgtgtctgtgtgttaccaaaacggcgaaacaaagcaaataattaatgcctaaccacatgatccaccacgttctgttgttaccttctttaatttgtagatagaagaagatggtgattgataacggagatgtatttttttctttaataaaaagcccacttcaaggcccagatccatttctgtactttgtaggttttccaactttcccggcgccggaagcaagcgtaagttatcactgttccccaaccaaattccatcatatcctattatcctactactaatggatccatctccaagattcctaatttcactttgctacaaacttatttcgtgtttttggtttataattaatagccgttgttggttatgaatatgtaagcataaaaggcatttgggagctccagacagacaatgaatcatcaacatcaggtactctgtctttcgtttatgtttctgttccattcttttgaaatatatagaggaggaacttgttattagctagtccattgatcaacacacaaagagtgagaatgaaagcaattcctccaaccaaaaggatgctttcccttattgatttagttggaccaatatataaagagaacaaaggagggtgttggtaggtaacaaaagattctaggtggtgggagggtagtggatttttgaaaaccgtgtgttgacttaatgaaagaggtgtagagtaatgggattgtgagagtgttaaataataaaagactaggatacgaaatcattgtgacatgtcaatttttcaagtgggtggtggaatccgcaacaaaatataaaataagaaaaatgctttgcttgcttgcttgctctactttgccttctttttgcaaccaacatgacgttatgctggaaaggaatcaaattgttacttggtcatgcacctgtgaacgttacggagaggtctacctcaagataacgaatgatctattatactagtaaataccacatcttgcttgagaaggagaatataatcccctttatgatcatcaaattgaccccaaatcttcacccgacttttggtagtattcgaacaattataacagaatctaaaagttgctgtgcccgtgccacgtcatctctaagaatctttagtggcacgtgctcgatcaactaatgaaaacaaggttcggttccggtggcctaccatttttatcctccttcaacttccctctccctctctcttttaggaattttcctcagaaattggaggactcacactcttctgggtttctgctgcagccaaatcaccaaggagatacatactacaacc

SEQ ID NO: 9265 - DNA, 3000 bp, Unknown
  misc_feature (1)..( 3000): cDNA_ID_3040964_gDNA_ID_1972047_Annot_ID_178252 3000 nt of promoter + ATG
ttgttgaatacattacatgtttatagaatacaattgattttttacaaatataagttttcaatatctgacttttattaatacattaagtgactccatgcatgaatcttaattagctagaaatttaaaaatctaaatttgacacttacttttaattacaacaatgaataaactcttatagtatatattaacaattaattctcagtctctttttgaaatagactagatcctatagttacgtctaatatttgtctcaatcccctaaataaaggtttatagtaatacactaatttggggaaacttttataatactggacttttgattttattattttatcaagatttgtatataaatgtgttttccatacgtcagaaaataagaaagcacattaaccagttaactaaaatctgacgattaatactttccacatatcctccacatacatttcagtatttcacactaaaaggcatttcgacttttcatcggaggttccccctctttcccttgatcctttacaaataatgcaatgcatcataagcattacgagacaacattgttcgatcctttggaaaacaacaatcaaggacaaattaagaaacataatgtatagtaatttaatattatttaaagttttttttttctttctttttgtcttctttagcgttggacgtcaataggggcatgactagtcatcatattccgtcgccgatcagtgaagctactacaggaaaccaaacgcggaacgcagcgaccaagagcagctgatctcactctcttgaatttttgctgtctttctttgttgttattataaggagtggccggcgcagaagatctaacaggtgttcttatccagagacatgctcttgctttgccttctgccacgtaatcttcttcctcttcatcctcttcgtcttgtgtctctttaaagagttcgaggagcctcttcttgttatcggtaggagacgcttcttcttcttcttctccgtgtttgttctcctctccttggtgaggagtttggtcacagaatttgtgatgcaccggtgttgttcctcgcgacggcgtaaattctgtgttgtaaactcaaattctgtcaattcatttgttaaaattacaaaataagaagaaaaaagaagaagaaaaacaaacgtaccaccaccaacgctcatgaaatcatcatcgcagtcggaatcaagccacccccgtgaatcgaaaaatatcatatcctctttgttaccttaagacataatccaaatcattgttatctcatgtaacgtattgcaaataagaagatactaatattaaaatggtaggttatgtatgtgaatgtagtatacttttagttgcacacacctaaatatacggttgtaaatttctagcgataaaatttttaagagcatatgcatttattaacattaagataaataagcaaatggaagtagcaacttgaagtgtggtccatcacacatctctcgcaaagatatatgccttgaagacattctaacctatatcgtacgccaccgttgtccaccatgtgctgctaaatgctactgtagcagatatatagaagacccggttgcacattcacccatgtttatttatgatgcatgaccatgatccatttcatatgtaagtcataacaacttttttaatcaaatcttgacttaatatataagtatacgattttgtaattcatcagtactaaatacctcatttgtgcctacatcttgattgggtctgaaaaagctaaccactttacatttgtcggcactaaagcttacagtcatcaacaactttaattactatataaatacttctaccattcgttaattagacctttaattattgtttctagagacaaaacaaaaataaatcatataaaataaaataaaggccgatatgaactaaactaaacgcaaagaatagttatcgtaataataaacctgaatcccaacgaccggaatcgatgggagggttgccgttgatggtggaggaagtgatcatgacgtcagtcttgaggggcggtgtggagtctggtttagagatgaaagaggcaagcttcacgacggaatcagaggcggatgagctcttgctttgagaagaggagacacacgaacccatatgatgatgatgatgatgtgaaagagagagaattcctgtggtttaggagaagaagtgaagatatgggtttagagaatctaaaaggcatagagagatggaagacgaagaagcaaagatgagaggaaagagagagagtagctttggaatgggagggcttggaagtgaagtaaatggacgacccaaaaaggagcagtttccgatttggtatgtgtcttaattgtctcttcagtgaattcttatttaggttatggcttcttattggtcctcacaatcatattgtgggctcccctcctttaaaaataaataataatcaaatcttcctaattttctgattaattattagtcattttgatgatgttgttgtgtttcatgctctcaggtctcacaaatgtatgtcgcaatcgcatctaattggaaatatctagatttttttttttgaggttcagataaatattaagttaaatttcatcaagttttgtttagtatagattgaacttgaagggacatgacaaataaattccataattaaaggaagaaaaaagatcattagatcgttgacccacaaacaaaaaagaaagaaagaaaaagagacaattgggccaactgttttgggtggtatataaatgggtcgggtcgttgtagtaataagatccattaaaaaaagaagtcgtctctctcaaattgcaaaatcacccccacaccaaaagacaaaattaccctgcgatttaattattatgaatttatgacggtacctccacgtcaacataatggctgatgccacgtcatcacgcatgttgagatttggtggagagatccggggttcttagaggtatccaactatccatccatcatcggtcagtccccaaagtcggcggaagaagatg

SEQ ID NO: 9266 - DNA, 3000 bp, Unknown
  misc_feature (1)..( 3000): cDNA_ID_2034525_gDNA_ID_1972047_Annot_ID_178248 3000 nt of promoter + ATG
ggcaaaaaatcaagtatgttgtttattcctcatttccatttatcaatcactcgctcgtgaatcttattaacatgatttgtagacttttcaagtagagggattgatagattcttcttgtactagttgtagttggtatcaaaagagtttcttttttcttttgttttttgttgtatgaacaacggcatttctgccttcttcttcagaggacgattcaggaacagggatggtcgacgcagctccagatatcggacctaccgtgaaagcagcagcctcttctcaaatggaggcagccattgatgcattgtcccgggatttaactaaattaagaaccggaagagccgctccaggtacttctcacctctttctttcgggtttaggttaagcctctctgtgtctgtgcttattgtgtgcatttgcaggaatgcttgatcatattgttgttgaaacgggaggagtaaagatgccactcaatcacttagctttggtctctgtcttggatcctaagactctctctgtcaatccttatgatcccgatgtatactgattctttctttctcttttactaagaaaaacttcgactacattagagtgtcatttttctccaacaagccgccattgacgctttgtttgtctctgcagacggtcaaagaacttgagaaagcaatagtcgcgtcgccattaggattaaacccgaaactggatgggcaacgactggtcgcatctatcccagcgtatgaaagttcttctctgtcaaatttcattgtttatcacagccgtaattgactgactttgtctgatttccgctctatgtttttatttcgtgagcagattgaccaaggagcatatacaggtaaagcatccaagtcatgtgttattgtttagtcactgaggttgagccttgaccctatctatctatatgaactccaggcaatgtgcaagattgttacaaagtccagtgaagttgtcaaacaaagcataagaagagcgaggcaaaaggtagtatgaatggtgtagagcacaaccatagaagctgtttgttgtaaactctctcctacacgtcagaacatctaatgatcagagacttttttttttggtcaggcactggacacgataaagaaagcaggctcgagtctaccaaaggatgaagtaaaaagactggagaaggaagtgagtgtcattgtatgatctttctgcaaatatgcatcctacttcagttactgaaaataatggcctttgtgtgaacaggtagatgagttgacgaagaaatttgtgaagtcagcagaggacatgtgcaagtccaaagagaaagagatcaccgaagcctgattcatcattcctatacatcactagtcttttcacgctaccttgaaagaatcttttattcattaccaagatttgttttcaacttttgaatgtttgatttggggatcttggaactgcaagaaaattgatgatgaatagcgatggaaggcccttcaaagggcccaagaaaggccttgaaagaattccaataattatgatgttatttttcgagtttcatatatagtagtactaattggcttttgtagttgaagagaagtttccaaacttgaaaaccaaggcaaggggggaagaggtaggagatgagtcaattagtttaccaataatttgacatgatagtgaaattgatgtgtttggtaaatttgttacaaccccattaatctaatctttttttttgtacttgttgcaaagaataattcaatgatatttcttaaagaggaaatttctatatacatataaacgataagcttatctcagcattccaaattgatagtgcgctttcaaacatattataaaatttcagacatagtttactctaaactcggtccatctctgcaacaaaattaaaaataaaaccgtcctcaccaaccacaaatcttatatttaaaattgaatgcatttaatttttaaaattgatcactaacaaagaaatgtaggtaatataacaagctgtataatttgtcggcaaaaagatataacaaagaaaaacatgtacatatacatttatctaaaatgttgagcaataacaatattgaagacgcaataacgataccatttaatctttgcccactcgcattggtgacggagactaaggcaaaatctatcgaaagtggtgaccattaaaaagcgcgtcggtgttcactttttttagtcagggaccaggagatcaccgtaacgtcgccgtttcgatatttgcacgatcaaactcctttttttattcttttttggtcatcttttttttctttcttttctttatggcatcataattttttttagtcgtaatctatagaggagactaaagattcttcattctgtgtcagtggctcacatcctctgattaactaaaacgcacacaaacaagaaaaaaagctatgaaaacaggaaaaaaaataggaaatatcagtcttgtctaaaacgacgaagaagaagaggaagaatcgagacaaacatttcacattcccagagattgtggtgtcgttgggtattcattctctctctctctcacattactttgacgagttcttagtgtgttggttctccaaatgctctgcatattacattaaatctctctctgcttttttttgggctataatatatgttgggttttcttcaacttgcttggatctgttgtaataagcgagttagctcaaaatctctttcttaatgaatgagctttcaaagttagctgttttttcctcttcttcttctttatcttggatcttgatcaatcgaatcagtaatgtgtttggaatagaattagttacatacatttacctttctggttcatgcattgtcttagcatttgacggtttcgctgtttcagattaaaagttgaattcttagggtttagacaaagctttccctgttttgttacttaaatgtttgctttgcattcggatgatgcttgtgcaggtacttacttcttagggtgattcaggacttgctaattataggcaaaaa

SEQ ID NO: 9267 - DNA, 3000 bp, Unknown
  misc_feature (1)..( 3000): cDNA_ID_1989361_gDNA_ID_1972047_Annot_ID_178242 3000 nt of promoter + ATG
ttcatgggtttttggtcaccgaaacagattcagacacgtcaacatgttcgcaaagtgcactcattatccctcgttgacttctatttaaaactgacgagtaattattactatcaatattgggctctcgtatatggtatattatcgggcccaacccaaaacatatttgggccggattagaaactagtgagaaaaagggaatgttactatgttagtattattgttgactgttagagtttttttcgctccgcctctctgaaactcgccgctagtaagcttcttcttcacttgtgctcttcttcgacgtaagttttctctctttccttctcaaaggtttctctctcgattgacaatcctaagtttcctcgctcttgtggcaattttaattttatttttctggatttggctaaccctaatttcgtctggaaacaatgatattcaacgaaatggcgatttgtgatttaaaaagttgctctgtttttggtatctaaaatttgtgtaggagatgaaccgtattggattgataaggggatcatcatccaaggatgtagtccggagaacgtttgcagcagcagctagtaaagccaagaaaggtggcaaaggaggtggagccagcgatgctcctaaaggttccagcttgaccaaagagatcaaatccaccactgttgttggtgccaatactctcaaagacggatctgatcccaagatcttgcctgattctgattaccctgattggctctggcatctcctcgataagcgaccagctctcagtgagcttaggaggaagaacgtcgagactcttccctacgatgatctcaaacgttttgtcaagctcgacacacggggtaaaatcaaggagaacaactccatcaaggccaaaaactgagagatgtaagatgttttcaactctctcactgttgctgttttctttgtatgtgggaactatgcttgctaataagtagattcttccagttagattacatttccaaggcgttattatgctcttgtatgttctcagacactcttagtatatccaagaaattgctgcttcatcttttctctgcatgattctctttgaaaagttggaataggtttattcttacttgctctaagtatattctttcagttatcttacttttccgagtcagtaacattatgcccttgtaagttcttgatccttaagactctttattagtgaatccaagaaattgctgcttgtgtgagtgaaactcttggctcttgtttaatctaccgaatgatatgtccagcaagtgtgtaatacaaatccttctccggatagaggagatgagttggtcggttcttaaagacactgcaggtgtaactgatccatttaacaatcagatttattgtttactgtatgggacctggctcattgatattgcatcactattctgttggtggataccaactcttgttgtctatctctttgtggggtttgataccttcaaaagaaaggtaaagcaaatgttgcatcattatctcccctttgttcttccattattgctcttctttgctttgattgttacttgtctcctgtgatttgcccagttacaatttcatattgctttgtgttaatactagttaggataagtttcaatttaaatcggttttgatttaggtcttattggtctgatattatggcttttctctctctctctctatggtattgtatctgacaagtgctgctacttatttgctttatggttatatcctcccatgcccatgaaaggtttaagagtttgaaaaggagacaccactcatcacatgcttttgtgggtataacaaaaaataaagctaacttttttctctgctcacatgcttattttcctcttttgacaccttaacaatatcttgctttgtttttgtttcgttttttgcatgttccttcttaactatatgtactaaatgtatgatttagatatgttatggatataattatccaaatctgtggtcatgattgatagaggccacgagggcggacattttaaatcgctgatccgaatttgttcttatagtctctctactataatgtaatgggacataggttgggtgtagttgcccatccttatttgttgtctgaataaactcttacctatatttatttatttatatataagtgcaacggtactactatttccagaaagaaattttgatggttcatgtttccttctactcttttattttgctcttaagaggctttatcgacatataatataaattcaaacactgctgcaattctaacggatataaatcatccaataaaatctcagaaataaaaacgagtaacgaattttgagatttgcaagaatctcaaaagatgtcatattaaaaaattcttcgatatccaattaaagactcgattatacggacttgctttggagaatccacaccaacactcaattcgattacctcgaaaacaaaagtagttcaacttttgataccatctcaaataatactaaacaagttcttgatatacatttattcccgatgggtgaaaaaggccacttttctccatgtgtctctatcattactatcaagtatcaaccctttttcactttatagaattaggcatttctcacgatcagttcctccttccaattattattctgtaacttttgaagtcatttctactccctaatgttacgcgttaaacatttatttataaaaaaagatctaagattttttccaattattccttcaaatttggtatttaattcgtgtaatgaagacaccagatttttccaagtacggttacatatataaactggggagttttctttgtttaggctgattaaagagacccaagtgcctcctacgctattcttcattttctccggtgaccaatccttttctttttcttctcctctccgtccttaaatagttatataggagcaggcattgttccttgatcaccaagaaatcgctttgacccctatctccttcttctgcaactctttttcagttttcctcaacacaatttct

SEQ ID NO: 9268 - DNA, 3000 bp, Unknown; identical to SEQ ID NO: 9056
  misc_feature (1)..( 3000): cDNA_ID_2026743_gDNA_ID_1972047_Annot_ID_178244 3000 nt of promoter + ATG

SEQ ID NO: 9269 - DNA, 3000 bp, Unknown
  misc_feature (1)..( 3000): cDNA_ID_4370927_gDNA_ID_1972047_Annot_ID_178246 3000 nt of promoter + ATG
ccactgacacagaatgaagaatctttagtctcctctatagattacgactaaaaaaaattatgatgccataaagaaaagaaagaaaaaaaagatgaccaaaaaagaataaaaaaaggagtttgatcgtgcaaatatcgaaacggcgacgttacggtgatctcctggtccctgactaaaaaaagtgaacaccgacgcgctttttaatggtcaccactttcgatagattttgccttagtctccgtcaccaatgcgagtgggcaaagattaaatggtatcgttattgcgtcttcaatattgttattgctcaacattttagataaatgtatatgtacatgtttttctttgttatatctttttgccgacaaattatacagcttgttatattacctacatttctttgttagtgatcaattttaaaaattaaatgcattcaattttaaatataagatttgtggttggtgaggacggttttatttttaattttgttgcagagatggaccgagtttagagtaaactatgtctgaaattttataatatgtttgaaagcgcactatcaatttggaatgctgagataagcttatcgtttatatgtatatagaaatttcctctttaagaaatatcattgaattattctttgcaacaagtacaaaaaaaaagattagattaatggggttgtaacaaatttaccaaacacatcaatttcactatcatgtcaaattattggtaaactaattgactcatctcctacctcttccccccttgccttggttttcaagtttggaaacttctcttcaactacaaaagccaattagtactactatatatgaaactcgaaaaataacatcataattattggaattctttcaaggcctttcttgggccctttgaagggccttccatcgctattcatcatcaattttcttgcagttccaagatccccaaatcaaacattcaaaagttgaaaacaaatcttggtaatgaataaaagattctttcaaggtagcgtgaaaagactagtgatgtataggaatgatgaatcaggcttcggtgatctctttctctttggacttgcacatgtcctctgctgacttcacaaatttcttcgtcaactcatctacctgttcacacaaaggccattattttcagtaactgaagtaggatgcatatttgcagaaagatcatacaatgacactcacttccttctccagtctttttacttcatcctttggtagactcgagcctgctttctttatcgtgtccagtgcctgaccaaaaaaaaaagtctctgatcattagatgttctgacgtgtaggagagagtttacaacaaacagcttctatggttgtgctctacaccattcatactaccttttgcctcgctcttcttatgctttgtttgacaacttcactggactttgtaacaatcttgcacattgcctggagttcatatagatagatagggtcaaggctcaacctcagtgactaaacaataacacatgacttggatgctttacctgtatatgctccttggtcaatctgctcacgaaataaaaacatagagcggaaatcagacaaagtcagtcaattacggctgtgataaacaatgaaatttgacagagaagaactttcatacgctgggatagatgcgaccagtcgttgcccatccagtttcgggtttaatcctaatggcgacgcgactattgctttctcaagttctttgaccgtctgcagagacaaacaaagcgtcaatggcggcttgttggagaaaaatgacactctaatgtagtcgaagtttttcttagtaaaagagaaagaaagaatcagtatacatcgggatcataaggattgacagagagagtcttaggatccaagacagagaccaaagctaagtgattgagtggcatctttactcctcccgtttcaacaacaatatgatcaagcattcctgcaaatgcacacaataagcacagacacagagaggcttaacctaaacccgaaagaaagaggtgagaagtacctggagcggctcttccggttcttaatttagttaaatcccgggacaatgcatcaatggctgcctccatttgagaagaggctgctgctttcacggtaggtccgatatctggagctgcgtcgaccatccctgttcctgaatcgtcctctgaagaagaaggcagaaatgccgttgttcatacaacaaaaaacaaaagaaaaaagaaactcttttgataccaactacaactagtacaagaagaatctatcaatccctctacttgaaaagtctacaaatcatgttaataagattcacgagcgagtgattgataaatggaaatgaggaataaacaacatacttgattttttgccttttgcaaagcctcgacgagaatctctgaggaaatcgggcatggacaaatcgaattgcagatctcggcctcccatcatcatgagattgggtgaagaaatgaaggagaaatcacgagattgaacaacaacggagcttcttctgagaaacccaatcgcgttacgactagatagagctcgtctcacgaacatagccatcatccctaaagacttcaactttcttcttcttcttcttcttcttcttttctgaggtttaaggaggaagacacgcaagaaaaacaagtaccttttgattgattccgtgtatagagctaaaaccctcgacctcgaatcgacgactgaaatgtaataaaaaaaatttagtttccttcatatataaagtcatttccttttcttttaatgagaaaataccaaaatagccctccgccttctaaaaccctttgttatacagctccctcctagatcttcccatttccaccgccgctgtcacttccggcactgtctccggtaaccggtgagtcatctctctggtgattctggtcaattcgttgcagacttctccatacgaatctgtataactgaaatcacattctcagttttgttttttgttttttgtctaacaaacagctgaagaacgatg

SEQ ID NO: 9270 - DNA, 3000 bp, Unknown
  misc_feature (1)..( 3000): cDNA_ID_3044430_gDNA_ID_1972047_Annot_ID_178239 3000 nt of promoter + ATG
gcaacagtgagagagttgaaaacatcttacatctctcagtttttggccttgatggagttgttctccttgattttaccccgtgtgtcgagcttgacaaaacgtttgagatcatcgtagggaagagtctcgacgttcttcctcctaagctcactgagagctggtcgcttatcgaggagatgccagagccaatcagggtaatcagaatcaggcaagatcttgggatcagatccgtctttgagagtattggcaccaacaacagtggtggatttgatctctttggtcaagctggaacctttaggagcatcgctggctccacctcctttgccacctttcttggctttactagctgctgctgcaaacgttctccggactacatccttggatgatgatccccttatcaatccaatacggttcatctcctacacaaattttagataccaaaaacagagcaactttttaaatcacaaatcgccatttcgttgaatatcattgtttccagacgaaattagggttagccaaatccagaaaaataaaattaaaattgccacaagagcgaggaaacttaggattgtcaatcgagagagaaacctttgagaaggaaagagagaaaacttacgtcgaagaagagcacaagtgaagaagaagcttactagcggcgagtttcagagaggcggagcgaaaaaaactctaacagtcaacaataatactaacatagtaacattccctttttctcactagtttctaatccggcccaaatatgttttgggttgggcccgataatataccatatacgagagcccaatattgatagtaataattactcgtcagttttaaatagaagtcaacgagggataatgagtgcactttgcgaacatgttgacgtgtctgaatctgtttcggtgaccaaaaacccatgaatgttctgtcacagctgtgaataatagaaacagcgacatgtacttttgcatattcagacgaccaagtagaaattctttaacacaacttattattaacgggcgttgatctcgatcgttggatcatcacggtaatagaaaccgttgatatttgattaatcataagaaccaaaaggtgataaatttattatgaataatatacgtataactttttattcatcttttaccaaaaaaaaaacattttattcattatcaattaattttgagtttggaatctcatattttcaaaatagtattagaacgagttccgatttctcattttaggaccacaattagattttcattcccacgcaacttcgtgtttatatgttctgccctgatcgcaaaaagaaatgtaatgtttcagagtaatatgtagtatatgatcaatgctaatttgttttaatttagaaattaatctacgattcttaaatgtaaccaaacaataattatccaaacaataattttttgctaattaaagtctataatactatgagaataaaagacaacaaattaaatggggatagtgtactagtttcgtttatcagtacatcgcaaaatttatctgatcgttgtgaatactcgtagtcgaaggttagttggagatcagtatacacgagttgaacttgaaaacaaaacaaggaaataaattcaaaacaaagtaaagaagaagaaaaacacgtcttatattagaagacgaaagccaaggcactaatcaatgttgaggtgattaacagcgggcaagtggtgaaagtggcggcgtttggaggtggtagaagcgtcttgggttcaccaaagtgaccgccgtcagtaccagttggtgacggtgaaggagccatcggaggaggaggagtgagtgtctcgtcgttcccactataggaagacttagactcggccaccataatcaacgttgccaagacgagaacacatatcattaagctgaaagctctcattgctacaatatttgatctcctctctttcttttaatttctctttctgtatttttagttagttgatacagtcggatcatcgcaaaggaaatagtacttatatataaaggtcaacgagggagaatgattctaattcgagggaaatgtgattatacggtcttagatcttgttacgttagtggctaaccatctattttgagtaccataacgtgatgtccttcatcttttttggatcgacacagtaataaaagatatatatcaaaaaggcaaagcgataattacttataagttccaatccaagaacaagtgataattgatcttaaaccaaataataaaaaatgataattgatgaactgatctatgttgtctgtatattattattctacgtttctattagttcatgcgagattcccaacagaaaaaatggagtatactcctccgaaaagaagaaagacataatcaaaaagccatttatataccaaatgtatagtacctaatgacagaaataaatgtatattattgtattaaaaataaaatggatatatagaaaatttggattggtctaatactctatagtatgtttttttgtttgggtgcaaaatagactaatcatgtttagactaataattcttgtaagaaaattgttattgtatttgtttggttattaaaaaaaatatttgtgagaataaaaaaaaaaacacaggcaagtcgccgagttttggacgtatgtgtatgtaaaatggttgccggagtccatggcagccaaaacttgggcgattcaaagagagaatctttgatttattattcaaatgccaaagatctcaactttttttatttattaattagtcacaagtggcagttcttcgtggtcgccactacctaatcataaccatcgacaggtttatagagaagaactaggcaacgcatcgccatggatcaatcatcctccatgcattgactttttttagatcggaggaaaaaagtatgcaaatttagttagggttttgaaattcgaaaatcgagatgcggtgggatttgatcacggcgattgtggctgcgctggtggtctcggttttggctgatgaatcgggtcaaatg

SEQ ID NO: 9271 - DNA, 3000 bp, Unknown
  misc_feature (1)..( 3000): cDNA_ID_2181541_gDNA_ID_1972048_Annot_ID_178294 3000 nt of promoter + ATG
gctaagttctatttatacaatgaagacaaatctacagaaagtaaatgaatgctcgtatcacgccgcagatctcgcctcattaaatgggctcctgaagcccatctcatcctgaatgggtcgaacttgttattcacccgatctaggacatatcgacggattgcgggtcgggtcgaatagacgtgatccgacatccacaatttaccccccaagtctcaaaaatgaattcaattcggggacttagatcaatttcaacatactatcttgaagtaatgccgtaattttcaggatcctcaacaggcgcgtatatcctccgaagtagggaaaggaaacaaaatatcgcgattttcgagattattcttggaaagagtgtgacgctttgtgatcctaggattttcctttttctcgctcttctgacgctttatatatcgaggttaaactcttggcttctgatatatctctgttttcactgattttatctatgttttaggtataggatttcgagtctttatattatttcccgagtcgttttagtgtcttttcaggtattctatgcagtgggacaacaatggagatgagaagacattctggagcaaaagctaaggaaaggaagccaaggacgattttggattcaggaatcagcgaggactgtcgatcgacacactcttggtgtcgatcgacaccagtttcggcccagcaaagtccaagacgctttcaagtttagagaagaggaatttgccccagaagacttccgtatttgcattattagtccttggacgttttatagggtttatatacattgtttagacctatgttttcatcatccagttttctatcaagttcttataaagctttttgcaaaccctgttactgagagacataagctattcatcgattcttttcagagattgattcagatcttaatacagtgaagagatcccttctttcccttaatctatttgttgtgtttatgttttcatactcaatatgttgtttacttcaatcaatatgtctgagtaatctgcttgttaggaagagggtttctcattagggattcatatggtttagtagattgcccccttgctaggttatctgtagaattcttcatctttaattatgcttaatgctagatctagagtaattaactagatcttgaatccagacaatagatatgcccgccataggtatttgtagttggatctattatttgatgagcctggtttataggtgtgtaataagaatcggcctatctactaaggtgaacaatcgaactcgttaagaatgtatatttaggttgataatttctcggcttctccgattattcttagctatagatatagggagttttgcggaacgccaccggttattccataattagagtttgagttcaagaatggtttgataacaacctagctttcattagatctactaaccaatagtttcctgagaataccctgttcctagctctttatttaatcgtttacatcacaatcaacttgctgtctttttattttgttttcttactattttaatcatcacctgctagcttaatctcgacattcaactcactgtttgaacaaagaactccgtgaattcgatccttaaatactgcaattgatctcttatttgagagagtagttctaggtaatttgaaccttatcagcttcctaatatcgcttataacttgctggagctcattcaccgctaaaagtaaagcctcgattcttctctcttcctcttaaacttgtttcagttaaatcgtttagttcgttagaagatccagcatgtttattaagcttagaattgcttaggatttgaacaggctgttttaggacatgattccttatcggtttctcagattttcaactttgattttgaagaaattcatcgttttaaccaccggtttctctttcaccgcctgtaatccgtcatctgtcgtcgagcctaccggcgctctgaactgctaaccaccggattccggtgataatttattgagtgttcttcagattttgggaagatcttcaacatgttcttgagccaaaaacttcccagaccttcctcaccatccgcgacacgatttcgcagtgttaattatgcctccgagaaagattaaacccgaaagattctcgattaacggtcagtttgggaaatatatgacttccctaacgactccgggcaaacttaaccttttaaagggggcccactaaacttctccccaaatcaacctgttatcccccgaaccaaccgtttcaccgaatcactgcctcctggtcatacttgcgctttcgagattttcttcttggaatgcggactttactttctgctttcttattgattttatgcatgatttcaaaattgctctgccccagttatgtctgaatgtcatctgtaccattatgtgcttccttactttagccgaagaagacggcttcatgctgtcgctgcccgaccttcttcaactatacacagtgaagaagggtcacacaaatggaacctttctcctgtcaccctggaagggtttttgagtgtttgatgacttcccagaaaaggatgaacaatggaggaagtcttacttctttttccctgtgaatgaactcacgtacggcaagaagacagacttgtttgggtctgaatggacagctcgggccgatagataatgaacttaggatgccatttttcatttcgtcgtacccttttgcgattcatctcgcattctacgagctaaccacttctgttctcttacagttaaagtcgacaaacccccagtctcacacacattgtcgtcaagacttaggttaagaatctctcacgtcggacatgatcagagcatcaggtagacggcttcaatatcgtaccgatcttgctgccttaacttctcccttccaaccacaaattctttccaaagctgacatgtcttccatttcataacgcgaagagaagagattggaaagagagagggctaatcaggtgaaagctcaaattaaatccgacaaagtcgtgatg

SEQ ID NO: 9272 - DNA, 3000 bp, Unknown
  misc_feature (1)..( 3000): cDNA_ID_4282741_gDNA_ID_1972048_Annot_ID_178303 3000 nt of promoter + ATG
atcatcagcggttcaataacagtttcagaaactccattctctagcatcataggttcactaactgtctcacgctgttcctctagttcaataataggttcactaactgtctcacgctgttcctctagttcaataataagttcattagtactcagaattcctgtatttacatccgcaaccattacaacattggcagccaattccccataatttacaccgcatgaacttcttcgctctactattggaacttgcctattattactttccaaatcactgcataactctacatgcaaaacaggtctaaatccctctttatccaatgacgttaaatatatcaacacatcctcattatctacaatataagactctctccatgctttacatatcttgtaactcaatttcagattccttttctctccacctagagcaatctttctacagatcttatctattaaatccgcatatgttattctctccaaagatgatgtcttaaacactataccgtatattgaatttttgcaacttcactcatggtctgctgtatagtaccctccatagtcaaagtgtaggttcatctggatcctcttcttcatcgcctcctacaaatataaacactatattagtaccagttgaaccacgagatgtaccagtgtctgattcaatttcagttcgtccatccattgtattatgcaaatatggtttgattctgcttacacattgattcaattcaattacattgtactaactataatacttacaggagatggaagaactaaagaaggatcgtttccagagtagccgcagcaaagatcaataaagaattcgatccaatagtatcgactcacgtagcacgcagcaccggagaaatcgacggccggagaattggattagctgacctagcaaagtttccccagactcgacggagccaatgtcaaaaatcaccgatgttggaagttaatcggaaatcgcctatctcgtcggaattaaatgaattgggtcggaattaattgggttgggtcgggataatttcgatttcgatttggattttgtttttgatttttcttttaaaattaattgatataattcattaagggtaaataggtattatccactacaagagtggcatgcagatcaaaagatggcacgccggattcaaatttccagtttagtggcattgttgattaggactccttcaagttggaataggacggtcggagatcgccgtggtttttaccgtcgctgtcacaatcacagccagagccgcagtcactttgctcattcctttgcaaaaccctaaaaaaattattgggttgggcttttgattgtatgttgggttttttaattgtattgggcttttatattatttgtaatggtttattttagtagggtgaattacaaaaatgacggtttttgaaaaagttattaaatatatagcaccataatgtgtgtaattcatttgatagcacatgtcagttgtgaaaatacacccaactccttcccaacgatgcgcttggagagaaagagaagccacaggaggaaagagaaatatatatgagtaatatatattcacccctcttgattttgtttactttattagtttaacaatattacttggttaaagttaaagatactattgaaaaaacagattttttttttgtttatctaatatgatttgaattttaaaaatcggaaacgaatttcttaaaaaatgaatagtggtatcaaattctatacagatcatcatagaaagatagaatattatatatttgttcaaatagaaacgtttgttccgatgaatccaaataatcaattaaatactttttgatggaaggatactaaaccctaagataatatatagggaacccaagacttttaatataaaacactaatcaaatcacttaatatccttaatcaaaacaaacaattcattttaaaacatatatagtacaaggtatacgtaaatagtatacccaaaaagtacaacgacgccaataaattagagagacccaaaaaaagaaatcaaatgaaggaaacagaaaacagagattgatcaaattcagcgcttattagcgagaatctcgactaattcaatttcaaaaaataaaaccaaagtctcttaaaaaaaaccaaagactccaacaaaatctgaagtcttgcctgtgtaaatcaaaacctctaattcaatttcgagcaaaaccgaaatgtcatttccgaaaattaactgtcttgcttctgtgcccaatacacctctgttaatcgttggcaaaatcaaaagcttcataaacggtggactgaaatttattagagccaaacccatgttcaaaagttaatagttagtgaaagagaataattggttttctatggaagggagaagatgaagagcgtgtatttcaaacagggatagtattggcattattacagaaaatacaaacaatattggttacttttttttagagtgttagttacctaattataatatttttgtaggttataaatgtaaatttcccattttagtattttactagatttgtgtttgtaatagagtaattgtaatatgtaaaccaaaatgaaaaaatctataaaccaagaaaaatacaaaatccagttcatgttcagaacataaattttagctaataaccgatccgaattaaccgactaccgaactgatccgaaccgaattttaattcgagtctattcagtgaaattttcaaaaccctgaattttccttaaaccgaataacccgatccgaccaacccgatttagtcgaactcccgggcctactaacttttgtagcgtttaacggaacaaccggaccggttttagtaatttccctaattcaaattcactcttccctcagtttgaaatctctaaactggtaattccaatacagtcttttcttaaaatcgcactagcttaaaccagtagatcctaaaccgattcatttaaacaacaaaaaaccacttacagagttcgttcgccggcggcggcgagtcatcgtcatca

SEQ ID NO: 9273 - DNA, 3000 bp, Unknown
  misc_feature (1)..( 3000): cDNA_ID_2181575_gDNA_ID_1972048_Annot_ID_178304 3000 nt of promoter + ATG
tttttcataaacgctgtgttatgcccctgttatggtagaccctccatatacgatagcattttttccgtatgttatgatagaatattctaccatagcattagtaaaacgctttcatttattgacttataatagcgatatatataggctatgatctataatgtttataatgctataatattcagtgtcatgactctaattttatgcggttgttttaatctatttgcatttggtggaacatgtttagttttcaaaataaccaatacatatataataataaacatccaaaaagtatacaccatttcataaaccaaaaatcaattcatacataacacaagtctcaatccaacacttaaactaatatcctaacttctatatactacttttgccaatgaagttattgatgagatcatgcaaaatccttacttcgttttctagatattagactcggttcttcaagtaatttagctcagcttcataggttgttgtagtctcatcctttctcttaggttttcggaaaacattgctaccttttctcttaggttttccccaaagactgttgtcttcatctatctcactgtcctcaacgacgagattcataatatcttctgttagaacatgaaataaaacaagtaaaatttcggcttcttgaacacaaacttattaagtcacattattagtaaacaaatctttttactcacctgaaaactcaatttgggactgagacatatctttagcgtgagaagagactaattccatttcctttatacttttactttctccaagaaaagcaaacccaagaccatcacttgtatccatcatcggtgactcatagatataactcgaacaccattgacttagatcaggaacttctgagaattctgaaaacaaaaatgacaaaccacataagtgaaatcaatctagctaatcttgctaaccactaagaatcgacaaaatgaagtttcagaaaccaaaccaattaagcaagtttgatgctaccttgactatcacccatctctcaattctctatattcaaaagtcaagtctttttctctgtctctttggtcttaccaaaactcggtctcctagtagcttaattgaagctaagtatattgtcaatagtaaactgaaatagagaaaattataagtcattattagaaggaaaactattaatcatataaccaaatcattataaactcgatgtagaaatacaattaaagtagctaaacgtaatcatccatggaaacagattaaagaaatccaaagagagtaacaacaatttagagaatcatgagagaaagcaatgagaatttgtgaaatatattagcacgaaacaacataaagaacaaaacaaaatcttttttatgctacatatgctaacaaagagaccttgcttaatgacctaagatactacaatatccacggctgaatgcaatgtcgaaccatatacacaacataattcaacatgaggaagaacacttaagatgttatagataaagtatttgtaattaggtttatgaatcatagtgatttgagatataccacaaccttggagaagagagaaacgaacccagagaaagagatgttgagtcttttcttggtttttgtctcacagtcaattcgtcgaacaccttgtgtgcacaaaaacacttcaaaaacgttacccttttgagctgcaaattcaaaaaaagaggagagacaaaaccaacagaggagcgatacaaccaacaaacaaggattagaagctatagattcaaagggaaaagagagacaaaatcaacaaaccttttccatctgaaacgtgagaggatgagtgaaagaagagagaaaggaggagagaaaggtgaagaacaatgtagaatttgggatgtaagaagtggaattagagattttcaaagaagaaatttagggtttgaaggaatcaatttgggggatttttttttttcttaagatgtgtttagcgttttgtcgcttaatatttttagatctgagacataaggcgcttaagtgattttttcgcatatatattggcggaatagatgattttagctttccgcttagtgattttctatcatagtgtttatcaaacgctattacaaaataatcaaaataaaaattaatctttcatagcagtaacggaaaatgagttatcctcttgtgctatcaatgtatcctcttgtgctattaatgtggatatttgttgtagtgataacaagattaagacttcaatcttatgttgctagcagtcatcctcaatgattgtcggatcaatttgccaaagaaagcattgttgggcagcaaagaactttgtaaagagtgaggactgatagatgagatgacacaaagattgaggttggggagtcatctaaatatctatcaattgtgacagataatgaactgaagaaaaaaataatgaaagtttcaagaacatcagtttggggagttgagatacctccaaagaagagataatatcactctacaaatactgtcatccactttttggtatcacgtagtttcgacaaagcaggaaaaggttgtttcgttttttttctttaatccagtttttaggaatttgtgtgtgttaactttcaggtaaaagatgaagactagcctatgttgtagagtcttctaatgatccttggttattctcattgcgagctcattaatccttgaatgttcaagatgttatggtcgagcttcaagtaacttaggatacttttggttctgttgaagtagggattgtcagtactctgtttgataatccaaaacttgtaatagttagcaggctttaaaggttgtaggtggttgtacccacttttataatgtttggaatctctctgtttctaaacaaaaagaacactttgtgaaaaaaaattaaaaatagaatggtcctctgtacatgctggttcatgtatagatttcaactcacctttggaagtttacaaatgagacaattgaaattgaaatcgagagaaattaagttggtagaaagctgcaacaatg

SEQ ID NO: 9274 - DNA, 3000 bp, Unknown
  misc_feature (1)..( 3000): cDNA_ID_2181617_gDNA_ID_1972048_Annot_ID_178315 3000 nt of promoter + ATG
tcacataagttgaaactatactattaagttgtcttaagtgttttctagttgtccttatacactacttttaattttcgaacacaattttcagaaattaatgttacctcagatttttcttcttccccttctttatcctcttcttcagggttttcttccatcccctgaggctgcatttgttcctcgttatcaatttcctgaaaattcatacacaaccataaaattaatatttcgttgtactacttgtaccagttatcttagaacaacattattaacttttctcagaattcaattttctaatgcaaaccaatgtatgattgatcacgttaacgtataaatccatgcaccaatcaaataaacctatactattaacttgtactaattgttttctagttgtccatatacactactttcaaacacaattttcagaaattaatgttacctcagatttttcttcttccccttcttttttcctcttcttcagggctttcttccatcacctgaggttgcattggttcctcatcattaattttctgaaaattcatacacaaccataaaattaatatttcgctgtactacttgtactagttatctcagaacaacattatcaactttttcagaagtcaattttctaatgcaaaccaatgtatgattgatcatgttaacgtatatccatgcaccaatcacacaaaactatactattaaattgtactaattattttatagttgtccctatacactatatcaatattcacataaaattttcagatatttgtatatacctcagatttttcttcttccggttcgttaaggttttccggatgctcttcgtcacagttttcgtcttccactttgttttcctctaccacttcttctcggttcacatccacttcacggatcgtgaccctctcatcttcactctcactcgaagtaggactgactaactttgcacgaaccataattcccttgcaaaccacacaacaatcaaagaaaccgttcaaatcaacacaacaaaaaccacatctaatatttcaaataaaaaaccgttcactttataaactaataagatacttacaagagtatagcggtaacggcggctaaacgacggcggtttggaacgacggcggtgacgaacatcggcggtttggaacgacggcagtgacaaacgtcggcggtttggaacagcagcggtaacgacttagcaaaatcatttggtgaagaagtagagatgaaaccggtgacggtgaactaatcggagaagagaaaacgacaaaattttccaagaatcgccggaataatcgccgtttaagttaatcggagaagagaaagcgacaatattgattttcgaaaaatattagttaggttaaaagttttgatttgggggaaaacctagtgacaatgggtcggatcctggagctatccttggatttgtggttggatcctgtagttttcctaacttaacaaggttatttcgtaatatccctctgcttctctatttaaaaaaaattcaaaacgaaaatcaattttgagattggcaaaatgaaaatttttcccgcagatgatggcagaatagataaaaatccgcatgtacacattaaaaccatttatttaagtaactttttttcaactaaaatctatatgacaaatatatccctataaaaaaatatgataaaaatcaggataattagcagataactgcattattgaaataatatcattaacaaatatagatggagtttgatgtatggatgaaatgatataacgtacaaaccaacttaatatgttaataatatatttgacgatataaacaaattctcagttattaaaccaatgattagatttcaaagactgatatatatgcaaaaaacattatatctactctattatttgagacgtatgttaagtgattctcagttaaaaaaaaatttaccttaaaatcatatgtttaaaatgttaatgtcatgaaaaaaattacctttaactgagaatcacttaacttccgttataatctttgccattcgattgaattgtttgtgtctgttcgatctctcgccttcactttaaaaacacgcggaaccttttgacccaggtttacaatttttgggtcatacgttataatcttggccattcgattgaagtgcttgtgtccgttcgatctctcgccttcacttaaaaaacaagcggatccttttgacccgggtttacaacttttgggttatacgttataatcttggccattcaattaaattgtttttatccgttcgatttcgcggcttcgcttaaaaaaacacgcggatcattttacccggtttgaaactaatgggtattcgcctctaatcttggccattgaattgaattgtttgtatccgttcgattacgtatttcccaaaaaaaaacacgcgcttctttttatcctgttttaaaaaaatgggattctccttttaatcctcgccgttgaatagatttatttcaagctgtccgattttgtagtttcatgcataaattcttccgactatatttcaggaaactaatcgtattaatttcattcaatatcttgcgtatcttcgttaacaattaagtatatatcacttctccataattatccatgaaacagtatttcgtgtggatcttctttgagaattatcttacattttctccataattatagcacatataatatttcgtttggatcttcttttggaattatcttacattttctccataattatagcacatctaatatttctttgcgatcttcttttggaattattttacatttctccataatcctatattcatacctacttttacggaaaatgataaatattttcctataatttactgatttttgatatggaataaacttgaattccaaggataatatcttttgcgcatatttttttgacctaaccactcattcttataaatatcggacgcctcatttcaatctactcactcagcttacactcacacagtttcattttcaatttcatttttttaaaa

SEQ ID NO: 9275 - DNA, 3000 bp, Unknown
  misc_feature (1)..( 3000): cDNA_ID_2181594_gDNA_ID_1972048_Annot_ID_178310 3000 nt of promoter + ATG
tatgaaagagtttctggacagatgatcaatttagatatatctgcaattacctttggagtaaaagtggaacaagagatgaaagagtggatcaagcgaagatctgggattcatttagaaggtggaacaggtcgttatttggggctaccagagtgcctcagtggatctaagcaccaattgtttggttttatcaaagacaagttacaggaccggatgtcaggatggtatgcaaaatctttatctcaaggtggcaaggaggttttgttgaaatcgattgcaatggctctactagggctatgacgcgttttaagttgcatgttagtctctacaaagatcttacaagtattatgatggattatttgtggaacaatttgcaaaatacaaagaaaattcattgggtaagttggcagaagcttacaatgcctaacttactaggagggtttggttttaaagatcttcaattttttaatcaagctctcttagctaagcaagtgataataggtttttaagatcaattaatcctaaagcactatcatgtcgttgtagtactgaaggttgtcaatccaaatgagtgtgatgctagcaatcaagatgcaatcagagttcacagagtcaagtcaagcaagaacaggttttggggtgttctagcagtcctaagtgaacatgcaggaaacagaaattcaagcagacaattaaaacacttgaccaacacagcttgttgccaagcactgggtgtggtcgagtaacagacagaaaatgtaacagagatactcgactgcagggaaaaggggattttcatacccgtaccttttttggagtgtattttcatacctaaacaaatttgtcgggtattttcatacctaaaccgtatatttatttgaatttcatacctcaacttaagaaaaagtataaaattcaaagtcaaactaacgggtgtttgtcaacttcgtgaaaacgatgagtcaacggacacgtggattatgacgtgtctaaaacgacgttgttttgcataatagacgttaaaatgataaaaaaaaaagaaaaaaaaaaaacttgcaacagacgggaatcgaacccacgccctaagagcatcgttactgattaccaaaccattttaaccaacaatatttattggttatacgtcaaacgtttaaatatataacggtaatgattttgtgttttctcattaataaaacgaagtcgttttgaattgggggaaatgaatcaaattttagtgtttctaattgaaatcaaattatagaatgtgaaaaatcgatttcaatttgaaaaattctaaaatgtagaatgttaaaaaatttagaatgtaaaatctttctaaactgaaactgaataaattttataatagttttgtattttctcattaataaaacgaaaacgttttgaattgagggaaatgaataaacttagggtttgtatttgaaattgatttttcatattctagaatttcaattacaaaccataaaatttaattcattcctcctaatacaaaataatttttattaatgagaaaacacaaaataattacccttatattttaaaacgtttgggatataaccaatgaaaatggagatggaatgtttagacactccgttaaaagacattgaggatgcaagttcgacacctttgttttgcaaacaatttaacacaaaactgttatccttatatattgaaacgtttgagttataaccaataaagtttgttggtaaaaatggttagattctccgggtaaaggtttaaacgacgtgggttcaattcccgtctgtttcaaattttttatcatttataaacgtctgttatgcaaaacgacgtcgttctagacatgtcataattcacatgtccgctgactcagcatctttacggatttgactaacacccgttagtttgactttgaattttgcactttttcttaagttgaggtatgaaattcaaataaatatacagtttaggtatgaaaataccttacaaatttgtttaggtatgaaaatacactctgaataaaagtatgagtatgaaaatcccgttttcccctcgactgcacagtctgttgtcagaaaactgggtggtcgagtatcaggtcgagtaacaggaaaaatgcaaaaactaagcaatatgtaacaagatgcagtaaacaacagcagaataaacaaagaaatcaattagattaagaatttctgaggatggggtaattgagtagtttcgtttcttcagtttacaggtgattgacatgctcaataaattatccccagacaacaagttcgataaccaaatctaagtgccaccgcaacagagaccctcaagttaaaccagtcccagactcaatcaccattgacgagagctaacctaacatgcattacgaatcaacaagttaaagccaaaacgctccctgtaaccaataccttggtacagaaccacgatctctggaactaggggttcagacattttatcgaacaccttttgggcgcggaaatgtctaggcacaaattccagttgatcaaaaagcaataagcattaagaacaactaatccagaaggatctacaaatcaaactcaaccacctagcatactgagaattctaaactactttaacccatcctcagaaacctagtcactactcagacatcattgcagagaacataaacgatgaagagaatgaaaacatgatagcaacagagtaatagcaggatgataacatggtgaacaacttagtaaacgaaataaaaaacaaatactgaataaattaatagatatccggattacaaaaacgtcaagaacacagtgtctgcagaataaaacgttttgttacaaaaatgtaaaatatatgctacttatagcgaaatattccgaaacccgaatactcaaaacgacacagtattgggacgaattaagaacgacactcgacccaggtggtcgagtgaatggtcgagtgataagctagagtcttcttcccttcattgtgctcgagtgtcttgttgagtgcggaatg

SEQ ID NO: 9276 - DNA, 3000 bp, Unknown
  misc_feature (1)..( 3000): cDNA_ID_2181556_gDNA_ID_1972048_Annot_ID_178298 3000 nt of promoter + ATG
aatacctttgcttgttgtttgacggttggtctcttttcggcctgtatctacttggtaatcgtgtgctccagagaagttacgtctctcatgatgtacgaatggtccgctctgaatgcccctcttctgggtcaggaagtttgtgtgtactttctcggctcgtgcttccttgctagcagctccatgtcctttttgtgggcgacgtaatacaaagcgcgaagcagggcgtctcggattgtcaaaggcttagacaaatttaactcttttcagaattcagatttgtacgaaatggccttccttagggccgagagggcagcgacgtcgcttattcattcgactttagccagggttgacttaaacgttgcgacaaagtcccttagtggctcattaggttgttgagataatgaccaaagatatgcgtcggatgtccatgggtcgattagcatggagtactgcatgagaaagagcgtcaacggctcttggaaactctcaaccaaattccgatccaaactagagaacaaatcttgtgcagttcctttgaggtgtccacgaacaacaaacacaagctggcgtctctctctcctagtttgaatctgcctcatctaacagctatcatgaaagacttttatatgtccctttgggtcgtatgacccgttcaaatactcgatcttgagctttcacaggtcagagatcgtggcctaagtgatcatgcgtgtgaatggcgtattgtacgattcttccgggatgcggtcaatatggaggccgaggaggccatgctatgcatctgcgaattcacgagcttcatgtcagcctcaacattggctagcgaggcttttatcacgtcgatctcatactccctttcgtactcctcggtccatttgatgttttcctcagcttcttcatcgttagtgacttcaatctgtttgattgcattagcctctgcttggggatgcagttcttgatggttgccaagctcgtccgtttagtttgatgcgtctaaatctaacggctcagcatgattgttacagtaggggatgtcgagcggtttcttaacttggctcggcatcccctactgtaattcgtatgatcccgaggtaatccataaccattggcgtttggctcggtctcattaagtgggtgaaatctgaccctaacaattatgcttagtcaatttccattctttttacacctaaccctttatttcgataagagggttttgcaaaacccaacactgaaacccttctccgtaatttctcaactccaacacttaacccacttttttcttatctcatatgagctctattatacaaaccagaacatgacagcttaaaaaacagagcacaaacgctcatcaacaaaacacatatgccttaactctgaaaaaaaaaaaactaaatcatcctcctcgtttttcctcttcaattcgtgaatgtaaccaccacggttttataaccaaattctactaatatgtaaagtccaatagttccacgatcttggcaatacaaagtgatgagaaatagaaacccaatctcaaatgcttataactactactttcattaaaataaaactacttaattccacgatctgacaacgttctaccgactggtttcgagaatcaactaccacactccaaaatatcacatatgcaaatcaggttgaaatccaccagtttcgtcttagaaaagccataagaagacatcttctagcctttatcatcttaacccgatttcttaacaaaaacgtttgtctaagacctatatgaagtactcttcatagtaattgacaaatatattactcccacataaaagtggaaccaatcgactatgagacataggaaatcaatcaatggtaaatgaaaatcgaattgaaatcctagttgaatctaaaacgaatactattagaaccagaaaagccgattcaacaaagatgaaaaagatccaactcaaatcagaaattatatgtttaacaaaaaaaacttgcgttttcattaaccagatatcacattctctctagaaaatataattgagataagagagatctaatgcaaactattttttataattacgtttcaaaaattgtactatactacaaactcaccctaacttttaggcctgggagttcggattaaaccgatcaaaccggcacgatcaacccgaaattttcggttctcggcttagaccgaagagattaaaccaaaccgaacggcaaattaatttgggcaatcagatgtcggtttgggtcggtttggtaatcagttatcgatcgattacttcgggtttaaaggaacattgtataaaaacataaaaccctagatctaattcatttcatctcttctcctccttttcgcctctcctttacgatccttctttttccactctcctcctctccttacgatcttccttgttctttcttcttctccttccttctcttctaaactcttctacatcttaatcttcttcgttttcgtctcagccttccatgacatttaccgacgtgaggttcgtgttgggatttgattattggtgttacttgattttttcgtagtgattgttttttcaagttctagatcttagaaatcgtttttattttattgatttaattgttttctttcttctttcagtgagaatgctaaaaacacattcatcaacctcattcaatgcaatctcgcttcaaggaataaatgtctggaatgccactatgtgcgaaaaagtaaccaggaatgccactcttctaattcttattttttgccgaattaaaaataaatgagagaaaatccaaataattggcaaaagaccaaaaacccagacgacccaacaaagtatccgatccaattaagatccatgcccagcgacccaaaactcatcccaaacacttaagcgaaatccctaatttctaaaatcaaaccgtttctgctctcagaaaattcaaattttccaaaatcaaattcataatttctcgcctttcacgattttccgacgaattcttgattcgtgtaatagtttg

SEQ ID NO: 9277 - DNA, 3000 bp, Unknown
  misc_feature (1)..( 3000): cDNA_ID_2181569_gDNA_ID_1972048_Annot_ID_178301 3000 nt of promoter + ATG
caatcaaaagcccaacccaataatttttttagggttttgcaaaggaatgagcaaagtgactgcggctctggctgtgattgtgacagcgacggtaaaaaccacggcgatctccgaccgtcctattccaacttgaaggagtcctaatcaacaatgccactaaactggaaatttgaatccggcgtgccatcttttgatctgcatgccactcttgtagtggataatacctatttacccttaatgaattatatcaattaattttaaaagaaaaatcaaaaacaaaatccaaatcgaaatcgaaattatcccgacccaacccaattaattccgacccaattcatttaattccgacgagataggcgatttccgattaacttccaacatcggtgatttttgacattggctccgtcgagtctggggaaactttgctaggtcagctaatccaattctccggccgtcgatttctccggtgctgcgtgctacgtgagtcgatactattggatcgaattctttattgatctttgctgcggctactctggaaacgatccttctttagttcttccatctcctgtaagtattatagttagtacaatgtaattgaattgaatcaatgtgtaagcagaatcaaaccatatttgcataatacaatggatggacgaactgaaattgaatcagacactggtacatctcgtggttcaactggtactaatatagtgtttatatttgtaggaggcgatgaagaagaggatccagatgaacctacactttgactatggagggtactatacagcagaccatgagtgaagttgcaaaaattcaatatacggtatagtgtttaagacatcatctttggagagaataacatatgcggatttaatagataagatctgtagaaagattgctctaggtggagagaaaaggaatctgaaattgagttacaagatatgtaaagcatggagagagtcttatattgtagataatgaggatgtgttgatatatttaacgtcattggataaagagggatttagacctgttttgcatgtagagttatgcagtgatttggaaagtaataataggcaagttccaatagtagagcgaagaagttcatgcggtgtaaattatggggaattggctgccaatgttgtaatggttgcggatgtaaatacaggaattctgagtactaatgaacttattattgaactagaggaacagcgtgagacagttagtgaacctattattgaactagaggaacagcgtgagacagttagtgaacctatgatgctagagaatggagtttctgaaactgttattgaaccgctgatgatagagtgtggggttaatgaagattctgataatgattatgttagggaagaatattgataataggtttttagtcaattaattctaaaacactatcctgtcgttgtagtattttaggtgtcaatccaaatgagtgtgatacaaacaaatgagatgtgatcagaagtcactaagtcaagccaagcaataacagttttggggtttctaacagtcctaagcgaacatgcagaaaacagaaacaataacagaattactaaaatcactcgactacaacaggctgatgccagaagtaggatgtggtcgagtaactggtcgagtaacagacatgatatgaaacagatatactcgactgcacagtctgttgccagacactgggtgtggtcgagtatactggtcgagtaacagacaggaaacaagataactgtactcgactgcacagtctgttgccagacactgggtgtggtcgagtaagttggttgagtaattgcaaaaactaagaaacaagcaatgagaatgattaagcgataacgataaaacagagaaataatatagacgagaaattcctaaggatggggtaatcgagtatagtggtatcctagcctatccgaatggttaacaagcgcaatcaagttatccctagacaacaggttcaacaacagatcaattcactcccgtgatagaaatcctcaagcaaagctagcccagactaattcccattaacggaatctaactatgcaggcaataaaaacagactgataaagtcaataaacgctctaaacggccaatcccttgggatagagacgcatatctcaggaactagtggatcaagcatttcatcgaacaccttctgggtgctggaatgcttgggatcgaattccagttgatcagaaagaaataagcagtaaacgcaagtagtcctaaagggattcaatcaattctaaaacttaaccactctacagactacgaattccacaactactctatcccatccctaagaattctaagtcactactcagacaacatgctcaaagacataaacgtagataaatgataatattgcataagtaaagagataaagagtagagaaacaggatgacaaatgaaatcaaatgcggaatctgaataacttggaaaaatctcgaattacaggttgcagaagcaaaagcggcgcagcagagtaaaacaaaaaataaaactgaagcaaaaactcaatgtcgactagatgtctcaggacagaaccctaagacatctatttatacaaaacgaaataaaatgatagtagacgggccaataacctaatcgcccggcccacagagtgataatgggccgagatgggcttcgtgattcgatggaggtccaggccgcttccaaacactttgtcttctcctcttctcttccttgtgcttagcttgtctggttgagtgcggatttgagtagactgtgaagacgtgatcgagtgtccggtcgagtgatggtgatggtggtgagtgatgatactcgaccagggggtcgagtaatttggtagagtgaatggccgagtgtggtcaggtggtgtggcgaagtgatactcgaccagggggtcgagtggcatcatcgagtggcctgagctgaggttactcgaccaaggggtcgagaagatgggaagaatggctccaaagtcactcgaccagggggtcgagtatg

SEQ ID NO: 9278 - DNA, 3000 bp, Unknown; identical to SEQ ID NO: 8976
  misc_feature (1)..( 3000): cDNA_ID_3044167_gDNA_ID_1972049_Annot_ID_178321 3000 nt of promoter + ATG

SEQ ID NO: 9279 - DNA, 3000 bp, Unknown
  misc_feature (1)..( 3000): cDNA_ID_2991265_gDNA_ID_1972049_Annot_ID_178331 3000 nt of promoter + ATG
tacttcgcagtagcaggctgaagcattatataagaaagagacttagaaaaagctcaaaatcgtgtaaaacaaagagaactttcgtatcgatgacaaatgtatacctgagaaccaatcttgaacccatcaacgttattcgctgcaagcaaatcaaaaaaggattagagaggaagataagtaattatcagaaataagcaagaactgtaatggttaggagtaagagcatacaatgtaactgcaagcgagaatcagcttcccaactcggtttctctggattaacattgtccgtatgagcaacaaatgtagaagtgaagtaattgataccgacaaaatcataagaacccttcagtttctccttctgctcgggcgtaaaagatggtaatcgactaccaacaacatctttcatggcctgagggtaatctccatgtgttattggctccatatgcctgtaaacagcaagtatccacactcaaaacactaagcttaataagtttgctcaaacaatatttcttaaagactactcaccagcctagagtgaaatccatagctctcttcactatctcctctgaaggactcgaggtggatttcttatcataaggctcaaaccacattggactttgaacaattccgatctttccacctgtgcactgtttgttttaaatccatggattagctcaactgaaattcgagtccaaatctgttgtgattatcctaacattcttacctttccacatttcctgaattcttccacagcttcggcatgagccaacagcagattgtgactaacagtgtaaacttcatggccactcttgcctgcaacacatttctcattgacatatttagaacatcttcctggtgctttctctccagtctcgtatccaccacgactaaattcataaggttcgtttatagtaacccaatgcttcactctatcaccatatttattgaaagcaaactgtgcaaaatcacggaaatcctccctatatatgagtttcagaacatattaagtaactgcaaaaagataggagacataactgagataacatagatcaatatttggcttagaggacttacaaaatacggtcactcaagaaaccgccgtattcatcttcaagagcctgaggtacatcccattgaaacaatgtgacaagaggcgttacacctgcaaaactcaatcaagattgccattttagccacaaggttaaaggaaaaaaaaaaggagatttcatatgaaataaagatgtgggggaatgtgtaacaaccatttgcaatgagctcgttgataagatcattgtagaatttaactcctgtttcactcactcccttgtcttttttcccatctgattgttttcaacaacaaaatgttgttagaaagtgcatctcataataaactgcaaaagaatcattaaccaaagaatagatctttgtcttacggggaaatattcttgaccaagatatagagaacctaaaggcatccatattcagttttttcaatagttgaacatcttcctgcaacattttcaaaaagttagattagatcaacatcttcagtgggaaggattgctcgtagaacaatatataccttgtaatgatgatagaaatcaactccgagcctgccgtcaagattgttgttgctttctgcagattcaaataacatgctcatgagttaataatcacaggacgagatcgaattctaaactcataacaatggctcagttttataatcttctgacctgaatgttgtttaagagtgaatgagtcccaaatgctggaacctcggcctccttcttctgctgcaccttcatgctatacaaacaaatgaaccaaattagaaacgtttggcagtagaagaggactatcaataagtcaatcatgaaacttgaagcatcatcaacagaattcaaaagtgaatgtgaaaaagaaactacccttaggcattaaaactagagacttgaaaatgaccaatgactgccttgaattggaaaaagctttaaacttttccctttcaagctatttggtttggctaaagataccaaatttgatttctttaaactagatttgagattaaagactttcttaatcgtacttacaaagctgctagagctgatattagagtaaatccggcaacgaaatattaaaactcgccggacaaaaagaatccagtcaacggcgattcaacaatgtttggacttataaatcccaaattcgatatacctggaaagcagaagttgtagcaccgaacaagaaaccatcaggaaagcttccacgaccaaacgtggaactcgccggacacacagctccaccgtagacggtgatcggagaaactatcacgacgagaaataaacccaaaaagagaatcgctttgagtgccatttttcaagtaagttttttttatgcttaacgtggttgtcgtgttccattatttataagagtcgagatcacaaagaagaagaatttaaaagatagttgtttttgagatccaatacttcgtctcgaagattaaagcaaggtgagagcgacgtgtgtgttaaaataaactatctttgatattgtacatttaattttcgatagcttagccttgtcttgtcgacgacgatggtagtagtagaagaaacaacgttaaggttccttcttaccacggtaaaaaataaataacaacaaccaataattgtaattctataacttaatttttgaaaaacagtttttaatttgaaacaacataattttaccttttatacggactaatatatacctacgacaaaaaaaggactaaatttatagctaatttttttgttttttttttcaatttatattagttagttggaccgacatgaaatatttatttaccttcaattaaagaataataaaacaaaattatctcagcaaaattaattgaatttttttagctgacacgtcaccatctttatgtttttttaattcatttatttccatttggataaaacagaaacctaatcccttaaacctcgccggcgacggaaa

SEQ ID NO: 9280 - DNA, 3000 bp, Unknown
  misc_feature (1)..( 3000): cDNA_ID_2181759_gDNA_ID_1972049_Annot_ID_178333 3000 nt of promoter + ATG
atgtcgatatattcgttgccggaataggaactggtggtactgtaactggtactggaggtttcttgaaaatgatgaacaaggatattaaggtatttctctttctcttgttttcagatttctggtttaaccttgtgattacctttatatgaaagatccttaaaacataggtagttggcgttgaaccatcagaaagaagtgtgatttctggagacaaccctggtaaggagcattgaggcttcatgtcttcagaatcaatacttttgaattgggtttatatgctttggaatcccccttacaaaatactactaaacggtttttcaggttacttaccgggaatcttggatgttaaattacttgatgaagtgtttaaggttaacaatactttcaaatcataatcaacatttcaaacgatacatctattgaaaaaataaaagaagatcatgttgaaaaacaataggttagcaacggggaagcgattgagatggcgaggagactagctttagaggaaggattgctggtatatatgataaacctctacttatgttcttgcgtctttcttatacatgacattgggtttaaaacttttgcaaaatctatacaccttaggttgggatttcatctggagctgctgcagtagcagcagtcagcttggctaaaagagcagagaatgccggtaaactaatcacggtgagtaaaaacagattgacatatgtagtaatcacagttggtggtttttagctctaataatttcgtaaaacaggttctgtttccaagccatggcgagcggtatatcacaacggctctgtttagttccatcaacagagaagtccaagagatgagatattagtagcagccattagaaaagcccccaaagtttggtccttttggagagtgtaaacaacaaatctctttgcaatacagaaaagagaggtataaatggtgtttcttttttcttttcttcttgctcaaaagttcaacttcctgttgaggtaatcttacaagccaacacctgtacaggtttcagaagactgtgaggttagagctcacacgagaactgagagataaacatgtctcgagcccaaccagttttattcaaagatttgtgaatgtatagaagatcatagaccttgttgcattattcttcttcttctcactcatatgtcagggaagtatgctgaacaaataaaagtttgatcatctaaaccctgaaattgatttgagatctccaagattggaaaaactcaccgagagcaagcatgtatgtacattatatggtggttagaactcaaaactttttgcctttgatgataacaaaagatatggttttattgttccctttggatttgttaaacagttaaaagagagcaatcggtaagatacaagaatgagtgtgaaataaattttactcttggtagaaggaaattggataaaaaaaataagaagtcgaatctttaaagagatgagcacttgtgggcttttgcgcatttgacgtccattcctcaagtcgaatatccgcatgtgcctaaaagcccaacgaaatatacatgaatgcacaatttaatacactatgacccaaactctgcccaaaaatatgtatagatagaaatgagtcacaaatgtaatttccataaaagagaatgggacaagattttacagatggaggatattgggtggaacagtgtacacgtgcaatcttactttctccgtgtcttgcataacgtggcggatttgtagggacacctttgtatctgtattatcaaagtcgtagaaagaaagcattgtcgaaaacagcatgcagtccatatttattatgagtaaacaggcagtagttttcttttaagattgtaaagtaacgtgtaacgagttttgagtggtgactcagcatgatgtattatttcactctttttttttttactgattggggttgggggttgggggtggggggaatgattagaaactccagtttttaaattttcaaaacgggttgataataatctgatttcttcagtagtatgaattttggagggttagattaaagatttggtccatatctatatcgcataatgtattttattaacaagaaaacaattgtgttgtaataagttttgtatattttttccggcattaattttggatatatctaataatacagagaactacaattcaaaattttctttgtaagtttacatatgtacgaatacacacattacacacacacataggttagttttctagtacatcataatccgtttataccccttgcaaatctctattatatgtctatagattatcaacacgtttcggttttactctgacattttttcctaaaaagaggaaaaccaggtaacttcagttttacaaatttattttattttctctattattttctgttgttcgttttcgccaacctctgtctctcttctctggtcttcttcgctttgagtctttccccttgaactaaggtaactaatcactctgtacttcgtagattcagtatatataacaaaagtgcatctgtgtgttatgttttgatgaatcttttgaggtaagaaatgagtttaaacaaactttattagctcatttcttgatatataactttctcctggctgacaatttctataagaaagggattgggaagaaaaaaaaaaaagagaaataaataggattaaaaaaaaaaaaactgtttggaattgcatatactcgtgaaaacttaaaaaacagatttttttttttgtttttgttttgttgcttttttttttccaatgaaactcgttgtaaatatatgtgtgtgattttatgaattactaatatgattaatatttatccgcctaataaaacacattccattatttcgttgattaactaaacaatttttttttttaaagttcgaaagcttataaacctttatttctttcttttttttttgttagtgaaattatcagattagagttaaagaacggaagaacaaaagaacaattagaaatgagtactcaagaagaa

SEQ ID NO: 9281 - DNA, 3000 bp, Unknown; identical to SEQ ID NO: 9090
  misc_feature (1)..( 3000): cDNA_ID_1989396_gDNA_ID_1972049_Annot_ID_178344 3000 nt of promoter + ATG

SEQ ID NO: 9282 - DNA, 3000 bp, Unknown
  misc_feature (1)..( 3000): cDNA_ID_3041013_gDNA_ID_1972049_Annot_ID_178330 3000 nt of promoter + ATG
gtttagatgatcaaacttttatttgttcagcatacttccctgacatatgagtgagaagaagaagaataatgcaacaaggtctatgatcttctatacattcacaaatctttgaataaaactggttgggctcgagacatgtttatctctcagttctcgtgtgagctctaacctcacagtcttctgaaacctgtacaggtgttggcttgtaagattacctcaacaggaagttgaacttttgagcaagaagaaaagaaaaaagaaacaccatttatacctctcttttctgtattgcaaagagatttgttgtttacactctccaaaaggaccaaactttgggggcttttctaatggctgctactaatatctcatctcttggacttctctgttgatggaactaaacagagccgttgtgatataccgctcgccatggcttggaaacagaacctgttttacgaaattattagagctaaaaaccaccaactgtgattactacatatgtcaatctgtttttactcaccgtgattagtttaccggcattctctgctcttttagccaagctgactgctgctactgcagcagctccagatgaaatcccaacctaaggtgtatagattttgcaaaagttttaaacccaatgtcatgtataagaaagacgcaagaacataagtagaggtttatcatatataccagcaatccttcctctaaagctagtctcctcgccatctcaatcgcttccccgttgctaacctattgtttttcaacatgatcttcttttattttttcaatagatgtatcgtttgaaatgttgattatgatttgaaagtattgttaaccttaaacacttcatcaagtaatttaacatccaagattcccggtaagtaacctgaaaaaccgtttagtagtattttgtaagggggattccaaagcatataaacccaattcaaaagtattgattctgaagacatgaagcctcaatgctccttaccagggttgtctccagaaatcacacttctttctgatggttcaacgccaactacctatgttttaaggatctttcatataaaggtaatcacaaggttaaaccagaaatctgaaaacaagagaaagagaaataccttaatatccttgttcatcattttcaagaaacctccagtaccagttacagtaccaccagttcctattccggcaacgaatatatcgacattacccattgtatcttcccagatttctggtcctgtagtttcaaagtggatcttaccaaacaaaccataagaaaaataccttattaggccacacacctcatatccaaaattaaaagagtaaaagctcgataacttcttacctttgtatttgctgtattgtcgaattgctgaaacatatatgcgttctttgtcttgagaacaatctctttggctttatccactgctcctttgagacccttctctggattcgttagcacaatctctgctcctagtgcacgtaaaagcatcctcctttcaatattgatagaagctggcattgtcactataagcttgtagcctttagctgcagccacaaatgcaatcccaaggccagtgtttccggttgttggttctactaatacagtctgctttaataacaccatcgaattagcaatctacaatgtggcaacacagaacattaaaatatcgaaaggcaagaagtacaataaccttcctcggagttatagctccgctgttttctgcctcgttgatcatgctcagaccgatcctgcagaaagggaaaactgttaagaatgttaaatccacaagactgataatttagagaagacgaagaatcattctgacctatctttgacgcttctacagggctccattgattcgagcttggcagcaatgtcagccaaacaaccatctgtgactctattgagatagaccattggtgtgcttccaatcaactatacaaacaaagttcgaatcctaaattatcaaacttcatcacataatctaatctttaataagaaaaaaacgtctctttactcataagcttagtaaaatttgaatcctttgaactcacttgagtgacatcttcggcaatgttgactgtctctgactcagcaatgtgttgctcttcagccacagtagtgactggcggaggaggaggtggtttccgtttggttttggatttcgatttcgttccggtagaggattttccggagatagcgccgacgacgaaggaagataccggagttctgacagccaaagaagatgaagaatcatggtgaaaggagaagagtgagagtttcgcagtactgaaacggtgtagtttagatgttattcgacctaacggagactgaggaagaagacggagcgaaggagacgcgaaagccattttccgtcgccggcgaggtttaagggattaggtttctgttttatccaaatggaaataaatgaattaaaaaaacataaagatggtgacgtgtcagctaaaaaaattcaattaattttgctgagataattttgttttattattctttaattgaaggtaaataaatatttcatgtcggtccaactaactaatataaattgaaaaaaaaaacaaaaaaattagctataaatttagtcctttttttgtcgtaggtatatattagtccgtataaaaggtaaaattatgttgtttcaaattaaaaactgtttttcaaaaattaagttatagaattacaattattggttgttgttatttattttttaccgtggtaagaaggaaccttaacgttgtttcttctactactaccatcgtcgtcgacaagacaaggctaagctatcgaaaattaaatgtacaatatcaaagatagtttattttaacacacacgtcgctctcaccttgctttaatcttcgagacgaagtattggatctcaaaaacaactatcttttaaattcttcttctttgtgatctcgactcttataaataatggaacacgacaaccacgttaagcataaaaaaaacttacttgaaaaatg

SEQ ID NO: 9283 - DNA, 3000 bp, Unknown
  misc_feature (1)..( 3000): cDNA_ID_2181748_gDNA_ID_1972049_Annot_ID_178329 3000 nt of promoter + ATG
gtaatatgatgtgaaattatttaggtggaagtgcacagttgtaaatccgattagttaaagactaggatactcggatgatacaattccaaactaaaagcgatactgatcgagatgcttggagttgtatgtgcgacatcgagtaaaatgataaaattctccaaattggccatcataagaacgtgtttgaaacggcgcgcatcataatgaaatgaaaatctaggattcttaagaataatggtcctttttaaaaaagcatcatatatattcactcacatagacaattaactgaagtttgctcaaaaaataataataattgaattcgatgtatattctatgaatctcatttgaaataataataatgagtcatttctactctaaattttcaaagaagagaattcaaccaataaacttcattatattttgaaaaatataattttagcaaatcaaaagataatatatcctgctattattataaggcatgttagaaataaccaaaaaaaaagttaagtggctcaaatgcatattaaacatacacaaaacgatagtacttaatgaatgtgagccatgtaaattagtaaaaaggttagcttgttaataaattaattagtaaaacgcttagtgatctgattttaaaccaaattcaatattagcatatcagtaccgatatggtgatatataattcggattttattagttttaatgaatatatatatatatatatatatatatatatctacgaaaaataagaaaacaataaaaaggaagagcataagacagctgggttcatcagatttctattcttgtcgattcctgctctccgaaacacaaaccttaattaacagctcgaagcaatatcttaatcggatagtgaagacaaatttttatttttttatagagccaacttctgcccattagatttagatctaaccttgtaaacatcaagtacaaggttataagtattgaactaatgttcacttaataaaatctgaaggacaaaatctataaattttagaaattacgcatagacaaatccaagataatttctttataaacttttttgatccctctccgtaattatatagggtggcacgagcacatataatattatgttgggtgaacacaaattgtcacatcatatatagtagttgtatattgaaactaaatttgtgtagacgagatcgatataaataactcaataagcagagcttagataaactgaatagaatatgtgttgccattttatacagaaaatattcaatattcaataattaatgttatactagcgatagaagaagattatttagatacaaaaattcgtattaagaaataaaataaagcaagtaggcgacaacaccgaccactataaccagtgactaggagacgcatgtttggttaattcttgatttcccaactcaaagaagaaagcatatattgtgagacttaccatattgatcttttcaaactctctccacacattttcctattggctcccatgtgggtaattaattaacttttgtactttggagatactcaacctttttagcgtttgtactttttagcttcccacattctatgtgtatttttttggtttctgattttgtttgttgactaatcttgttaaagataataaaattcggcagtgattaaatgtatgtaaccagcccataaaaaaaaaaacatacggctaatgaaagttacaatgacttgatcaaatatggccacatgctcttttctgttggcccagcccaaaatatcgtaaatccacaaccaaattggcctagcgtaaatattttcttagtaacattagttttggaatcaagatccatttgaattagttgacaagcaacataattaaaattcaaaagagctgtcaggtttcatcccacgtaaacgttgacagaccaaccgacgatgtgatttgcacatttcatttacagaattatatgtactttttcatccagaaaattgttttttttttggttaattaaattaaatatctacagacgttacgttatcaatgaataattaaggagtcacttaagatctttaaaatactatcaaatgctataaaacaattagaagataattatgcatcattatttgtagttcttaaatagaatcacctaaaaatgcattcttttgagcagcttcatcagtactagacgcagccgatgatgtggagttgtggacatttgggttcaaagcacgaatccgttggggaatcacggtgaaccacaagagcttgtgcaccagtaggaaagtacttttgtaacctaataaaatatgaacagtaaactctgtcagatctaataaattctctttaatcaatcataacgttttgaccatttactaaaattctgactaccattaatctacgcaaactttttactatttcaaatatatttatttccttcaaaatcagtggtctcagaaatactaaacaaacatttttactaaatcaaaactataggagtaagtaatattgatacatattttaccctttttcttgatattgtttttacgctaaatcaaaactatatgaataagtaatattgattaccttttccttaattttttttatgctaataaaaatcagactttttttggttaatgatagaaataaatcctttggttaaacaacaaattctaatatcgttttgattgccccgcgtctcaagatcaacgacgacgactcagtttcttccttcacaagcgagatagatagagcaaagagcgtgttgtgttgtttcttctctcttcggcgttttcatcgtttctcatctacctcgaaattttctcgtcactctaatcaaaaatctcacttcgttattttctcgggaaaaatttcccgatcactaaacctagtttttagatattttctctcctggattctggatctacacaatctttcttcctcttcttctatgaatctgttcatcgtaatttcagattcttgatatatgattccttttctccaatctcttctcttagctctcagag

SEQ ID NO: 9284 - DNA, 3000 bp, Unknown
  misc_feature (1)..( 3000): cDNA_ID_2181660_gDNA_ID_1972053_Annot_ID_178355 3000 nt of promoter + ATG
taaaaaaatacgtatcaatttgtgttaaaacgttaaagaataaagtattttccaaaaaagaaaaagaaaaaagataaaataaattttgctgccagtaaccgaataaaagaaaattaaagcatccataggaaatgacgtgtatttatcgacgtggaaaagaacgtgagacacgtggcagtatatatcagagcgagagagaaggttgatgcacggaagctgttcccttttaaaaaatttggtgcaagtctacgttgtggcactcactcacttaataaactccacttttctccaaagttgattttatcatcctttttccttttttaaaccattattggattcttataatttataatccgcatgaacatttaattaccataaattaatctctactgtatatcgtctttagtagttaattgtaatttcatcttaggtattttaagtctttctgtaaatcgccaaatattccggaaactatatggttctgagaccatcttatcttttactctcttaattatttcctacttttctatttatagagttaatactttgatagtcagaaagtaataaatctttatctctcttaatttttcaaatctctgctcagtttataatttctaccttctcattttctccgtactctctgcagatttggcctaatatattaagttttttttaaaaaatatatatatatatatatatattttttcgtgactggaaaaatgcagatctaatccaacaatgataagcctctttgataataaatttcaaacaatcgaggtatgagaggaaaaagaaaatgagtcctggtttggtaactccttggatattgaggaacatcggtttaaggccaacctaaagcttcgatggatatatttgcatcaaagattcgaataatggctcactgaagagcaagtctcggtaatacttttgctctaaacaattcgatcttatctcattcctctcttaaatccaccctataatggcaccaccacccacgttgcataagtttgtatataggtgtttctttcacaattgttttttataaaaaagaaaaatgtttttttcaaagaagaattttagataaatttaaaaacctttcgacaaaaaaagaaagattaaatttaaatattcaaaagaaaaagaccttaatccccaaagtcggtcaatgaggcaaaaaaaggttgttcaaaaaatgatagcacacttttaatggatttttgttttttgtgtcacgaacactttgaatttaaggaactaaatcgtaagaattgaatactataacgttccactacagtcagttttacaactatagaacagtttaaaaaaaaaaaatttatctataattccttaattacagaaccacctacaagtgttaatatgcatccgtttttatatgcgacgcctggcacgtatagagaaaacgtgttttgttcacgtattcgctattcgcaaaacgtatgccacgtgagatctacatgacgacatacttacttgtattgtatgtaacctcttcgtacatgatacctactaaattgaaatttaagtttgcttgaattttctttaaaaaacaattctaatgaaatttatcgaaatagaactatcattttttgtaatcatattaactttcatgagcttttcaattcgatactaattgctactaaatgagttgatctatcattaatatattactttagactttttgtattttttgatgtggaattctaacaaaccaaaaataaattaagttaaaatatagactaaacacttatcacgaaatgagctcacatcaatattttgataatcaaatgattttttctttttttaccaagaacaaaacgtttaggaaaaatagagaaattagaaacaaagaaacaaaagaacaaccttgtataaggaaaaagaatcgcaaaaaagggaatgcgaaaattatgtatataaaagagtatcaaatacgccaaatgtaaatgaaaggaacatataactttaattatagttatttctttttcatattgtacaagggtgaaggatgaattcaatgtagctaacagatagaaagctaagagctagatggtccattttagtgatatatactgcatgattttgcattttatcgacatatttataaaaaatttcctctttttctttcttttgtaaaatacgttaaacctcaatttaattaaaagggtgttgacctataaaaaaactaaagggtaagagatatataatagacttaatagtgtttaattataatagaacaaatctgcaaaaaaaaatggtttgcgcaacggttattaaagatataattcaaactagggtgcatacaaacctattgaatttcctaatctacttaaaccaggtttcatttaaaccattttcatgaaactttccaattcacatatttctttaagaattcaattagttagtttattttggttgacatctacaatgagtgtttttttccacctacataaaactccatcatttggtaaaaaaaacttttactagcttgtacctttcttcgttaaatgtttaattttcactttttaactcatccgtattttacaaacgaagagaataaaaatcaatttgaagtgtatatttggctatatacagttttagtttaattcgtataaaattggaaaacacatcttttgaagaaacagaagaagcatggtaagaaaagaaggaaaaactatttaataaatacataaatccacccacataggtgtggagacaaagatatagaattccaaatatggaaattaatctctgccattagtggaagttaattctcataacaccgaaaagctaacgattttcaactttttttttttgttactcagaagattttaaacctttataaatacgaaaaaaccaatctcacaaatcatcaacaatcaccttgatctccactctcttacatataaataaccaaataatttctctcccctcttctctctacacacatagacaataaacacataaagacagtttctaatg

SEQ ID NO: 9285 - DNA, 3000 bp, Unknown
  misc_feature (1)..( 3000): cDNA_ID_1715608_gDNA_ID_1972053_Annot_ID_178371 3000 nt of promoter + ATG
actaagaatgtgactgaacaagtaagactacttgcaatggatgaagacgagaacctcactgagccatacgatataattcctccatatgatcaagcaaaagcccttggcaagacaaacattgacagtgatcggattgcttctggattaccatgtggtagtgaaggattccttctgatgtttgctcggtggataaaacttgctagggatctctacaatgaaagaaaagagtaagtttatcatcggatttggattttagcgatgcttctcaaaattttcatctctttgtttccagtaaagttttgtgagtagcactgatagttaattttaattgcagccgatttgacatcacacagattccggatgtttacgattcatgcaagtaagttgtttttagtgtatctctagatttacacctagctttagttactcgtttttgaataagccgtaatatgttattctcaccaggtacgacctgttacataattcccatctcgatctaaaaggattagatgaactcttcaaagtagcacaggtaaacaaactgaaattcctccttccctttcctgaaactttaatcatagtttgcactgaaacaatgaactttcttgttacatctctaaaatgtatggttgactgtgctcgcttatagctaagttatgtgttatgtggttgcagttacttgcagatggtgtaatcccaaatgagtatggcatcaatccgcaacaaaagcttaaaatcggttcaaaggtgacaatctaagataagagtagttattttcctctctaacaattgtttttccaggggatctcacaacttatcatttctataatttttttccaataaaacaaaagattgctcggcgcttaatggggaaaatcttgatagacttgaggaatactcgagaagaagcactgagcgttgccgagttgaaagaaagccaagaacaagtcttgtcattatccgcctcgcaaagggaagatagaaatagtcaaccgaagctatttatcaatagcgatgaattgagacgacctggcacaggtgataaagatgaagatgatgataaagaaaccaaataccgattagatccaaagtaatagtctttactttctctctcactcttatatagatagttatttcggctactaattggtggttttcatttcgcttttaggtatgcaaatgtgaagacacctgaacgtcatgtgaggactcgactttacttcacatctgtaagtttcctctttgctccattgcttgtttaagtctgtctatgagtgaaactataatgtttatgcctggtatgatttggaacaggaatcgcatattcattcgctcatgaacgtccttcgatactgtaaccttgatgaatctctcctaggagaagaaagcctcatttgccaaaacgccttagaacgtctctgtaaaaccaaggaactcgattacatgagttacattgtcctaaggctctttgagaacaccgaggtttaacattacattccctttgactctcacacatgcttcaatatatgtatatgctctctcagtgtctgactctagacgtaaaaaacggatgcaggtatcacttgaagacccgaaaagattccgcattgaacttacatttagccgtggagctgatttgtctcccttaagggtaagagcaaaggatgtctttaactaattagaggaacatattataaacttttggtaatattgaaacatgatgcagaataatgacgacgaggcagagacattgctaagggaacacacacttccgataatgggaccagagaggcttcaagaagtaggttcttgtttaagcttggagacaatggagaaaatggttcgtccatttgctatgccggcggaagatttccctccggcgtccactccggttggtttctcgggttacttctcaaaaagtgctgcggtgctggagcgactcgtaaacctcttccacaactataagaactcttcttctaatggaaggagctaagcagagaccaattgttttttccacttatatatattttgctcatgcttttttctatgtgcagtttttaatcatcttcttgtttttctactgatgttttaattttctatgtgaaattgtgaaagggactagtgcagttgggtttgaataaagatatgattacatggaacataaatgagtcacccgtgacgttgtctagtgtttacaataggactcatctattataactcaagaaatgatgatgagtcttattgtaaacactgtgttttcatatcatgctgttacgttaaagttgttgcggatttgttggaatttatatataatctgcaaaagaataggctgatgatatcggataaacaaataccgaatctaaaacaatctaataatcggtggatttttcgttttgggaaaatctcaagacattaaattgataattgaaatacaaattattattattagtaagaatagtactaattgattggaaattgtaataaacgacttaatatacaaactgaaaaataacaaatgatcatgaaaaacattttaaaaaatgaccaaatgaaggagatacatagatagttttatcaaattttaaaaaatgttggtaatgcaattagggaacatttgtccgtgaaggaattaattagtctctgtttaaaaaactacgaaaaatgcgttttgtaactgttgttgagaagagaagagagagttagcaaacaaacacatatatatttacattattattgcccaacaaatctctctctcttgcccgcttcgtgcccgtctcttctctcttcttcgtattctctctccacagacatgaattccctttttgactaacctcctttttcccctaataagtgaatcttacttcttcttctcgccaagatcaaatttctgggattcttcttcttctctctaattcccttgcgtttgtttcctctgatcaagttccgtcctttttcctttttttgttcttgagttctcgtttgagctgctttttgggggag

SEQ ID NO: 9286 - DNA, 3000 bp, Unknown
  misc_feature (1)..( 3000): cDNA_ID_3035959_gDNA_ID_1972053_Annot_ID_178372 3000 nt of promoter + ATG
tgttaaactggtgggttattgtatcgaagatgatcaaaggctgcttgtatatgagtttatgcctcgaggaagtttggagaatcaccttttcagaagtaagtaaaacaactacaaccttcatattctaattacactgtagagttattttctttccttttctttgttttcgatttgggtaacaagtgtctacaatttagagatgtgtctactccatattgttaaagtgattagaatctatacagctaaaattggaacctttctgctctatatggtaaagttggtaccttttagtgctgtcttagatggtttatattgcttgactgtattgacccacgaagcaataagtaaatccctcgcattcattgtttcaagatttttcggcgtaaaaaatgtgtttaaaaagacacagtgcttttgtatgatttatcttctcagttatcattgatgcaaatctttttatttgtgaattaacttgtgcttcgtgttgaagggtccttgcctcttccatggtcaattcggatgaagattgcattaggtgctgcaaagggtctcagtttccttcacgaagaagctttaaagccggtcatttatcgagatttcaaaacctcaaatattttactggatggggtatgttttcctcttctttatatcaagggatcaacatcttatatacacgtctgtttctttgcttctaaagtcttaccatgtcccaatttcaggagtacaatgctaaattatcagattttgggcttgccaaagatgctcctgatgaaggcaaaactcatgtgtctactcgagtcatgggcacttatggttacgctgcccccgagtatgtaatgaccggtaagttttgttttttgtctttgcatttcattcactcctctacttatatcttctctgtatggttgaatatagaaaattagaaacctacacatatggttgatgcaaagtattactatgatgaaacatacatctaatttctttggtttgagattatatataactactgtcctcttattactccttaggtcacttgacatcaaaaagcgacgtttacagtttcggtgtggttcttctcgaaatgctgactggtagaagatcaatggacaaaaatcgaccaaacggtgaacacaacctcgttgaatgggcgagaccgcatctcctggacaaaagaagattctaccggttacttgatccgaggctggagggtcatttctcagttaaaggagcacaaaaagtgactcagcttgcagcacaatgccttagccgtgactccaaaataagacccaaaatgagtgaagtggtggaagtacttaagcctctcccacacctcaaggacatggctagcgcttcttactacttccagacaatgcaagctgaacgtttgaaagctggttctggttctggttctggtcgtggattcgggtcaagaaacgggcaaccagtgtttcggacattgtctagtcctcatggtcaagctggttcgtcgccttatcgtcatcagattccgtctcctaagcctaaaggtgcaactacttagattggctcgcaagtgtggacgcaagcaaacgtcttttttaaccgatgtaaaaccgacattgttaaccgatttaaagaaggaaaattaaggttgttccgaagaagatccgaatttgtgtatttactacctttgtgacctcatgtttcttcgtctgttgtaactcttgaacaaattgtctgttagggtaatattgtcattatgtattagtcgtttcgtatcgcttcaccagcatgcaaccaccacttcttcaatgtaaagatagatagatatcaagaatggtaatggaagatgtgggtgggggtgagagacattttgctttgaaattttgaaaattttcttctctttgatttttggacttatctacttgtagcttgtcgataatcgagttattaaaatataaatacgaaagaagaaaactgacaacttttcttacgtgaaacttttatactcacatacaagttatccactttcttggttaaacatgcgagccgcaaggaccaacgacttttatatacaaataatttccttataaaaaggattacagtaagatactttgcacactagcaagcttgatgattgtatatcaacatcataatttttcttattaagttatgataaaaaacattcaactataatttaaaatataatggaccgttccgaatttccataaattcggttaccacctccaccattttacatcaaacagaaaccaaaaaattagatttagatatatatatatatactagtagaagtagaaccatcttgttctcgtatattattacgaaaccctacagttaacagctgcagaataatataaataaagcgacactccacttttttctcctacattttgttgaatttgaacctttaaatcaatagtatataagaacatacaatgtaatagataacgcgtttactcaatcaaaaggaacaagtatatactactagataactcttgtttattggcgtctgacaaggctctgtagtatattcaacgatacgattatcctcttttcttcgataaaagtatattcgattctcttactacagaaacatagtttacattaatgttagtgaaaaataccatgcacggaaaatcaaagatttaattctgtggtttgtataatttgaagtgtataatgaaactattttttagcctaacccaaaaagaattaaaaagaaaaagtaattgttataaaaacgaaaagcatatttatcaaatattattattgaatattctccaagatataaacaatttgacttttcaatgaaaatgccactattgaataataaataggaaatttccgaggagtagtacaactagatgacaacttgacatgatcttcttcttacttttgtctatataacactcctgcgactttcttctcttcaacaaacttacagagagacaaatacctataataagccattcataatcttcttgcttcttgttcagaata

SEQ ID NO: 9287 - DNA, 3000 bp, Unknown
  misc_feature (1)..( 3000): cDNA_ID_3035956_gDNA_ID_1972053_Annot_ID_178373 3000 nt of promoter + ATG
agccgttcgcatagattctttacacagagcctttcataaattagaataattaatttccatttttaccccatgattttatcagttcttatataggctttgatacaaagagaaaaaatttagtagtgagttatatttttagcatgcttttccgacccggcaatccaatgctccggcgtatttggtaagcttagaaacggccataccatttttgggctttatcatctgttgcctagaatgcgaacacttgaaatgaggatttccagattgtctgaaatatgcattgttcatgaaaacatctttctcggatctccagttccagtttttccattcgctttctgaagcataatccctctttgtcacctatatatacacatgttttctattagtactttgatttgatgccatatatatatgtgcacactcaaatcattttggacctctctgtagtgttgtttgtgaggaggagcgatgaaacggtttccatggctgagaatggtaggaccttggctaccaccgatcgcgtaaagctcccaatgagtgtagtcattgttgacaacgtggacgaaaccccatcggaccctaggcatcctctgcacaagtccttttccgaaatggttgtaagccactgtgacttgcatcttcttgtcatccatgttgttgttttgtgcaccaagcaacatcacctaaagacagaacccaaaaacataacaagatcctttggttaacttgggttgtcattaatagtataacggtcgagttaattacgttgtggaatgctcacatcgttgtggtgggtgaaatgagagttagagatggtgattgcggtggaacccattatagcgtcgataagtccatcttggcatttagacatagaaatgtggtcaagccaaatgtttgttgccccaaagatagagataccatctccatcagcctctcctctatgcccaaagtggttaatcgaatctcttatcaaaccaccactgcttttcacgatgtggtggacgtgaagcccatggatgatgatattgtgcacgtactgcatcgtgataccagcaccatatgcgatgtgcacgttagcgccacgagcatcgattgtcttgtcactagtaatcatcagctcttggcttaaccgaatgctcatatcgtgcttaaaaacgatccatagaggttctttctggatcacagcgtgacgtagtgttccaggtctagggttcaccatatcatcgtctctggggctcgtgactacatagatgcggccgcgtttgcctccggtggtcctgtaaccaaacccacggacacagtgaacgagcttcttgcgacgtctggcccaatcaggctggcaacgccagcatttatcgatggggttgcttgcggtgcaaggtcccgttagcttgctccattttccttttccttttcccttgcccctaccggttaggctccgccttgtgctgtttgtcggactagaaatcatctcaatgacgtcctcttcctcggaagcgaccgccttctcttcctcggtcccctcgacgtcagtcgagttgctgaagatatacaccaaaccaaaaccatcataaatccaacatcctttttacaacccaaaaaaaacttctactaataaatatttgtaatttgaatgaaatcagaataaactaatccaaaccgttctctaatgattacaatcaagcctggttaatttcaacgagacgacaaatcggtaggattcaaaaacaatgcatatatagatcgagatactaatatttgacttactcgtaatgacgctcgtggaagtggtcgacgatctcataagggtcgggatgataagccataagggtatgtttacgagcttcattggccttgtttacccaatactcatcggtctcatcagcaacattggctcgtatggtcggaatcaaactggcaatacatatcacacacactaatttgaaaagcctagccgtctccattttatttgattacccctttcttttacggaaaacaaatatctattttattttttaaaaaggggtaatctttttatatattgaaatatatgtggagaactgctaagctttaaacatagctttaggtcgttatttctgtttgacctaaagccttttttggtagatgaatcgtattgcgaagtttgacaaacatgaatgttggtgtttaaataatgataaaaaaaacctggtgaagaaagtgaactactatatttagaaaaatttcccgttatgtatggaaagccaccataatttacttgtggacagctttctttgttttctttttttctttttaattttacatctccttgttttttgttcgtttcctatatttggatatttctatggagagactaacattatgatttcgaccaattttagcaacaagaaacaattacgtttacattctcatgatgcatctaaaagtagtgaaaatgtcagactgcttgtagtataaattgctaccataacggagacttgactaatcgtttactatatcagccgctaactagttgggatatttttctgaaaatagtttgataaatatgtaaaaatcacgatttcaccatcacattcgattactcattcatgactaaaataaaggatgaaatagctaaatttatgcgactaatcatcaagggaaaaaaacgattttctcattttaggcgtggaaagaaaaatgtgttattaaacgacgccgtttagttgccacgtaataaatgagaataaatttcttggtgagtggggaataaatatatggacggctgtggataaggaatactgaagcaagcgagtctccatccaacggctgataaaattatgcttgataaacaggaaaactcttctttctctgataatattcggaaataaaaaacattttagggttttcctcagtctctctctcttatagacgccaaccacgttttccagctcttgttctttcgattctcagagaagacttttcagaacatcctccaactttctcagataagcaacaatg

SEQ ID NO: 9288 - DNA, 3000 bp, Unknown
  misc_feature (1)..( 3000): cDNA_ID_2181693_gDNA_ID_1972053_Annot_ID_178366 3000 nt of promoter + ATG
tccgcagatgaatccaacttttcgggtagagtttgaagtaccttgtgaatatgaaacacacacggcttgtttagcaagaaacatttccacgtttaaaaaaattctgtttatgcgtttttgtttgcgctatagtcataagaatgggttttctcgttgttaaacatttgaaatatctcttgggcaagatttactttgtcaaagtgtttataaatgttatcaatggatttggatgccttgtttttcaagaaatttattgaaaaagaatcctaattttgatttgagatggtttcttgtaacccaatctcccctagataaacctaccttttcgccggtggctccaaggaggaaatgaatattagtggcggtaaggtatttgccgtaacagctttgaagacggatcacattggatccaggtacgatctcaaccgtccatctagtgttttttgttgtgccgcgacgatcttgatgaacggattcttgatcttcatcggcacttaggtatttgtcgttgtggctacggagacgtacaatcgttgcctttctaaatatctccatccgagaacaataatgatctctttctaaaaaattaagaattaggagacaaaaggggatggatctataagttattcttcattatcgtgatgcaacgtaggctaatatggtttgttgacctgagtcttgttttttaattcgcttgatttgagtcttttatcgttaatggtttgttatatgtttgatccatgtcaaaagtttgttgaaccgtgggattaggattgttcagattataagaccagatttctaaatagtatgacaactccgaagaccagattctgaacctcttccattaattgaactatttggttaaataaatcaaactgttctatttgtttctatgattccatctctgtaaacggtcaatgtatatgtgtgagtcttttataattcgaatcttctgctcagatatatgaatttattctcatagattacaagaatctctgaagtctgacatgtgaatttctcataaaatcatcaccgcagaagaagaaattatccaaaacgaaatttgaaggaaaatactaaaaaatcgaaagaaaagaagagagatcagagtttggttaagaattttttcggtcacggttaatctgaaacacggaccaatttgttgatcatcatatctctcgtttcaaacaaaacaatcaaaacagaagaaaatcaaatcgaaaaagatctagttgaaaacgattaagatcatcagagacttaaatactaataatcacaaagattactccatcatattgttgcagtattacctcatcacctgatctcaattttgcattatctatacggaccaatacatcataactcgaaaaccaaagatctaaagaaaactaaactgaagataaaatacgaacttgaacagagaaccctaaactgacttgataagagcttgatgtctgtcaaagtcatgtgtggtttgtatataaaggtccccaatggcggcgattcttaggtttctcgaggaaaaccctaacgcttatgggtcgtatatgagcttcataaggcccattataataaacctcttttgacccataaaaaccccaaaccaatactcaattagcttatatggatgggcttgactgaaaatttacaacttctcatttttggtttgattcaagaaaaaacaaaatattaattttaaaaaaaaatatgtacttggaacaaaataatttgtaagaaaatctacatctatttaaggcttgaagtcattggatcctattttaatggaagacaagatcaaaatttatatcctttttttggggagtagatataaacttttaagcttaatttagcatgttttgtagtaaatccaaaactggataaaatctaatttcaaactcaactaattctgttcattttatctttaaacaagttcaaacacttgaaacaatagcttcatacatacgcaaaagaaacaaacacacaacaaaattgatagaataaaataagtttggtattaaagaagatataatcgtaacaagattcaaaacttaagtaatgacatcgctacaaagatcagctgtttcgttccgacgtcaaggttcttcgggtcgtatttggagtgatcaattcatcttagatcaaaaaaatggagcaattcttcaaaatcatctagaacaaaccggaagaaatagtaatgatcttgaagataaaaatccatcacagaaatcaagttcttcgtcatcttcttcatcaccacctccatacttttctgaaatacgtagaggaccagacatctcatcttctacacgaaacaaactcgcttgtggtttatcatcacttttccgacaatgtatcggttcttcggctcgtgcttaattttgttcaatgcttgacgcaaatctgtacatatattttcttgttatatgaaaaattcatcacaattttttccgaccaaacagagttcttgataaatgggcctattattttaaaaagcccaatagatatttgagtgtccggcccaaattgaagtagaataaaagataagttaccaatttaccagtagttagcagcaaacacacagagaaagtgaaacatcgaagagaccccagaatgcaaaatctctctccgcctttttctccttccttattcgaaaattctcagcgtctttgttgcaaactcctctgaaattctccgtcttcttcattcgttttcgactctgcgttctactacttctcgtctcctatcagtatcatcgcaattcatattcagtctagtgtgttaaaccggagaatttggagtctcgccggaattttcctctgtctatgtatgattgccggtgatcaaagcgcttcttaacgattctgttctcctttgagagatctgagtatctgatttcatctactacatatgttttctcgagagtgatagaaagtaggtctcatacatatttttcctctggagggaattttgatcctctgcttcgttaattaacttgtgatg

SEQ ID NO: 9289 - DNA, 1116 bp, Unknown
  misc_feature (1)..( 1116): cDNA_ID_2034901_gDNA_ID_1972067_Annot_ID_178386 3000 nt of promoter + ATG
gaattcttgtagatgtctctttatgtgcatgaatgattcattaagctctttatgatgcttaacggacttttatgaatgtttgttcttaaatttcaggacgggaagcctgggcttcagggaatcttgaagaatttggaaagctaatttcagcatccggcttgagttccattgagaattacgaatgcggtacattacactctcttttcttctctcccaaatgcaacatatcctatagtgaatacagaccactagtatgcttacagacattattctctcttagattcattattttggttttaaattctgtgagttttgtgaaggtgcggagccactgatccagctatacaagattcttctgaaggctcctggtgtatatggagctagattcagcggtgcaggtttcaggggatgttgtctagcctttgtagatgcagaaaaagctgaggcagctgcttcatatgtgaaggatgaatatgaaaaggcccaacccgagtttgctaacaatctaaatggaggaaaacctgttctcatctgtgaagcaggtgacgctgctcgtgttcttctctgatcaatcctggagtttttggtttcttccccacttaaactcgatttttttgtcccttatatctctcacgcttattgattctttgcttgtttatctctttttgatcctgtctgagaaattctctggtctctttggtcggagtttcatcattgcttgatacattttttttgctacaaatacataatgtaaatcattctctaccgttttcgagtcgatagaagaatcgcaaacttcaaaaatgtgactaacatttctccataaatttgttaaattttcaacaattggtgaatttagttctgtaattgatctaacaaagacactatacaagtatgaaattagaaattgaaatcgaaagttagttattataatcttgtttgtataaaatagtgtatatctcaaatagagatacagattagttttttgtttggacacaaagacccccgccaaagtattgaaattcgcgcctgagaaattctccggtgtggctctctagggttttagcactttaatccatttgtacttgtaaaaatccctaaaaccctctgggcatg

SEQ ID NO: 9290 - DNA, 3000 bp, Unknown
  misc_feature (1)..( 3000): cDNA_ID_2034861_gDNA_ID_1972067_Annot_ID_178404 3000 nt of promoter + ATG
accaaatttggaaggcccgcatgcaaaagtatatagatcccaaactctctctggcttggtacacttcagtaatgcatcaaacacattacgtctctgcaaatgtaagttttgaaggttagacagaatttacggagaaatgactaaggcagcataagaggaagtgagagtttcacctgcttggtgcgaggacgaaagccataaacaattatcctcatgtctttgcctgcaagatgaaagtgatcataacatataatgtcaagtaaagatacaagacgcatcaaataaagatgtaagagaagtagaaaacacttcaaccaacatcactgtgggaagatgtccattgtccaagataatattgggacgtcaagaatcaaggaaaaaaaacatgaaacacaattcaacgtcatagcgaatattaagctatgacgtgaaaaccaggtgaaacaaaacttaggggaaatcaaatctagcaaacaataaaatccggtcacataccagtgacctgtaaaagacgtcttggtggaatcttgtcagactgacggggacttgattgaactttcagaacctatgaacacatcacccatcaatcagaaaatgcacagacttaacaatataaaaccctagagcctaacttaaatagtattaatcaaatagctctgtccccaggggtgtatagcaactgaccattttgttaaacttctcaatagttgccaatggaattgtaccaagtggaatgacttttctggttccttcactcttcacaaaagagaaacaaagaatatattgatcaacagtacttaaaaactaaaggcctaatcctgaaatagtgaaatataagtaagttcaagatctgtataattacattggccagaaaaaatagatcaaatgcatataagaaacagaggaaagataatatcataccaaaaaaagaatacggaaattagtcaccaaaagggttcctgcctcatcggtgttaataagcacaactccataaccctgcaaataaagtccaaaatcatattacttcaacaacatattcttcacactagtatcatggacaaatgcaaattgcataccaagtctcaaattcaatagccggatatggtaacaaaaattcaaataaaagagacactttgaccaactctacctcgacgatgaccctctccgattccagcaagcaactcaaattcgagaaagaacctgaccctgaagttgactgcgaccaatcaaaagagaaccaaagcagaaattgtttgagcaatcaatttcaatacaataaccaaattatgagctttttggatacgaaaaaagaaacgacattcacgtgatgtctgtgtaattgtgggttaaaaggggaaaaagcgtgaatcaggagagaattgagagcaaattacatcgagtttggtccattcaagcgtgtcccaactaccggtaccatccatcttttctgattccgaagaataatcacgcagcgaccttactcgcccagacggtggtctcggcggcgtcatgaaaaaggggggagagaaagagacggtgacgaggcttctggtgatcacctgccgatcaacggagcaaaacgacggatttgtttcgccacaccaatcaattaatacgacactgttttggtttggtacgaagttgtcgtttttttccttttgtactttattttgtttagtgttatctatttgtatttatcggcaaccaaaaaaaaaaaaaatcaaggcaaaataatctgaggtcaatcaaaatatttaccaaaatatttttccataataattctttatcttaacgctaatttagaaatttaactaaagttaaattattcaaaatactgtttttcgtattagatataatgtacgaaatgtttttcttatataaagttaaattttggacggtagaagaacttatctctagttgtgcacaattatatgtcaccgtcttaacaacaaaaagtcacaaactactaaataatccacaggtgtttatcaacaatttgaattgtattaaacatcaacatcaataatcttcaaagccatgtcacctgaattatccaagttgaatttataaaagaccaaaattacctgcaacactctgtcggttcagaaaaattccgcaatcgtttcccccttgatttataatagtatatttctcattagtttttacctaaaaaataataatttcagcatattaaaattaatcactaaaccccggaatacttgaaaatagaaaatacatgactaaaaaaaaaagtaaaagaaaaaaaaagcacacactactttttgcaccatttcccggtgctcttcgaatgtccgttcctcaatacatatgtaccacttcaatccaaaagatatgtcggtactaatttgtaaaattataaccactttaaaacctaactaagtcaatattctataacacatagcatgttgcctcctcttaccacttaaaaaacactacaacatgttatatgttttcaaccattgtaactcgttatcctctcgagctgatcggccaaatcagctttttaagcaatcaatcttgcgtggtttttgcagtaacttataagaaacgtttccatataatgctgagcccattctcaatttccatcagattatataacgtctaactgtttctaagtaatgattttatactccatataacatataaccgattgctataacatgctgtatacacgtctaatatgattattatacatgtaaataaatgaaactatatcgcaaatagaaatggtaagcaataatgcgaaggcgttaaaaagataattatacgaagaaataggaaaacaaacatcaaattaagatttacaagtcaagtaacgaccgttacggctttataacattgacgattaacctaacaaaaattatttgcctactacaaaaatatttcagtcttataattataaagcttcctcttttcttcttcttcaattcatccgaagctaaaagaaaacactagaggaggtgaagatttttaaaaatg

SEQ ID NO: 9291 - DNA, 3000 bp, Unknown
  misc_feature (1)..( 3000): cDNA_ID_2026721_gDNA_ID_1972067_Annot_ID_178414 3000 nt of promoter + ATG
atgtacataagaaatcacaattacataagataccagtcgaaaaaacattaatattgtgtagcgtttcgaaaatatactctgtttgaaactttgaatataagcgggttttcactgtaagatgttaaatttagaaggatttttttttaaatctatcgtaatattaatgacagcaataaattgggttatcaaaaatgctaatggcgtttaaaagtttttaggtgttaatttggtaggagatgtatcagttgcgtgtcctacgtgtaattgtgaaagcaacaacgcaaagaaaatgaagccttgatgaaaatatatgtttaaaacaaaattaattgacggaaatagtatgttttaaattaatgttctaattgtacaatagaaaaagcatgtacatgtacaaaactcagttatattgtaatcaaatttattgatctgtaattcatgcttgtttatgacttttttgaccggccgatagagcggcggacgcaactttgggatctgaagatattaaaagaaaatgttcctaaagaattctaatatcgaagttgattctcatcgtttcttactttatttctttatgatctcaaaatcatcaccctttagaaaatttgtttcatgaccagaaaatatgcaagtgttaacatgttttaatttagactgttttcaaaatttacagttgttatttagtaaaatttagcaatgaatacaaacaaaacgatacaccaaattaatgtttgtagtatttactatttagtaaatgcatggtactgtggtagactcgctaagtaaattgcatgtgttacattttaatatgtaaccagtaacctcatgcatgtgtatctctttcaagtttcaacaacctttttgttttttagaagtaaaaacttaaaattctttaattggcggacagaaagataaggcgattactcaccagaccaacaaaattaaatggaaattaaatacatatagagtaattaaatggctctgtgaccaaaacatggaattaatgggcgttattcattagaccagtaaaattgactggaaattaaatatatatagtaatgatacgatggtcctgcgacgaaggaggagccatgtctacgcaactcatccaataagcaacacaagctattcttttttacttctttcatgattgtcagtttcttctttcatttattctatcattgcttgagatatgtattctttaatagaagttaaatagtgtgtacatataccatgttgtcactttttaacaaacaaaaagtcatatggtatcatcatcatgtcgcatgaagaggagctacaacatttcttgattcatgcgttacgtggtctaacaaagggaatgtgatgaattgtcgctctgggagtaatttcgaaacgaaagttttcttacctaaaactctttattaattatctgagtttctgtagagagaaatagcatcaatttaaagcttgaaaagtttaacacatctttgacaaaacaaatttaggaagaccaaaaccaaaataattactatttctctctatctgttttcagtggggggacgaaagacctttctttctttttggtaatgggccgggccgggccggtttaatccaaggcaaatggcaagatccgtagagttttacatacaaactttactctagtgtaaacaagaaagtcagaaaccgcatgcgttatagttagtgaaaggttcgatttctgtcaggtcttcgcatccgtcacgtttgctatctcgaacttcagggagcatattacaaacgtaaaagaaattgatatattacgctaattaatttattcccgttgttgtcaagaaactaatgtcttaattagccttttaggttaaaccctaatttttgtcgatttaagttttgaaaaacgaattttgattgtttggattttggtaaaaggagatcagagttcatcgctggtaccatgttggttaactggctcgccgggagacccagcaataagttttatgctctccaaaagtcaatagacgagctacacaaggtattatcatatatattggcaattgatgtttttaagttcctatttatttttctgtgacattgaatctattttcaaaagcacccaataatgtggttctcattctttttttctgatcactaatgtgtgttcacctcaagacgctcgagtctcttgaacaaaaagaaaaggtttctctgctgccgtacagtacaaggaagcgaaaacatgttacctggcaggttacaaaacatgttacctggcaggttacaaaacaagtatgaaacatcttttgattttgaagcacgaaaaagtaaaatatcttattatcttttatggatcaatttaaaacatgtgtgttgaatcttgtcatgcaggtgctaaactttgtttgaaagagaagaggattcacgagcgaacagctcaatataataggaattgtcagcttctcttacatgaagctgtgagttttttctttttctttttgtgtcttactaaattatttttttattaactactttttaagcgatgaattgaatttattgtcactatttttctttcttcttaattatacagctgattttgtgtgaaagtagaaaagaacaaatgattgaagctatgcgggatggagattttactacgcagaagacaatgcaagtttttatttatctttgtttgttccttttaatcttaacttatttgtatcaatctaactcatgtattatcctacgtctatctagactgatcggacggacataatgtgtatccatatttcttggctacgcgtgtccaccttttagagactatgcctttaggtagtagatgttttactacaaaataaacatatttagtcaaataaaataaaatttgagagaatcttctacataagtagctcacagacccaaccaaaggaccattgaataccatatatatatagatacacagacatataaacacacaaatattcgtgtttttttcaaactgtgagagaaaaagaaagagagaaagag

SEQ ID NO: 9292 - DNA, 3000 bp, Unknown
  misc_feature (1)..( 3000): cDNA_ID_3610508_gDNA_ID_1972067_Annot_ID_178416 3000 nt of promoter + ATG
gttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtggtactgtattgtccaaattactttcgaatttggtttatctgataatttccaaaagatctcaattctttgtttgggtgcagcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccaggtttgtgatttcttcttactctggcttcattacccaaaccttattagtttcattcaatatttcttgtatgcaaaaaactctgttgaaatactctctttcttagttttccattgggctgagtgagtttatttaactgcattagtctatttatgaaccaatctactatttcaacgttatttagtgcaaatgtacaaatttatctgatgcatcatttctcttgtttcacaagatattatatttattatctgcaaaactctgtgttgaagtgaagcttctcctaataactgtttcagcgggctgtgacgctagtaactccatttagtctgtaaccaactcttgtagaaatcaaccttataggtttatctgatgaatcaactctcttgatttagaagatatctgaattttcggtggtcttttttttttttgtttcttgggctttattcttaatcatactgattacaagatcgttcaaactttgcatcctcatttgaccagcaattttactgtgcatcatatgaactcacttaattgatcagtaaatgttgaccagaagtagaatgatttgttgttttagtgaaaatgcagttttaatccttcatcagcaaaattgattgaagcatttggtttcagataatttatgcgtcgtctggggttcacttgtaatttgttgtaggaaatccagtcagccagcaagagtctcatcaacatcaatgagccaccgagagagacagctccactggatatcgaatcggaccaacagaatcatcatgagaatgacctcaagccggaggagcataacaacaataataattatgatgaaaacgaggaaacactcaaacgcgagcagatggaagaagaggagcgtcctcctcgacctgtatgcgttctcaacaaagaagctccattacctcttctgcaatacaaacgtagacgccaaagcgagtccaacaacaactcaagcaggaacacacaggaccattgttcgtccacaacaacaactgtcgacaatacaaccactttaatctcatcatctgccgctgccaccaacactgccatctctgcattgcttgagttctcactcatgggtatctccgacaagaaagaaaagccgcagcaaccgctacgtcctcacaaggaacctttgcctcctcaaactccacttgcatctcctgaagagaaggttaatgatctccagaaggagattcaccagatgtctgttgaaagagaaactttcaagcttgaaatgatgagtgcagaagctatgatcagtattctccagtcaaggatcgatgcgctgcgtcaggagaacgaggaactcaagaagaacaatgctaatggacaataaaggctctaaaaacatctctccaggttacttcttattgcccttcgccttttatttagctttaatctccctaatactatgacccatctacatagctcctctagacagattgcgaactgtgtgaatctctgttgtaacataggataaaacggattcgagcccctgagctgagtgttttatccttcttctttttttgtgtggatgttcttgcatcttttgagaacattttttaggttgctccattgtcatatatcatctatctatctagtcttttcagacaaaaactatctttaagttgtctcgagaatgttgtcttcataacacactgagccttctctggggtagtagtggttaggtacgagggcataattgtcatttcctttgcattatcatttagatttccagacaagaagaactttctttgtttaaaataattgggaattatgttcggtctccggtaataccgtggttaatggtaaggatattttcggctaggattacgaatgtggatgcgtcagcgacgttagaagactttcgttacacgtaatttgcaataattttaaaaaagcgaaaaagtgtttggtacgattttttcaacttcaaatatattctctatttatttactctattcaaacaaaattgcatatagtatagaattttagtcatcttgatatttattgaagtggataaatcttcatttgcgcgaaccaaccaactacctcaacaaattctagagactttaaaattgatgactagtgcaagacttccacgtgtcagtttaataaagactgtcacccgaaaacagtcacagccagtcacatgatatgctctcgcggcacactttcctggaatattaaaacctcacggcgtgaaacttctttcgcacattttctagctacggtcgcttagctccgattggttcgtcgtcaccatcactcgtcttcaacgatttgcttcttttttttttctctctatttagtcccattttcctcaatttctaaaccccttatttcgaaatcattgttttgctctttcttttgattcgaattcgacagaacagctcttttaagttattcataaaccttgtgtttgagttttggtccatcgagtatatg

SEQ ID NO: 9293 - DNA, 3000 bp, Unknown
  misc_feature (1)..( 3000): cDNA_ID_3041106_gDNA_ID_1972067_Annot_ID_178424 3000 nt of promoter + ATG
atgttatcgatttgtatgtaattttcgatcaccataattgtaaactaagttaatcactcgtttgccaaaaaaaaaaaaagttaatcacttaaaaaattgccacattttctttccaggagcaaacccttccatgtacgcgtcatgcatcaaaagtcaaggtacttatgattattggcttttgtacttatggaataggacatttcgaccctactgctccattgttcttatgttttcttctgcattgttgtgaccttcaggctcaagcaaatgcttgtggtggggcttgcaaaacctttcagccaaatgatgcagatcatgagcatggtaagataaatcacagtcaaagatgaaatgtaactctttcggttttcattgttggttctaggaatctcttagcgtgatcacccttattgacttttttgtttcattttcagcttccgggagctccaacgctaactcattgcaaagaaatgagaaagccaacagtaaaaggttgggtctctcttgatgtttcaaccattgtcttataaaaacttttggacaatcttgttatcctggatttcttgcttttctttataggagagtttctggaaggaagaatcccgccaattccgaggtattagatataattggcagatcgggagagacatgtcagatggaagacaacattgacaacaagaagttggtctctgatagtgacaatgatgctgaaaaccatataaatgacaatgtccaaagcaaaaggtttatttattcaaagcgattagataacgtaaatatatatttgtatttcactatcttatttttgcttcttcttttttgggttgtttttgctacagatattgtgcaggaagacagagtagcagttctaagactcgagaagccagccaaacagaaaccttgcaaaaggtggttgacgccaaagaaattaagggggatgcaaggtttgtttaactgcctttttccactttcaaatttgggaatagcattcaaagtggatgaagaatagtggaactgacttgtgagtatacactttctctgtttcaaacaggttttctttgacaaagcattctgactggttaaaatctcaagaacctgagccatctgaaagcctatacgagtcaaggttggttaactgtcctttttccagtttcaaattttggactaacatctaaagcctgtgaagactattggaaatgactagtgattttgcactctttgtttcaagcaggttccctttgagaaggcgttctgcccggttaaaatctcaagaacctgagccatctgaaagcttccatgactcaatagagacaaccaagaggaggaggtcggcaataaggttaggctctgtttataactactgtacccttctgaaggttgatatagtgcgatatgatcttttgcaggtctgctatgtttaatatccaagagctgggcgttattcaaaacttgaacggtttacctgatgatcaagagattgctgcaaaggccaggtttgtagaagcacatgttatttccttttccactaacatatccctgaaccaagtacacttatgccatttgcggtgttttctttttctttctttgtggatgtcatttcagatgctctgcacgtgaacagtctaccgggtctaaacccgaagcagtagaaccacatgacacaaaagagataatcgggaaaagcaggttttgtagtgatagataattgtctgtattctgcagtattacagactaaagtgttaagactgttatctaatgcgattttattttccgcaggatatctttgagaagacagtctgcgaggtttaatttccaagagctgggcgtgactgaaaacttgaatggtccacatgatgatcaaacgattgctgcaaatgccaggtttgtagtagcttcacatgttctttccttttccaatcctcttgacttataacttattcataaaccaagtacatttatgctacttcctctgatttctttatggatgtcattttagatgctgtgcaagtgaacagtctatcgggtctaaacccgaagcagtagaaccacatgacattgaagagagaatcgggaaaatcaggtttgtagtgaatatagatcaattttctatattccgttaaagtaaagacgtaagaatttttatctaaactggtatacttgacagagtctcttcaagaagacaatctgcaaacattgaaactccgagagccatcaaagaacctgcaaatccgcctttgcatgatgacaatgttgaggagtctagtcagatatcatgttcagtttcaatggagcttaaaagagaatcaaagaagaaaccaacaggcgacgaatcagaggaaatgagaaaaacaactgttggaagaccttcaaggcaagctgctgaaaaaatcaaatcgtacaaggaaccttcacttaaggagaagatgcgagggggcttctgagtcttgctaagatcgaataccctctcgtcagcctcgtatgtattggattctgcgacttcacttttgttcagtgagctattgctcaatgctgtagatcacaatgtatattcgtagttgcttgtagataaagctagcgagtggtcttgctactgtacatgaagcggattggacggtttaattcggtttgatggagaacccctctgtgtactctgctaagtaaattctttcacaatctcatttgtaaaggggtgaaataatattttcttcatttttttcttacagtaaataaattagtaaaaacaagctctctaattatatcatgggtaataaaactcgagcggtggtaaaacaaaaacctgacagttttgagttgacaacgaaccccataattcaaagattgggagacagtgaaaagtacacaagtgaatcacggtacgcaatctaccgccttatttcttaaaagataattctaaggatttttgttcttttcttgttgttttcctataaaaggtttaataattgttactttaaaggttttgatttatcagataaacgaatg

SEQ ID NO: 9294 - DNA, 3000 bp, Unknown
  misc_feature (1)..( 3000): cDNA_ID_3041098_gDNA_ID_1972067_Annot_ID_178428 3000 nt of promoter + ATG
actaacttatgaggaacatcgtcttcgccacgaatttgacggatctcaaatggagcggatttccctataataacaaagaagtttgttcggtttggttttaccatttgttaactcaattacactttattgggagaggaagtcttttaagttttaacttaccagctagtatagcatcaacggtaacatctagtctttgatgaacacgacactcagttctcgatatcatctctacagcacaagtgaatgtcggaggtccttttctttcaagaattgtcttctgcacttttcttttccttgcttcttcatcaccaagagtcacactctgggcaaaataaattcaaattaaggttagagaagataaacaacagaacaaaataagaagcaaagttgttgtctaaggttttacctcaattccaccaataagaatctgcaaagaaggatttttgattatgttgtctatagtcatcccatgagcagttgcaacaagctgaacacctcgttgagcaatagtgctagcagctaaagcttcaagctcagttcctatctcgtcaatgatgattgtctcaggcatatgattctcaaccgcctcaatcataacctgcataaagaacttgttaatacagcaagatccttttgattccatcctacaccatattattacaaggttataaagttgcgagacatacatcgtgctgtaaattcacatttggaacttgcatccgcctggcacgaccaattccagaatgaggaacatcaccatcacctccaatctcatttgacgtgtcaacaatcactacacgtttcctgtgttcatcagctaacatccgtgcaatttctctgtacaaaacaaaccaatcttgtcatataccatttatcaatcacagttttaacagaaagatcatcacattataagttcatattgatgtacctgattaaagttgttttgccaactccaggagatccaatgaccaagatggatcctcctccttcaatcaagtctcttataatttctgcacttccagagactactcgacccactcgacatgttagaccaattacttgcagtttgcgattacgtatagcgcttatacgatgcaaagatctgtcaatcccggatcggttatcatccgaaaaatcaccaacctaaattcaaaacattttgattcagacacagaagagaccataatcagtataagcaagtcttatcagtcttgaagaactgcaataagctaaaacatttgagaaattagttgcatgtcttagatcagagacacacatacctttgataccgcaagctccagatcctggtgtgtcacaggctgctctgagatcacccaatcgccggaagggaatctagcaagtggctttctccctaaatccatcactacttcgatcaattcctcaatcgcctcgtgcttaacaagctccttcctcgtcgccggaggaagaatctctaggaaagcgtcgagctccaccgtaggcggagccgtcgtcggtgacttccgtgatgagatcgatgaatcagatgacggtgaccgaacatcgaaactgaatccatcagatggtctccgaacaggagacggtgacgacgccggggatttcgatgaagcgattctctgacgcgcaccacgtgtccgacggaatgaggaagaggaatcagatgaaaaagcggttgcggtggctgagattaaccggcgcgaagcttgccaggagctgttgatgtcgatcagaactagccgcgaattcaacgccctcatcacgattaattaattattttttttaattatgtactttcaaataaaaaatgaattaaataaaagattctgtcttttcgttttagctactggtgtgtatatctgtctggaaagcagaaatgaagaagctaaaaaggaaaagctgaggaggagaagagctatgaagcacaacgaaacgacaacgttttgagtattagttcttttttcatttcatttttttggaatatgatgatgcgtgaagactgaaactagtggaagattccaaaggatcaaagcatctaattacacagaaactgcatctgtatagaacaaagtagggtccattgtagagggaaagatgataacatagccgttcaagcaactggttcacgtggcgccacgtggagagttggacaatcttgttgacacgtgtctgactatggagctaccgtttattgccaattcgtttggaactctttgacaaatttagcccaaagtcggagttggtgtttctcgcacggcagatgcaaaagtcgtcaactttttagctctgcaaattgagatttgaaccaaaattgctgactaaattaaaccaaacaaaaaccagactaaatgaatgaaatacaagtcaacccaaacattgtgtatctacaacgacggttccttaatttcttgagtcatcttcgttttttagccgaatgggcttttaggtgctttacaaatagtggtttaggattgggccttctaatcagaaacacaccttgtagaatattacattcactataaaatgtaaggtttacattcacgtgaggcccataagtgtttttgtaataattaatttaatatatagtgtaaacttaatattaatatcaaaccgaccttagctcagttggtagagcggaagactgtaatgggtaattccaaagaaatctttaggtcgctggttcgattccggcaggttgaatatttttaacattttatttcacttttaaattatctgggacccacactcatccatcttttgcttcacattcaactcgcgtgcctaaccgtcgattactacgccaaacgttatctttgttgtaacgtaacagattcacccactatttctcatatttcgcaaaatagccccaactttctcgggcacgtatcggaagatatttctgtgatagttcctgccacgtgtacattctctcctcccccaaattgttgtatacaacaatctcagaaaaggaaaaaaaaagaagcacagttgaaagaaccaaaa

SEQ ID NO: 9295 - DNA, 3000 bp, Unknown
  misc_feature (1)..( 3000): cDNA_ID_2034818_gDNA_ID_1972067_Annot_ID_178427 3000 nt of promoter + ATG
aaatatgaaacacaatttctttctacaagtaaggatagaaatggtttgccagaacgaattatatctagaaatccaacgagcaataaaaattgagcagttcttttgggcttacgtttactccaccagcatgactcattacaccactgaacaaagagttgcagacaagatatgatgccaaacaagaagttgtgccatcagttcctggtaaaacaaaaacacggattcaggattcatcaaacacagagcaattttaaagataaattgataaggaataaaggagtaagtaccacaaagcttgattgatagttcgcacagtgggacaatcttttctaagcgatcatgctctttttgcgtgattagacccatttccaaagcgtagtcaggataggctgggtattggagtgcaggatctgtaagcccatttccaatagcgaatccctgcaaggttatacttgtgagtactacagacttccattaacaccttaagagagaaacaagaaatagtcacatgcctttaggttaatatgaactccctcattagccttgtttcctttatggactcgggaagcaaaagctgggatatagtgcccagcatatgactctccagtaatataaaagtcgttttttgccaacttagggtgctccgcaaagaaagcctgaggtaacatcagcaaacttcatcaagatcttgttacacagctaagcaaacaaaggcagattcccattttttcgaagactcaagaaaaccaaaacagtctaacagagttgttgtttatccaattcatagctttaaagcagaaaagtgcagtatagaaaggaattcaagagaagatccagtgacctaacctgcagaaaatcataaagatcattgctaactccagtttcgtcatgacggatatcacttttatctgtcgtgtagctgaaaccagttccaacaggctgatcaacatacagaagattggaaacctgcaagacaaactctctatcaactctcatgtgcaataatctggaatattaaggcggtttgggattataatagaaagtaataatacctgatcccatccatactcattccaagcaagagacatgttactagtgatcttgaaaggaccattctcatagaacacagccaactcactactacatccaggccctcccgtcaaccaaatcacaacaggagcatccttcttgttccgtgactcgaagaagaagtagaacatgctaacacacaccaagcaaacaaatcaacaaacaaagcaaacaaacatttataatctattcccactactttgagattccaattagaaaaacgtcaccaacagtccaatgttctaatcgaatcaaacataacctagtcaagagctagctgcaagcttctatatacctatgaaccaaaatctaaagtcagatataaaccttgcgccacgagatttcgggagcttgtaataaccagcatgatgacctaaatcgtcgacagtagggccaccatcggcaagtatattcgggaatacgaacttccgttcaacaatccccggtccctccgcagcagtgagaggcaaatcagcgacatcgatcacattcagatcctgctgcgggaaaaggtttagctcacggatcagcttctccgcgcgcgtagacggcaagttcgatctctcaaaggtgcgatcattcaagaggaacgatgaagacggtatcgttgaagcgatgaagacgacgaaatgcaggagaaggctgagaaaagttagtttctccatttttggttctttcaactgtgcttctttttttttccttttctgagattgttgtatacaacaatttgggggaggagagaatgtacacgtggcaggaactatcacagaaatatcttccgatacgtgcccgagaaagttggggctattttgcgaaatatgagaaatagtgggtgaatctgttacgttacaacaaagataacgtttggcgtagtaatcgacggttaggcacgcgagttgaatgtgaagcaaaagatggatgagtgtgggtcccagataatttaaaagtgaaataaaatgttaaaaatattcaacctgccggaatcgaaccagcgacctaaagatttctttggaattacccattacagtcttccgctctaccaactgagctaaggtcggtttgatattaatattaagtttacactatatattaaattaattattacaaaaacacttatgggcctcacgtgaatgtaaaccttacattttatagtgaatgtaatattctacaaggtgtgtttctgattagaaggcccaatcctaaaccactatttgtaaagcacctaaaagcccattcggctaaaaaacgaagatgactcaagaaattaaggaaccgtcgttgtagatacacaatgtttgggttgacttgtatttcattcatttagtctggtttttgtttggtttaatttagtcagcaattttggttcaaatctcaatttgcagagctaaaaagttgacgacttttgcatctgccgtgcgagaaacaccaactccgactttgggctaaatttgtcaaagagttccaaacgaattggcaataaacggtagctccatagtcagacacgtgtcaacaagattgtccaactctccacgtggcgccacgtgaaccagttgcttgaacggctatgttatcatctttccctctacaatggaccctactttgttctatacagatgcagtttctgtgtaattagatgctttgatcctttggaatcttccactagtttcagtcttcacgcatcatcatattccaaaaaaatgaaatgaaaaaagaactaatactcaaaacgttgtcgtttcgttgtgcttcatagctcttctcctcctcagcttttcctttttagcttcttcatttctgctttccagacagatatacacaccagtagctaaaacgaaaagacagaatcttttatttaattcattttttatttgaaagtacataattaaaaaaaataattaattaatcgtgatg

SEQ ID NO: 9296 - DNA, 3000 bp, Unknown
  misc_feature (1)..( 3000): cDNA_ID_3041094_gDNA_ID_1972067_Annot_ID_178430 3000 nt of promoter + ATG
attacattttgattaggaaccacattatatccaaatggcgagaaaatatatctagttgggtcacaaaggagatgtttcttaattcgattcctaaacattgtagtagtctcttagattcggcttataattacttggttacacatggatatatcaattttggaatagcacaggcgattaaagataagtttcctgctcagtcaagcaagtctagtgtgattatagttggtgctggtttatctgggttggctgcagctaggcaactgatgaggtttggcttcaaagtcacggttttggagggtaggaaacgacccggtggacgggtttataccaaaaagatggaagctaatagggtaggtgctgcagcggatttaggtgggagtgttttgactggaacattaggaaatcctttagggattatagcgagacagcttggttcttctctctataaggtacgagacaagtgtcctctttatagggtggatggtaagccggttgatccagatgtggatataaaggttgaggtagcgtttaaccagcttctagacaaggcaagtaaacttaggcagttgatgggtgatgtttccatggatgtctcccttggggcagcactcgagacattcaggcaggtttctgggaatgatgtggccaccgaggagatgggtttgtttaactggcatcttgctaacttggagtatgcaaatgcgggcctagtatcaaagctttctcttgcattctgggatcaagatgacccatatgatatgggtggagatcactgctttctgcctggaggaaatggaaggctggttcaggctttggctgaaaatgtaccaatattatatgagaagaccgtccaaacaatcagatatggttcaaatggtgtcaaggtaactgctggaaatcaagtgtatgagggtgatatggtgctgtgtacagttccccttggtgtccttaagaacggatccatcaaatttgttcccgaattacctcagagaaagcttgattgtataaagagattaggttttgggttactgaataaagttgcaatgctctttccgtatgtattttggagcacagatctcgatacctttgggcatcttactgaggatccgaactatcgaggtgaattctttctgttctatagctacgcaccggttgctggtggtgctctcttgatcgcgttggttgcgggagaagctgctcataagtttgagacaatgccacccactgacgcagtgactcgtgttcttcatattcttaggggtaatagatttcactatctattgattgtcatttaattgaatttcaatttttacctgtcaatatcaatcttcaagaattattagttgaggatttgtattccagatttgttaaagttgatgctagcgtctgacgcaagttccattttaatgaatatcaggtatttatgaacctcaaggaataaatgtccctgatccacttcaaacggtctgcaccagatggggtggggatccattcagtttaggatcttactctaatgttgcagtgggagcttcaggcgatgattacgatatattagcagaaagtgtgggagatggaaggcttttctttgccggagaagccacaacaaggcgataccctgcaaccatgcatggagcttttgttactggtctgcgagaagctgcaaacatggctcaatctgcaaaggcccgaggcataaggaaaagaatcgataggaacccatcaaggaatgctcattcctgtgccattcttcttgcagatttatttagggaccctgatctggaatttgggagtttttgcataatctttagtaggaggaatccagacccaaaatctcctgctattttgagggtaactctaagcgagcctcgtaagagaaacgaggacccaaaagcagatcagcactcaaacaagatactgtttcagcagcttcagtctcatttcaaccagcagcaacagattcaggtgtatacattattaactagacaacaggctcttgacctgagagaagtcagaggtggtgatgaaaagagactatactatctctgtgagacacttggagtgaaactggtggggagaaaaggtcttggtgttggagctgattcagtcattgcttctattaaagccgagcgaactggtcgcaagctaccatcatcatctacctcaggcacaaaatctggttaggctccgtaatttcctgatttgattactccttacttaccggatagaaccagtagcaacatctctaacttcttctatattgagtaggtatattaaaagcaaaatccggtgcattgaagcggaagatgatcaggtttgctacgaaatcatatgtgcaataatttctctcacttatcaaaaacaacattacagagaacctttctgttgcacagaaggattaaaggaccgttgccgctgaagcaaagtaataacaatggcgtctcagagagtataaaatcagagtctttaggtaatggcaaatccttagagcaacaacaacaacctagaatagtagagtcgataggaggaggtagcagcatgcaaggggaaagcaagtctttgagcacaggagttgcatctagttctggtattcatttttcgtaacttctttgttccttttgaaattctgatcatttacatcgataataactcacacgtaggtggttccttacatgttggtggtgagacgatgaaaaagattgaacaatgacttttggagaatccctgtttgatacaacatctgtagttcacaaaatttgtacttcataatccatttctattgtaacaactaacaaatttaagttataaattttttcctaatgataatttgtctggtatgtttccagactttttatttgcaaatgtaaaaagaaaatatttgattttttcttgcttcattacatcgaattttttttgtttgttctttaccaatataaatacaaataccctttgaaagctcagctttcaaaactggaacacaaaaattgaaattaagtggaaatg

SEQ ID NO: 9297 - DNA, 3000 bp, Unknown
  misc_feature (1)..( 3000): cDNA_ID_3041096_gDNA_ID_1972067_Annot_ID_178429 3000 nt of promoter + ATG
tatacaacaatctcagaaaaggaaaaaaaaagaagcacagttgaaagaaccaaaaatggagaaactaacttttctcagccttctcctgcatttcgtcgtcttcatcgcttcaacgataccgtcttcatcgttcctcttgaatgatcgcacctttgagagatcgaacttgccgtctacgcgcgcggagaagctgatccgtgagctaaaccttttcccgcagcaggatctgaatgtgatcgatgtcgctgatttgcctctcactgctgcggagggaccggggattgttgaacggaagttcgtattcccgaatatacttgccgatggtggccctactgtcgacgatttaggtcatcatgctggttattacaagctcccgaaatctcgtggcgcaaggtttatatctgactttagattttggttcataggtatatagaagcttgcagctagctcttgactaggttatgtttgattcgattagaacattggactgttggtgacgtttttctaattggaatctcaaagtagtgggaatagattataaatgtttgtttgctttgtttgttgatttgtttgcttggtgtgtgttagcatgttctacttcttcttcgagtcacggaacaagaaggatgctcctgttgtgatttggttgacgggagggcctggatgtagtagtgagttggctgtgttctatgagaatggtcctttcaagatcactagtaacatgtctcttgcttggaatgagtatggatgggatcaggtattattactttctattataatcccaaaccgccttaatattccagattattgcacatgagagttgatagagagtttgtcttgcaggtttccaatcttctgtatgttgatcagcctgttggaactggtttcagctacacgacagataaaagtgatatccgtcatgacgaaactggagttagcaatgatctttatgattttctgcaggttaggtcactggatcttctcttgaattcctttctatactgcacttttctgctttaaagctatgaattggataaacaacaactctgttagactgttttggttttcttgagtcttcgaaaaaatgggaatctgcctttgtttgcttagctgtgtaacaagatcttgatgaagtttgctgatgttacctcaggctttctttgcggagcaccctaagttggcaaaaaacgacttttatattactggagagtcatatgctgggcactatatcccagcttttgcttcccgagtccataaaggaaacaaggctaatgagggagttcatattaacctaaaggcatgtgactatttcttgtttctctcttaaggtgttaatggaagtctgtagtactcacaagtataaccttgcagggattcgctattggaaatgggcttacagatcctgcactccaatacccagcctatcctgactacgctttggaaatgggtctaatcacgcaaaaagagcatgatcgcttagaaaagattgtcccactgtgcgaactatcaatcaagctttgtggtacttactcctttattccttatcaatttatctttaaaattgctctgtgtttgatgaatcctgaatccgtgtttttgttttaccaggaactgatggcacaacttcttgtttggcatcatatcttgtctgcaactctttgttcagtggtgtaatgagtcatgctggtggagtaaacgtaagcccaaaagaactgctcaatttttattgctcgttggatttctagatataattcgttctggcaaaccatttctatccttacttgtagaaagaaattgtgtttcatatttctgcatttgaagtaaggaaacaaggctaatgagggagttcacatatctttgtgtagtattacgacatcaggaagaagtgcgtgggaagtttgtgctacgatttctcaaacatggagaaatttttgaatctgcaatctgtgaggaagtcacttggtgttggggacatagactttgtctcctgcagtacttcagtctatcaggcaatgcttgtagattggatgaggaatctcgaggttggaattcccacgctcttggaagatggaatcagcctccttgtgtatgctggagaatatgatcttatctgcaactggctcggtaagttccaaaacatagataatcaaatccagacatgaaaataatgaaatagattgatttgaactgttgagggaaacaaaattggagcaggtaactcgaggtgggtgaatgcaatggagtggtcagggaaaacaaactttggggcggctaaagaagttccgtttattgtggatggcaaagaagcaggcttgttaaagacttatgaacaactcagtttcctcaaggtcggcctttcttgcataataacaacagtcgttctttggttctactggttttcttatagtatgtaacaacaacaaagggtttgatgatttaaacataaaaacacaggtgagagatgcaggacacatggttccaatggaccagcctaaagctgcattgaaaatgctgaagcgatggatggagaattcacttatcgaagatgctactgtgactgttgctgctcagggaggagaggaactggttgctcagatgtgatcacatcttcttttgcgttgcatgaaaacaaaaggcagcaaacataaaacaatgtgtgagcaattgacgttttcttctgtaatttgatctcataagtcataagaaagatacagtatatgtaggggttgcccaatttcgttataaaatcaaactctgctgacaccaaaaacataataattactacgaaatgtgttatctatgtttgtttccgaaataacgaaatgtataaaacaaaacttaaaacgttgtttatacaaaataaagccgaggtaggcttgcaagagtaatgaacaggttttgatgcggtttatgtacatgacacatggcaaaacatgattggctacatgaacgattttatctaacaagcaagatagagatgagattaggagacaaggagca

SEQ ID NO: 9298 - DNA, 3000 bp, Unknown
  misc_feature (1)..( 3000): cDNA_ID_3041114_gDNA_ID_1972067_Annot_ID_178418 3000 nt of promoter + ATG
taagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaacaaaattaagcagaaattgatgaaccatttttttaagaaagttactgattccttgctttgtacaagacttgcaagattcttctctcttttttttcctttcttacttccttaatttcaaaggaaaaaccatatattatacaaatatatatactcccattaggcatatgcaatgctttgtaattacatccaagttaatgtaagatcttttggttacacaatataaataataaaaaccacattcgtttactattggggctttctcataaagagaccacattcccaacatccttctttgtatatatttaaatgaatcaactaaaatacatagaaataaaaaatttctctatactattattttcagttgatccattcaaatcattttctaaaaacttatgtcacgttcatgtatacttttagttaaagaatgtttttttttttttggattggaaaaaaaaaaagctcaaaccttttaagaaaataaagctcatgaaaagagcgtgacgggtccaactcttttttttggttaaatttgcaatttaaacagattacttgttcatgttgacattgaaatagcaggtcgagagcgagagatcaaaatgcaatgtattatgcccttaatttatgcttttatatattttgtttattaatgtcacatatcttattatggatatactttgcaacggatcacaaatcttaccctgaaatatgcaacctgttaccggaattgaaatttcataacacactattctcagctcttcaagattcagtgtttcattcgtgaagacgaatgcatgttgttctagtctcgatacgagaaactgcgtttatgaaaataagaaaaagaagaataaattagcatgggcttgatttacacccgtccgtcaccgaaatgggctacaaataaatcatgggcttttaatattctaacttagaagaaatttggcccattgcttaaacacgaggcacaaaccatatattttttttgagccaaaaaaaaaagtcttgatattttagcattttgtcctttttggagacagtggtgtcagatagctgacaacctatataaataaataaataaaatagagttttcttttactcttactttctttattagtttcataataatatgtgtaaaagtaagagttggatatttttcgttttaatttctgccttcgaattagttacgcatacaaagcataagagacaagagacatagcgtaccaaaaaagaagaaaatagtgcaaaaatatcatatagttttctggtacgcctcatcaattccacccccgtacaccataattatatagaatttcaatatcgaaatgtcgacagcaacaaaattcaacatgtcgaataatattgttttaaatattccattttactagaagatgaaaaaaagagagaagaaagtaaccttttgtctttgtcaccttgacttaaacagtaatacaaaccccacaagtaaattattcaagttcaaatcgtagttaatgtttatatttgagaattgcaaatggtttaaacgaaaaccaaactacgaattacaaatttgaagaggacttgtactagaaaataaatagagaaaagaagaataataaatagtaacagaaaatgggaaagatgatgattcgtgtggaccaagtctctcctcccctttagcttgccttattggtaaagtatcctcctgcaagcaaacgtatctgtcactccttttttattttctttcaccttctatcttattctcattaattcttcttttttggtcaacttcatgtatagaaaataataccaaaattttttgatatagtaaaactattagaactgaatttcaaacaaaaataatacaaatttaagcaaaaaaatattaaaaataaattttaaagaatatttttacatataataaatatacatagttgatacttttatataattattaatttatgatattaatgagaccatatatttacatagaacattcaaaataattattatcttattaatctatcgatatatatcactttttatactagtttttggaatcttaataatttattaatttgtagaagttattaatttatagaggttttactgtacatgtcagcatttaacttttgataagcacaaaaccattacatattttccaaccagattattttctatttatcctagcgtttgtaaatctttgaactacaataatttatcaaatacaatataagatttttatactaaagatgtatacaatgcatttaacattaaaggaaacaaataaactctaatcttttaaaaaaatactttaccttttaaaaagagttattaatcacataagcaatatttaatttttcattatttttttcatcatctgtctaacatattactttttaaaaaatatttatcgttggatacttacttttcagaccacacactaggactagtggttcctttattttactgcatagaacgacaacaaaaagctaagcagtaacattttttagggttttattactgcaacactcaaaaatgagaaattattattaaaattgaaaatgaaaaatagtaatcgcaatccgaaattactttttttctagccttctaggaactcgaaaagaaagcaaatttcttgcaattgaaggtacctgcttctctttttctggtttgtctggtttcatattaaaaaaaacattttgacaactatatttctggtttgtctgaaaaaattgagaagaaaacctagaaacaaatacggtcttttttttttctttttatg

SEQ ID NO: 9299 - DNA, 3000 bp, Unknown
  misc_feature (1)..( 3000): cDNA_ID_2034846_gDNA_ID_1972067_Annot_ID_178415 3000 nt of promoter + ATG
aaacatgttacctggcaggttacaaaacatgttacctggcaggttacaaaacaagtatgaaacatcttttgattttgaagcacgaaaaagtaaaatatcttattatcttttatggatcaatttaaaacatgtgtgttgaatcttgtcatgcaggtgctaaactttgtttgaaagagaagaggattcacgagcgaacagctcaatataataggaattgtcagcttctcttacatgaagctgtgagttttttctttttctttttgtgtcttactaaattatttttttattaactactttttaagcgatgaattgaatttattgtcactatttttctttcttcttaattatacagctgattttgtgtgaaagtagaaaagaacaaatgattgaagctatgcgggatggagattttactacgcagaagacaatgcaagtttttatttatctttgtttgttccttttaatcttaacttatttgtatcaatctaactcatgtattatcctacgtctatctagactgatcggacggacataatgtgtatccatatttcttggctacgcgtgtccaccttttagagactatgcctttaggtagtagatgttttactacaaaataaacatatttagtcaaataaaataaaatttgagagaatcttctacataagtagctcacagacccaaccaaaggaccattgaataccatatatatatagatacacagacatataaacacacaaatattcgtgtttttttcaaactgtgagagaaaaagaaagagagaaagagatgggagagattgggtttacagagaagcaagaagctttggtgaaggaatcgtgggagatactgaaacaagacatccccaaatacagccttcacttcttctcacagtaaccatatatacttagttatatataagctctttacatgttgtttatatatgcgagctaatgaacaatataattgtgataggatactggagatagcaccagcagcaaaaggcttgttctctttcctaagagactcagatgaagtccctcacaacaatcctaaactcaaagctcatgctgttaaagtcttcaagatggtaattacttactttccgattttccacatctacatatatgtgaatcacttgcatatactgtatcattatcttacacttccttaaaattgaaagtagaatgtttcattatttacagctaagaatctttatttactcattatataccatttatatataatagaaaatagtagtctgaattaacttttcttgtcatttattgacgcagccatgtgcacacaagttgcgattttgtttgaacttggctagttggctttgtcttcttctttgagaataaaaatctcatactagtaaagaatactctgtgatattttatttttaagaacaaacatagatttctctgtcaataaagaattgttactgaagaatccaagtggttcgggtcgctttatggatttttacttttttgctaatcttattataatagaaccatataaaccaaattccgtttactttttaaatttgggtttatgacttggtttggttcaactcacttttggcttctaagactttgcataacatgttttagacagacaaaaaagaaaaagactttgcataacatgtatgaatttttattttattttgtttgtgtgtagacatgtgaaacagctatacagctgagggaggaaggaaaggtggtagtggctgacacaaccctccaatatttaggctcaattcatctcaaaagcggcgttattgaccctcacttcgaggtctgttatgttaaaaaaaaatatatatacacattaattttggctgattttgattttcgatttgaacgcattttaataaggtgtgaatgtgaaagcaggtggtgaaagaagctttgctaaggacattgaaagaggggttgggggagaaatacaatgaagaagtggaaggtgcttggtctcaagcttatgatcacttggctttagccatcaagaccgagatgaaacaagaagagtcataaaaccctattgatcatttgggtatcgcatacatgaatctattccacatacatgatacacatatacgtgtttctgtgtgtgtactatgttgctctctgactttctacagttcactattttaattataaagaaggatcttgtgctatcattagggagatacgtgatactgtagttcttcttgaaattgttattcgtgagaaatatcatggtttgaagtatttattttcacaagatggatgttaacgtggggatcattttacaatcattctacaaataattttacttctccagacacaagattttggatctattttagttcaattttttctttttttaaaaaacagtacactaaaactattttttatattaataatgtggtattagtctgatgcatgataaattttatgaattttaagatttgccccggtaaaaaagataatacacaatttcctagtaatatgttatatataaatctatctacaatgttactcttttttctgaaaatgatgaaattttgtgggccaaatagaacaaaaattcttgaaacagaaaattagttttcattttttaataaaataattatatgtattggaccacaactagacatttataattttatagtaattaagaagcaaatatttgatctaagtaaaatataaagaaaagcaccatatattaaaattatgaaagatttcctatttataaattaagatatcatattgaaggttaattttaagttcataaatggaatagaattcactaagaaaataattaaatttaaaataattgctaacagtaagatctcatcggataaaacttgtataattatgtttattcatgaatcatccttgcacctacgtatccatcttttccatcatctcatctatatatatgtacatttgcaaagctgagaagaaaaaacatcatattgtcgattgagcctatctctttatattatattgggag

SEQ ID NO: 9300 - DNA, 3000 bp, Unknown
  misc_feature (1)..( 3000): cDNA_ID_2033137_gDNA_ID_1972067_Annot_ID_178408 3000 nt of promoter + ATG
acacaaactcgctaagctagctgtatatttatgtaattaattattacatttgctgagtaattttacggcaaaatatgacatattttggacatgccacgtagaaaagcatgtgatgatgatatatactgtatatagagtagatctgtgtaagtgagtcagtggtaatatctaactaaaaaagtacagaaatggaaagatctatatgatctctctcgcaggatctcaatctctggcccttttttttgtcaacccttcttcctctcttattatgttcttctctctcttttcttttggttactgtaatttgtttttttgtttattgacattgacacgttttcttgcttcgatttttacggaaagagagatatgtatatgaggaattaggataagtcgatgtaattttgtaaggccacgaaaccatacgatcacaatcaaacaatctgtagcatttagaatccatcaattataatcgatgttgaagtttcggtggtccaatatacttacggttgttaaaactttggccaaaacgaatcgtctaaaagcaataccagatttaaatggaatgtaaatggaaaaggaatcgagaaataagaacaactgatcttaaagtctcacaatgtcctacaaattaaaaatgcacttgtaataatagtaataataattaattatattaaaaaaactccttgcaataaaatcataatttatgtaattcaaaatagatcttgtctgaattagtttcaacatatttcctagaaatgcaaagattaatgaacaaaagcaggacatatataataaatcagattagagaacttctagatctagttctattacttagtcaatcgattaaaagttctatacactcagaaaaaaaaggatatatattcataatatagacagtttaacaacttgagttgaaggaaagattctcacatatattttcgaggcataagacacgatggccctaccattacaggatgataacaaggaacgaacattgtagacacaagaatcactgttacaggttggtaacaaagaaaacgaacctaaattgataagaatgaacgtgtcttttttttttttttttttggcaatccaaattttgttgcatatgcataggattccaaatcatttctgtttgttcttttgtttcgaccgtgtttttttgttaactttaaattatataagttagatgcataaaattagtacacacccatatagaagaagacaaataatcatgtgtctatcacatgaaattaaactgtttgagtatatatattagaccggaatttaatatgtaattttactaattaaaaaatgctttcaaattcgtaataagtcgcaaatcaaatttcgttgttacatttttaaaagaaagtatttcttcttttcaaggaaatattttttaaacaagatcaataaaatacgtattctaaatatagattaactctcttgttccatgtgtatctgtgtttggtgatgtaaagagctcatttacagacatttctttttcttgtaaagcggatatattgtaatgatcgcatgtgaaacgtaattacgtaaagcgacatgcaaatctgagttatggtatattaattacagtttttgtattgacgtgaattttaaaaatgaatttgtttagcatccactgccgttttaacattttattcgttgtaatgtacaatgtcgacaaagaaagcaagtgaaacgtaacgtgcatggcctccaaatcatgaacttattcgtaaaatatcatttctataataatatagtttagctatatatcgcaataataaatagaaaaaccataaaattccaaagaatatattaccaatcgacaccaaaaagtaaagataagggtcataatgggctctcccttggatggtttagaatcttcgtaaccaattgtctccctagtccctattatagctttgagagatgaacgagtaatactgtatcaatcatacaatatatatatatatatattaatttgacatatatattagagctaaccaaaaacaaatatcgcaatagcttagattagtgaatgatagttaattgttacatttgataactcattattagaccgccaagagtcccatcaaactagcaggttcatgcggccacgccgggaccaagatctggttcttttatttcccataacaagaatctttttcattttatttatattatagagaacttttaaagcagtctggttatgttggatctggaggaaaatcaggaaagtacatttgattttttaaatgtactcatatgaaaatgtaaacaaaacatgaataatcctttatatatgggagtgggacctagattttttttgttgctatttaacaaaacaacatttctccaacattctgaaaaacaggatcacttgttttgtttcactgtacagtagaagagttttcactaactagtaaactaattaattagtgatttttatttttttttaatcaactcaggcctaattgagataacttgttcgtgggtatcaggcccaatataaagtattctaaggcctactcaataatatctccaatatttttattttcggacagatcatttatttatttttgtaatattttgttttttcttctcgtaaaaccctaaaatatacaaaaccctcaaattcagtctaccagcgaggatcgatgtcggagctcacagtatctcctttcacgcattaactcaatttatctgctaaaccctaaatagcttcacgccgtttttctaattctcaatcaaagcttcaccgccgccgtgtgttgttctttctccgagtcgtgttctctaatctcaggtgaagcttctttcttcaatttgcctttggtttcgtttcgaaaaatcatgtcttttctaagatttatctccggtgctaatcagaattagtcggtatctaatgggtttctgaattatctgtctggtttggtatcagtgtttaattgtaattgagttgtttggttcgtttaggtgataaggatcaagatg

SEQ ID NO: 9301 - DNA, 3000 bp, Unknown
  misc_feature (1)..( 3000): cDNA_ID_3041147_gDNA_ID_1972067_Annot_ID_178393 3000 nt of promoter + ATG
gttggacaattagaggagcctagactagagagagtagaggttgatgtaatgtttacagaagctagtgaagtccattttcagtgtagtcaatagaatctcactttcttgcttttgaagatgttgcaacttgaaatagtttctttctccatctttgttgactgacttcttctttctgaaagattgtatcttgattttcagaattagattttgacattctttttacagatatagaatattttgtaatcctcccaaaaacaaatattcgaaagccactaaataaagacaacccaacaaatataactgtacaaaattgtagaatggtttgacaaaagtatttatcaacttttgaattttgatcatagtgacatgtatctaatagtgatttgttaaaatggataataccgtagaagataaagatggcaataaagtttgtgaataaatgaatttttttatatttccataaaatttagaaaagggatgatactttagattagatgctaaaaacagcagcaagtatttggcatcttgcaagatcggatattgttatacacctccaccaataaaagcacaaatcaagtttgctttattccttttcgttatatcgaatatttgtaaatgtccaatttgttaagtcataactaaaaacatggataacgttggtgttgttcgtttggcagcaaaaacaatggaatttgatcacaaggagctgaaattcaaaacgattgtcttaattgttccgattgatagattctatgcccactgatttaaaatgggcctcatattaaaagcccgtttaaatcagttgtctcgaaaattgactttttggtccattttgaactatgatttggagttgcaataaattgaaaacagcatgtaattcatctcttcaattgttttgtgataagaaaatgatatcaaaaacgttttctatgtaagggtgtgttttgcacaaaaaatggtcagggtgtgtagtctttgtccgtaattttcagcagaatcaggtcgtgatatcagaagctcttctgtgttcacacctattgattctgctagagaaggatccatggcattctctgcatcaagataagcgcaataacctggtacaagcaagtcctttttagataaataaaaagctaatggagtgaagaacaaaagcaagtcagaatcaaactgtaacttcacaaaatcgaatcttagccagagcaagccaaaacgcttcttcttccattcagctacaaagcaagataagagtaaacacaagagacattcgtttagtcaggagcttgggcaaatcatcaatgctactctaaaggagataactttattttggttggattgttgtcctagtttcttcatctgaaaaatcaaatctttctttcttatactcaagctaagaattgttgagaaacattagagacgaagagaacctgagataagtaagagaagaaacggaatctctgaatcggactggcccatgagagtcgacccattccccgttcttcttcaagcggctcctccttcgctgttcagtttcaattccacagttctgtcttcgatctccagtttccgccatggtcattgtccttaaccagaagtggatacataaaaatcgaaaaccgtattaaaccgatcggttcaaggctaatggaatctaatttaacggaacctattaataatctaattattgggtaatgttagagtacaagcctattaacaaaccctaactttacccatataaattcttgcacacaagtttactttttctttttctttgctttcttctgtatttgccgccgcttctctgctctccagctccggtcaatccgtacaggtacgttctggttacattcaaaacggcacttcaccataaatgaaaacataggagaatttcataaaagaagttgtgaaattcatctcttttaattatagatgcagctcgattttggatctctcttgatgttcctgcatctctctagattgtatcaatacccaaatgttgaaatttaacggcataattgaaattgaatcctcatttgtagttactcgagactcttatgtcaattgttggttctttcatagtttattagtcagaagttgatgtatctgcatttctctgatttgtataaagtagtataatgtgaatgttctctgatggtttgtctgaatttgggcaggtaagtcaaaaagttgtgaaagatgggtcgtgttcgtaccaaaacggttaagaagtcttcacgtcaggtgattgagaagtactactcacggatgacactagacttccacaccaacaagaagatcttggaagaagttgcaatcatcccatcgaaaaggctacgcaacaagattgctggattctccactcacttgatgaaacgtatccaaaagggtccagtccgtggaatctccctcaagctacaagaggaagagcgtgaaaggcgaatggactttgttcccgatgagtcagccattaaaatcgatgatgttaaggtggacaaagagacactagagatgcttgcttctttgggaatgtctgatattgctgggatttctcaagtggagacacaacaagctatggcacctgctgtgtttggacgtcccgcaggaagataccaacgctaagtttattgggtttcaatcaaagatttcggagacgagagtttggtttattggtctagtatggattcaacatcgtttcctttgatttaagattaatgtcgtttcctttgatttaagattaatgtctggaatttatagcttttgctttgttttaacctttttttttggtccattttgaactatgatttggagttgcaatcaattgaaaacagcatgtaattcatctcttcaattgttttgtggtaagaaaatgatatcaaaaacgttttctaaattccaagggtgtgtagtctttgtacgtaatattcatgatgagtcaggggcataacggtccagttacttattaatttcccgaatacgtggaaaaataggttttggctcgaaatg

SEQ ID NO: 9302 - DNA, 3000 bp, Unknown
  misc_feature (1)..( 3000): cDNA_ID_2034898_gDNA_ID_1972067_Annot_ID_178387 3000 nt of promoter + ATG
ttgcataaaaagctaaagggaggtgtaatcttgttcgataagtcaattacgaagaagatgaagatgatgaaggaaattgattgaacgagtttgaaaaacgcgtttgggtttaataatcatcagcgaattttgcgttcttcttgtcataaattatgaatttgttttctattaccaactcgttccagcagcagcaggcgatagaataatcaaattaaattttattttgtcaaatttctcaagtaatgtaagtaaccactaggtttgattggatttgatccacttaaagtctcaaactttataagagcatttataataacaaaatttattaactgaattttaaacttgttagttacaaaaaggtgtggaatactgttcacatcccaataaagtagtttgtcatgcaaattgcaaaccaaaactacgggtcaaagattgtagtgatagatttcagtttccaatcatcagctttagcttccattgtatttgtcccatataataaccatggtctctcaaagaaggaagacaggttatatgtatgatccgcgataactaaccggatatcgctttgtagccttccttttccagtagtttggccaaggagttgtctccggttttaatgattctcccattctcctgaaacccaaggaaacatacatgagcttaccaaaatatatatgatcattgtgtagccagtaaagaaggctggtttggcaacaatgctcaccatgatatgtatgagagttggtttgatgtagtcaagtaggcgttggtagtgcgttatcatcagaacagagttttttggtgtcaaaagcccgttcaccgcctttgccacatcttgaagagcatcaacatccaaccctgaatcaatctcgtccagtatagccaactcagctccaaggacctgcaaggacaggaaaacgttgcattagcgtacttccatgacctctttccatatattgcttacaaagaataggagactaatagtgttctcatgttatcgataaaccagaaatgaccactccttgggaggcagatatttcaagatcaggaaaatataaagagatatgaagacatataacatgccatgtctttttagctaaaactgcagtcaaatacttgtaatagaatactaactgccatgcaataaccgcgtctacttatggtaaaacctgtaactgcttaagctaatctacccagatatcctgaaattcctaactattagccttgtggttttgcacactgtagcatggaacaagcttagtaatccactaccttctctaatcacatttgtttcttatcatatgcagtccttatggatactgagaaacaagggaagcagaaccattaccgctaactgtagaatctcattgcgtttcctttcaccaccactaaatccttcattgacatttctgttgagaaaatcggtcttcatattcacaacttcgagttttgataccaagtggctgtagaactgcatgagccatgtgatatcagtaagacataatacatagacagttctacaattgggaccatttagcaaacaacaacaagtaagaaacagtgcaaaccaaatccaagtcatttaattcgataaggcacctggattggatcaagctctggctgaccaagctttcttttccgagcattgaatgccatattcaagaaatccatattgctaacaccagggatctcaactggggactggaaactcataaagagaccggcaagagatctatcctctggttccatatcaagtagattctgccctttaaacacaatactccctcccgtcacttcataatcgggatgaccaacaagaacctacaaataataagactctcactaagataacaaacagaaagagaacaatactctgcagcatcaatgttaatcctgagatacaagatatacaaataaaatgttcaccttcgaaaacgtgctctttcctgaaccgttcttccccatcactgcgtgaacctattagcaaccacaaaagaagccatggattacaatcggcagcaatgcaaaacaaatccacacaaatagaattcacaagttatgatatcaaactcaaaactttatcatataatgagacagcactaccaggcaaagctttctgcaaattaaatttcaagtcttaaccataaaattgcattgattaatacgcacctctccttcgtagacaaccaaattgacgcctttcagtatctcttgtctcgattcagcaatcactgctctcaaatccctaacttcaagcaacgggatcctccccacgtcatcacgatcttccaccaacgaatccgaatcgacggctgaggatacggaagacgccgaaacaataactgaacggcgagtagttcgcaggattggagcggcggcggaattagctcggagattgcataatagaacacgagagggtgaagtcccgaggcgaactcgctgagtaggaagaggaggaggagaagaaacagttggaacgaattgagctatggagtatgcgtgacggagctgtaggttaacgccggccatggagacagaaattgcggcggaagaagacggtggaggttttatccggtgaagtgatgtggttagttaggtccagggattcttttaatttcacatgttgaatgccacgtaatatatatatcggctactagcttaattaaaatggaaacaaaaaaaaaatggaaataacaaataaaacgacatcactttgtgttgatacgcatattcttcaaaaccttaaaagcttctttccttgaagtacaagaaactatttacacatatgagaccttgggatgaagaaacagacaaagtccataccctaaagcaatcctaaacccataccgtaatctcaaaatctcttcttacctctctttctatcttatatacatcattcaaacattttttatgttttcatatacagtttgattcatttatttcgtaaaggctttgaactttttgtcctgatatagtgtgatctatatataaacatatatg

SEQ ID NO: 9303 - DNA, 3000 bp, Unknown
  misc_feature (1)..( 3000): cDNA_ID_2990859_gDNA_ID_1972067_Annot_ID_178391 3000 nt of promoter + ATG
cgaagtagagaaaagtcatatcagcatgcctataggggagaaaccacttactccatctgaagccatgccatctacatcatatatttctaatggtgacgcctctcagggtacttctaatgggtctctggaaactgaaagaaacaagtttgttgctttccccattgaagctgttcagcaaagtaatatggcctctgagccaacttcaaagttcatccaagggactgagaaatcgagtatttcttctggcaagccaacctcagaagagaaacgtatccctctggaagagcctaaaaaacctgctgctgtatttcccaatatctccttttcaccgcctgccacgggcttattaaatcaaaacagtggtgcatctgcagacatcaagttagaaaagactagcaggttggtggcatgatatttttcctctcagcttgataggcttttatatcactacttgtgcctaagtgagcctcatccatattggttatgattttttttttctggtttactcgcttccgactctctttcttgatgttacagcactgcgtttggagtatcagaggcttgggcaaagccaactgaatcaaagaaaacgttcagcaacagtgcttctggagctgagtcatctacctcagctgcaccaaccctcaatggtagtatattctcagctggagcaaacgctgtcactccacctccgagtaatggctctcttacttcaagcccttccttcccaccttctatttcaaatataccttctgataattctgtgggtgatatgccgtccactgttcaatcttttgctgctactcacaattcctctagtatatttggaaagttgcctaccagtaacgacagcaactcacaatcaacttcagcatctcccctctcttccacatcacctttcaagtttgggcaacctgcagctccgttttctgcgccagcagtgtctgaatctagcggtcagatctcaaaggagactgaagtaaaaaacgccacatttggaaatacaagcactttcaagtttggaggtatggcttcagcagaccagagcactggcatcgtttttggtgctaaatctgcggaaaataaaagcagacctggttttgtgtttgggagctcctccgttgttggtggcagcacattaaacccttctactgctgcagcttcagcacctgagagctctggaagtttaatatttggtgtgacatcgtcctcaacccctgggacagagaccagcaaaatttctgcgagttctgcagctactaatactggaaatagtgtatttggcacttcctcttttgcatttacaagctctggtagtagcatggttggtggtgtatctgcaagtactggaagcagtgtttttggattcaatgctgtttcatcagcttctgctactagctctcaatctcaggcctcaaatctttttggtgctggaaatgctcagacgggtaatactgggagcggaaccacaacatcaactcaaagcatcccctttcagtttggttcatctccatcagctccttcatttggtttgtctgggaactcttctcttgcatcaaacagttctccatttggattttctaagtcggaacctgctgtatttacttctgtgtcaactcctcaattgagttcgacaaactcctctgcaagctctagtagtacaatgagctctcccctatttgggacaagctggcaagctcccaactcttctccaaactctggtccagtcttcagttcctcgttcaccacatcttcaactcctaccaccttttcctttggaggatcttctgctgctactgtttcgagcactactactcccatttttggtgcatctaccaacaacaccccgtcaccttcacctatctttggtttcgggtcaacccctcctaccactccccagcagccggtatttggtaactcagggactccatcacagtctctgtttggtaactcaactcctgggtttgcatttggtgcacctaataatggaaatggtatcaacaataaccaacaagtgagcatggaagacagtatggcagaagacacagaccaagctaatagagcatctatggtagccccaatgtttggacaagcagcagtctcgatgcctcaaccaaactttgccttcggtggaggagcagcaacgcagcctccatcaatggcaaaccccttccagtttggaggccaaccaatggcaagcacgttacagaacgcatcacctttccaggcatcacagagtctagagttccaaggaggtgggagcttttcactaggcagcactggaggtggcgataagtcaggccgcagaatcttcaaagcaaagaaatccaccaggaagaaataagaaaaacacattgttcaagagtcattttatcagccttatggtctttttgttcgctatatactccgggaaccttggggattacgagcatatcgtcgtttaatgaaagaggtaaagtatgagaatgtgtatcgtttatgctcttgatcgtctctgtcattttagtatgagtcaggattttgggggtcaaattgttcagggttataaaagttgtaggaaagttttgtaattttcagaaagtactggtgtctgtaagagtaatatagctctgtgcctctgtctttcgcttctttttctttttgtccttataaaaaaacacactttattgtagctgtttgttaaactcttttctctcttcagttctggttttagtggtttaaattaataattgcctcattacaacttggtttacccaaatcaaatcgaaccaaaccaaaattgaataaatccaattcgatgatcttcaaggaagcttcttttagttgaccaattccattaaatccaatccaattcgatcaagtaaataaacaaattctcaatccttttattagagaagccttcttctccaaagtctcgatttctctttattcttccaaattcttttgtctctctgtatcatccaaaattcccagatttattcacggagttagaagaagaag

SEQ ID NO: 9304 - DNA, 3000 bp, Unknown
  misc_feature (1)..( 3000): cDNA_ID_3088380_gDNA_ID_1972068_Annot_ID_178445 3000 nt of promoter + ATG
cagacgtgttatccaagagaccagtaagattcaagattcgtctgtgacggttcaagtgcctcaaatggagcaatctccagcgtcaaactcagtcaaagagatcactgacccgaagaagaagattaaagtatatgtggtggcagcttcaagtgagtgtaaaggtctgaagagatttattgaggtggatgtgaactcgacggatcaagtgaaaatactgagaaccgagttggttgaaagtggtcggaggggtcatataagaatgcctcacgaaggatatttctttgtggacagaaagaaagagagagtattgaacgaagatcagtcattcgagtggaaccgtgttcttccagccgaaacagtttatatggttagtggacgtgatacacattttgcctcgtcttttactcgtggctctaaagtcacaatgctttgtgctcaaaaagttctgtagaaagtctgtatatatgacacagaagaaaccaaaaactatgatacattcagcaacagaaagttatgtggatctttaactctttgctaataggttttaatctttcttcaagttttcttctggcccttaagtcacaatgctttgaaatttttgagtatatgtagatacatagaagaaacaaaactatgatacatttagtaacagaaatttatgtggattttatcctatttgtaggtgtaactcttttcttctaggttttaatatttttcttcaagtaaacttgttgttattgaattccctttagtcgaaagcagcgatcaagcttctcttataagttacaaaccctaatttcagcaaacacaacttggaaacactagcagcaacaactttgttattttaaaacattagcaaaagaaatctcattgcaacatcaaatggcaaaactggaaggtaaaaaaagcagaacttatcaaacaagactaccaatatgatgaactgatgatttttttttttttttttttggctcaacaacaaactttccattcacccatttatggatacacagtctagctcaacagagcttttaacccaaattggtacaatagaatacaactttagatcataattctcaaaagaaagagattccttagctattctatctgccactccatttccttctcggcttgtatgcacaagcataaaatcctcaaacttgctaagtagatactttatgtcttggataattggattgagacttgacaagcataactttcatgtaaccaaagacacaagttgctgagaatccacctcaaaaatgatcttcctataattgaatcgggataatgacagcacagcccatctaagagcctccacttctacttccagcacgcttcttacttttaccacagctcttgcacctaaccataacaccttccctgtatgatcgcgaagcacccaccctaagccacattttaatccttctgttggccatgccccatcaaagttgcacttaacccaagattgtggtggagcttcccatgtttctcgtctgtcccgacggtgttgtggttggtgctttccttacattctgagcctctttccttctaatccactcatctgcatcttcttgtgtccttactaatacctcattggttccaaattccctccctttaagcaccagctcgtttctgttcttccacagcctcccaagtatccaagggactaaagcctccacattcttcagatcaggatattcttgtttaagatgttgaactctatggaggtttgtatgaactgatgatctaggaccggataagttcccttcttcatagcgaacttattcaaagaatgttttgtgtatcattcttgttacattgttattaatgaaaaaatattattggtcattggactgaacacgagtgttaaatatggaccaggccccaaataagatccattgatatatgaattaaataacaagaataaatcgagtcaccaaaccacttgccttttttaacgagacttgttcaccaacttgatacaaaagtcattatcctatgcaaatcaataatcatacaaaaatatccaataacactaaaaaattaaaagaaatggataatttcacaatatgttatacgataaagaagttacttttccaagaaattcactgattttataagcccacttgcattagataaatggcaaaaaaaaacaaaaaggaaaagaaataaagcacgaagaattctagaaaatacgaaatacgcttcaatgcagtgggacccacggttcaattattgccaattttcagctccaccgtatatttaaaaaataaaacgataatgctaaaaaaatataaatcgtaacgatcgttaaatctcaacggctggatcttatgacgaccgttagaaattgtggttgtcgacgagtcagtaataaacggcgtcaaagtggttgcagccggcacacacgagtcgtgtttatcaactcaaagcacaaatacttttcctcaacctaaaaataaggcaattagccaaaaacaactttgcgtgtaaacaacgctcaatacacgtgtcattttattattagctattgcttcaccgccttagctttctcgtgacctagtcgtcctcgtcttttcttcttcttcttctataaaacaatacccaaagagctcttcttcttcacaattcagatttcaatttctcaaaatcttaaaaactttctctcaattctctctaccgtgatcaaggtaaatttctgtgttccttattctctcaaaatcttcgattttgttttcgttcgatcccaatttcgtatatgttctttggtttagattctgttaatcttagatcgaagacgattttctgggtttgatcgttagatatcatcttaattctcgattagggtttcatagatatcatccgatttgttcaaataatttgagttttgtcgaataattactcttcgatttgtgatttctatctagatctggtgttagtttctagtttgtgcgatcgaatttgtcgattaatctgagtttttctgattaacagatg

SEQ ID NO: 9305 - DNA, 3000 bp, Unknown
  misc_feature (1)..( 3000): cDNA_ID_3041196_gDNA_ID_1972068_Annot_ID_178453 3000 nt of promoter + ATG
tgtaattacctacaaagaattttgaaatgaaaattgttcttattgaataatgaagatgaattaagctaagtttgtagaattgatatgcgaattggaaactggagaaagagaacagatacattcgaatttttatccttttttaaaaacattacgttggataattttagtaagatttagattcttcgaggaggctattgacttagggaacacgtaaccgagaaggttaatatgggctaagcccaagtgagttctatttaatacgttcattaaatgatataaatactaaacaaattctctacaaaacaatcactttaattatctctctttttcttcatccgtttctattgataaagttatgaagtttctcgtcgagaatctgaatggttcatcattcgaacttgaggttgattacagggatacactgttagtggtcaaacaaaagatcgagaggtctcaacatattcctgtttccaaacaaacccttatcgtcgacggcattgttattcttcgagaggatcttactgtcgaacaatgccagatcgtccccacttctgatatccaactcgaagtctcatctgacgatgataaccctaatcacaacgactgcgatcaaaagccgcaaaccgagcaatctccagcactaccattggtttcagcggaagagtactttgagagacaagattggcctttgacagcagaagagctgagacagatttatagttatcggcctgagcatgaaggttgagagcaaccacaacgatgatcaaaccgagcaatatccaccgtcgtcgttgcgaagatgaggcttgacgagatctttggaaacttttcattattatctttggaaatttttcattattatcttcaatgtgtttactattttttttaagttagtttagataattatagattatttacattttacctaaggttttggtttctattttcttaataaatagctcattatttcccattatttcatgaagttatttgtttagttgagattttataaaaagggataataaactaataagcatactagattgtaactcgtgttggtagtagaattttaatttttaaatatttatttaaagttggatcattgtttgttttataatacagctttaatcaatccatacataatacaaaacaaagaaacttagaccatgcacatagttggtattcataaagtatcataacattttttactattaattttaatgtttatttattgtttgagaatttttataatactgataataaatctgttttcagtgatgagatccgtaatgatatcattgaaaaaaaatatttgcaaaatcgaaaatacctgctagcatcggccactacaacgataccggagacagtccgattgaagagaacagttaaaagagaagcgcctccgacgtagatataaaggagtgtgagagaatttgcgattaaggttccaagggatctgaatttggaagatgattctcgttttcattgaaaaagaatcgtatcaagatgcactgaagaggagagaagagaagagcaaatgattttttttttctctcctttcccacaaaaacgcgttgccgactaatcacaagccgccaaatcatcaaaaactagtatcagaagtatctctccagtgatacgacttaggcccaaatcagttgttttacccattaatttaatgttttttgggtttctgatactcataaaaatcctactatgtacatggtcttacccttattccattgtcggtgaaatccttcagggtttatgcttttccagtgctaaaatcgcatttcaacgaaaccgaatccctaatgaatgaaatcgcatttcaacaagtagaaaaaagtgataagactagggctttttattcaaaatctcggttttgtttaaattcgaaccaaatccgaccggtttacttaattaaaccaaattgttaaccatctctcagaagcaaacccctaatggcctaatccgatgatcgacctagttctcaatgtacttgaagattttatattgccttctactcacaatattatgcataaccctattataaagatgatcaatgtttatatacagctacaaactttttcattctcacttagtctcattgtattatcaatcaacgatatagctctataccatattgaactccgatgatcggggctataatcggagaagagagagatgtaacaaacgtttattatcaactcaaaatattgttacaaagcttaaactaaaattagttacattcacatcttatatactattcacattaatcttaaaccgaaatctagttaactggagttaaccaaattaaaccagtccatctatcccaataattcattcattcatacaattttatgtacaaggttaccaaaagaatcaaagagaaaacacttggcttaagtaagagtataacaataaacagacaattaaagaagaatcatatgcatatataatttcaccatgtgatattgaattatataaaaagaaattttcacagaagtggacgaaaaaagatttgctctcaccgtttgtcaaagtgagaactggttttcacgttttgtcttttcattcaatttcggaccaaattaccctgggaaaacttaataatggcacaaaccaaaccgtgcagcagttcgtatcggttaagttgacggcgtaaaccaaaccctacagcagttggtttcggtttagttgatgcggttcagttttgaaaaagacaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttggatagttgaattgagccactgaactcccacatccggggaagtgaaagttactgtttttctcggcgaagccaagagaaagttactgtttattccggcgaaatttgaacctccggcgagatagcatctttagctatg

SEQ ID NO: 9306 - DNA, 3000 bp, Unknown
  misc_feature (1)..( 3000): cDNA_ID_2035053_gDNA_ID_1972068_Annot_ID_178462 3000 nt of promoter + ATG
gtaaccgctggaccgagtttagtaatgatcgggctcaaggaaccgtgggtttcaggctcgatatagtttcgactattcggtttaaactccataggtggatcagtaagcatcataggatgcacgctaattgcaacatcgtggttggaagagacgggttgatcttgcccaagtttaaccataaacggtgtccagtctacttcacttagaaagattgattggtttgttatttgctattctctttatattttactttccttttgaatgattttgctttctttacgttttgtaacttggatttgggagtttggtttttctcattaaatgtatgatctttgagttaaacatatcaaagaaatcatttggtaaaagtaaaaacgcaaagcaattggcagatagttcaatctattacctcagtcttcttgagtctggcaaacagaataagttatggtttcctcttgctcgaaatctgagcttcaacaatttgccttctccattgatgaattgggacctgaataagaattttttgtaagatgaaacaatgtttatcggaagcaaaagcagagtccggctctgtttttttatactggcttatgataaaaaatcaaagcaaacttgggatcttggaatcagatggaagtgaagactcaatcgaagagaaagagagatgcttacagcaggaaaaccgccgtaatcccctggttccgtaatgtttttagtaacacaactattagcagcaagtcgaacctatagtcggaaaccaaaaacggatttagatgaagcactgcacaatttcattactccaattatgtttctatttttttaccttggatacaatggagacatggtctcgaacagctactcgtcctcctagtgctacaaagtcaccaatcctacaaaaaataattgtcgaaaagacgagaagcttatagtttcaatcaacggaacataatagttatttggttgctgggattagaagcatttactctgctgatccagctatgcctacttggccacagaacaagcaacatttgccaataatcacattgtgacctatctgcaatatttaagtaaacagaatagcatctcagttgtcatttacttgtgatctatgggggagttgcaagatagaatcgaagagacacctgaactaagttgtctatcttagtatcatccccgatcacggtatctctccagctgcataaatagtaaaggatatggagctagaaaagagctttacagggaactagttcttgaaatattctgttacctgccccgatcaatgcatgtgtttgctccgatttccacacgattccctatcttcacatttaaagtctagggagagcaagaaacagaacaaaggataaaagtgatgcacaattgttatccagattcaagagagcaatctaggtgtgcttacttgaggcttcttcaccatgtttccgttgtcatccacgtaaaacccaaatcctgaacagttaaaaaccaatctcaattcaatgccaattctcagaagataaagaagaaaacatggacttggtccataccatcttgaccaatgcagactccattatggatgacacataaatcaccaatactacaattgctgactgaaacattatacctgtagacaagtatagattctttcaagattctcttcaaaaacatgtataagacattaagcaaaaccgttacccgatctttgtagaagggccaattttgactgatgatccaattacagtgttggatcctatatgaacctctgctcccaatatagcttcttggtgaaccactgctccaaactcaaccagagccgaggaatcaattagggccgaacgatggtacattcctcctccgtttcgccatcttagaaaacctttctcaacattacctccactacttgtctctaatcttgacagttacaacaaaacacaagaagtatcagcaacaatcatttacatagaatagtcaccacctttacacatataacatctttccaccatctaaatatcacaatccggactctttaatagcgtaaaatgtttcatgcaacaattgtcatcaatattcgttcatcacaatgctgttaaatcatatacagatcatgaacatctttcccaagcatcataataccacacatgtcagaccttatacacgaaactgatacgaatctaggaatttcactgcatattctcagaggcattccaacaaacaccttgcgtacacgataacttgataagataaatgcaaacaaaagtcaaaactttaaaggtacaaattcttaacaagactaaccgttatgtggagaaacattaacagtgacggattcagttgattgatgagagcaaacccttaaatttcggctactagagaaaaacctagaccgcttgttcaaaaagacaccatgagtggacactgagaacaatgttcgcaaactatttgccatagtcaacaaaatttatagagattcagaagaaactgaacaaatttagcgacacgaccaaaaaaaaaaaaactttgaacttgcttttttttttttccctccaaagctttaaactctttcttttaacaaaacaaattagaactaaaaaatcaacatttccatgtaatattttatactcaacaaacaatcttgaaaccgcttcatatcacttttgtaaacaatgttactcaggattggctattatgagttctaaataaaatctgatgacaaaaaaaaactattttgatgaatttataaattttatgattccccgaaacctttgaccaaatatgttttttaatcatattattatgtcaatgattacaacagcacattttaatttcattatctagacaggcctgcctaacctatggaatattgaagtttgaacataataatttgatttaaacaatcttaattatcaatgactaactgtagtaattagactttgaatcccactaattccaatgaagattatattaagaaactcaaagaagaagaagagcaaagaaaacaaaaac

SEQ ID NO: 9307 - DNA, 3000 bp, Unknown
  misc_feature (1)..( 3000): cDNA_ID_1396277_gDNA_ID_1972068_Annot_ID_178464 3000 nt of promoter + ATG
cttcatctctgttatagttgctcgtagctcttcctctttggtctttgcatccaactctagaaataatgagaaatcaagtccatattcagtgtacacaaaacgatgtgagaaccaaacatgtaactagaaaactaaaattcacctttatcactgtatcttttctctgcagattgaagagaagaagaaagattttccttgtcttgaacatgagtttcatccacttgttggtaccatctaacacagaccttaagcttcttgataatatccgtcatttgctcaatcttaccctattagtaccacaatgcaaatacatattaaagtgatttttttcttagaatctcctataatcaaccaattggttattcggttcacaaaccttggtatcaaattttccagctttagctctctcgttaagcaaagccaacacttcatcttttgtaaactcaactttaccacactcctctgtgcttcccacatcgctgttcgcatcttgtctgttcactgtcgaaagcacttgtcttcttccagtaccttgcgtctccttccttcgcttgtcaaaaggaatacttgagagcgcttcctttttcttaaacatagttcaaaaaccaacaaaattaagtaaagccacagacttttatgaatcaatttctcaagagaacccacaagatcttctcaattgaacaaaaccctaaatcaaacaattaaactgaaaaatatcgttatgacttttacaatctccgcttctctcttagaagaaggaaaataaaagaaagaagaaggcttacgacgtttggactaggtaaaggagcgcgattctggttgcgaagtggcatcttcgatggattgcttcaccttaggctcgtcaataggatccaaatctcaatcccgagatcggcggcggatttcttaagaacccgggagaaatcagacctggttttttctgaatctgagatgggaaattagggttcttgcttttttcctaatgggggagattttaagaattgaggaaggaggaaggaagaaggaggagcctgttgtttgaatatttgaaaacagatcggcggactcttgtcaaaattgtaacgttactcttctcctcgattataatattaactttcaggcccatcagcattaaacaataatcttttttttccttagatacttactctcaggccaattgacttaactttcaggcccatcaacattgtaacgttactcttgtccattaatatttaaattattattatataaagtataggctccatttgagccaattgacttaaaactcggtccattaacactagtgatattccatattttgcgtgactttttgttggctaaataaattatgggaaagaaaaaaaagtaagatattaatcaaattggtttctattttatggttaaatctttttataaaattatttttcttttattttgtataaaatgaagggttttaaaagtttcaaattcttgtttttagtttgattcgcagttaatattcgattttgggataattttggagagttattacttactttaactaggattcaacccgtggtttacagcgggcctcggttttatatgttttttttttttttttgtcatcatcatcttattgatttataaatcagcagtgtagtcacaatgtaaagcatagcttattacattaggaacccaaaaatgattaaggaataaagattggttttggagaggagctttagcaagaatatcagctggaacattgtgatgtcttcttatccaattgaaatggattgattcaaacttccttgaccaccaatgaacgtctcgtatccagttgtgaacgccaaaatgtaccttggatccgttgattaggtcaaacagcatcttgttatctccttcaaagcaaacccgtttgtaaccatgactccaacagtgctgcattgaaatgattagcgcttgaatttcactctccagagcattgtccacctttcttcctatagcctgacccgccagtagataacttccattactatcccgaacaacccaacctgctttactttctacatctccattaacgaatgagccatcaaagttgcatttgatccatcctctttcaggtcgtcaatcttatatggtttttaattaagtatttgattatatttatattataaatttataaaatatttcttttattttaaatttttataaataatgattgagatttttattggttagttgttatttagtgattaaaataatgtgttttaatgtgtgtatgtaatttaaatataagtaaagtagtaacaaaaatgtaaaatagtaaaaacggtgtaattttttttgtgattataagtttttttattattattatttttgtgattataattctttttggaatgaaatatgctcatatttagataccaaaatgaagtagtgataccaatattgttgaacggttaagattgtctactttggatgctaaacatgattaggtatttgaattcgtgaataagtgactattattcctaacccacccgaaattaaaaatgtggatcatataaactttaatagattgaattgaccaaattattcttaatggctatgtacaaaatccaaaattgaaattgaggccaaaattatctatttttcaatttgtacttttttttaacaataagggatttcatttatttgtcaagttggattggatttaagttacaatttgcttagatattatcgaaaccggttttcaattaactttgactaggtttaaccgaattggtcaatttccacgtcattcagccacgtgacaatcgcattctgggaacactcgatctcaatcctatgtggcaaaactgagaatcaagaaaccacgtgtcaacatattagtagttaaaaccatatccgagtaatctaagtaacaacgtgaatcagataaggtattctttgtcacataaccaaacaccaaaaattataactcaacacttcactaatcaattattcaaagcagataaaaaaaaa

SEQ ID NO: 9308 - DNA, 3000 bp, Unknown
  misc_feature (1)..( 3000): cDNA_ID_2035028_gDNA_ID_1972068_Annot_ID_178469 3000 nt of promoter + ATG
aattgtttagtattagtaaagctatttgcaaattaaattctaaacgcaaacgaaaataaacaatcatatccacaatctttattaaggagctatatgatgagaatgcaaacactgagatgtccattagtcaatcccaaaatagaaatgagcataatcatccatccttgatcaccatacttggcagtgaagtagaattccggaatgaggaaaaaacgcgacaaaatcgcaactgtgagtctttttctattctcaattttgagccatttcaccagcggtgtgtatcttccgaccaaatcccatagtacattgctacgaggccaagcgtgtaccatgttcctagtctgtgttgtcccgtgttttcatataaaaacctgggtaccagggataatgtcaaatcgtagaggaggaatagattcactgcataatccttcataagcggatttacttcagtagtacttaacaatgggaagtttcggaaatacataaccatttattgtggaaaacatgtaaccgatcatattacattttcgtgtattgctttttgattcgcggtatgagaaaatcgtgattgttccaagctcaaaaggttcgtataccacaatgagtatccttaaaggatgggtaatcctacggagccaagaaacatagagaattcaactatagttttttataaccaaaacataaaacttcgaaaaccaaaacgaaaacaaattggaaaaacgtggtagtaataatcttcaagtgtgagcatattgttccaagaaatgttgttccaactccaagaatacagcaaaaaacagtgaagactttagatatgtcttatttatgttttcttttggaaaaatgtaataatttgaaattataagttgtgtcattattcgtttatgtatatcatagtacaatatatgatagattacgttgaaagagtaagatagatagataatataatgtttgatatagattttctcgtcatacccaacaagtaaacaaaaaaccttactaactgcaacaccattggaaacttatcctcttttcattggtcaatttcttcttttcgctattgtttagtcgaactaaaacgtcattaaatatcaatcaaactacagagacattatttttgtttaacaatacaataacatggacttcaaattagttttagtggaaataatgattagtactaataaaattcgatcgcctgtcgtaataaccaactcagctcaatgtcacatgctaagaagtaagaactcctgattatattttatttttaattctgttgctagattaattaaataaaataaagtcaggaattttgttttccttctttactcttttttttgtgccgacgtcaagaacctagttgaagattgaaaatatatattagatacaatttttaattatatgttatcttttttttttttcttgtctaaattatatgtatcttaaaatcgttaaatcacaatggtttttgtggagtcaagtcaaatgcatatggtgaatgattaggagcatctaacttctggctgatagctatttgacggctacgatgcatctgtcatataaaatggaataacggccagtagttctcatagaccgctattattttggccaacagattgatcgtaagaaaatataatagttgtatacattagtctttttggacacaaaatttttgatgaaaactttaacgaagttgagacgaaaagaaaaaaaaaaaatgtttctcatgaaaatatagttacattacataaggaatgcgtatggtaaatgtttgttttttgaaagttttattatgataaaattattatattagatttatattttttttatttttttgtcgaccgttattaattatttttttattttttgttcaaagatattaattgttgcattagataacataaaatatatataaaaaaccaagatttgttcacaagataaaaaaccaaaccaaatccaaatttcataagatattttctacactaactaaagtacttcaatcgaacgattctgttacaactttgtaatagtaaataagtaattagatttctgagtaaaacatagattatcaaagtcgcttttattattgttttgtttgcaagactcgtgcttacaaatctcccattgtaatcaactatcgttttctagagtttgtttcagtcattcttacactcttattgactactcttattgattattggaatttttttttctttttttttttcaatctttgcttttattcattgaaacaaagaacaattacaagcataagagttaaagaactcaaaaattaaaacattacaacaaaaggtattctccaataccataaaaaaaaaatctaaaattcatcgatttgaagtccatgagagttttaaggcaaagacaaagaaacacaatgcaacatatgagattatagagaatctaaagatcattgttttattttgttttattttgatcgaaagattacagaaaatcaaggaattgttttattttgttgatatatttttgtggtaatatttttaaaattactttttttctttcatataaataaaattcgatagaaattagtatttatatatatatatatatatatatatatatatatatatatatctgtatctcatttattcaaaattatcatttgtgcaaatcggttaataaatgtcgtttatgacactaacgagtaatgagtggtgataataatcaattcggtaatactctcacatttataaattatattaaaatattcaaacggttaactaattatattactttattttttgtgcaacaaactaattatattacatgagaaaaaataatgctgtgagaatgcggtacatgacagccacgtatctctaacatatcctcttcccgaacattcaccttaataatttatatggtcgttgaatgaaatcgaatcaaaaaaaacaaaaatccccaaattaccaaaatcctcggcgacaaagaggagagatagagagagagaaagaggcgaaaataatg

SEQ ID NO: 9309 - DNA, 3000 bp, Unknown
  misc_feature (1)..( 3000): cDNA_ID_3041184_gDNA_ID_1972068_Annot_ID_178479 3000 nt of promoter + ATG
tcaaagtgtttaaagttccatttcttgctttgtttgtgttttccctgttacagtgatattcttagcaatctcaaccttcatagaactactctgcgtgattttatatgcatatgtgttcccaaaactccccatcgttaagtattaccgaagaaaagccgcttctgaaggatctaaaactgttgttgctgatcttgctgctgctggtatccaaaatttatcagatttggtaacatcaaactcctcaagaattctttcctttcttggtttctttaaaaaaaatcatcaagaatatgtttcttgattcattctttttttctacaactttcccactctttaaacattatttagcttcatgatttttctacgcagagtgatgatgattccaagaatcaaatgctaagaaagaaagagttgttgcttcaaaacatagaccatgcagtgaatctattcctcatctacgttttgacattatccatttttcctggattcttatacgaaaacacgggacaacacggactaggtgattggtatgcacttatcctagtagcgacatacaatttttgggatttgttcgggaggtacgcaccgctggtgaaatggctgaagcttgagaatagaaaggccctaacgattgcggtcttgacccgttatttcctcgttccggcattctatttcactgcaaaatatggtgataaaggatggatgattatgctcgtttctattttgggattaactactggacatctcactgtttgcattatgactatagcccctaacgggtacaaggtaatctatctactctccctatgctgttaaccaaattaatttgaatatatctagaaacttagattagttcatatttagaaaacaaaacacattatctttacaatttttttgtgttataccctttgcttttacgatttgaaaatataacacaagttttttttgacatataaatacaaacactataataaacaaacgacctctaccttcatatttaatctgattttgtattttgtgaagggtccggagaagaatgcattagggaatttgctggtggtttttattttaggaggagcagttgtaggaatttctttgggttggttatggcttattggcaagaaatatgctttctgagttctcatcattttgtgcaattaattccgatgaatctgactctttatggcaaaaaatgagaagcttggtgcctcgctcgaacctaactgtttattcatgaaaaaagaagaagaagagaatactaacacgtaaaactttcgaaagcttgaagtgatgaattcttatttcgatgcttcaccaaattataaaatttcactttttcaactccacaatttgctgtatctattttagttaatattttagacccatttgatcattttattaactattttctaaaatcttatatggtgttatttaaccatagatttttatagaaactaaatcctaacagtctacttttgtttgatcactgattataattttatgcattaaagtttagcattgttccatcagatatttgtaaaacaaaattaatagcaaaataaagtcattcatttaagctagtaacggacggttttcttcgagagaaaaccagtccggagtagaagagcttacatgggaaaacatagaacctcgtgctcttttcttcttagcaagacaatcagcagagacattgtttaagtatgtaataaaagataaagaaaaacgagaaaaactaggctttgaagcattaaaatcttttcactccgaagaaaaagcggactactcatcaggagtgttcaaaagttgtgtcgactccttactatctgtctataaaataatgtcgaaaatggataaaaatataagaaatcgtattgcccataagagagcctcaacagatatttgtaaattatatttaagagttttaaaatttggtcttattaaccaagtgttcatggccaagtgctttcgtcatgttggtccagactagagaacacttcttttaatcatgaaaacttaactcattgtttcctttatgtaaacattttaaagtggcaaaagttttttcttaggtatctacaaatattgagaactagtttcggttacgatccaaaaaagaagtaggtgttatttagttaagattttaaatattttgctaaaataagatttcaggcattttcgtgtaatttacaaatacaaaatgtagtgtgtaatttagacccatatttcctttcaaactaaccgatcaaaacattgatcacaaaatccttgtgtgcaactaattccccaaaaaagaagaggagaatactaacacgtaataatcaatttgaggtgaagtgtttatttatttattttgctaaatatttgaggtgaagtgttattttgataaatgcttcacttatcctttttcttttttacaacaaaattagttcatccatttaaattagaaacggatgattttttttaggagaaaaccagttcataataaaagattttatatgaaaaaaagataaaactttgtgctttttctttttcggcgaggcaattaataccaatattgtttaaacgtaaaataaaaagataaagaaaaacgataaaagttaggttttaaaatattaaaattttataattctagaaatgtccaaaaactaagtcaactacttcaaatgcttcacttatccaacttcaccgattctcatcgagtctatttcatacatagtttttattttcatttattacgtttagaccgatctcacagatatgtggatatttaatgattaaggattttaaagaaagttttgctttcatactatatcgtcaacaagttgtctaaaaataggaacataaaaaaagctttcacactttgaattctttaaattctataatcttttctttttctttttgagtcttactttatcctttcatatttgctgtcacaccttgaaaaggtctattattttactcgctcatctcctctttttaagaatcttgttttgaatcttc

SEQ ID NO: 9310 - DNA, 3000 bp, Unknown
  misc_feature (1)..( 3000): cDNA_ID_2034982_gDNA_ID_1972068_Annot_ID_178482 3000 nt of promoter + ATG
gaaaaattattgattgtagagaggaactaccttttggattaaatttttgtaaaaaattacaaattttttaaaatctctccataaattaataattattaatttatcgataaattaatacctctctaaattaataaatttttgtactattattacctagaaagtgaaaattgacctacaaatatatcttcaatttgattcacatatacgaagtcacgtatgtttctataaatttagatccaaaatgtgtgaaaacccatctgtttttgcaaattcttgcaattgcaattgcacatgtttctattacgtttaaatcaatcgagctctaagtgatttatccatagtgatatacagatccaatatccatgaaacatatttaattcatgaaaaggctcaaacattatcaacaaataagatatggtcaactatgtagtaactagtaacacgtaggctgctgctctttgtggcaaattcatgcgcaagcaaagcctctagatgtttgacaagttactaccctaatatagcatcactagctatcttctaatttttttttttagttattttaatcctgtattcttttatttatttatttgataaagtgatgaaattttattctcctttttcttatcaactaatatacttattcattcacataatttcgcactttgcggagttttcatttgtcgttaaacccgacagattcttgaaccgcaaggaacgagacattaacctaatgtacttatatttaactatagtattataatagcataaatgtgacaatgattcgatcactactaatatattaatcaccaatctatatcgtcgtccttcctgattatttgaagattttgtctataaactagctgcttttgtttatgtatttttattacttggatgcttttgtttgttggaatattcgaatgaatttttgtttgcctgaaactatgcatatataataaggccatatgcgccaataatatagaatccaaatattcattaactataattagtttgttctagagttttagctactcatatattcaaattcttaggagatcaaaaaagtacttaattagttaataaaatccatttttattagttgtaattaaatgtaaagtgtcgaaacacgaaagggaagatgagttgcacaactcgtggttcctataagagtgataatctatctgacgtcacgccatgcaaaatgtatcaatcaattttcttctcacatttatatttacttcaaaatgattataaagccacccaatgaataataagatatatatatatatatatataactcaaaatcaaaaatttcaaatggaatttggaagcatcacaaattcacaatcatgtattcaaaatctcacgtagaaaaagctaataagtccaaaagattggtcttcatttttttcttgagaaagtttgatgggatagagagagagacagagaggaacagctaaatttgctgtgtatgtatttaatacttgaacatttatttatctattttcttatacatcaaactcacgaatttataggttggtaatgtcgtttttataacattaataaaaattgcaattgtagtttttattgaaatttacccaaaaaaaactattatacgaaaatatgttatttatttaaaatttgatattagatgaatccagaatcttttataaaacttggtgtgtgtgaacctgcgttaatttgttaaatacttttcacgtaaaaatcaaaattaattttaaaagttatgttaccaaacagtattctgatagttttacaaattttatccattgtatatgttttgtttttgcaaaaaagtccaaaggaaaaaacaaagcagaagggttgaattgtgaggaaagagagagtacgtggcatcataactttggcgacagctaatgtgaaaacagccaaaagctacggagagcgacactcctcgacgacgtccatgtctctttagattgtgattgcattgttaattatcatatttatcaattgattagttaagtcttaagtatcatcacacaagtttatacattaatctatacagtgtttaacactacaaaactccccaaaatcacgtgtttcatatcatacgtacatttgtctaccgtctttattaacaatattaaaacagaatttatcaattttctagttgaatagactatatactattatagagactcttataaattatgaaactcctaatcaattaaaaatagttaatttgaaacatatcactcgaaactagggtattagttggattgacgatatttttcttattaatatcaacgagaagaatcaagtgtcgttagctcaattggtaaaaaatttaggcaaagcttagagatgtctatttgagtgacgcttggaacaaaaattacatgctatggtttcaggcctagagaaatgcttcgatccagaatctcttgatattcaaaaaaaaaaaaaaaatcaacaagaagaatgtataaatggtttctatactatctaagttatgaaaaatatttttggttacccaaattacaagatttgtaccgaagtgtcacactagattcacatgcatgcatagttataattaacttaaaacataaatgacttacaaaaatacttacaaacaaaaaccaaattaagttatttagtggccagctttgttactagagttttagccattatcataattcacaataaggtgtaggaaaaaacattaatatatagtatgtatacatccaaaaaaaactttttggaaaaaacaaattttgggattataaaggacacgtagcccaatcgatgaacagaggacggcaccgaatcaatttgacttcaccttttttccccatatgataagagtctcatctctttcctatatatatttcgtacctctctttaaggaccctacgtctctctctttctctctactctctgtttcctcataattcaatcactatatttttttaaaaacatttgacttcatcgatcggttaacaattaatcaaaaagatg

SEQ ID NO: 9311 - DNA, 3000 bp, Unknown
  misc_feature (1)..( 3000): cDNA_ID_2025014_gDNA_ID_1972068_Annot_ID_178492 3000 nt of promoter + ATG
tgaacccaacacctccatatgggaaatttactactagactaccaccacgttgtttacaatacaagaaaatgacatgaaaacgattgtagtttataacattgaaccctaataggaaccatgaatccgagagagaacatggcaaaaactcaatttctcattaatgaatcagaaagtttgttacatcaatgtatagacaacaaaccaactaaaccaaaaataaaccagagattcactttaattagaatgaataaaccgggactataccgaacccttaatgacttctattatgtacaaatatacttagtatagaaactatacacaatctaataaaccctaacactttcgagatgatttagaattgaaaaattagtataaaatgcacgttgaagaaaaagcacgattgacatatttttataaatagtaaaaaaatcttggtcaaattcgagtagacaaccttatcaaaaaaagaatttataaattagacgacaaagtgaagcaaaaacagaaaacgttatctagaaaacgattaaatgaaacatcacaacctaatttcttcgtcaaagtaaaaaacatcttatgattcataattatccaacggaaaacgacacagatattataaataacttttccaaataaacaaaaatgaattaaagtaataaaatatccattcctcttcgatcatatccacagttcccacaccaacatgtcgcgaaagttcctaaaaccgccacgtgtcagtcacttatccaacagtaatccaattattcgtcaagcctccggtttattaccgtctaaaccggtagctcctcccaaatcatatggctcactcacttctccgtctatataaacaaaacatctcttactcttcacaaaagaaaaaactctcttcggaatctgaaaagccataaatcagcagaaaaaaatcttaaggatcggaaattttataatcggatgaatagagtgattagtcagttttccggtaagttgatgaaggagaagagtgttaccggtgtaagcggcggagatacgactttaagatctgccgtcaaagaatcggtctcgtctccacagagtgcgtcgtcgtcgtcgtcggtgaggaggcttaaaggagatctggaatcgagtcgatttggtgcggcggcgagtgagaggctgaggcaagcggaggaatctttgaggacggtgatgtttctgagctgttggggatcttgttagatctggttgagaaaataatagatgagaaaacgaaaccaaaacgtttctgtttgtgtttttgagttttggatttttgttttctctgtgaatagttttttttttttttcgttttctttgtactttgtgttttatgtaaatcatgtataaaatgaaaagtaaatcaatgaagataatggtttgtcttcaccaaatcatgtatttacatgtggatttgaactatagattatacaaaaaaattagtttgataaagacgatgactcaaaatgtaataagtatgttattttggattttaataagtcgatttttagataatgtataattggtaaatcgttaaataaatcgatatataaaagttgtattctaaactcagcaaattgtcataccatgcctaaataaaaatgctgaaataggtagatttggtccattttggttgatactagaattgtttgaagtctacatttacgattataataatggataacaagatattttgtaagatgtgagatggtcatatagtttggagttgtcaagctataacgttaaaatggtacaattatttatcaagctaagcgaagatttacagcggatttttgacgcatttttaatcgtttttgataggtctgggcaaaatatctaaatctgaagaaccgaatcaaattcgataaaaatttttgatccaaacttgaattcaaaactttaaaatatccgaacggatcacaaatttcaaaactcaaaaatccgaattcgaaaccgatccgaatatgaacccgatcaagtatccgaacatatccaaaatatatacataaaaataatttaataatatttacacaacttaagttcctaaaatatttgaattttaaaatattttgtatattttggatacttaacctacttttcaatagatttggatagaaaatactcaaattttgttagaaaattttatatatttttaagtaatttaaatattttgatacaaaattttgattttggatactcgggtgaatccgaaaaacagatccgaatctaacttagagtcttaggtggtgttattcaattatggtgttaaagtcaattatttaagctttagatttgttttctgatattgcttttaagaatatgtttgtatgaatttcaaaatctctgcaatatgtcttggattttgattttaatgatttactcatgaaactccaaagagctttcatttcaaatcaattaatatacaaagattttaaaagtcttttagttttgaataacattggattttaatgaaatatttcaaatcttaattgaataacaccaaactttagaatctattaagcatgatttacaaatatgagttccaataacactagattttaaagctggatttagaatcattagttaaataacagtggattagtgtggatttcaattctattaaaatccattaacgaataacacccccttacaatatccgaatggatcttagatttctaaatttggaatacccgaacccaaaaaactcgactcgaacctgatccgaccccaatccgaatacccaaaaacccaagccttattttttgagtgtaactcaaccgtttttattgcttttcagaacgcaatcactacaacaaccaaaaagtaagctttaagcgaatccaaacgctatcgtattaaacgctattactatctgcgttttagctcttcatcttcttctccacttcagatgactttctcgcttaataaaaaaacactaacccaatcaaatccactttaatccttccctctctcgcgtccgattctccg

SEQ ID NO: 9312 - DNA, 3000 bp, Unknown
  misc_feature (1)..( 3000): cDNA_ID_2034963_gDNA_ID_1972068_Annot_ID_178489 3000 nt of promoter + ATG
gatgtatacaatgaccattttttgaaaattggggaattaaatgacatttttcccttagtaaaatacttaaataaactggatatttacttaatcgagaagaagaagatgttgttttgttttgagaaatttatttttattgggataaagaagaaatttatgcagctggagaagaactttttgtaaatcatgcctaaattaatgaaatgaaggaagtctaaaagtaatatgcatcttcgacatcactttatatgatatatatgtttgatcttcaatcatcaatttgtttatttgctgaaatcagagaacaccattagtctcaaaatatgttgacttttgcggtgaaattgaagctaaagagcaaagaagtattctaataaaattgctgacctgctaaaaatgtttgtttcaacaaaaagtgtcaaataataatcaagtagatagtactctaagaaaaaacgaatgagaagcgatagtcttcttgtttccttttgagtggtagtgatgattacaccttgttgttggtggttcccttcctcttcttctcttttcgtttgctgttcctctctcttcttctgcgtcttgcaatgggatcatcaatttgcactaaacttgaaacgtaacagctagataacataattgcggtataagatcttgcagtgtttccaagactattcatttttttcaagtagccatcatctccaatgatgtaagaattgatgtgagaattagatcttttgcagtcttcagattcgactttatcaataaccaccgcgagtttcttctcctcgtcaatgaagaaattgttgtaatctatatcaaaccaaaaatcaagagcaatgagttgctcaatataacattttaagaaggaggtccacgatagtgcattgggctctatcttagtagtaatccaaatctctatcatagatgtatccaagtgctgatataaggctacgagtttctcttctctaacccaggatagactcatccaaccatgctgaaaaggtggatcaagaagctttccaaatctttctgccgtaaaatcaaaacagattagtaaatttggggtttcatctatcgtcctaaagtaagtatttccctttaccgatgcactctgcccatcatcatctatatcccacttgggaatgacatcaaaagccctccatgaataagacttcaaatcgtaaatttcgtatgagccctgtttattatcgagaaacctcaatatcttgtggtttttgttgttgtcatatctgagacaaaacgtggaatacatagtttctgttttgagttggatccacctgatttgccccaaatacgggttccaaatcacgagcctagtatccgtggtgacacataacaatataccgccgcagtaatacatatgagatatctcaactttattaagaaaattaccaatctcctttactgataagttaacgaattcttcaccattttccttgaaggttccagagatattgaacctcattgaacgaagcctataatcagacagcatgaacccttgatgaaactgctgttttggttttgctttacatagaatccgatctttggataaagcgttccatcctttgcaagtggatctcactgctcctagggaagttatcggaaccctagacaatatctctttcaccaaatcctgcgtaagatcgaacatcatcgtcattattttcttagtatgtagaaattagggttttcaactctttagctagcccactcttttctacgattattaatataggtttctacaagttattattttattttttttggtagtaattaacgtaaacaagtgtcgggccctttttaataactttcactaagataaataatatgcggtttctaatcttcgggaaatgttaaatatacaaaaaaataaaaaggacatgtttcctcactaatggaaattccgtatgtgaaagtattctctttctgtatttagttttttattttggatcaaaacctgctctatatttctattattaactttctacgacacaactaccacatgaacaaagtctaaaacataaaaattaaggaggtaaaaccgctgtaactgtcagtgaaactgcttcaagtccctgcggaaacattaatacataccgataccgccgaatgggattagggcatatggttatcacacgaccactcttaaattttaaatactcatttttgacatggttaacgacacgaaaccggttaacgacggggaacagaatgatcaaatgacaagttggagtagacatatcttgtattttctgtagtgagcaggtagaagaccgagaacacctattctttacatgtggatatgctaacgagatttggttagggctaagcaagaaggttatgggtcataattaaattctcaacaagatggaatgatattcaaacagtcctcatagacatgtctttggggatgcattgcctattcttaacatggtacaactttcagctctattcaatttggagagaacgaaacagttagagtgaagaagtattgatctatatgctaagtataagagactctctaagtgtttcagaaggtttcagggtcaactggttgacgagctaaggagatcgtgacacgtggagcgatccaatccgtttactctcaacggcattttcttatcctttactcgtcttattctgtttcctttcagtattgttgtttctctgtagatttgattgatttagaaatttgttgaataagagaagtgagagagagaaaacagaacgattgtagagagagaaagctcgttttgagctaagtgcttttagtgaattccggagacatctccggtgagacgtagggttcctcatcggagcctgaactcgtaaaatcttgtgtgtctcttttaaaggttctttgtgttcaatctcacacgagtgtccgatcgatttcgttagtgttcttgagggttcgaggatcacaaattggtatcagagcccaggttctgagctcaagaatttcagatcgattcaagg

SEQ ID NO: 9313 - DNA, 3000 bp, Unknown
  misc_feature (1)..( 3000): cDNA_ID_3041167_gDNA_ID_1972068_Annot_ID_178511 3000 nt of promoter + ATG
tccatacaattcttacttctagagatccaatgcataatgtgcccaagaatattgaggccagagagcgtcttgctttctttagcaactctctctttatgactatgccccaggctcccagtgtagaaaagatgatggctttcagcgtgttgactccttactatgacgaagaagtgatgtatcgacaagaaatgctccgagctgagaatgaggatggaatttccaccctattctaccttcaaagaatttatgaagatgaatgggtgaattttctggagcggatgcgtagagagggagcagagaatgagaatgatatctggtcaaagaaggttagagatcttcgcctctgggcttcatataggggacaaacattgtccagaacagtgcgagggatgatgtattattatagtgccttgaagaaacttgcctttcttgattctgcttctgaaatggacatcaggatgggaactcagattgcccctgaggcacgccgttcgtactacacaaatgatggtggggataacacactgcaaccaacaccttctcaggaaattagcagaatggctagtggtataacccacttgcttaaagggtctgagtatgggagtgcaatgatgaaattcacatatgttgtggcatgccaagtttatgggcaacataaagcaagaggggaccatagagctgaggagattctgttcctgatgaagaatcatgacgcccttcgtattgcatatgttgatgaggttgacctgggaaggggtgaggtcgagtactattcagttcttgtgaaatttgatcaacaacttcagagagaggtggagatctatcgtatcagactgccaggccccttgaagcttggtgagggaaaaccagaaaaccaaaaccatgctctaatctttacacgaggagatgcgattcagaccattgatatgaatcaagataaccattttgaggaggctcttaagatgaggaacttgttggaatcattcaagacttactatggcattaggaagcctactattcttggagtccgtgagaaagttttcactggttcagtatcttcactcgcatggtttatgtccgctcaggaaacaagttttgtaaccttaggacagcgtgttcttgccaacccactgaaagtgaggatgcattatggtcatccggatgtatttgatcggttttggtttgtgcctcggggtggaattagcaaagcctcaagagttataaacatcagtgaggatatatttgctggattcaattgtactttaagaggtgggaacgttacacaccatgaatacattcaggtaggcaaaggaagggatgtgggtttgaatcagatctctatgtttgaagccaaggtagcgagtggtaacggtgagcaagcattgagcagagacgtttacaggttaggtcacaggctggacttctttagaatgctctctttcttctacacaacggttggctactatttcaacacaatgttgatagtatttactgtttatgcattcttgtggggtcggctttatctagcacttagtggtgttgagaaaatagcaaaggataggagtagcagcaatgaagctcttggtgcaatcttgaatcagcaatttattattcagctaggacttttcactgcacttccaatgattcttgaaaattctctcgagcgtgggtttcttccagcggtttgggacttcataacaatgcagctgcaacttgcatcgtttttctacactttctccatgggaactcgaacccattactttggccggactatactccatggtggagccaagtatcgtgccactggaagagggttcgtggtggagcataagaaatttgctgagaactacagattgtatgctcgaactcatttcattaaagctattgagctcgcgattattctgttggtatatgcggcttatagcccgttggctaagagttcgtttgtttacatactgatgacgatttcgagctggttccttattacatcttggattatttctccatttctgtttaacccttctggcttcgattggctcaaaacagtaaatgattttgatgatttcattgcatggctatggtctagaggcgggttgtttacgaaagcagatcagagttggtttacgtggtggaatgaggaacaagagcatctgaaaacaaccggagtgtggggaaaactgcttgagattatacttgatcttcggttcttctttttccagtacagtattgtgtaccatcttcgcattgcagagaatcgaaccagcattggtgtatacttaatttcttggggatgcatcatcgggattgttgcgatatacatcacaacaatctatgctcagaaaagatattctgtcaaggagcatataaaatatcgattcattcagttcttagtaattctccttacggttcttgtggtcgtgatgatgctgcagttcactaaacttacagtagttgatttgttgataagtctcttggcttttgttcccacaggctggggattgatttctatagctcaagtactgaaaccgtttctgttatcaacagtggtttgggacacagtaatctctgtggctcgcttttacgaccttttctttgggctgatagttatggctccagttgcattgctttcatggttgcccggttttcagaatatgcaaacacggattttgttcaatgaagcttttagcagagggttacagatttctatcattctcgctggcaaaaaatccacttgaagcaaatattgggtatggttcagaataagatcttctttatatgttacactgattactattaactaaacatccattaataagactgatttcatcatatttgcagggttcttaaagtttttgaaatgagttggtctgagaaggttgggcgatatccttttctctagcaaaaaaagttttgcttgaagcagcttatggtagcctggtttaatatcatcctccaccgttttgtggcattgctccaggttaagcctggtttttcctcatg

SEQ ID NO: 9314 - DNA, 3000 bp, Unknown
  misc_feature (1)..( 3000): cDNA_ID_1989590_gDNA_ID_1972068_Annot_ID_178500 3000 nt of promoter + ATG
cgtcgtttcaccttatctatcatgttttgatatgggggaatgtctcttttatttgcattttaaactttataatctttgtgttattttttatatatttggtttgatttaaatgaataaaaacaagtctttatctaaacacaaaaggacccaaaaatggtcaaatttgggtaggtctaagagtgggttgtcaatctccaactaaccatgttttgatgtcccaacaagctcttgccttcagatttgctagtcctaattattctttgaaattataattcataataactaatgacctaccaacttcatcatcttccactaatctaccgagtaacatgttaggatttagccaaatgtcatttccttagttttggttacaaccacaataaaaattattatagtaccctatatatatattatcattcaaccgtagaacatgcacaacgttgacaaaataccccaaaaatgtcatttcctttgttttactcttattttctaaacaggtgattttggattaaaggttacttaattttggattttattataatcgtcatgtaaattttctaatggtcaagagaagaagacttcaacgagaaacgacttttttggcattgaccaacaaaaaagtgccactaaactaccatcatgggagtaattacaaaagctttgcgtagtcaaacattcggacatcaaagacaaaaagtacacaatataacaattttaggtggaaaaaacaaccaaaaacaaaaatttgacgcgttttcttgttaacaggagtattggttaatacttaatagctttaactatgcattgtaaaaataaatcataaaaggatcaatgacgatcttgattgtttagaaaaaaaaattatttcaaaaagatttattttttaggttttcaatgcaatagttattagttataattgataaattgtaaactttaatacaaattattgaatatcattggtttagagttattgaaaattgtaaatcacaaagaacaatacatttaaaaacaacatttaatatgttttcttaatatttgtgtttttcctaaaagattaaacaaaaaagaacagaaagaatatgaaataagaaaaaatgcactagctttttttgtttgagttaaaaaggactatatttattaagaggtaaatagtatatcatttttacatgttttaacgctatgtaaacgtgattaagttacttgttatcaaataatcaaaattttatgattttcatgtttttgaaaaatgatattgccgtatactgtgaatgtgtaaaaatataggtgaaaaaaacaaacgccaacaatctattatgcttaataatgactcatatataagaatagtttgctcatttcttatgctttgttaattgttgttgtatgctaagagaggattgatgtttctagtgatgtgctaggaatgttctcatgtataggatgtatcggatcttgaggttaagaaatagagattcacatttccattcttaacacaacataaataaggattaaggctaatgaaaaagagttcacatattacacattttactaattaatcatggtgattagataaaggtaacaactaaaagtcattttaaccgcactcaatattacgagcttgttagaacactgtaacacaagtgttctcttccagtttatcaatggaggaaactggtaaaatcccatggacgatcttcttctctcatcctctgttctcttgtttcatttcactctacactatatttcttctttatttccctcaagattctcttcgaattcttatttcccatgtccctctcctcatcggagctttcttaatctcctgcctccatctcgggtcgacccggaaatccattgcccgacccggaagcaatgaggattcgataggacctgaactcaaaacgggtctcggtttaaacccggattttatggaatggaactttaaattgggagctccattggaagttattcacaaagaagaagaagaacagtcgatgacgggtgtaaaagatccgacccggttcgtgatgatcaagaggtttccatcgttatcgatgtttaacccggaatctgattccgaattggaccgcgatttcccggttatgagtgaaaatgatccaacccggttcgtgaggctggaaaggtcaattaaaccggaatctgatatggattacgactccgaattggacaacaatttggttattgatgtaaaagatcgaactcggttcgtgaaggtggagatattcccatcgttgtcaatctttaaaccggattcgaattccggttcgccggagaaattgcgttgtatatacgaaatcaaaacggaaacgctttttgtagttttatattcctggagaacaatattctaacaacttgttttggcagcaatattctgatttctgagtataatttgattcgtcaagtaaaatctaattttataattctcaacaaacaaactcgaatttgatttctctaatgtgtaatgtcgtcacgatttacgtataacatattaaaagttgtcgacaaagaaaatgaaatacatttccaccaaatataataagtaacaacatggtcagattcagagaggacgatctggcttggccaccaagattgtttgacaagtatttatttaactactatactttctcttccacaatattaataatgttttaaatgtcattattaatacgtgacgaaactgtagctctgaaataaatatattaacaaaacaaataaatattctcaaccaatcataacctcgtatttgtttttgtttccatttaaattttattttgactcgacttttacacgcatgccacgtggtcaaccaaaacgtatgacaaactctacttctccaccgtcacaatcatctcctggccccctctagatctctctctcttttcctccttagattaaaatttctccaggtttcttggcgttactgtgtgaaaaattcttcttcttcttcttctcagcgattgaatcgaaccaagagcgaaaatg

SEQ ID NO: 9315 - DNA, 3000 bp, Unknown
  misc_feature (1)..( 3000): cDNA_ID_2034990_gDNA_ID_1972068_Annot_ID_178480 3000 nt of promoter + ATG
atacattaggaagggagcatatgataagtttttttttctaactttacctaataatcaaatttggtgctctctattattgtgacgtcaatagacataaggataaatataggaaataaataacattaaattttataaacttttatgaattgtttttaattcaaaaattagttcaaactacataagcgattttatacaaactttatgacatgtggcatatttttctatgttttatttccattttcattctcacttgaaaagaaatgatatacataaggtatgaattataagaaaagcttataaatagtagtttacagttttacattgatttttattttatttagcatgttataaaataattattcttatcatcaaaatatatattttcaggttttttttttatatgaagatacatcacacaaaggatctattcatccaccatttttattaagtgatgagggtttacagtcatttttgtttttgatttgcttgggcttttcttatttttgctgatctgttcaaaaaatatgggcatgattatgagacctgatttactccatatttagcactttatcaaggttgtaaatattctttttgttaaattttattagtgttttcattgttttttgttgcatttagtatccacgtgatttttcttgtgttttagaaatcctatagtgtctttgtgtgtgtgtttttagttatgtgaagttaaaataatggaatacacacatgtagatgctaagaagagaaatgatgatcatgaacaagtccaaagtgtcagaaatatcaattcggatgaaggccttactttcgaatttagattcagaaatttagttagctttccactgatggtgatttcaagccaaacggaacagaggtttaagaattatcatcgatttagtagacacatatcattttcatgcttaagaaaagctcatccagaaattttccttcaatgccagaggttatattaacttagtgcagtaggatcaacatacaattagagactttttaatgatgtaatcatctaagatatgatccactttattttggaataatccggtccaaacaaatttatattcaaggattttttagacattttttaatatagtgagatcaacaatttttagacatttttaatacagtgagaccactagagactttttcatgatatcattatccaagatttgacccgttttatcttgggtcgaccaggtctaaacgaatttgtatttaagcaatttttagacattttttaactgaaatttgttttgtgaaggattcttcaattctatcatttatatttttgtttatgcatttttcttatatctttcaccatgtttaatgagtagtcttttgtttgatcatgagttatgatagattaggataatttgatagttaaatgatgatgatttatattgcttattgtagatttcttcatttaggttaatcttattattatgtgcaccgattatgtggttcataagtatctggtgaacattttattttaagtttttttgttaggttatacagctaacattaaaaaatagtaagaaaatacaagggataatatagtgaaaaaacactgatagtgagaacatatttcctgaagtctctcttcacttcatttggaaatggaataacttattttggcaatgagatgtttgattactgaacaataacatttggtggtttttgttcggaagatttctaaattggtgaaaatagagcagcatcttgtggggtttgatcaacatatacgaatgaagtaaaagaatgcaaagaaattgcgattaaacactatgcaattaaacctcattatggtcttagtaactgaataatctactcagttactaatgtataaatatatttttgctttatgataattattaattattattcatgtaaagtttaaattccaaataaacatatggattagtcatacctcaataattactcttttaatagtgcataatatttagttacttaattacttcaatcaagttttttttttgagttttcttgtcaataaaaaatgtcccgtttttttttattttgcatcaaaaaaagtatatataaaagaatacagagtaaaatagtattttaaacataaacttttcactttaacaaaattttctacttcaattcttaactagcggcacaatacttatttattttaagtgtttgatgatactttttctacatgtaaaaatcaattaacatatataaggtaatttttcaaacaaaaatataaaaatttcaagtatatttataaaattaaaatatatcaaaactattaaaaaaaattaaaactaattttattttgcacatcacgcgaggctacttctagtgtatatatattgtttgatgatgttgtgttttatatagagaaaaaacaaactcatagcataatgctttttaatttcgtcagaaaagccaaattaattagacaaaactacatttttcttctaaccacaccttatagagtgcttttttctttcaagtgcgtttctatatctgtgacgaagaaatacgtatcgcactgctttttcttttctttttttcttcaaaaaaagagtttgaaacaaacttaatggtgagaaataagtagaaccacacataaaaagctggaacgcgtcgtacattcacgcccttactttaatctatttggttctgtttctttttcttctgtgtctcatattatatccttccatatttgctgtcaaaaaccttttaaaagtcttattattattttacttgctcatctccttgtattaagaatcttgttttgagtttttgtgaaagcgttactctttaaataatcaacaaactcgttggctctgcaaaaccctcatgcatgtgctaagttccaagtaagtgtctatagctttctgctccaacaacaaaaagaaaaagaataacatcatccagtgtttgatccatttcttgaatcttgtaaaagggttatgttcttttgatctctctgtaacaatttcgaaa

SEQ ID NO: 9316 - DNA, 3000 bp, Unknown
  misc_feature (1)..( 3000): cDNA_ID_2035016_gDNA_ID_1972068_Annot_ID_178472 3000 nt of promoter + ATG
cgttttctccattttgctaaagactataaatacatgtgttttgtctcttaactccatctagttgatgatatacagctctctctttctgttacgtatcttaaatctgaattttgttcttttacattttcagatcaattcaattcacgtcacatgttggatatgggcttcgccccaccaacatgtttaaaagcccaacacatcgaaattagcaacaaggaaggaaggaagaaaagatcggcccgttaaagataaaagagcccagcatcaaacgaagcccacctcgaggaagttgttgatcaagagaaagtcccacatcgagaagaaaactgtactatagactgtccttgcagtactataaatactgacaaaggaatgtcagaaaaggacacctgaaatatgcagagaagagcaataaaaacttctacttcggattcaaaagcataagtctagttttgacttgtgaagtttgtatttacgtaagtttaagctcggctgtagaaacaccttgtaaacggccgaacttggggaatattaataaagatcttccttaaggctcgtcatttcctttttggtttggaggttcggttttatacaccaacatcacagtatcttccctttttaaaaaaaaatatttatctcacagtaacatgtatatcttcttctaactgtttttttttatgtctccataatggcttacgtctcacaacaacttgttttctttaatatagatagagaagacagattcattttacaaaataaatataacaaaacgtatatcaacataattaaatgatttcctgtacgtagtacaagattaataccagtatattagaaactttaagcctctaagaaaaagtaaaattttaatcaaaatttaggattaagaaattctttaaaatgtcgaaactgttcaactatttattcgtaaacgcgcatattaaatacccaagaaaaaccattatttttcgtttagtgtgtaccagtggcaaagtagtagcctagctatattattttttatttttttttgaaaataatgttaaattatattccaaaaaaaaacgtttttacaacaagtgcagattggttttgagaattagagctgagaatagttttgaacaaaagaaagaaacagagctaagagattaacttcttgactgaaaccaaacttggagacttccatcataacgcttgtcccccttgaaacagatagaggacagctgatttctaatttgtttatctatccaaccaacgagttgagatgctgtgttcggaggctcgccgtgacgcctaccattccgctccctccacacaatgtagattgtggcttggaaaacatagcggcggagaaaccattccacacggtgatgctgagagtttgtaatggcttcaattatcgattgccagtgtgaagtgtactgcgttttgaaaattcctctcgctaaatctacccaaattgcagaagtgaaactgcaagtaaagaagaggtggtcccgtgtttctagagtcccttggcaaaaaatgcagtctgttgcagtgccatttgcccaattgatcatacgatcgcctgttgggagtctaccatgtgctgcaagccaggagcagaaagagtattttggggtggcatgactgaaccaaatcaccttatgccatggaaccctagctgacgtagaacgagtatgatgccaagtatctctagtagagaaagtagtcctgaaaacatcagattttcctctccaaaggaccttgtcttcagtttccgttctagtatcccaagacttagcctagctatattaacagtaatgaattttattaggaaaagttttctttttcatacaaaactgtttccagataaccagaaatagaaaataattaaaagccttcaaattttagggggtgttattggtttattgatttgtaaatctatatagaatttgaaaatctctattaattatgaaatcaagatatatggatttttaaataacatgtatttacccatggatttgaatccttctatttttctctttcaaatccattcaattacatttaaaacataatttgggttctcaaatccaaaaataaatgactatgcgaataacaaaggattttaactagtatttataaatcatcgaatcaataacacatgattttagttagaattttaaaatcaatgattgaataacaaataattttgtttggatttccaattccttataaatctataaaccaataacccctccttagattcttatgtttgttttgtttattgtaaataaccaattgtcaataaattcaagagattttttcggaaaaacgaaaagctaaataaacaaaatatgatgaatttttctaaaactatatagactattttgttttgttttatggttgacgatttaggtcttctggattggtgttagtatttaggtttactgtacagtttaagggtggtttagactattttattaatttttaaaaacctatactattttctgagttttcaaataaaatttaaattaatatcataatttttccaatgtaattaatggtttatgtcttttatgttaaatgttaaaaaccatctaatgaacgataccattgaccaaactatgtatactaattttctttgtattactagtgttgctgtaatggtgttgttctcttaatatggaagaatatgcatttaatgatcaaaaacaaaacaatgtgacaatttaacacttgtgattttttttaataaaccatttaaaaattatgacttgtgagctaactagcttgtaagtcgtattttaacattgtagcacttaacacgattgagtcttattctaacattctaaacgtcaaaccttgaagctttgaactagaattaagaaatcaacaaacacgtttattgttcatcaagatcataaatccacaaacacgttgacacttcaagatcataatactaagtttccaaacacgttgatatataaaaacaaacatcgtaattatttgcgaagagtaaca

SEQ ID NO: 9317 - DNA, 3000 bp, Unknown
  misc_feature (1)..( 3000): cDNA_ID_2035036_gDNA_ID_1972068_Annot_ID_178467 3000 nt of promoter + ATG
gccatgagattttggaattttgcgggaaagtattcattcaatttataaaaagaaaatattttgattggggaataataatgatgattgttgcgttggaatatttggataaggtaaaagcaacataagcgtgaagtaccagctaccaaacgaagatcttgacgcgttgatttccgtatcaacggacgaagatgtagagaacatgatggacgaatacgaccgcgtcgcacagaatcaaaacccacgcgcctctcgtcttcgtctttttctcttcaccaaaaacgtcgccggagaagaagataacgatagtcgagctagcagtatcagctctctcctcgatagctctgttaatcgggagcaatggttcctcgacgctcttaacctcggttcttccgccgccgcaaccgcggtatctaacggtgggtccggtagagtctttgagcgagttagatctgaagtctcgtcgattgtttctgaagttcctgattatctctttggattggataatttcgatgaaactgctccgccgcatgagcttcgtgatcgtgatccgagagctaagatccaacgagaagtctcgacgctttcggatcctggttcgcctcgtcgcgatgttccttcgccgtatggttcgacgtcttcggctcctgtgatgcgaatatctacaccggaacttccaccaccagtttttattaaaccggaaagtccagaaccggtttcgactccgaaatccaatcctcaaccggaacaagtaatgcaacagagtaatctcccggttaactcgcaatggcaatatgcccctggcccaggccaacaggttcattaccagggtcataccattcaccaatcaccggtttattacgttcctggttcggttccgggtaatcatatggtccagcaaggaaatcatatggttcaaccgggtaatcatatggtacaaccggttcaaatgccgggtcagtatcttcaacaataccatcatgtaccaatgggataccaccaacctcagactcatcagatggctggtccgggtcaagtatatggtggaacggttaggccggttatgatggcagttgatggaatgaaccggacgggttattatggaatgaaaacacccggtccggttcaaatgtatcagcatcacactggtatggttgttcctggtgtagaagaacaacaacaatacagaaccgaaacggattcggatacgggtcgggcttcttagctgtttgaagaagaaatatgaaaaattatcacatccggggttttcgtcttttcattggagtcgttcttattcgttactgtgtgaactgtgtattattttttgttttacttttgtaaaatttatttttgtgtgtaataattttgtattacaaaatataatgaacagtaaaacccaataataataacattataatctatcaatagtgaattacatttgctaaacttttttttgtcatcttattactcgatttatcataataatgttaatggaatataatttgtcaatcatatgttcctcttcgtctttgctggtgacttgtgaggaagtagatatgtcttagaaaccacaccgaattcaatctcatatgtttgttggtgatgtcttcatagttgtaacttttaatacaatctaacaaagcataaaatggaagggaggtaaggatattgtgttgcatcattcttctcacaatcacttcttctttaccaagattgtcgaagcatgcattataaccattataaccatgcatcttaaacacatcctcccctttttttccttttttgtcgatacctttttatgttcatttgaactttctctttatgttcatttgttctacaagtactattcttgtaaaacatgttatttgtttaattgtccctactcactagtcactacctattttactaaaatcacaatttctacttttagctaccatactattcataatcgtaacaactaacacacttacatgaccaaaaatagatttttgtaccatttaatcttaactattaatttgtaaacgatctcactactattgtaacgtttagtccgtccttactagtgtgctccacgttctttctcaggtctatggactcatccctgtccgacgatcggtccgccaaatctaagaggttttaaagacttgttaacgatcctacaaatcactatacgatatttcatcatgttttatcctcatttacatggttctgataatcatttctcggaaggtcacctatcttaaaactacttcgactcaaacacgtttaactgtggagttctccgcataaattaattattttattctctataaaagttatagaaatggtctcgtcattgtactgattgacatcatcaactggagagacatcaactttgggagctgccaatctcagaagaagtttatctcctttacatgccgaggtggaagctctcctctgggcgatgaagtgtatgattggtgccgacaaccaagatgtagtttttcttacagactgttcagatctggtggagatggtgtcttccccaaccgaatggccggctttctcatcgtatttggaggagttacagagcgacaaggatgagttcacaaacttttttctatctttaatctctcgtagtactaatgttaaagcggattttttggcacgaaaagttcgtacccaaccgcttcatattacatctgtaaacaacattcctcaggattggctcgtttgagtcctaattaattttcggatgacaaaaaaaaaaggtctcgtcattgttaattattattctaattgactattcccattaaagcaatcatagagttacttaagtttgacattcataaatttatgcgactatgattaattattgactaagaaaaaattaaatactaatagtactaacattaaagacaaatgtaacgttttacgtgaagtaatcagaaaccagaaatagtcttcttcttcttcctcacacacatacttctctcaccttatcctccgagatcggaaaatatg

SEQ ID NO: 9318 - DNA, 3000 bp, Unknown
  misc_feature (1)..( 3000): cDNA_ID_2035049_gDNA_ID_1972068_Annot_ID_178463 3000 nt of promoter + ATG
ttgtcaatggtttggaaaagctttgcggtgagatctttaaggctttgcttctcttccttaggcttagcggagataacggtgttgagatcgtaacggaggtacgatgctcttaaacggagatcgttctgaacatagggccaagcttttttgtcgataaatgacttaacgttgatgatctctttagcagaatctttggctctagctgcagcttctgttggtgacaatggttgtatgtaaaatctatctttcaatgccaatgaaaagtctcttgcttggtctgagttatctgttccagctgctcacacacaaaaaaacaaaaacaaaagcagaaccataatcaatcaaacagaaccggtctctataatctaattactaaaacttttatcttacaaaagtgattaaagatacgtttgataaaaacctaaattataaccatgcaagctataacacaataatttcgttttgttatctccttaaccaaaaaaatagtattagtcattatgtgaaatttaattaaattagttttacttacgtaggccaccggaaggaagtggaggaccaccaactttgatcggaatagcttcggcgaaaacagctttaacgaatgaaccaccggctaaaccagccgccacgagtccaatcactgaccggcgactactttctggtactgacacgttctgctgagccctgatcacaagtccggttctctgagacccaaccgagactcttgagatgttcaaacggtttgagccgttgatctgtaaacttccttcaaggacagcctgagatgctccacgtaagccagccatcgaagtcactgcttgagccattttttttttatctgctttgaataattgattagtgaagtgttgagttataatttttggtgtttggttatgtgacaaagaataccttatctgattcacgttgttacttagattactcggatatggttttaactactaatatgttgacacgtggtttcttgattctcagttttgccacataggattgagatcgagtgttcccagaatgcgattgtcacgtggctgaatgacgtggaaattgaccaattcggttaaacctagtcaaagttaattgaaaaccggtttcgataatatctaagcaaattgtaacttaaatccaatccaacttgacaaataaatgaaatcccttattgttaaaaaaaagtacaaattgaaaaatagataattttggcctcaatttcaattttggattttgtacatagccattaagaataatttggtcaattcaatctattaaagtttatatgatccacatttttaatttcgggtgggttaggaataatagtcacttattcacgaattcaaatacctaatcatgtttagcatccaaagtagacaatcttaaccgttcaacaatattggtatcactacttcattttggtatctaaatatgagcatatttcattccaaaaagaattataatcacaaaaataataataataaaaaaacttataatcacaaaaaaaattacaccgtttttactattttacatttttgttactactttacttatatttaaattacatacacacattaaaacacattattttaatcactaaataacaactaaccaataaaaatctcaatcattatttataaaaatttaaaataaaagaaatattttataaatttataatataaatataatcaaatacttaattaaaaaccatataagattgacgacctgaaagaggatggatcaaatgcaactttgatggctcattcgttaatggagatgtagaaagtaaagcaggttgggttgttcgggatagtaatggaagttatctactggcgggtcaggctataggaagaaaggtggacaatgctctggagagtgaaattcaagcgctaatcatttcaatgcagcactgttggagtcatggttacaaacgggtttgctttgaaggagataacaagatgctgtttgacctaatcaacggatccaaggtacattttggcgttcacaactggatacgagacgttcattggtggtcaaggaagtttgaatcaatccatttcaattggataagaagacatcacaatgttccagctgatattcttgctaaagctcctctccaaaaccaatctttattccttaatcatttttgggttcctaatgtaataagctatgctttacattgtgactacactgctgatttataaatcaataagatgatgatgacaaaaaaaaaaaaaaaacatataaaaccgaggcccgctgtaaaccacgggttgaatcctagttaaagtaagtaataactctccaaaattatcccaaaatcgaatattaactgcgaatcaaactaaaaacaagaatttgaaacttttaaaacccttcattttatacaaaataaaagaaaaataattttataaaaagatttaaccataaaatagaaaccaatttgattaatatcttacttttttttctttcccataatttatttagccaacaaaaagtcacgcaaaatatggaatatcactagtgttaatggaccgagttttaagtcaattggctcaaatggagcctatactttatataataataatttaaatattaatggacaagagtaacgttacaatgttgatgggcctgaaagttaagtcaattggcctgagagtaagtatctaaggaaaaaaaagattattgtttaatgctgatgggcctgaaagttaatattataatcgaggagaagagtaacgttacaattttgacaagagtccgccgatctgttttcaaatattcaaacaacaggctcctccttcttccttcctccttcctcaattcttaaaatctcccccattaggaaaaaagcaagaaccctaatttcccatctcagattcagaaaaaaccaggtctgatttctcccgggttcttaagaaatccgccgccgatctcgggattgagatttggatcctattgacgagcctaaggtgaagcaatccatcgaagatg

SEQ ID NO: 9319 - DNA, 3000 bp, Unknown
  misc_feature (1)..( 3000): cDNA_ID_2035112_gDNA_ID_1972068_Annot_ID_178447 3000 nt of promoter + ATG
tttatttcttttcctttttgtttttttttgccatttatctaatgcaagtgggcttataaaatcagtgaatttcttggaaaagtaacttctttatcgtataacatattgtgaaattatccatttcttttaattttttagtgttattggatatttttgtatgattattgatttgcataggataatgacttttgtatcaagttggtgaacaagtctcgttaaaaaaggcaagtggtttggtgactcgatttattcttgttatttaattcatatatcaatggatcttatttggggcctggtccatatttaacactcgtgttcagtccaatgaccaataatattttttcattaataacaatgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactgtgtatccataaatgggtgaatggaaagtttgttgttgagccaaaaaaaaaaaaaaaaaaatcatcagttcatcatattggtagtcttgtttgataagttctgctttttttaccttccagttttgccatttgatgttgcaatgagatttcttttgctaatgttttaaaataacaaagttgttgctgctagtgtttccaagttgtgtttgctgaaattagggtttgtaacttataagagaagcttgatcgctgctttcgactaaagggaattcaataacaacaagtttacttgaagaaaaatattaaaacctagaagaaaagagttacacctacaaataggataaaatccacataaatttctgttactaaatgtatcatagttttgtttcttctatgtatctacatatactcaaaaatttcaaagcattgtgacttaagggccagaagaaaacttgaagaaagattaaaacctattagcaaagagttaaagatccacataactttctgttgctgaatgtatcatagtttttggtttcttctgtgtcatatatacagactttctacagaactttttgagcacaaagcattgtgactttagagccacgagtaaaagacgaggcaaaatgtgtatcacgtccactaaccatataaactgtttcggctggaagaacacggttccactcgaatgactgatcttcgttcaatactctctctttctttctgtccacaaagaaatatccttcgtgaggcattcttatatgacccctccgaccactttcaaccaactcggttctcagtattttcacttgatccgtcgagttcacatccacctcaataaatctcttcagacctttacactcacttgaagctgccaccacatatactttaatcttcttcttcgggtcagtgatctctttgactgagtttgacgctggagattgctccatttgaggcacttgaaccgtcacagacgaatcttgaatcttactggtctcttggataacacgtctgggaacaatcacaattgtatccaagggtttaacactgttacactcgtatgactgatcttcgttcaatacttgattattgtgcgtaaagatgtacccttcttgagccagtttcataagacctctcagtgttttcacctcatccgtaactttcacttgcaccagaatattcgttgggacttcattcataccaggatatggcgacacatatactagcatctgccggactcttttttttccgttagtgatctttttgactaagtttgactgtggaaattgcttcgttggaggcacttgatcgttgttgttcttactcgcaaacttcacagacgaatcttgaatgttaacggtctctttgactgagtttgacggtggagattcctctgtttgatgcgcatcttgaatcttactgatgtcttgggttgtctcaggccgataactgtaaatctttctgatctcttcctctgtcaaaggccaatcttgctccgcaaagtactcttcaactgaaatccacggtgctggaggagattgctctgtttgcgggatttgatcgtcgttgttgtgaatagggttcacgtcaggagagacttcgagttggatttgagaatcgtggaagatctggcattggtcgaggttaagatcttctcgaagaataaaaatgccgtcgacgataagggtttgtttcgaaactgggacacgttgagacttctcgatcttctgtttgaccactaacaatgtatctgtgcgttccacttcaatctcgaacgatgaaccacccagaatctcgaccacaaacttcatgactctatcaatggtgtttcaagatca

SEQ ID NO: 9320 - DNA, 3000 bp, Unknown
  misc_feature (1)..( 3000): cDNA_ID_2035097_gDNA_ID_1972068_Annot_ID_178451 3000 nt of promoter + ATG
actgcatattaactttataacataactcaagtgataaattgatttgacagccaacgcttactaacacaagtatgacattcatttcaaccgtaattgccccaaccaaattcacagtagtggttattaaagtgaagaaattactgacgatctctgactatctcatttcaaacatggttaacccgactcttcccgacgatttactctcgaagatagctaagaacctggctaaccaatgctggtccgaccttggtccactggtacgatccggcactcgtggaagagacattgtctaccgtccggatgtcctcaaagatgccaatattctcaccttgtgtaactcgcccgatgacttccaagcttgagggggccacaatccctccggatccgctgatgaaggccgacatcgaccattttttttacggtgttttgcagctaataatcccacggcagtgtattacgaaggtattcgtgttctaacgcatgaacgaaacatcaatggagccatcaggctcttacagcgtcatgctccagtacgagcaaatgcaacagttacatgcgccattgtattcatatgtgctgggtatgattatatgggcgacttgtttctacagctcttcacccgcaaccattatccattggactcggttgccactcgaatttgggtgatgagtttcttcaaggaaataaagaagtttgaccctgcatacaacaatacatatggtcctacgttctcttatcctaccagccatggaattagtatgcctccttgcgccttatattgttacatggtatcaggagctttccaaaacgtttgcaaccgctgttacctctgatcgtgtgccaggcgtgttagtcaaatgctatagttaaaatctaaagttgaatatttttcagccaaattcgcatatgatatttagttcccgaagtaaatgtaaatttggatattaaaatctaagcgtccacaactacgtacacgtgcatctaccaaataatacttaaaggttttttgtttgtctcggaaaactagatatgtacgtacactagcatgagatatcaactctaacgtacactaaaaaataacacattcaaacatatgaggtctttggtttgtctcataaatggtgatatttatgaatggacgtacactgatagtacactacagcgtacactgtttgttgggtaaatgtagaaatgtaaatgtggacgtacactacaacgtacactgtttgttgggcaaatgtagaaatgtaaatgtggacgtacactaaaacgcacactaaaacgtacacgtctagttttaagctgttattaaaaagtggttgctcataacaacaataacaaattatatatggaatactattacgttgatttgacaatatgaatacacatcatcacttaatacctttgcaataaatacaaccataacttacccaaccatatcttcaatgatgcttatttaagtgttggaatttcattttgttaaaacaccttactcctaaatataacaaacccaaatattcatgatgatttgcttgcgaagatagccaagaaaatggctgacaaatgttggtggtacctcggacctatgttgaaatccggtcctcgtggaagagacattgtctaccgtccggatgtcctcaaggatgcaaacattttcagcatgtgcgacgatcccgatgacttctacgcggtaggccacgatccaaatgacatcaactccgaaggtcgctatagacccttcttcaaacggtgcttacaagctggtaaccccacggctatttaccatgaaggactgcgtctcgttacacatgagtctgacattcagggagctatcctacacttagagcgaatctccccaaggaacgccgctgcaacccttgcatgcgcaattctttacatatgtgctggtaatgctcacatgggtggtgtctaccttcggctcttcggaagcaaccattatgctttggaatcggaggaggcacgtgacatttgtgaggaggtgctagaagatataaagaaatatggtaatactttaaaatacacatacgctaacagtttttcgtacccggaatgtggtgacttaagcactcctgaatgcgcagagatgtgttacatgagatcgagactcttcaataatctttgcaaccaatgttacatctggttgtgtgctaaacggattagccagatcctgtagagctcacattcgccacgatcctgtcatatttataagtttttcatgcaacaatatgtgagctttttacgttgattatcagtaatggaagtttgtttttaataattatcactttgtaattgattcaaacatactagctcaaactactctaatatgagacatcattaacacaaaataataataaaataataaaatatctacgtacacggtatatgataatgtacatgtggtatagtttaattccaactataaagattacatagtgagcgacggtatagtttgtaaatgaagacgaaagaaaatttgatttgacgtcgtataacacatatctagaagatttcgctccatattaattactcgctgtcaaatacacactagaagtgacctccatcacactctcattaatatctctattagacatacacggttcccgagcaacgtactcaattgatttggcagataaaataagtaagttaatgtttatttgaaaagattgttagtaaatgcgttgacccctaatatagcactatacatgaagccatattgttccacttatatgcaatacaaacagacgttaactcaaccttctgtaagaaaacgtaatgagtattttatagacatacacggcgcgattatgagaggtacacagtagtttgtttaaattaaaagttactaatatgatgcactaaatatacatccacgtcacccacccacttacattgatgattattcccctctttaaaactcatgtcaaacacacttagttgaatacacgaatccgtctaaacctcctcgtttgaaaaacaatg

SEQ ID NO: 9321 - DNA, 3000 bp, Unknown
  misc_feature (1)..( 3000): cDNA_ID_3041335_gDNA_ID_1972069_Annot_ID_178524 3000 nt of promoter + ATG
atatacttgtggccacttcatgggacaatcaggttttcttttaattccttggctcctttgtttttccatggcttaaaatctaatttgtttgtcctaataactcttgtatatatattgtaacatgtgagtttgcttcttctattgcaggtgaggtgttgggaaatatcccgtagtggagcctctctagccagtgctcctaaagcatcaatatcacatgatcagccggtaatatgtcattcttcttcttatcttacctttttttttcttttgcctttgaatctgatgcatatacgtcctttcttgtgttgaaggttttatgttctgcttggaaagatgatggaaccacagtctttagcggtggatgtgataagcaagcaaaaatgtggcccttgttgtctggtggtcaacctgtaactgttgctatgcatgagggtcctatcgcagctatggcttggatcccgggaatgaatctccttgcaactggaagttgggataaaactttgaagtaagaatgattgttcattatttcctatgactgaatgtagcaaattatagaatgttgactgattcatttatttgctgccatgaatttaatgatgtatgttggttttccttccagatattgggacacaagacagcaaaatcctgtacatacccaacagcttccagacaaatgttatacattgtctgtgaaacatcctctgatggttgtcgggactgccgatagaaatctgatagtcttcaacttgcaaaatcctcaggttagaatttttccttgttgttccatgttataacttgcgcatgagagttctaagtgctaacaatgctgtcagcatcacatggttttgggaattcgtgatcaatttagcccatgtgctatcttacaaagaatagatgaacaggctttcaccattagattaacagtttctcttgtgtaaactgtagactgagtttaagagaatccaatccccactgaagtaccagacgaggtgtgttactgccttccctgatcagcaaggttttttggtatgtcttcttatttatgttctgttgtgttttggttaattcagttttacaggaattagcttgttcgttagatgcttacattttaggttagacattgcaatgtttttatttgcaatctcgagaagattttatgtatgtcattctagcaaaaaatagagtaattttatatgggagattgttttgctagtcacatctccagatcctatctaaatcacaatggtgttgaatatgaaaaattaaccagatccaatgatctctataggttggttcaattgaggggcgggttggtgttcatcatctggatgattctcaacagagcaaaaacttcacattcaaatgccacagagatggaaatgatatatattctgtcaactctctgaatttccacccggtaagctctatctatagttatactcttatactcgtatgtattctttgaagccttcagcatatgttgagcgatgaaaatgattgtttgagttgttgtggatttaaggtacatggcacttttgcaactgctgggtcagatggtgctttcaatttctgggacaaagatagtaaacaaagactcaaggtattttcctcctgcattgattttttattttgttaaccaagtaattatctaacagttttgtattctgtgtccccacaggccatgtcgaggtgcaatcagccaattccatgcagctcgttcaaccacgatggatcgatatatgcatatgcggtatgatataaatcttatttggtttcactttatttgtacatgctcatgttatatgttgcaaaatcgagatggtcttttacttggaatctaaaaccatcattgtgttgaaaaacctttgagagcatacatgaatgctttctaacatgtattattatataggcttgctatgactggagcaaaggtgcagaaaatcacaacccggcgactgcaaaaagcagcattttcttgcacctgccacaggtgtgtgcgcgtcacagacaatagtaatatcatcatgtttcctaaacattagtgtctgtatctaacggacggaatttgttttaaatgaaattgcaggaaagcgaggttaaggccaagccaagagttggagcaaccggcagaaaatgagcgttgcttagtctgatttcttcgctagtgattttttttttttttttagcttgtggacttcgttgggctttgttatctactttagttcatgacattttgaatatacattaggagtcttgtctaaaagactaaaagtaaatctctaatgtttctagttgggcctaatttggaaccatctcgtctcatacctctttcgtttcatcatactaaggaaatctttttttcttatcaagaatttattttagtacatctgattccatagttaaactttagttattttaataactcaaatcaataaaatcaaccaagaaatgtttatctaaaactagtataattaaaacgactaatgttttcttctctcattgttactgtcggagcaaattttcctaaatttggttattagttaattttttttttggttgtgtgattaaatatggtcattagttagttagtgaagaaagagagagagataacgtggcagtagattagtggaagcaggagaagaaagcgggaatgagcaaaggacctggactttgtccatagccaagaaactcgcgtcctcttcttcttcctcttcacctatataaacactttgtcttcgactccaattttccttcaattttatataaaaaataatttgttttcgttttttgtgtttctgtttttctcccttttgttcttctgtttcgttagaataacaacagaaaagaaaaaaagatcgtgagaaaatttcactttgaaaaagaaaaaagtgcagagagagatactttggaaaaattttgtcaacaaagaaagaaagaaagaaagaaagagtgaaaaagaaaacaaagaaacacaccaccctgtttctgtaaaacaagatg

SEQ ID NO: 9322 - DNA, 3000 bp, Unknown
  misc_feature (1)..( 3000): cDNA_ID_1024765_gDNA_ID_1972069_Annot_ID_178530 3000 nt of promoter + ATG
gttattattcttttggaactgatacactagttgatgcagttctctcattttacttttgtttgttgaatcacctttataattaatatagattacaaggatttgcaagctataagagctacagtttttttttttttaaacttgcttccatttctttgtacaacataacaaaacaacacaacatctcatgctaattcaaataggtcaagtatgctactttgttgtccaaacatagacttgtcctccagctgtggatcctgcaagcgttccaacattataaggatggcaatggattctgcatggtatagctctctgcagagggttatgcagttccatcactgttcgctttagttttggattgatcacatcaatcttctttgacaaattgcccacatagatgtatgaatcatcccacccccatactgccctgcaatcaaaatcattaccaacttcagtttttcgacaaatagacgaaatcaattcctacttcttttcatttctcataacaaaaaagagtggaaaaagagtgtattggtcagagaaatagtgaaagactcataacaattacttgtggattcttttgtcagaacacagtacattaagcaagaagtgtattggaactgagaggcttattaaggtacaagatactggaacatacttgaatttggagatccatctgctggtgttattgtgatatatcatgcaagtgttctcaaaattggcgccgcttagaacaccaatgtagttgtcaaggctacaaggaaaacaaaacaaaacaagagttcagcaaaccccagagatgcacatagggacctacattatacatcagtttcactctctctacacatgtttactcttgtctacgttgctaaaagtttatgagatgtatttatttcccgtctcaaaaccatcaaggcacaaagttttctagctaagtaaagttcccagacataattgcttcaaggcagtggtgttttttcaaatatgtgcaacttttaaaccgaaatgcacagactttatgacctcaacaaaactagaacatatattacttaatctctccaatataatgacaaacaacatttgatgtgacttaaatcaaggagattatacttgtagttcttaatgaagtgtattgaataggctgtggaaaaaatgacaagataccttgtagttgcaagtgaaaggccagaaggtgagaaataagcagagtgcacagccctagaatgattaacagtagacaatgttttcggttttttggctcccatgcttctcaagtcccaaaggcaagcagttccatctgtggaacttgtcgccatgacatgcggattctgcgggttgaagtctatagagttaatcctccgttcatgtaactcccaatggaaaactgactttcctgctcggaggtcccatacattgaacactccataatcctgaccaaagtacaagctttgctcatcatttggtctctgcgagagtgaaaatatagcttcgtccgtggaataaaccagatcaaaaaccgacttctcgacatccatcaaccggatgagaccatcatagctgctgctaataacctgccatgaatgcaccaacgaacttgatgacttaaagaaagagataacgtttctccaatttcaatagacaactaaataaagacaagtcgtttaacaaaaaacttacccttgataaagagttttgctgaaacacaatagatgaaactggtgctgagtgaggagtgaatagatatatcccatcattatcttcctcattcccacaatccaaattccaaaacccaacattcccaagtttgtcccctgcagcaaccatcttaacattctcgcaaggtaagaactggacaacaaaaatcctcccaggcacaacacgagctacattctgcggttctaaagtcaacaaatccagatcaaactcaattttctcaggcttaaccggaatactaaattccttgttcacataatcactgaaggaatcatcttcaggctcttcctttttaacagaaactttagatacacgagaactactcctagtcctcaccataggagactcgttctcatccttaaccactccaatttctcccttaaccaatttgcctctacaagacttactctcaatacccaaaagagtatcaaccaattgcgtataagaaccgtatccttcatacgcggattcgaagggaataggagccaaaagacgcggcgattgcttctgaggagatggttggttgtgtgtgatctgagaacccatccggaaatctgaaaagccatcaggtaagccagcggaatctggattcaaacctctggtgcgtagagacattcggataacagtgggcgttgaagcaggtttgggcttcttcttcttaaaagatttagaatcatctcgagagcgtttggcggcggagagaagagaagaagctttggcgcggacattgagagcagccaacatctcatcgttccgtcttatgttctccaatctcttccgctcgtactccgtcgccattgattgattgatgcttgagaaaattgagattttttctctttacacacaaacaaaaaaggagagatttttttcttcacaccaaaactgaaagaagacctagaagaaaaagaaaaaagctaacaacatttgatgggtcggaaataggcggcagaataacaactgccgccaaaaaaataaaaaaacgaaaatatataattacacatttacaccaaagtgtgatctaaattgaacggtgcagattagtttaacatttatcccaaattttaagaaccgtacgatggagcatcttaatgacttaaaccctaaaagaagaaaaaccccaatcgagctctgtcaatggctcgcttcgtcagatgtctgagaagaacactcttttctaattcgtctccttctattgctcaccggagccctaggattggtttgcccacgaatctaaatcctaaaattttaatcagccgcagatgtctgagctccgggagttacgtctcagaa

SEQ ID NO: 9323 - DNA, 3000 bp, Unknown
  misc_feature (1)..( 3000): cDNA_ID_3041323_gDNA_ID_1972069_Annot_ID_178533 3000 nt of promoter + ATG
aattactttatatttctccagcaactgcaaggagaagctgaaggagtacgtgatagatgggtttaagtctcatctcttaccacttccggtaagataatatctttgctttatatgatctttttaatataaagctatttacaatcttaactaaatgtttgatgatttttcagggtactgtctacacagtgtgcggtgggcccccttgccaagggatcagtgggtataaccggtatagaaacaatgaagcaccgcttgaagatcagaagaaccagcaacttttggtgtttttagacatcattgacttcctcaagccaaactatgtgctgatggaaaatgttgtagaccttcttaggttttcaaagggtttcctggcacgtcatgctgtagctagctttgttgcgatgaattaccagacgcggttgggcatgatggctgctggatcttatgggctccctcagcttagaaacagggtttttttatgggctgcacaaccatcagaggtaaatatatgttacagaatatttaccactaatatattgtcttttgaggaacatgatctttattgctctctcttgatttgtttgacagaaacttcccccttatcccctcccaacacatgaagttgctaaaaagttcaacacacctaaagaattcaaagcaagtgtggacagttgtacatttaaatttaatagactcttataagttataactgcattgcttattcatctgttataaatgtaggatttacaagttggacgtattcaaatggagttccttaaattggacaacgctcttacgctggctgatgctattagtgatctgccaccggtgtgtatctaaacttcagaactgccattgatgattatgttacaatatatctgtctgatcactgctctcttagtgctgcaggtgacaaattatgtggcaaatgatgtaatggattataatgatgctgctcctaagacagagtttgagaactttattagcctcaaaagatctggtgagcattttaaactcgtaaatttggtaggtaccactaatccaatactaacgtatctttcttgtttcagagacacttttacccgcatttggtggagatccgacacgcaggttgtttgatcaccaacccctcgtattaggagatgatgacttggaaagagtttcctacataccaaaacagaaggtgcgacatttttaaagtacttgcttcaagcattcaatgtataatcatttcttgttcatgtcattgtattcttattgttacagggggcaaactatcgcgacatgcctggtgttttagttcacaacaacaaagcggaaattaatcctaggtttcgagcaaagttgaaatctggaaaaaatgtggtataaaataaaccactcgcaaccttatcatttttctgctctagtttctttttgcaccttctatatgacatgtcttttggttttcacaggtccctgcttatgcaatttcattcataaaaggaaaatcaaaaaagtgagtttctccaactaatatgcttcttgtggatcctctttccataacgtaagaatgttaaattcattaaaagtaacacatctgttatctgaatttcaggccgtttggtagactttggggtgatgaaatcgttaacactgttgtgacaagggctgaacctcacaaccaggtaagcccttttgctttcatttcccatgtgtctgggtacgttccacttagaattctctagtggctggtttattaaaactggttgatgcagtgtgtaatccatccaatgcaaaaccgtgtgttgtctgttcgtgagaatgcgagattacaggggttccctgattgttacaagctctgtggaacaattaaggaaaagtaagtccttggttcttgctgcttttctatctatgtatatgattgtttttaaactggagatcctaatgtatgtaaaaactgggtttgaatctaaattttgtaggtacatccaggttgggaatgctgtggcagttcctgtaggggttgcattaggatatgcctttggtatggcgagtcaaggactgacggatgatgaaccagtaatcaagctgccattcaagtatcccgaatgcatgcaggcaaaggatcaaatctgattgacagtctccatcaagtcgtcatgatgaaactatctttaggaatcatacttcattttctagactttcttttaattttttgggttagcaagagctatatgctcaaacaatggcggcttaaactgtctagctctttcttgttggtttatctttgactttataatcatttggaaccattttatttcttatgatttttaatctcaagatttcaaattctattgcgtagacttcaatcctacgtgatgccatccaacaagaattaagaccaagcaaaagacagacaaaacctgttattgagcatccgaggtgctaggtacgtccgtgatctctcgacgaacattggttcgattttgcgtaattcagttgccaccgaccgaccgaaactctggtcaatgatcaccacttaccagcttttattagtgttattcattcattcgcaaaagctaagtaaattcgaaggcagttaggcccacaagcccatataatggtgaaagatttggttcacccaaataatgtccccactccttcggttgggcttttacgttataatattcggcccaaatttgatatctcataacagagcaaatttttcacatagaagaagcagagaaaccaattgatctactttttttttttttttgtttcttcctcttcatcaggcttgttcttcgattccctcacttaaagaagggtttcgaatttgctcgaaagattgaaaggaaaaaaagaaagaggtgaaccattctcaacataaatttgttgtttaggagatgtaagaatgataatttcttggatctaatcgcgttcagaaagtgagaaagttttaggattcataaatatctttgtgttcttctccaccctaataaacacattgatacagag

SEQ ID NO: 9324 - DNA, 3000 bp, Unknown
  misc_feature (1)..( 3000): cDNA_ID_2989975_gDNA_ID_1972069_Annot_ID_178536 3000 nt of promoter + ATG
acttgcccacttcctacatcactcagaagcagattgaaatccctacctcccctgtatatatattgaacccttgtttactccaaccttgggtttccaactttgtgtttccattaagacaaaaacacgattttggatttggtttgcaggaaaaacaatcgccaccagtgcaggaaggtttgggtgcttttcaaaaactgcccatggtcatgccatctattgatttgtatgcttctgctctcaggaagtctaaaagagtccaaccaactaaaggttatttgattctttatcttgttgtctttgtttacacattaacttcttcaaactctttaactgagtctttgtccatttttggtctcaggcattgctaatattgctaagcgagaaagaaatagaggtgctaaacagcttgatgcattcatgaaagtaagttcattgcatccttcgctgtgttatggtttaaattctgaaacgttaattgtctttaccaaatcagaaattgtttttttgtgaaaggaactggctctacctttaaaaggctacatggaaagttttcccaggaagaaactcttgcatccatatgaaaggtctcttattgacttgacacttggtgatggaaagtatgaagaggtatctatttttaagtaattcagcatcttagcctgcaactgattttagcaaaggcttatagataagtttttaggtgttaggaaaagttgatgttctgaggaagaaggtgcaatctgttggaaaggaacatgcttctctctgcgccaaggtcagactcctcagttccgtcaaaagcatattgtgtcttacattttagttaatcccatatactgtagattgtgattggtactacatcagtaaaggccttataagcttcataccgatcccatttttttcatcttattctatcatatatcagtgtaggaaaagttaaacatctttcaatttcgttgcaggctttgtcaaagaaggaggcagaggaacgcttgagcgaaggtgtggagaagctggaattggttttccaacaacaagggggagctgttgatgatttgctaactatagcgaaggttccttactagaatcttttgtttgtctcttccagtgttatcagaattgtatgtatgaacagagttacgcactttgcaggttttgagggctatgccagttgttgacttggaaatgccgactctttgccttgtcggagcaccaaacgttgggaagtcatcattggttcgcatactgtcaacagggaagcctgaggtctgccttatgtaccaatctttatatatgtgataataacttgcattgtctaatgcttatggttttttcggttgtcagatttgcaattatcctttcacaaccagaggaattctgatgggtcacatcgttttaaactaccaacgatttcaggttgcgttgcttacttcgctgcgtctaatcactttcctcatgatatagattattgaatcatccagaaacgcattgcaggttacagacacccctggccttcttaggagatgcgatggtaaagtctagttgctacgaactctcatgtggatgaataactatatgatatttgattaagtcttgattcttgtatttttttatttggtaattacagaggataggaataatctagagaagttaactcttgctgtactcactcatcttccaaccgcggttctatatgttcatgatctaacgggagaatgtgggacttctccttctgatcaggtatatagtaagaaacaaatccttatggatttcgttgcatcagatgtgtcaaaggaaagcacaagaatgtgcaccgttatctgatttgccgaataattgggtctgatatatcctgattcagttatatgtttgttgtgagggcattgcagtttcaaatatataaagagatgaaagagaggtttaaggattacctgtggattgatgctgtgtccaaatgcgatctgctgggaggctcaccggtgatgtatgccaaagaagatagaagcagtgatgacgcggaaatcattaagtaccgggaaagaggacctgatgaatcaattcatgtctcggtgaaaacagaacaaggtctcaatgaggtatgaaacttaccagaaatatttaatgtggaaagaaagcaagagtgtgttttgagtggtctgtttctctacatggctctgcagctaaagaacaaagtgaaggaagtactgagtagtgagatggagaagatccaaagtggagagaaaactgatcaaagtgttgctacttgctagtgcttagctagagattttttgcccattttagcattttgacattaatgtctcatttgtttttaatatacttaaataggattaaaatcttaatgcattatatatacatagctatttctctcctcccttgttagtagtggatttggtacgcatatatatatatacatatataagttttagcaataatgcaggattagattgtttttaaaaaaagagaaaaatgttgccaaaggaaaattgtgacgcacaaaaaaaggaacgatcctgaaattgtcagaagtagacagaaacaagaaaacttgtggagaacaataaaatatcggattcagaacagagattaaaaaaaaatattaaaaaaatagaaatcgataagtaataataatattatctcttcttctctgcttccattttgggtatcgataaaccaccacatccttccctgaaaccctaaccacaacaatcgccgccgtctctagaaatatccatccacctacttcggctttgtttatcaggttcgatatatctatcaccaccgccttcttatctcaatttctgtgtttgatttttgctttgttggtgtttgattttaccgcagattttgatgaaaccagatcgggtcttcctctagatccgttctaggttttctatttccaccgtcttatcattatcatcatcatcaattcatcatcatcatcaataatccagatgctcaccaaattcgtcattcatagac

SEQ ID NO: 9325 - DNA, 3000 bp, Unknown
  misc_feature (1)..( 3000): cDNA_ID_3041304_gDNA_ID_1972069_Annot_ID_178540 3000 nt of promoter + ATG
cccaacatgcatagtgtttgacacaacaatatatgacagctaacttttaagtataattcgaaatgaactaaatcgttgattatacataagtttaggttatgagtttttgtcttttgcaatctattaattaacaattggtttgtgaccaaattgttcgttgagtgttgtaagaaccaacctatttcaatcagtttcttaaaaaaggaaagggaaggcaaaaaaaaaaagaactattagcagccttacttttctatgataatattagtcagtagggaaatatatatatatatatatatatatatatatatatatatatatatatataatttggaccgacgactgattacaataactgttaaagcttaaaccggcggaacttaatcttatataattaatatgattgtaattagctgtatgataattttatgttgttaatgatgatgtattaccttttcgctatagggtttatagattacatctatacttctgcatacaattagatattaataaagttataaaaacaaattaaactgaataattgtgtgtgtgttacgttgcatgtgttattagttatggagaaatatgatttacgtcttctgaaatgctatcaacgattggtttcagatttaaagaaactatctgaccaaaatcctgagatatcttaattagatatatctatttaaactttcaagttgttatatgttaaacagtaaatggcgttttccgtattactcatctagtagatcgtagtaagttatatacgtttttacaatgaaaggtttcggcaatgtaagttgtatacgtggtacgagtgagtatccatacttctaccggaaagaatagagatcaagaaaaatgaatataattaataaagctctaccgaggaaaagaagagtgaaggataatggagaaaaataagaaaaaagatgatgagatctgaattaagattttattattcacaattacaagaataggtacagtcctggtttgtgctaaaccaaattcgaatatcaaatataaattacttataggttcgactgtaaaatgagatatgaaagaaagaaataatatatgatgatgtaatgcatgagaaagtccaaaatgatcggcatatgggattaagcgattccatatagttaagtcaagttactatttcagataaatggataagtttgtcgtctatatgttctgttatctccaaacccaaatctataacattgcgacatttttgaatcgttaacggcaaaataagtggggaggggggggggaaggaaaaaaggaaggacactgagattttgataaagttcggtagccaaatttgtgcatgacttttaagaaaatacgtatgctgatccaaaaacaaacaactaaatagattttagtttgagaaaatcgaagtaacaaaattattatttaatatatagtgtgagaatttaacagctactaataattatcataacacgaattaagtgtaatagtaatatatgtaggaaaatggtttagcaccactcacttgattaactcgacttaaaccaaatataaagtaatatttatagatgtagttggttgtatttttgcaagctttggtactcgatatctaaatttttaatggaaaaattagtcgagtggtaattcgttatatataagaaaatattttgtttgtaattgtgcaaactttagcattggacatctaactatattctgaaaaatcagcggaatgataaaagttcggattttccttctttttatttaagtaaacataattggtgttctgaaaaccaaaagaaggaagaaggcaattaagatttgttaaagttcgtcacgatattgatgtcaagaaaaaaggaaaaaaaaaaaaaatcgtcacgatggtatcgtcaatttgtctagtggattttgaaaagccgtgtgggcttgactttgaccgaacaaggcacacgtatacatctagtactactgaagaaatctctcattagaacgcaaaccacgttccgcacactcttaatatactattagtctattactatcaccaactagttgtcattttttttgtcaaacgtgctaattaattcacaaatagaagtattaaacttcctaattaagcacgcctttactacatttcattattattatacatgtaatcaaccatttcttttatcccacatgtcatttgtagtcctgattttatgactttatgcatcaagttatctttttttttgtcactccatgcatcaagttatctaaacaacataattattgtctgaaaaatctaagatgatatacaacatatgtatttaattacacattaggcttgtttaacaattcttgattatttttactctttttgggtgagttcttgatggatgtcttgaattacaaaactacatattctgaaaatattaaccttgagtttaggccggctatgctataacgaaaaataaataaaagcaactaacccgacagaaatgtcaaccaactatccaaaatgaaaaacaaacgtggagagcgtcatattattagtaggccaatcacacaccaaatgtttgtttaacaaaaaaaataagaatgtcaaccaactatccaaaattaaaatcaagaatacatttcatatgtttccaatatgtttttcttaaacaaaattgggactaaagattggaccaaatacgtgtgcgggtggacccgatagaagccgagttgagtctaaagactaaaaagtaaacaaaaaatgataagaccatcacttagtttattgcatgaaaatgaaaagcacatgctcctctctctctcttctgcctctttccatctagtttcctcttaaaactccattatatatagaaacaaaatcttttctctcttcaacaatcccaccattaaaaaagaagaacccaagatcgactcttacttcgaatctctctcaactttcttcctcagcttacgggaacttccacacatatacatccacaagaacccatatcgaagattcatcctacatatatttac

SEQ ID NO: 9326 - DNA, 3000 bp, Unknown
  misc_feature (1)..( 3000): cDNA_ID_1447386_gDNA_ID_1972069_Annot_ID_178546 3000 nt of promoter + ATG
aaacagggcaatgcagagtagtagttcgaggtttgatatgatcttttcattttcgaaattgttggatgtaacttgaaagagttttagcttttgagaattgtattatgttgtaatttttgtaaactatatatataatttaaaatcttatatataaatatttaaactttaaactttttcgattgattaaataattttagataaattgtcttattttcttaactatacctaatatttttgttttttaagtgttaaattttaaatatgtgtaaactaattgattgtccaattatgtttatttagaattttaacacctatttcatttatcgaaaaacgtttttagtttttagtttatactaatttatatatcaatatttaaaaggtttttcgatgttttccatactcttgatggagtaaactgatggttccttgaaatgtggcatgaaaaaattgcaacacataaaagaatccaaggccataacattcatcattggttcacgagtcacagaatacaaaaatattatataagaaaatgaagtccaaggacaaaagaatacagaaaaggacacaaatagactatgagagagctctgaagatcttgccttggaaacacagtgagctcagcctttgcctgttctgcagtctggctcatatcataacacattgaactttaacttcttgtaacttgaacgtgcagcgatgcgtggacgtgtaacaatcaagaatcacactagtttttaacgtctatcatgtaatccggagagagattcctgaatcagcatggctgcaaatgattagttttgcagattcattgatattaggaatatgcaaaggtagcgatcagcaaatctagtaaactgacgaaaagattacctggaaaactgcacggcggatgtagtgaaagagtggagaccgtgaggtttgagaattgagtcattatttcagtgatcgtttgatgagaaacttcaagtcttacccctatctgattattttctgtctactgatcgttgacccttgtagccttcctgagaaccaactttttgaagattcatcctcttgctttttctgacccccttcaccttttgctcctcaagaagtttctggagcataggatttcctacgaacccctttgatttcatctctgaatagatctctctggccttttcaagccacccacatgacaaaaggccctgtattgtagccaagtaaagagcaggattagccactatctcaaaacgatccatttctgcccagatcttcaaagcattttctggttgctttcccttgaacaattttccaagaataagaagaaaggtctcttctgtaggacctaaatcagagatcttcatttggcctaaaacctctaaagttttctcgaaatttacagcctcaaggaatgcatgaaatgtatcaactgttggactaaggttctcactaatcatggttgccaatacattcctggctacgtccagctttccagcctcacaaagggggcgtatcatcgagttgtaggtcactgaatctggctttaatccttcctcgttcaactttttcataagcttcatagcttcatcaaagcaatcctcacgggtcaacacataaaccaaggaattgtaaacttcaatccctggagccaatccccgtttcttcatttcatcgtatagcctgagagaatcaaaaaggttcccaactttagagaagcaagagatcatgtgactgtaagagtccttgttaggcgtgatacagtaattccccatctctcgccaaatcctctttgcttcagtcacatcagtccaaatgttacaccaaccattaagaattacgttgaatccctcaacatccaccggaaagagctttttgcttgcaagcatgaactcttcagctttttcaatgtggccatgtctacacaatgcacatagcaatccttgaaatgcttcatcataaggagtgtgtttaaacttatccataatatcaaatgtccgaatagcttggctagtatcattagcagcagcatatctacatcaacaccgtcaccaagacaaccaattcaatacctagctagtaaatctttcaatttagcacaacaaaagagaaacttttatcaagaagacgaaaccgaacctgtccatcatgagaaacatggcctttctagtatcctttgaaacattaaacatatcacggatcaaacaccaagcaatgttgaacttttgatgattacccaacacccagatcatcaaatcacaagatttctgatcatcacagccgcgtttctctccccatttgaatgctagaaaggcaagcctccattcatctcttaattcccagattaaggagtagaaagaatcatgatttagatcaaatgatgagtcctccagagaagccatggcatccgcctctgactccagctcagagacctgtctgattaaatcaatcagacccttttctaacggagccaatgctgttaagttgatatcaaatgtttcggagatggttttggtggagaagcgattagaagaggcaaaatgtgggagatagcttaaaacttgagaatgcacatgacctgctcgatgaaatgctgaagagaaggaatgattttgggaaactgagctcgaaaacgacgtcgacactgcacgacgtagcagagattgatgctgaacaatccgccattgtggcgttcgcgcgagtttcctaccaatggcaacgatcgcggccatagcgagtgagtgagaaggcttaaattaatacatttcaaacatggtcttaatgggatgaggatatgaagttaatggggtcaaaaacgaatatatagataatatggggtctaatatggtaataaacaaagtaacactaatatgaatgggcctaaatagggcccattttagatttctttaaaagatccgagagagagagggatctaattcctgataaaccctagaagaagaagaagaagaagaagaagaagaagaagaagaagaagaagaagcaaaacctgtggagatcgag

SEQ ID NO: 9327 - DNA, 3000 bp, Unknown
  misc_feature (1)..( 3000): cDNA_ID_3041275_gDNA_ID_1972069_Annot_ID_178549 3000 nt of promoter + ATG
tagtttttgtaatacagggatttttgagaggtttcgtggtatactgcacgagggagagatagataagagagttcagtatttgattgaaagtctctttgctactaggaaggcgaaatttcaggtaatttactccttgacacattgaattcgaatctgatattttgggttgtgatagatgtagcagtatgcttattgtcacggatagcaaatcttgttgatggtttactttcagggacatccggccgttcgtcctgagctagatcttgttgaagaaaaatattcgcatgatctctctcttgatcatgaaattgatcctgaaactgctcttggtaagcttggtattgtattttaaagtttactccatgctctagagagcggttattattttggaagtactgaaactgctcttaattctacatttttctgactgaagatattttcaaacctgatcctgatttcgtggagaacgaaaagaaatatgaggcgctgaagaaagagttactcggtgacgaagagtctgaggatgaagatggctctgatgctagttcagaggataacgatgaggaggaagatgagtctgatgaagaagatgaagaacaaatgagaataagagacgaaacagagactaatcttgttaatcttagaaggacaatctacctgaccataatgtccagtgttgattttgaagaagcaggtcacaaattacttaaaattaagcttgaaccaggtcaagaggtaacttcttccaaattcggatactctatattttcctgtgctttctgcttttctattttattgtttaatgttgaaatgaatccatcttaaagtttgtgactttctgcaagtacagaagtcttatgacattcttatccaatcaatgttgcagatggaactatgcataatgctcctggaatgttgctctcaggagagaacatatctgcgttactatggattgttgggtcagcgtttctgtatgatcaacaaaattcatcaagagaattttgagaaatgctttgttcagcagtattccatgattcaccgtcttgagacaaacaaattgcgtaacgtggctaagttttttgcccatttactgggcacagatgctctcccctggcatgtgcttgcctacattcgattaaccgaggaagacactacttcctcatctcgtatcttcattaagatcctattccaggtaactagaatcttcagaactcatttgactatttcatgaaactcaatttcagagctgttcatctcattaatttgattggagatatgttcatgtgattgattaatttcttgtttcatatgaattatgaaattatggatatgttacatcacaattagggctctgctgataaattttgttaaggtgtggaaaattggtatttgagactgtttggtttgcattttttgcaggaattgtcagaacacttggggattaggctgcttaatgagaggcttcaggatccaacaatgcaggaatcacttgaatctatattccctaaggataatccaaagaacacgaggtttgcaatcaacttctttacgtccattggtcttggaggcatcacagagaatctgagagagtatctgaagaacatgccaagcctcatcatgcaacggcagaagcaagttgcggaatcagaatcaggatcatcatctggatctgacagttctgattccgagtctgaatctgagtcaggctcatcatcttcttctagttcggatgaaagcgacagagaaaagaggaagcgaagaagaagatcatgaagactgttttgcttgctgtctccagactccagcaaatttcttgaaatttcacatcttgttttggctatttcaacttgaattttcttgagaactcactgagcaatcatctggtgctgttcttgcatatcaattacgcaataacctgatgacaagagaatagacagtggaaggtttgtgaacggaaatgtttttgtttgttgttgtctaaatgttttataagacatttttatataatttgctatggtttttatgggaaattagctaagttctctatataatagctttgtattaaaattgttaaactgtttaagataaatttgatcaataggaccatagatgtatatttttgttgggtacattttgtgatccaaatttatttgcgtgttctgattggaatcatgagatattttaaatggtgaaaagtatcaaattgccaaggaatctttttttcgtatatttgttcttcaaataattttgttttttggataagaacggatattatgatcggtctttctcactgatttcaaagtcaaaatatcacaattccaaaaacatatatcttaaaaactatttcttcaaattgtctcaaagtattactgtggtgcaaagctttccaaatcgtactaatggtttattactttttaaaataaaaagttttgggtgctcttagtttagcgtgaatctactacccacagtatctaaaacatacttaattagtaaagaaaactgaattgtacttaactacaactttaaacacatgccaagtaccaacaacctatcaaccatttcctctgtctttcacattttgttaagccataccagaattaagacctcaataaagtagataactttgaacaaagtagatgctttttttatttttggaaaacaatattaaacttttttaaacataacaacaaaaaggttgggatggataactttttttttatttataaatctactgtatgtgtaaaaatagtaaaaaacaatttggccgtggaaatcggtagcgttatggataaggacactttgagatgagtcaccgtttcctttctttataaataatcccgcttcctctctttatccaatccattaaatcctaaaatccattattgattgaatcttcgagttaccaacaaaaaaaaaactctcctttatttcagtcttcttttacaaatcataatcttctctttgattccatcttgtgaaccaccggcataagaaaatatg

SEQ ID NO: 9328 - DNA, 3000 bp, Unknown
  misc_feature (1)..( 3000): cDNA_ID_3041267_gDNA_ID_1972069_Annot_ID_178552 3000 nt of promoter + ATG
attgttatcctgcacataccagcaaattaagactcggtagtcatagtcttcaactaagaagaacgaatgtacgcacataccttaaatataatctcgagctccagtattttacgagtccataaacctaagacttgtcgtaacctctcaacttctgtcggattcattaaatctacactcaccgacaaggctacatacaaatttgcaaacggtctcaacaactcaccatatatggtgttcacaaattcttcattcccaatgctcttttcctactcaacatcaaaacaatcaaataccttaattcctttttccagtgtatccaaatacattatttgaaacgtgtaacaatatatatacattatatgtacctctgatatgttgtagctgatgtgaggcacgtaaggccctagaacccaaaagtttctattaaattggagttggggggactggagggaaaggtcatctctccgacagcagatatctatgatggcgagaatgtctagactagttgttgacacttcaatggcatcaatgcgttcaagagaagacacttgcaagagctttaattttttgttctcaatcttcaaaggaaccctactttttttgaagcagcagatgcctagtacaagcacctcaagacaagggcaagatgcgagtaccctgttaaagactccaatctcgggagcgacgattgataaaagtttgagggtccggagattcgagcagtttctcaagggatgtgagctttcgagaaagtatgaatgtagcgagagagacataagacttggatgggacaaggagtctggggaaaagttaaaagttttgaactttcgatcccaagtaccataatggtatctaagtgtgagaactttcgtgcgtttcacgcaactcagtaatcgaatccaagaattgagcattccatttccaccttgatatgggacatggatgatcacgcagctctctagatgtccacgatgattgtttataaccttttacaaaccaaaaagtgatttatttaagatatgaataagcagatacaaactaataagagaaaagaaattgactgataagaagggacctgagtaatcaatgtagcaactggattcgaaccatcgagcgtgttgttggaattgataatattcttccgcatgtcgaagacgagatgagacatttgattccacacatgttcccatcgcttcgacacaacactcgtccttatggcttcttctgtggaaagtctcgataatattatgagcaatacatcgtcagggagtttgctgatccaatcaacatttttgacctgatcagatgataccattaggcaaacaaataggttaatctacgccacagtataagagttacaagtagacatgcattatataacagagaagtgaacagaattagaccttaacagagtgatcatcagagacggtaattagatagggcttatcgtcattggccaatgtaaaagttgggtaaggtaaaccaagattccaaacctgaagatgaacaagcatgtaaacatagaatgagataacatgtctcagaaccttactcggactaagtgccataatcaagttacatggttctgtatgatgcaggtccacagattttactctcgctaatttcttctgatcccataaaaccagagtgaatgatacgaaagaagagactcaataacccaaacacaaaaaaggtacacatcttctatttcatcgtcatcaccacaagacaaaatttcgaatcagattagacaaatcgtagaaaaaaattccctctgagattccactctaattcgtcggcgaatttgctgatccagtcaatattaccttatcacatgacgatgatgatgatgatgatgatctctccatattggcacggaagattccctcagatttttgaagcgtctgattctgtagctgattctaagatgaaagcacaagattttctgagaagaagaaaataaaaataaaaagatgtcaagagattattagggtttaaaaaaaaattattacatagatttgtttcgacaatatgcgtccggaaaacgccgatcggaacaatgcacacgatttcagtcgttgaagtccaagctctttgaaaaatataatgatttgtgtatgaattgttattcttgataccatatatatataggagactaacttatatttaatctaaataaattagaaaatagtaaatattttaaatttcttaattcttattccaataggaattttgtattcaatcaacttttttaaccaatcaactttttttcagtgcttatttttgtaaaaaccatacttctcttgcaaatacatttttctaatgcataccgtagttacaatactgtatcataaaactcacaatttttatacaaccaaatacattgttaccattcgaacttgtatcacttaatagagaaaacaatgatgtttctatcttattttttgaatattctactagtgaattttttatcatccaagaagatacatatttattttgttaaaaaaatgaaaaagatggtttttcttatccaaacggaaaattcctttgtttgattaggatataaattgcgttatacgtatatattcaaaaaataagatggacgaaatataaggaaaatctcattgatattatctggaaaataaaaaattccaatcgtgtggtccgtcttttgttccgactgatctatctgacggttaagatagaagagcgtatattaaagttaccatggaccttgatccacaggattaaaacacttgttttagtttcatgtttaccttttacggcgaatctacgtgtgcgcgaaagctgaaatcttcacggggaaatctagagacgacgaggaaaaaaggatgacactttcttcagatccgcgatctatttcttcatcccaacataacacgaacttccttgtgtgattcaatatctgaaaccctctctcttccttataaaaaaaaccaaaaaaagattagatttttaggttaggtgaaaacaataatg

SEQ ID NO: 9329 - DNA, 3000 bp, Unknown
  misc_feature (1)..( 3000): cDNA_ID_3041271_gDNA_ID_1972069_Annot_ID_178550 3000 nt of promoter + ATG
ctttccgttcaagttcgtaatgggttcaagtggctcgaacagagctttccttttctcggacagaagaggagttgtggtcattggttccccaactttctcggtatccattgctgttatctcgttcttctctggtgtgacctccgtaacagcctccggtgctttgtctaggttcaacaatgctgcgatcaaaatagttaatgctttgagttccaaaatcacatgcaaacggatcagatcaaaacgaaagttacaaagtctttgattttacaagcttaagacagagagaagaagactaaagctccatgtctagatctcgaggaaatagttcacatagagctaaaacaattgatgcttaaaaaaaattccaaatctttcagaccagaaatagaaagggtagctaataaaggtctagaatctttaatggtctgagaaaacaagaaacagtggaaaaaacctgatctttttcttgatttccacgcgatcttggtggtagagacagggaaaaaacctccgacaaacccatcactgactgtcttcatgtctttctcaaatccaacccctttctccatctaaatctgaaaatttcccagaagatacacgaattttgagaaagagaagaagaagaagaagataacgtacaaggaatcgaattcccaagaaaagagggctctctgttagatttcagttgaacggtaatgatttggcgttttggttacgactaccaaatgcttttgctttgtgcttcagctacagaggcttgtgaaaatgttttttattcttacaaaaagaaaaaaaatcagaagtcgaaaatagttgtcttatcgtattctttaggttgggaccttttccctctttattcctttgctaaattttcatgcaacctttaaccttctttatttttttatgaattcatctttaatccttttctaaactgtttttttttttccttttgggaaataactcattaaacgatttattgactatgatcatacgtctcttccacaagtattcttccggcacaagtcttgccttaaatcaattgaataaaagaattagtataaatcatctgattacttttttgttttgttttaatatcataatcaatgaccgttgagacttattcaaagtaatgtgatttgatttgttcagaatactaattttgaactcaaattgataagacctttatttttgtttaatcatttcttgtgttagtcaagaccttttgtatttacttgaaataaattttccatgcagccaagaaaaatatattaagctacatattattttaccaaatactaactgaatagtaaaaataatctttggggggcagcgttaggtgtctttaggacgagaattaaattactgaatacggagttataaaaataaatgtttggaacttggtaagagcatatgccacgaaacagagcatctttcttgaagttagtaattcttggaatgtgcgtcggtcttcttacaatttgcaaatattcgaatttgataaatattatcccaacccattgaaataagatgtagtcttgggctcacgacaaatcctcattcaaaattgagcctcttgacccattaagcttcttcttttctttttttttggacaaactcttcttctggttacaagaactggtcacccaaatagttagcagattttagtctgaaaagtatgattggaagagatacagtgactgaagaaatggccttgacccattgggccttatgtttccttggatttaaaattataagcatatagacattgtgtcgttttgagcatcgataagaggacatcgtgtcggcgaaagagcgccatctacaacaaaaacccaaatcgacacagatttttgtttcgccagtctatcacacttttgctcgccgattttccagatctcagtagggttcttgctacaggtttcagatctttggataggccttggtggatttttatctatcaatcgataaaaggttcttacttttactctgtaaatcgtagtttgggttgtttgtactactttctcatccatgggtaggcacggtagttcctccgacgaagaagagagagttagaagaagggataggagaagacgagagagaagccctgatgttagaagatcgaggactgagacagatgatgttgctcgtcgtgttagggtttctgatgatgaggaccgtaagagctcgcgacgagatcttgagattggtggtactgtcgctgatggtgagggacgccgtggagataaggtcagaagaaaagagacttctgatgatgaggaattagctagacggtcgagaaaggatcgaaaagaagcgaactctggttctgaggatgatagaggtaaaagaattgaggtagatagtgatggtgatggtgagaggagagtgaataaggggagaaatacggatagagttagagctgacacttcttctgatgaagaagatgatttgaaggggaataagaaggaaccgatggaggttgatgatgattacggtcggagaggaaggagaagaagccccaaagtcatggagaaacagggtagagagagaagtcataggggtagtagagtcatagctgataaaccttctgatgaggaagatgataggcagaggagcaggggaggtaggcgagaaagccagaggaaacgcagggatcatcgagcatctgacgacgatgaggaaggtgagattaggagtgagagaagaggaaaagagaagaatgatagaggtagtgaaggtctcttaaagagggatcggagggagagagacttgactgatgggcatgagaatgggagtcggcgtagggaaagtgaaagaaaagataggagtcggagggacgatggagttagagatgaaaaagaaaggagacacaatgataaatatgatgatagtcaaagagacaagttgagaaaggaagatagcaggaaaagggaagagaagaagattgaggttccaaagcccaagctggcagaactcaatccatctgagaacaatgctatg

SEQ ID NO: 9330 - DNA, 3000 bp, Unknown
  misc_feature (1)..( 3000): cDNA_ID_3041283_gDNA_ID_1972069_Annot_ID_178547 3000 nt of promoter + ATG
gcatagagatgataagggatggagtctgaaaagattttacaatgaagcaagacaggtttacagagatgagctaacgttttcaataacttgctgcttcacgaatgagatgtctagctctccattaacaattgcagcgataggcacgagaagaaccaaggtgagactcttgtactgataagtcaaaaggtaaaaactttcctgtgtcttctgtatcaaaattgtcggggtggcatctaaaccccaaatatcagttacaagaaacccatctttccccttcgaccacttatcgtgctgcaaaggtctaataacacgacctgtgctactaccatttcccgaaggcaatgtaccacctgaaccaagagggggcaccgtagtagatctagaagatatttgaggtgaaccggatcctttgcgtagatatgaccaggaacttgtgccagatgatagcgcgtttgtggttaatctcatgacagaaaatgcaaacaagtcgacggtatcatcctgaaaagagaagagagagagaagacaaagactaaagcttttagtattagtgaacaatatagtctacacagaccacgataatttaagaatcttaacgactcaacaatcttggcaaatatgattaatgcgaatgagggatttgaaaacatacaggtgagagagttgttgacaccagtagatcatgaaatagaatcacagagtggcatcgaacggtcccagcacatgaatctagcactccgacgagagactgtacatctaaataatactattcaaaatagtgaactttttttttgtttcgaaacgcatcttctgatagagaaacaaacctgaacttcaagtgccgcatctctagctaaagttagcatctgaactgttccacgctctttcaaagtgtcacggaaggaaggtaactgttgttttttcccaacgaaaagatctgccccaaaatagaaaaacttttgataagtgctactacacagggattttgtgggctatagacttggtgattattgcttaccatttaaatagtctgtgatgaatggatacaagtgcgatcttacaagtcctccagttggttctttctcaagcaatgccctaattgacccttgaaacataacaaagagagagtgcacttccttaagcactctccgcaatgcatcaatcctccatacagcttcaatctccttatttttctctacaatctaccaaagtctaaatcaaattttgttctttttatgcatatgaacaaagtgcaaatcaattgctaaaacaagtgaaagagttgataatgttgtaccatgaccatccagatatcgggctcggcctcatagaaaacatgggaatgtctctctgcttcaattacctcacaagctgcctccggggagaaaagtctgtgtttatattccataaaccacgtctcaggaacacccaacaatacaggaaaagctaataacgctcaaaatttatgtgaacatgagacaacatcaatcaatccatgaactcgaaaaatctgtgtaaagaaggaaaatctctagtagctaacctcgtgaacgtgataagcccttcactgagacctataaccgatagctgagtggagaaggttagatcaggaggatagaagaacaagatcttgtccagttcctgtccttcgtgttggcctcttcttaagtcaaacacgcaaagacgaaggctttcagtaccagagctcatggacgccattcccatagcttctaagagctcattaaacaccttaaaaagcacacagaaatgtgtatcggaaatcaggcaataatacaaactccgtatctaaaattcataactttaaggcacatcaaatcaccagagaaccctacaatttacgattttggaggttcaggtaattgcaagttaatcaatttcgttaagaaaattgcgtaatccatataaattgattacctttgaggatgaaccctaagaacaaagtcaaaggagtgatcggccttcaattcacaaagttgatttctgatgattgtggactcagatctaccagaaaattttagaagcaaaacttggtggtgagaggaaaccaggtaaacgggtcaccgggttaggatctaaaatggactcgggtcgtagaggatcttcagattctcatcggcttacgtcatccattgtcttctccaatgatcccttatttttactttttctaatcgcacgttgttgtcacctatactcgaataatttttgatttcgtctcctcaatctatgaataattcctaaaccggttataacatttcagatttcacatatcattctctcatttagtcgtcacgcttggatcaaataattgaatactaattgaattgatgcattaaattattgaacaaacattaatgaaatagatagctagagcattttataatgaaagttgcgttaaaccggtaaatttgagtctcaaccaatataaattagttaagaatcggtttgcattactcactacatgtaatttgatttcgtctacaaagtaccaaaacgcaaaaaaggttctaacttttgcttcttcttcgcattcactcaaaccaaactagaagacggaatccggccaagtcacttccgcaatcctttcgaatttagattttagggttactttgtcggagattgttaatttggaggtgtgaattgaaattttctctacaatttccgacctttttggtatatattgtctctgttttattgttttgggacgatccatctgattttgtgggatatgaccgatgaaacactctatagtattctgatcttttccttgtgatgtatgctttcttaagcttccattttttatcagagagattagtctgtatttattacttcgcttctggtatttgaaagacgatcctgcttggagaaatttctattcttgactttttatttattttatcaaatagaccttgaagagattctttttatatttcattccttatacttacctggttttgtagtatctggagattggcaacaatg

SEQ ID NO: 9331 - DNA, 3000 bp, Unknown
  misc_feature (1)..( 3000): cDNA_ID_3041300_gDNA_ID_1972069_Annot_ID_178541 3000 nt of promoter + ATG
cggtctttaccttttgcggctactggcggtccctgaaactggcggtctttgcagacttgctctgagcttatgcttgtatgtgtggtattatattcccaacgctgcaaagcattttccgttgtcagctcttggatggtttcagactgcagagtaacatgcgttccaaaatgtagaaaaacaaaaagagagagagagagaggtccttgaaatgtcaacaaaggagaacatataatcaatatgacagtattacataaagttatcaagaacccagcaagcatttcataaaatgtaaaactcaatgcagaaagatactcctatattgacaaaggtgcaacagaataggtaatgaaatcatgtcattttctagaattatccaataaaaaccaacgttatagtcaagtcaacaacgcgaatatacatgagtactttgtgagaggccaacctgagcttttagatgatgttcaaaactgggatgaagaggattgaggaacttggagccaaacgccgagcaaaggaaaagaattctaaagctgcagccaaagctaaagctgaagcggaagtagaagatcacttgaaaatctgatccgtgctgtatatatcgtaacaaacttgagcgatgtattgttagcagacacttaggcatagttgatcttgagatatccaatatatctatctagacgatgatcgtaaacccactacataatacaaaaaaaatatgttggtgtagcccttgaatacaaaaaaaaaaaaaaaggcaattaaaacttacttttaatttgatttgaagatgtgtagcatatgattgtattgggcaaaagaaatatgttgaggcctatttagagacccttgggccaaataaatctgttgatggctatttagatacccttgggccaaacaaatctgttgaggcccatttaaagacccaataaaagtcgtttttcttgggaaaatcagaaaaaacagagcaagaaaaaaagaaagcgaaatgggattattggccgcgatcggagttctgttgccatttccgttctactggtggctgtggacgaatgctcagtcatgggtcaatctctgcggccgagaaagagacccatcgacggtaatggcacgtgtttctcacgtgctcaaggctgctcaactcctttctctcttctccgttgcttctctctcctggccgcctccgctctacttctggcctctcatggcctttggccagtttctcaacttcaggtccaatctttttgtttccgttcctctctcaatttgttgaattcgtaatcgaatcgaatggcatgagatcgatgataataaagatctttagtcaaatccatttttagtttgaaattgcatctgtagacgttgtgaaagttttgtcttttcttttttcaagttttaatcatcgaatctggtttagttttgtgaaggtttgatacttgaaggtcacatctttgactgttaggtgaagttgtgtttttgtcccaacaaaatggatattgagtgatgtttgatatggtggacacttctatgttctgtaactgagctctcttgttgtaaagttttgttaacttaaaaggtcacatctttgcagggtataccaattgttaggtgaagctgggacttattacggtgttcgattcgggaagaacataccatgggttacagagttcccatttggagtcattagagatccacagtatgttgggagtatcatgtctctattggcatgcctctcttgggttccatttcaatacattctcctctggtctctcggttatgttttcatgatgtttctcgagtcaaaggaggatccaaatgctcgtgccaaatccatctcatgattcctaagcataacccactagtcttagaagagctcaactcccatgaacgtcaggtcttgactgttttctttatgagtttgtattctcttttgtactcaaactgatgctacactttcatggataatgcagttaccttttctcgggttatcggtagtctacagaattgtcgaagcaagtactattaagtttatatttaccctttatgccaaagccaatgatgatgcatctgctgcaaagaaccaactggaaatatagggcacatttgtaataaataaaaactaatggaaacaaatgtaataaacagaactttaaggagcgattgcaataaacaaatctataggaaatatctgtaataaacacaaaatatcgggaatatatgtaattattcttttttgggaaaaatatgtcattattcaaaactatgtgaaatctacgtaaatacacaaaatgtggggactcgagtacgaaagaagaagttttgtttatggtgtaattaaatctcttgtcttggcatggttttgatagaagacaaaacattcctaatctgtctagtaatcattaagcaataagcaagcaactaatttttagtttggctttgtcgggttaagagttaagaagacccatagttttgaaacttgaaacagtccttactggctaattagattttaacccggggtttttccgggtcgggtaaaccaaacgatgacgtgtcaaactgtgactggctaactacaacaactcttccttggtactcttctctttactcgctccggattcctatcgttctcgatcggaaaagtcgtctctttatttttgttttttgggttcgccgaagtaaaaaaaaaagaataaggattttctcattaaatttccaaagattagtcttttgtatgtatcttcactttcttatgaatgtgtaaaccttactcattcccgtgatcctactttgggatttcgctagaagaagtttaggtgacgaccttaatttaagtttgtaaatgcaggtcctttctttctagggtttatcgaaattggtgtaaatcttttggaattggtttgagattttttcttttggggaattgcaattcattagtcgtcgtgatccagtgtgtttttaagtgaagtaaggcattttcgatattcggagacttttaggtcaatg

SEQ ID NO: 9332 - DNA, 3000 bp, Unknown
  misc_feature (1)..( 3000): cDNA_ID_3013269_gDNA_ID_1972069_Annot_ID_178539 3000 nt of promoter + ATG
gatgttcaaaagctatcgcatatctagtgcactgtcaagctcagccaatcaattatggctcatttcacattaacacaattcaattcaactaagcccaattagcttaaataaaaaaattggcccaacacggacttgcatcggattacaccccaccattaagcattaaacttttaagaatgattgcttcatttcattcatatcgaaatagaatttgttattaaccaaaatgatataactactgtattttgtatcactcgtcgtttcaaaatttgatggtgggtatacagaaaataagcagcgtgtgttacgggtattctttgctcaatatgtaaagcccatatatttcatttattactcgcttgaactaaacccataaacgttcacatataaagcccaaccatttaaaaagttggaatttcacatactcgctcgcagtttcacgccatcagtcaaattttcacgttgactaattttttttttttttttttctccctttttcccgttgactaaataaccaaacaaaatactagtacttctctcgattagtagattcattttttatcagataacttaatttatcaaaagtcttttccagtttacatagtttaaaatatatgtttccagttttataattcactaatatattgtccagtaacaatgtacatcatgtgatagtgataactataagtctgtaacatatgcataaatataaattacatactgtcgcgatcatttcatataactttacacttgtagattctcaaacaaaaaaaggtcgcatatataacaataactgattgtcgcgatcatttcatataactctacaccggtagcttctctaaatatgttcaaaaaacacgtaaatataatgcatgataaataagataagaacgtatgtacttaagtcaactttccgaaaaaaatcataattaaatctaccgattttatcttgactgctaaatagtgccctatttgtagtttcgaaattgtggtagaagacttgagtaccttagtagaatatataatgtgctgtttttttcttcttgataaataatggccgtagattgtggaggtcaaattaatcaaacattggcatattctcaatgcttcggtttttgggataatattaagtgcaatcaatggctcatatcttagatcgtacggcttaaaggtaataaaagcatctcatgagtcaactaaataaacagtgaaaacaactttattctttccatcttcaaaataaacattcctattcttacgtaaagctatagtagtattctttagcaccggctcaaacaatcgagaagccttaggacgacttacaaaaaggggtcttttcaaacatgctaaaacaaaaaccatttcatataatcatgtcttaagcttcattacaaaaagggatttttacaaattcaggaattaattttgtgtgacagttagaggagagagattagtaaagcaaaaagtactatttattttcttagttatcatttttctccgaaaaagaaaaactaagtataaaaattctatcacacataaaactgtaaaagacttttaccaaaaaaaataattttagcattttattttcttgggctggtggcggtcacacctctgccttacctatatgagccgtgtttggtgctcttaactgttagctcgctaaatcatgtttgacgtgtaaaaaagtcagatacctttgatttaatctttctaacagtaattttttaaaccatttatattaaaaagtaaacgcaactaaaaccgtaatgaaaatgcaagagttgacatagttcttgtatcaattcagagaactacaagaagtagttatcagaacagaactgaaatatagaaatcaactatagcgattctactttgtttaccaaaataaaataacaaagaaattttgggcaacgaagcacaatcctattgatatatagttaggttttaagtataagactttaatttgattgtatcaatgagcttcgacgaacaggatccactgtatgaaaactatgtttgtgttccaaatccatatttcaagcgaatctaatcttgataggaaaacaagaaagattggtgttgattagattaggggccaagaagagaagagaaagccgtccaaatgaaaaaaaaaaaaaaaacattttagagagaatctatctatgaataaaactgaaagtgtgagtaggacccaccttcgatcgcagtcgctgagatccaatcacgttttagcttcccattacagtggacccacccactcaacttgttcatttcctacttcaacgtcccctctgtgactgtgtctgtgtgtttttttttctctatttatttaatatctcaaacagacggaaacaaataaaaattttaatatctcaaactcttaatcaatcaactactagtttattaacaacactatccgattaaatttggtttaaactagtatacaataatcctatttatcttaaaataatatgaatttccacgatatttcgacttacctaccctacatttttttcttggcctggatcataactttgataaaacaactgagaaagaaaagaacatgcatgttgagacaaaaagagtatataaatattgtctttagtgtactttgaggaggacccaataaaaaaaaacacttggtttgaacttgctttttcagagatctctcactttttcgttttttctgctacacacacttttttttttttgcaacacattttgtttctgctacacacacttctatcactctgtttttattttcctcagagtccgaggtacgtacaaaaaaacagaaccaccatttttttttttttattatttatctaagaagaatcttcaataaaatgcacctataaattaacttatccccgagtaagaagaataaaagaaaaaaaaaataacttatcgaaaaagtcgcatccattatatgtatatatatcgttgtggagttgttgtatactaaacaagaaagagattaggaagagagagacggcgatg

SEQ ID NO: 9333 - DNA, 3000 bp, Unknown
  misc_feature (1)..( 3000): cDNA_ID_3041316_gDNA_ID_1972069_Annot_ID_178535 3000 nt of promoter + ATG
gttgctatctttatgagaatgggtcgtgtattgtatctttcatatttctatttacatgatacatgtatcgtgtactaaagaagcttttgagatggagcaataattgtggatccttttctctatcgatcgacatacattattttgcataatatgttcttctccatgagaatggaactcttgcgtttgtgtggttgtaagttgttagcaaagagaatgatgataaaagcgatggttcttgacctttccttgtcacagaatgtgactcacagtcgactctctttttgtaaggaaataaatgatttgttttagtgtataatccttgcatgtattaacaccaattatcgatgcagatggttgtatagtttgcaagtataaaacatgattcctcccctcggaaattcaaggctttattaagcctttaatctccccatgcaaaaactatccgcaaaatatgcaattatgataagatgtatattattatcacgttccaagtgaggctcaaattaaatattcttgtttactaacaaaagataggtgaaaacaagattttacatgtcaaataaaagatttctgtgagatgtatattcttatcattaaaatttaaaatcacttttgagttcatctctttatttaattctttcgaatgactcttgcatataatttgtatacttttaacgttattccttttctatctataaaaaaacgaagaatctgtgatgacccgtcacaactctttagaatcaaaattaaaacactaatttattgctttgtcctcacaatcgtatgactatgaattgaagtgtcttggaacaagatttaattataattatttctctaaggtataagtttcttgaaccttattcgcttttataacttatgcccaagtatacatacccttttctaagttttatagaataagtagaggagtgagctagtggtctcggtttagattaaaaaactatgtgtagatatagataagaggtctatatatccggagaatatatacctcctaagactaagatagtcatttaaatttcgtccattcccttcaagttaaatcacattatgtcatagaataaaaatttggtacagtgagaacgcagatataatcgaaacaaaacaataaatcatgagaatgtattaatgcgtgtggtggaaatagattgttgggagtggaggaacaaatcaggaccgtttgaaagatgtgaagcgactgtttgttctaaagccccacgtcacatcgcagggcatcacagacatagtaactgtgagatttcatacattattaatttggatgattttagtgaatccatttacttcgttgtaaaaagattactcaagtctgattagttacttttctaaacacaatgcttgtaatatattcgacaattctatatagcataatttttatgtgcatgttaataacaacattagtgactataaatgatagatggtcaaaagacttcaaaaacaaaaacaaaaaaaaaagtaaagaggaaaacaaataaatgtaaaagaaatgataatgattttgaaggggatgtatctaagagtagaggggagggggtgtaaatagaaatgttgtagggtcgaataaaattgtcaaaagtccggtccaaattattttgtccctcactaatcgtggctaccatgaattgatacaactttattccattttcttcttaattagttttacaagtatatcattatcataaataatagctggctcccttcactgtgttcgttgagtcttattttgtcttcttttccttttggtttttcattcttttgtgggttgggtaaccataatttgacatgatgttttaaattagcatatcatttatttgtaatatacataaagtttttaactcttctgtatataaatgtatgcacaaaatatctaacgatgtgtataagttttgtatagattggagtttcatttgtttgaatcatagttttgaataatgtatatagtattagtctatacgaaatgctgtatgaaatcataatgtggcaggtcataattatttgaaacaggttatcgtgcatgcttaaaatttataaagaaaaacagtgactattttctaaagctattcacaactcatcaggagtttgatactcatcctaagattgctactgaaccacacaattaaagtgagcgtgataatagtcgtgtcaaacaacaaacaatttctcccaatctttttactccattaatcgtcgttcgatcatccgataatcttttgaatccctgagcagatcataacaaaaacagagccgtgcgtgaacacaagcaaaccataccaacagtcgagaacatgaaatatttataccgcgattaattcttcacgtgcttcttctatctcgtcattgcttcgacgttcttttatatatgacgaggatcgtgttcctaatctctcctctagctttttttattcaattctttcattttcttcttcacctcctcatcatctccatcatcaacttgcttcatcattttttttagttttacttggcatgtaccagtaaagttctagttccaagattggccacacaaagttttaactaaagcaagcctgacaagtaatcacccctaaaagacggaaacgacacacgtttttacgtaacacaaaaaatggttaatctaaagcccaataaaaggcacattggttcacattaagaagaaggagcactgaaacaatgatttaagtatggtaatctagtggaccaccaataaaaagcccattaattcataggcccaatattaacaacctgcgtttggaacaaactcacttcaactacaaaactcgaccctttgaaataagaagaagaaatctcggtgagtttttttgtggagattgaattttcttatctacctccactattcaatcgcatggcgtcagaggcccattagaaaagtcaagccaggggttttggattagatcgttcgttcttcaatttaaaagttttcttctttcttgttcggaactcagaaacacg

SEQ ID NO: 9334 - DNA, 3000 bp, Unknown
  misc_feature (1)..( 3000): cDNA_ID_3041331_gDNA_ID_1972069_Annot_ID_178525 3000 nt of promoter + ATG
taacgcatcatggatattaccagcaagcaattcgtaaagcttaattctctccttctcaatgaaattaaaatccagcccattccttctccaaaggtgaagctgctgcaagatatcattgcggtttacagttgatccaccagcctggctcaacaaacaagcaagtctaacatctcccttagatatggcaagttccacagctgaatcaagctctcgtccagttagaagaaagaataagtgctcaaggtagctagaaccatttagatcactcacatcttcttgtacacggtgactgacactttcttggagccaacaactgaattctgctcttcggataagcggaagagcttctgtatcaatttttgcagaatcttccttcacatcctgcatcacgtcttcctcgttatcagaagctgcatacatcaaacgttcagtactctgtctctcagaaaagagaacttttatgagttcccagaccatgacttggtgcattaaaaacagcttcgcagatgtggacaacccagcaacttccagctgtttctcgattataccaatataacttcggcagatatctgaaagaactacacgatcggtgacaacattctgaagtttaagactgaaagagccaaacctaacttcttcttctacatgattcaattccttgtggagacttaagggagcctcaaacgcagaatcaataagttctttctgaacttttccctttctatcccaaaccactttgtcaattgctatcttttctttattgatcacagaagacaataccatctgggaactggagctacatattggcttaccagtgtgaaaaagaacgccatttgggccccaacctgctcggaacgatcttcccatgaataatgctgcatcaacaacattgcgggaatagttatcagttaacggtgtgacatggctgatgtccagctcgaaacctcccgttttcgactttctcactgccaaattcttattttgttgtaccatcaggatactacctggggagcttttatcattaccagggttatactccagcaaagcaagcggagttttgcgcacgaccggtggagggtcttgatgactatttctttgagcaattttctgcgaaggtcttacatttcgtttagtcaaggatgtcataagatgggaagtttgctctctaaagtcctcactttcgtcttcatcttcattaggaaacatcagcattctcatttctttcatcttttcaggatcaagtcctaaatgagctgggagagaatgagaaagctctagctccgaagtttccatctgatcttcttcatcaatgtcagctacctttttaccatccagtcctacgggatctcccaaacctggcgcatcatccattgcaatatcttctgcctcatcatcactcaacccaaatctgctgaaatgaggaacgaagaacttccataaaccattatcgggatcaaatgagatgaaagttgctccttgtctttccgtgctctgtttcaatttataagcaatatggttaacttgctgttttccccaagttagatctggtatgtttacgaccagagtcacctcagcagccttgttaagtccctcaccaacaaccggcttggagctctcatcatcataaacaataacctcgtgcctatgaaacttaactatgtgatccaggtccaaccttctaacatccgtgtttccaagaaacctaatataaccgtaaccaatcctgccaatagtaaaatcaggaacccggctgcaataatcagggctttcaatttctcgctcaaccagctcgtttatacatggcttcaagaagtagtcaggagaattcaacataggcaatgaatcaatgatctctttggaatgctcacacaaggcagcaattccatctaaagagatccttcttttctttcgcgagtccaaatctctagccatccttgaaatctctgtcgacatagaatttttgaaaatttcaaaatcagatgataaaagttacaacctaagtagcacacgattctgaatcaaatgaacttagaacaggacttgagcgggtaaggtcagataaaaacatagcagagactcaaacatcagaaaaaaacaaaaagcaaatcaatgtactctaagcatcagtgttacaaactcgaattttataagagttgaatgatgaacatgattctgaagctaacatgatatgtaaaacattaatagcccaagttcaggcgcacgacttgagtagctaaggataaaaacatagcagagactcaaacatcaatagcaacacaaagaagatttacctggaaatggttgaatagaaagagacgtcatgattgaaggaaacagaaacaaacaccgagagggtaaagaaagcgacaagctagggttttctttcttataatcactgactctaccgcgacctttccgatttctcttacaaatccattactgagacgacgctaacttacggcggtgacgatgatcggataaaaatctaaaaccgtcctgattcccctaaattccagagttcttcacactgaagtggtcggagttagccgccgcaggggaaaagagagggaaagctctcatagtgtgtgagatctgccgggtttgtttaggatccgtttaaccacccgacccgaaccgaattcctttccaattaaagtcaacattgggccataataaggcccaaatattaggcccgataatgtttttccttttttcggtatgaaaatgttttaatcccagcgtctgataaacgctgcgccggacgtcaatgtgacgcagagagacctttataagtacttcgtcgcattctctctcttccgactcaattcgttttccctcctcttctgcttaccggaaaagtctatatctccgacggaccttcttctctctaggtttgtctcttttattctgataaaagcttttagagaaggattacttatgtgattctgtctcttgaattgaacttttaacagttaatcagacctcgcgctcgtgataatg

SEQ ID NO: 9335 - DNA, 3000 bp, Unknown
  misc_feature (1)..( 3000): cDNA_ID_2123511_gDNA_ID_1972069_Annot_ID_178527 3000 nt of promoter + ATG
tctatgtttggacaacaaagtagcatacttgacctatttgaattagcatgagatgttgtgttgttttgttatgttgtacaaagaaatggaagcaagtttaaaaaaaaaaaaactgtagctcttatagcttgcaaatccttgtaatctatattaattataaaggtgattcaacaaacaaaagtaaaatgagagaactgcatcaactagtgtatcagttccaaaagaataataacccacagaagggtacattcttcgtcatctaccacctaagtttcccttctaatcatctcagtgaggtccatcacctggtttctgtacattgcccttgtgttctttttctggctgtgatacttcttttggggagagtttagtagattgatcttcttgggttttggttggagcattccctgaaggtttcttggtttccaaaacaatttcttttattgtctcttcgatttttcccagtctctgtctcatctccattagctcttcgtgagacttggttgctgcctctacttgtaatgccttttgttcagcttcttctttctctttcttttcttcttctttccttttcttctctccaagttcctgagaattagtccaatatcatgaggcatatgctaacaataaccagaatgaagacagaggataaacattaagacatgactgaaacatcatcagaaactcatatcagtttgataatgaacaataaggagaactcacagcatccatgatcttcattttccggcgagcatattgagcaaccagatacacagctgttacaagaaacaatagccatttataaacaagtcacatttgacagtaaacattgaacataacaactaagataacgggagtgaatggcaatacctacagatggcaagcagacgatgatgaattgcaccacatgccaatcaaacctaacacaaagcaaaatccatatgagaacatactacaaacacaaagcagcacaagaactcaacttactatataagagatagtttcagaaagtcaaagagataatcgcagcagaaattgaaaaccagttcacttgtttcagcctaaagaagctcacattccacaattctacaatcctgaggttttgtagcctaaaattaacttcaaaatatacaaggtaagttgaaaaaatagggtctttccatgatttaaggcctatagaagcatgaatcaaacacattatagcatctgatagactaaacaaaggacaagatcagcgaagagtgtttgcacgcattcgagagtagaaccctctttaaaccccaaatctccggtagaaattacccaaatttgttcttcttgggtggttcagtgaacaagatcttcgcagcggtaacgaaatcgagcttatcgagtttcttataggtctcatcgtagcgagaaacactagattcagtgtcgctgtgatgcgcaacgctagattccgtcttctcgagtttattctctccttttgtgcagaaacgtcgggtcctgtaaagcttcaaccgggtcgataatccggaccacgagcctctgccgcgaatcatcttgatctctcccggcgtcagctccaatcactactcgcgcattttccacacaatatgagcgtttcaaaacgcggtcttgaggctaatgttggtctccacaataaccggatctgaccgtaccgtaccgggtctagggttattggttcgatcagatagcgaatttaagactctcatgtgtcaattgtgatcatctgactttgtaataaatttcaatcaaatttggtatgtttgtcaacaaatatttgttaccttttgttttcagtttgtttttcatttttttttttcagctttggattctatttgtgagctaagatattgaccttttttttttcccctttctgttcaattaattttaatgattattatattatgatagggaaacattttattttgaaggttaaccaaaggcaaattagtggcaggcctctaatatttcatatattaaagatagaaagttgaacttttcatacaacttgtaactcttaagtttatagtctttacaacatcttgtacatcatattatatagttgtaagaaaaaaatgaataaacgcaaagttatattgattatgatatttttgtggacactacctacattcaataaacaaacatagatccatgattagtgtcatttttccccccaaatttttattttccgcaatgaaaaaatggtttattgtactatatatatattcccactttgcaccataattagtcgcaccactttgacaccttaattaaaaaaaaaaaaattgtgagtgtattaaaaagaaaaagtgtggtctcgagacaaaaagttgagccaaagataggggaatattattaagctttatttatattggaccccataataaactgtgaaattattaaagcataccgccaatattaatttaagttctatgcatttataaaatcattggctataaacattctataaggtatctagatcgttcgcggtaatcggttttaagaaaaaagattcataaatagttttaaggaaattgtaaaatggattcataaatatatggaagtagatttatttattgaagattcaaaactagtaataaaagctaagcaagaagtctcatttctgttgctaaaggctttttaatcgaaaagaggaaacataattggcatcggaaatctcaaaagacaagtctcgttggcattttgtgtaattttaataatcttgaatttagagaaaaagggtaaagcttgtcatcaacttattcgacagtttatataaaaaccgagtcatctttcatcggaagtacttccctccggcccattttctgacgccggcgatactctctttcacctctttctttctttcttctctgtcttttttgctttgtttctctccagtgaggaaaatggcggagtcattacgattctccgactgaaaaaagaagttaaaacctttgaaagaagaggaagaatttgaaagaaaggaaaatg

SEQ ID NO: 9336 - DNA, 3000 bp, Unknown
  misc_feature (1)..( 3000): cDNA_ID_3041446_gDNA_ID_1972096_Annot_ID_178577 3000 nt of promoter + ATG
gtcagcacatcaacaatatttagcatcttttcagcagaactaggtcgtgatatcagaagctcttctgtgttcacacctattgattctgctagagaaggatccatggcattctctgcatcaagataagcgcaataacctggcacaaacaagtcttttagataaataaaaagctaatggagtgaagaacaaaagcaagtcagaatcaaactgtaacttcacaaaatcgaatcttacttatcgcactagaaacaagaaaggaaaaagtagaagatatgtgtccccaacttaggatggattctagtaacaagtcccaaggtttctgttcaaacaaatgtattgagaatgggattcaagaacagtacctccaagcttttgagcttccttgatgatatgcagagctagagttgtctttccagatgcttcttttccgtaaacctcaaccattcttccctacacaaaaaccaacaaagttctcttgtaaacacacatttagagacctcattaattgcaatacctttagcttggctagtcctatctgagactctaaattaacaacaacctttggcaatcctccaactccaagagctagatcaaggttgagggaacccgtggatatcacagaaactctcctttttctgtaaaaccgctgcaatgacaacttagagtctttatcaaaatcacctgaaagctgtgacaatgctaaatgtagagcagtgtctttctccgctacttttctatcatctggaacttcatcaagttcacaatctgaagcttcaactgaccaaacgaaacacactcataaagacaggatacagagtatggaaatcaaaagacaaaggaaattagtgattacctaaagacgaaagataacgattttcatagccagagcaagccaaaacgcttcttcttccattcagctacaaagcaagataagagtaaacacaagagacatttgtttagtcaggagcttgggcaaatcatcaatgctactctaaaggagataactttattttggttggagtgttgtcctaatttcttcatctgaaaaataaaatctttctttcttatactcaagctaagaattgttgagaaacattagagacgaagagaacctgagataagtaagagaagaaacggaatctctgaatcggactggcccatgagagtcgacccatgccccgttcttcttcaagcggctcctccttcgctgttcagtttcaattccacagttgtgtcttctccttttctactaacgatctccagtttccgccatggtcattgtccttaagaggtaagacctgaaccagaagtggatacataaaaatcgaaaaccgtattaaaccgatcggttcatggctaatggaatctaatttaacggtttgatatgaggaccggaaaagaggtaacaatttaagggaggtgtaactttagtctttttttttttttttttttttttttttttgtgtgtaactttagtcttatcccgaacattttgctcaaataagattttatttttctatataataataaatctgagaagataaatccctaaattaagattgttcatgcgtggagcataacctaaaggtctaagaatgtggagtgcaaattcaataatgaaattgttggttctcttgcttttggtggacgcttcattaatattgaatcgtatcctaagcatgaaaacatatccaacacataattccgaggttttccaaagcagacgcttcattacgtttgacttacgtacactaactggtgataaccagcgaagcggtgtggatcctgcttgcataccaaaatcaaaatgtgatgatagagtgatggaaataggtaatactccagattatcacagtagtaagttcattgatttgttggcacatctttaaacttgtaagctttttataattactttattttgtaggtatatggaggagaccgcgtactctttacagacctaaaaagttcgaccacgagattcatgacgaagaagaattatgaagttgttggtgctattttcttaaattttttggcgattggttttggtgttaattatcatcattttaatgtattagtttgtttttatttgcggaatatcatatgattaattagatggcccgaaacgtctggtacgtaagagtaagaagatatgaaagctaggtggagtcttgtgctattgacaagttctcgacccttgtaaagttgtgctcctccttcataatgccgtagagactaacacacaaactgctatttgggagataaaaacgaaaagaggaaacaacaaggctaagcggtaatgtccaataggatccattcaacttcattaatgtgagataataatatttttttaattaaaaactgttacattatttagtcgtatcccgaatattgtgttcaatcttacgaggaaaacgtcgttaaccctagtccaaagcgtttacgaaaaataaatgggagcttcttcttcgctttataaaaagtactaaataaagactgaaaagatatagaaatccctaaatattgattgttcctgcgtctccgagcataatgtaggtgtttctaacaatgtggagtgtatatgcatgcaacggcgaaattgcacttctccttgcttttttgatggatgcttcactgggtcgacattacgttttaaatgtatcgaaagcctagctagttacataatcacactctttgcagtaataaacccaaagtttttccgacatatcttcttcacaaacatcacatatgaactttgcaccggtgtgttgtagagaagagtgagtggatgttcgtcatcttcccgctccacagtctcaggggcctttgtggacttaaaaaaataaataagtgaaattccaaagggagataattaaaaatcgatttggtatgagaaaaatctaccggtatggtatgagagaaccaaaatcgagcggtcgttaataattagaacgaaaacagaacaaagagagaacgaaaacagaacaaagattgcgaagagaa

SEQ ID NO: 9337 - DNA, 3000 bp, Unknown
  misc_feature (1)..( 3000): cDNA_ID_3038923_gDNA_ID_1972096_Annot_ID_178600 3000 nt of promoter + ATG
aacaaggggaatgaattgggttttaatcattgaagatatttatcgtaattaagaacaataccacaaaggggaagagcttttatcaaaagaaaagatgatgtgtgtataaaattggtaagttagtaacgtttggtgaagagcacattattttagccatgaatggaattgcgtgagtaagttaattaagaaggagatgtacgtaattatgaatttataatcacgattcacgaatattattactgcagtctggctgtatatacgtcaccgtctcattcaattataccatgttactttccgtttaagaatgaatattatatttttgcccaaagaaaaagaatgtatattatttacacaaaccagaaaacgtaagagaattaatgaattagggacgtgaagaaactagtaagcatatcaatatatcatgaagaaaaatttctgttggcgttttaaaaaaaaaagttatgcctcaaaagtcagtccaatgttttccacatgctatgctctgggcaagtatatattctttgaaccaccatcgaaataagtaataaaaatttgagataaaatatttaaaaatacttccggtgtcaggaaattgacttatataaattgtagtttataagaatttttaaaatggagttggtttaattaccacatgttgccatggattaattgattcctcctaaaactttatgttaattaccacatgcactacgaaagtacaaattaattgatatcttattacagttaaaaagccagctaatatcatcatcccagttttttccgctataagaaaattaatccgttttatactccacacaacacaacaatatccaaaacatgtttatgtcaaaaagagcaattacagaataataattacacgagagaatcaagaagagcgattgagagaattgaagaattgtatgatgctgtaatagtaatgtgaataataattagtcttttttttcttatgaaataatgaagaaaagtcattgagtacataggaatttgaccgtacgatctgaaatgtttacacgcgaagatttcgacggttgcgatgaagtaccttatgtaatcataaccattgaaacagttgacttttgttgacaaaactatcaaacatcatcgaatcaaataatgcttagaattattgattgcattgcaagaaacaagactaatgatgacccaaaaaccacgaactgtgatctgcgtcggagacatccatggaaacatatcaaagctcaataaactctggcttaatcttcaatccgatatccaaaactcagatttcagctcagctctcgtcatcttcctcggcgactactgcgatcgtggaccggagactcgaaaagtcatcgacttcttgatctctttgccggagaaacatcccgatcagacccatgtctttcttgccggaaaccacgactttgcttttgctggcttcttgggtttgttacctcgcccttcagatgggtctgagtttaaggaaacgtggaaagagtactcaaaaagtgaggagagagaaggatggtataaaggtgaagggtttgagaatatgcatctccaaagcaggagatgggcgggaaagattagggttcagttcgattattccgcatatggagtgttgtataatggatcaatatacgatgcggcgtctacttttgaatcttatggcgttcctcatggatcttctggtgacattctccattgattcttctttctggttatagtttatgattagacgtttgtctttgtcggaaactgtaaatataggtcaagtgatcgatcatgtaattggtgatcagtcaaataagtaatgattggatctttggttaaccaaaaatataattgaatctttctcgatttggagttttcatgttctcatctctgtactagtgaaattatgaaattttataactgttttgaatctattggtattggttttgaaacttgtttgttttcttttccttgatagatttgataaaggcagtacctgagagtcacaagaaattcttgaccaatatggtttgggtacataaagaggtaagggcttttctcctaccatgtgacgtttcttaggaacaaatgttgagttgttataaagcaaatactttttgtctaagaaagcataagctaaatttgtaggaaaatgtacatgtagtaatagttatcatattgttgatactattgtaggatgatgtttgtatagaaacagaggaaggccttacgcattgtaagttgattgccgtacatgctggtctagagacaaagaataacgtagaagaacagcttaaactattgagagataaagacacaagcatcccaagaatacaacctctaactggtcggaaaaccgtttgggggatcccacaggtaaaaaaaacattgaaagaaccaaactttgtattaagatcttgctctcttttgaaatctctttgtatgactttgtttgctctggaacatactctgtaggaactggatgataaaaagactattgttgttagcggccaccatgggaaacttcacatcgatggcttgagattgatcatcgatgaaggtggtggatataccgatacacctttggctgcaattgttcttccttctaagaagattatccgcgacaccgataatttttccaattaagtatatcatgtcttcatattaaaattgaaacttctagtagtttttgtgattgttctgttgttactttttaattagtgtttcggtcttttccgctacttgtataacttgataatttttttccaaaattagaaaatggtataactacttaacactgttatgaaaaaaaattttgaaacttgtaaattcttttgcatgttgttagcttatgaaccaccaacttagaaaggagataagaagaagctaagaaaaactagacgaccaaaaaaacatgttattatttcgaaataatatatatagccaaaggcccatgaagcccacaagtacattatcatcatttcaagaaacagagagagactaatg

SEQ ID NO: 9338 - DNA, 3000 bp, Unknown
  misc_feature (1)..( 3000): cDNA_ID_3041383_gDNA_ID_1972096_Annot_ID_178598 3000 nt of promoter + ATG
gctttgactttgagtattggtattggtcatcaagggattctgatgatgagggacgatgttatgaatgttagaagcgcggaaattactatgaagagcattggtcattatgaactgcgtgttgttatagcaagaaaccgagtctttggattcgccgtatatcgcttcaagctgccggaaaaatctatagtttttaccatcttgtcgccgaccggatttgccttcttttgtttttttatagtacttgtagagattctcgaacttctctctacacttcttgccactcctagtgtatccatgttcctccgacataatcctaaacatatgaggtatataccaacaaaggaatgaaaaatgcatcactttcatgatttcatcattaattcataatttgcataataatgcaccacaatattgaatttatgaataaagcagagattatcaacgacaaaaagtcaaactaagtcaaagaatagatgtttcttatttgatggttatatatactctttttgttctttaaaaacacatgaagaaatcttaacagaaactcctaatgtctggtcattcactctctcgaccaaaacaaaactagtaccacagatctgcctatactttaaagtaattttgtttttaactaacttgaatttaagaaaaccaaggggttgatgatgtcatattctccttattaataaaaaaaaaaaatattttaacgtgaaaggtctaatctataacaaaacaattatgattccaaatcaaaaataaaacccataatcgattgtcttttttctcttccaagttctgatttttatcttaacttttcctctccggaataagggcaaaaaagacaaggaaaggggattttgggaaaataaagctggaaaaaattagggttaaaaaatgagacctagaaacttcatcccagagaggacccttttgattagcttctttgaacttgtgatcaagacgagatctgacctccaacaacatcaacgtctcttgcctcggccacctccctgttcctccgccgtccgtaaagccactaaacccaccaacacagccaccactctggatcgttgtaatagtgttactgttgtttccagccaccgtaagcccttgtattccacgtggcaataaacttatctcatggtcggtgaaatgaagacgatggtgctggtccggcgctgaaacgaggttgaagccgaagagatcagaggagaattgagaagatggttgttctataccgtactgtggatggttttgatgatcctccatttggtttgattcggtagaagagaagagttcaagtcagagagtgtgaggccaaaatattgaaaaaccaaagcaaatgttcgagcgtttttgatttccaacgatagaaggtttatactttatactactagaaaaatagaaataaatactaaataatttaattaacaaaaccaaaacaatagaaaaggttgaatagagggatcgagtgagagagcgatagaggcggatcgtgtcgtcaatgtaaaaggaaagttgaatttaagctacagtgacgatggtcccatgcatgactgtattatataaactcttaaatcttctggggtatgtgtagataacatattttcttgaactatatatattcacagtaaaaaacaaaaaagggctgtactgatgaatatttactttgactatgttttcttagttgagtttgagattacctcagaacatatatttgcaaactggttttaatgatgcagtagtaaaacgcaccatacaatatatgacaaaatgttatcaatgtttacatttgactataaagtgatttttaaaaaaaatagttgtaatatatgttttttttaatctcaaaatttggcaatttgtttatttatttttcttacaatttacgccaatactacttccacatttaccttatagtttataagactggtaattaatgtatatggaaaatgttatggacatcaaaagtttgatgacgtacttgattatccatagtgaccaaaacactttcaccgcgtctatttgatcatctttaaacgtgaaggttaccatattaagaaaataataagtttacttgtttctctttctgtatatgtctgttttgattcgcaaatcacatcctactacacataattataataatgttacgtttagaagtagcggtgtgatagagggaaggagtacatgacaaagaagacgaggagaatccaaaagctcaagactccaaaatttagagaccatacaaacaagacgctcgatgaacggaaatgcttggtcaagactcaagatgctgcgtaagcattcacaaaacaaacattgtttcatatttgacgttcaagaaccacaacgcgcgttttgtgatttttaattctctctaattaggcaaccaacatcgtcattttgtttgacgcgcctttaggatgaaaatatgtgtatttgtttttgcagtttaggttgtagcttctaaaagtagaagattctctaagtttcttgttataaagaaaaataaattcttaattaagatttctttaatatatataactcggataatttggaccgaagcccaactaatatcgaggtgtacaaacttattgggtacaagcgcaccctggaaacactcagagggaagcccaaagctaattagcatatatataggacatgttttgtagtggaccaatcatgattagcataaggattttttacctaattaagttgaatggataacattttagctgaagcgccgagctaattagccaatacacacatttcatagtaaccaagtaggattacatttttagccgataagcgtgttttgtagccgaaccgattaggataggtttactctggattctttgcctaattttgatgcatatcttgagattttctttatatggtttcccatttagtagcttcaagcaagcttatgtctagcacactctaatacactagtacctttaactttgctttgtgtttgctccctttcgacagtcttgagag

SEQ ID NO: 9339 - DNA, 3000 bp, Unknown
  misc_feature (1)..( 3000): cDNA_ID_3041372_gDNA_ID_1972096_Annot_ID_178603 3000 nt of promoter + ATG
gaaatctgagttttggatatcggattgaagattaagccagagtttattgagctttgatatgtttccatggatgtctccgacgcagatcacagttcgtggtttttgggtcatcattagtcttgtttcttgcaatgcaatcaataattctaagcattatttgattcgatgatgtttgatagttttgtcaacaaaagtcaactgtttcaatggttatgattacataaggtacttcatcgcaaccgtcgaaatcttcgcgtgtaaacatttcagatcgtacggtcaaattcctatgtactcaatgacttttcttcattatttcataagaaaaaaaagactaattattattcacattactattacagcatcatacaattcttcaattctctcaatcgctcttcttgattctctcgtgtaattattattctgtaattgctctttttgacataaacatgttttggatattgttgtgttgtgtggagtataaaacggattaattttcttatagcggaaaaaactgggatgatgatattagctggctttttaactgtaataagatatcaattaatttgtactttcgtagtgcatgtggtaattaacataaagttttaggaggaatcaattaatccatggcaacatgtggtaattaaaccaactccattttaaaaattcttataaactacaatttatataagtcaatttcctgacaccggaagtatttttaaatattttatctcaaatttttattacttatttcgatggtggttcaaagaatatatacttgcccagagcatagcatgtggaaaacattggactgacttttgaggcataacttttttttttaaaacgccaacagaaatttttcttcatgatatattgatatgcttactagtttcttcacgtccctaattcattaattctcttacgttttctggtttgtgtaaataatatacattctttttctttgggcaaaaatataatattcattcttaaacggaaagtaacatggtataattgaatgagacggtgacgtatatacagccagactgcagtaataatattcgtgaatcgtgattataaattcataattacgtacatctccttcttaattaacttactcacgcaattccattcatggctaaaataatgtgctcttcaccaaacgttactaacttaccaattttatacacacatcatcttttcttttgataaaagctcttcccctttgtggtattgttcttaattacgataaatatcttcaatgattaaaacccaattcattccccttgttgcttctttaatcgaactcatgaggtggcttatataaatggtataattaatgtggattaaaattgtaccctttaattcatgtaatgtgtcatttccgtttcttcacgtaatctcaccgtaatctctatatataagcacacaagcaacacaatcgatcataaaccaaaaaaaacgagagagagagatggggaaggggggttggcttcttaactttctgaaccatgccaaaaatcaagaaagtgtggagaatcttgacaaaaacggtgccgtaaaggccccaagcagtgggtttaagatgccgttgcattacccaagatacacaaaggaggattatgaagagatggaagagtggagattggatttgcttctctcggaatacggacttcttgccttccatgacaatactctccatgagaagcgagcttttgcaatcgacacttttatatggcctcatcacccataatttcatctccttcatttatcttgtttatatttcttaagagtaacggagattgtagagatacaacattggaagagatgacaaaaaccgggatatcaatctaccggatatatatgtcacaaaaagattttagtatatttttagtaatttgatttctactatattctttagttttcattagatctctttatgttatgttatctatataagtttggctttggattttgcatatattaacctttccgttcaataaaatatagttttaccgcttcttatggtatcaaagccttcatccaaaacttactcaaatgagattgactctcatgttaaaacagagaaaaacagagaaaaaacaaaagatcattaaagtcactatataaacatcatgattcatctccatctccacccttaatttctttactagtccgttcgttctcgccactattgttgtccgtgattgtacttcttcataagcatcactgaggaagcaaattctaaaacaatagtatcttttaacaatcataaagtaaaacagtttttttttttttgttcttatatatatactacttattacacatttaaactttggttttgaacagtgaaaatgttgcttgcaatttttttaactttgtagaaatcaggcaagttcttaagttgacaaatgacatatactagtaattttcacgaacgttatcccactaaagtagtcatacccaaaacaaaattgtttaaataaaagtaacttaattatatcattgagattcgagtgaataatgccaatgaaatttaatattcattatctgacactctgaaactatgattaactacataattatttaatttaacgtttgtaccagctaatagtatacacgtttttatgacaaacatttttgaattttttgagttaaaaaataataatggttttcgtcgtaataggagaggacagacaattccaacgtgatatgtacgtttatcatgttacttagtcagcagatcatttcttcggattatataatagctatttagaaacattaaaggtgtggattatattatagtcaagtctttccaatatgaatattatatcatccaccaatacataattattgtcaaatacaagttgagtcagattagtcaaatacaggcaaccaagactcgagatcctcatcgtctctccactttatataaaccccaagtcagtacttctcataatataccaaaaacgaaactgagaaagaagttttatttattaatta

SEQ ID NO: 9340 - DNA, 3000 bp, Unknown
  misc_feature (1)..( 3000): cDNA_ID_3041423_gDNA_ID_1972096_Annot_ID_178585 3000 nt of promoter + ATG
tttccggcaatgggtaaggttgttcttgtttctccgtcttcttcctctgagagcgaaatgccattagttcgccagacttctcggctaaccgggaatccgaacgacgaagctcagtctagtcgatcgaaccggatcgagattccgacgttgcttgatgagccagatcgggaaggttccggtggacatctcgctgctcctgaagatccggtggatttcttatctcagttcgacccactcatcgacctagaggatgcttataacacgcagccgcagtatacagaggctgaggttaatgcgagattacttcacgaggattatgttgaatttgacctcgacccagttgttagctggaacaccgagatcactgcgaaaaagaccctttcaacaaccgagtctgtcgcggaagtattcgccctatgtggctatggagatcgcccgctcacttgcatgattcccggagaggaggagcgcccatggaatccccctcgagggtatgtttgtatgtatgaagcctacttcagacagtgtcacctctggtttccgattccgtctctgatcatctcctttctgaatcgccgtcgtatggcgttctcccagcttactccggcggcgatctgcaattttgttgccgctttgaccttcggcgctgaagaaggttacctggtaaacgttcgttgtttcgaggaaatgacgacgttgaaagctgtcaggtcgcccggctattgggttgtgaacaaccgcccaaagcataactttcttcccggtcccaaagtcagtaacttcaagaactgggaagaatattacttctacgtcagggtcgacctcgagtcgtatgagcgtccgttctcggggaggaaaaggacgtggacggagtttcctggtagaccttttaaacagatagggtaaagatatgtcgatcttgactagattctcatagccttttcttttgttgcagatcggtacagacctagtccggagtttcccgttgagttcgaaggggttttagaggcaatattccgagctcggcgtcgcgcgtggaaagacatcacgaggtcgcgcgtcaacagaataatggggaaggtccggaaatccttcgttagctttgctgccgggcttttgaatatgccacctcccccggcttccatcgaagagacgcagcctttggacggagaggcggctgcactaaatcctcccgttagtgctggcccttccggtgttgatcaggtctctcaagagacgggcaatccggattctcaagacaagacgtgtcttgaaggggccgaggtcattccagctcaagagatcgccgagtgcgagcaaagtcaatccgttcaggttgtcgagcctgaagttcgaaatgttaccggcgaccgctccgtcgtcgtttatgccgccgcgccagaaagcgaagaggtcaacacgggcctaaccatccttgatcaagacaagggtgagaaggttgcggagctcggggcatccaggaggtcccgtgaggagaaagggaaaggattggctagccaatccaagaagaggtcggcttctgaagccggtctagatgaagctgctgctccgaagacgtttcgcctgtcacgaggtgagactcttaattctgaccagtttacgttcaagtattctggcgagaaattccttgtgagagatcaggaggccgccagtcatctttggcgtaacttgatgctccccggagcggcggacttccctaatcccgacgacctggttctgaaagagggatatcagaagtttgccagatcatcacttgaggtacgcgcaggttatacgtcttcctgttgcctagtatctttgtattttggatttaaccatgattctttttccagaccgctgccctggccaacgatctgattgcgacatatgatcgcaagttgaagctgaagctcgccgacagagaggccttcgataacctgaagaagtgcgctgaccaggccaaagccatctatgccaaagacatgaaggaaatggcagcattgagagatgctgccgagattcataaggcagagatgagctcgttgaacgacgaggtcaagcggctcaacggtcgagaagctaatcttcagaaagagatcagcgatcttcaagtcgcgttggttgccgtgaaagagcatggggagagggagtgcaacaggctgcggaatgaccgagctactaaagtcgcccgtaccacaaagaaagcccaagctcgtcttgataaagtgaaggcttatctcaaggagcaagaggacctcgtcgggccgaaggtggacgctgagaatcaagctaaaggagctgaggagatagtgggtattctgatgcagagaggcgcgaagattgcggcatccgagctcagcggccttaaggagttaaccagaagggcggccgacgaggtcaatgctttgaacgtcatcgagctcggggatgatgacctgaacatgtccccggatcagctcggtttttcgaggcaaacctctcaagttgctccggtggcggaccagcacggctcaaatgtcgaccttgttagcggaagtgatattcgacgcgtaagcgttgaagaggcgaaccagacgatctgaataggtcgtctttgtaatttattttgatacatcgatcgtggacccaatttttctgggcgatctcaaaactcttatttaaccgtggacccactttcggggcggttttttaattttaacttctattttcgatgattttccatcttgcctgtttccgaggcagaatagtattttttccatgtatgagctttgtcattttttggaaaaggaaattgagggaagtcaacccgtaatcatgtaaattcccattttcccagttttggagaaaatgcaaatattagtgtttctcggaaaaggaaaatgagaatttccagatcgcatttgagaaaatttccaattcgattcctgtatttgcctctataaatacttctttgttgatcaacaattgcttcaccggacttttcctcctatttgcaagatg

SEQ ID NO: 9341 - DNA, 3000 bp, Unknown
  misc_feature (1)..( 3000): cDNA_ID_3041406_gDNA_ID_1972096_Annot_ID_178592 3000 nt of promoter + ATG
ggttcgttctgatcaatattatctacctgcccgttttctttcaatttctcattccaattacaatgagtaatttctttttggtatcttctccttaaatgtagaaagaaactggaatattaggcctcctggttttagcagtgatgagttcaagacatttcggaagccagtaagaattagagatctgcattttatcaattcgtcttatttacaaaatagttcctaacatctttggttgtttccttggataatgttttgcagttgacaacagatattcacaaagagcgacttgcggctgtaagttttaacacatgattttaaacatcctaatagtatagattatggttctgagtagaagagaaacttatatattgaagattttcttgttgattttgtatatacattgtggattttgaagataaagaagtcggtcacggcaacagaagcagcaaacgccaggaatcagtttgggcatgggactgctaatgcaagaggcggtcaggcaaagacaccttctaatcccatgggctctacaactttcaatcactgatgtattagatcaaccctccaatcgtgtttggtaggaattttccattaaaaaggtacgaaatttgtatcacccattttgtaccctatctagatctcacagtccaagataactacaggcatggaggctaggctagatcttaattttaaccattagtaaagtatcttaccacctcatgggattgaattgattcaatgttttgcaaaacggccaaaagtgtatgaattgagtgatgagacacagttataaagcggttacaaaaccggactagccggtataatccattaaacagattcttctcatacagttgaatcttccatagctttgatcaattttatagttttttactgaatgtacacagaaaatcttggtacaatgttggcttcattagtccttttagccttcaactatcttcactggcgtcctgcagaataaaaccgaaaagaaagctttcagggcacttttttcgatcaaatttacccagtgtattagttgattgatttcacatacccgaaaggactctgcttgattgataacagctcaatgtcaagctgcaaaagaaagataacataaatgaacaccactttagaagccaacaaaaatttcaatccattcaacttggttacctctatcgtagcgtttggaggaatctcttgcactcctttcttcccgtaagccagctcgggaggaacaatcaccaatctctgtatataaacctcatagggtcatcaaaacaagactttgagtggcctgactttgtgaagcctttcggtttcaaaaactaacctgaccgcctacacgcatcccttcaacaccaagatcaagtcctttcagaacattgcctctctctgattgaccaacgtcaaacccataaggctgcaaaaattcattattatcagtaaaggatccttgcatattcaagtacagtaatggactctgtaagattgccttataccgttccacctccaacaccaagtccttgtcgacttgtcatgaacgttatccctttccattttgcaacatagtgaacctgcgacacaacatttgggttaagcatcaacgcttgttaaaactgttagcatttacatgtccaaagtaaaccaggaaacgtattcacaaccgtactgcgacccgagatcctttcacagcctctgctccattgccaacctttatatcatagtacctgccacaatataaacagaaaccaaacttgtgattattgcgagaaagacttgatttttcaatcctgttttgcggtatgagtactgtatcgaattcaaacaaaagatgatgcattggattacggacttgagaccattggggagagtcgtgaaatcgctttccggtaacttggatgcacgtagctgcagagaattgtatgtaagagattgagttttgagtcaagaacacaatgtatgcatagatatatatattgcttacagctcttctactggtgcttactgcctcggctgaaccagttgacaaaatcccagaagctgttttgaatcagataacaacattttctaaggattttgatacactgagcttaagtggagatgtgaagaactaatagagaatgatctaacctgtagcgagaagacatccaagtaagacccttctcccttcacaactcaccggcgccggaggcaggacagtctctgttctgatgaccttttcgcagccgggagaaggtaacgagcaccggtacggtttggattgcctttttcctgcaaattataacaaatccaaaaaaaaaacaatttttgcttaatcgatgtctcgatattggttcaaaacatacaagtaattgacagagagagataacagatgtgtgtacttgagggaaagggaatggaggaagacaaagagtgatggagagggtgaacaagtttcattgttaagatcattctttcaatgtttttgtgttagttcacagattcttgttgtctaaaacaaagaaactgactagttcttgtttgccttccttcagagtgtgcccttaattgtgtgtgagacgaagaagagagtaagtgataaaactggaattctcatccacaagttgtagatttcatgattctctcaagtcaccaccaaacttcttgtcgtagaccatataaataaaaaatatttgttttgctaaaacttagaaaagatcagtttttattttccaatatacatgatgatgaatgatccaccaacaccaagtgcgtccataatcgttattaattaatctgcaatacattagggctaatcacggaataatagttttttgtgttgggtttgtaatttatgtgtccggtgaaacctaaatacagacaaaaaaagtgctggttagtgtttggtgagaatcggtaataaaaggtttaaaaaaccaaaccggtcacgtagttttgtttgttgtgtttattaagagccgccaccagcttcttcctctctgtttaactctctctaaaccc

SEQ ID NO: 9342 - DNA, 3000 bp, Unknown
  misc_feature (1)..( 3000): cDNA_ID_3041399_gDNA_ID_1972096_Annot_ID_178594 3000 nt of promoter + ATG
gagcttagaaatgccgcaaaatccaccaaatccccaaaattcaattcagttccagcatcctcatccttacaccacctccggcgaccaacaaactcagccgccgataaaatccttatacccatacgcctcaaaacccaaacaaatgtcacccattagcggtggcggttgcgacgacgaggatcgcgggtcgggttccggatccggttgcaaccctgaagacagcgcgggaactgacgggaagaggaaattgtcacaatggcatagaatgaaatggacggatacaatggttaggcttttgatcatggcggttttctacatcggtgacgaagctggtttaaacgatccagtcgacgccaagaaaaagaccggcggtggcggtggcggcggaggaggaggagggatgttgcagaagaaagggaagtggaaatcagtgtcgagagctatggtggagaaaggtttctctgtgtcaccacaacaatgtgaagacaagttcaatgatttgaacaagaggtacaagagagttaacgatattcttggtaaaggaatcgcttgtcgtgtcgttgagaatcaaggattgttagagagtatggatcatttgactccgaagttgaaagatgaagtcaagaagttgcttaattctaagcatcttttctttagagagatgtgtgcttatcataatagttgtggtcatcttggtggtcatgaccaacaaccaccgcaacagaatcctatttcgattccgattccgagtcagcagcagaactgttttcacgcggcggaagcagggaaaatggcgagaattgcggagagggtggaggtggaggaggaagtagagtctgatatggcggaggattcggagtcagagatggaggaatcagaggaagaagagacgaggaagaagcggaggatatcgacggcggtgaagaggttgagggaagaagcggcaagtgtagtggaagatgttgggaagagtgtgtgggagaagaaagagtggataaggagaaagatgttggagattgaggagaagaagattgggtatgagtgggaaggagtggagatggagaagcagagagtgaagtggatgagatataggagcaagaaagagagagagatggagaaggctaagcttgacaatcagagacggaggcttgagacggagaggatgattctcatgttacggcggagtgaaattgagttgaatgagttacagtcttcgggtacacgggttgacccgagttccgctaaggggtgatgctgattagtatttaggattagagattttttacaactttgtagtttctaatgttaggattctcacgttttagtgacattaggcagtaaattaaatcttaaaagtatgtactattgtagacaaaaggtctttaatcagcaaattgattaagcatgtctacttttgtagtttcaattttcgaataaggattctctcacgctgtcaatatttaagtggttaattggtaaaagtgagaagaaattaatcaatcgtacaaaggttaacacacatactaagggaaaaaaaaaatgacacacccggtgggactcgaacccacaatcgtttgattagaagtcaaacgccttatccattaggccacgggtgctctgcttgcactagagtattgagaaaacattaagaaacataattacaatcagtaaaactacccacggcccacgggcgatcctcgtttatttaaagaatatatgtttctctatttaataatttacccttcaaagcatcacaatggagagtttttcttctatttttaaccaactagagttttgtgtacaagtagttattaaagatataattcaagaactgttatgatatttgtaagaagaagagattttctattataaatacttgagtgaaagtttaggtaggttacacaatgtcaataatgtgacaaagattatttgagatgatagaacacaaaaaaatatcataccataccactatattccatttccatctagtgtttgagcagatattctgctttgtacatgtttcttgcacctacaataagattcaaaagtttaattagataccattggaactatagcgatagttgcagttttctctaaagttttcctataacatattttcggacatatggtaggagcatctggaagattatgaggatcaacaaatagcggaaaacaaattactgtatacacattgctttcaaaaaccaaacaatcttcgtcaaatgaattttgtaacttttgctgaatatgataccaagtggagtccaatgacaaacaatctccggtatgaatttagtgtcgtacgtgaagtatatataagttacaaatcatgtctttagaacaaatgatggaaagtgatatatcatatatacagtgagacacgatgcgatcaatcaaacgaccaaattaaaaaaaaaaattagtaacataattatgactcgttgttatatctaaaaatgacaggaaaacattggactaaaccatttttttcagttttaattgttgtaacacctgtttccaacgttttatattgatagtattaattattttcttcgttcacccgttacatcaattgaaaattgaattgttatcatcaaaggttttataattttataaattttaatcttacaaagacaaaatcattatgggaatatatatctgtgaaagaattttgataatatgtattttgttggaaagctgaaaaatatgaggtaacgtaggttattgactgtaacggaagcgaatttaactatgtttcggtttggattaaccaaaaccgaatagaataacgcaatttaactttggttcggtttggtttttgtgaattaacttttttttattccacccttaccacttgcctaacggagccgttgtgacggcccatccacttttgcgctagttcacgccttgacgccttctccttccgtttcttcagcctctcgccgctaattaacgccgtctctggttgctaccaccgccgtaaccctaacggcattttta

SEQ ID NO: 9343 - DNA, 3000 bp, Unknown
  misc_feature (1)..( 3000): cDNA_ID_3041391_gDNA_ID_1972096_Annot_ID_178596 3000 nt of promoter + ATG
ggggcgaatgtgagaaagagggagaaatgtggggttggatttttaatttcgagttaatgttttagtgtaaaatgacttttcactatttctgtaaaaaataataattgatctgctagcattgaaatccaccattcggtggtcttttttcattatccaacataactctttttattacttattgttgtcatgtgctgtgtacttgcatggaagacaattagccagaggacacaatgtgtgagttaaatttcaatttcgagttgtgtatagttaaacagtatttatttgtgtgataataattaaatagagttgtggataatgcccgtaatggaacatggtaacaaaatggcatttaattatttatgatgacaagaagtttggtctgttctattaaatatctttgtaggatatgaacgccaagtgtcgtcttgagttctttatcaaatactaaaaaactctcgtctcgagttctttatccatacttctcaagtcccgagatttagtattgattagacacgacaattaaaggaaaactaaaatctttgagaaattatataaaacaaaagcaaaactgcaggctgtggggttcgaacccacgcgcacttatgtgcagaagaacttaagtcttcccccttaacctctcgggcaaacctgcgctgctgtttaaatattccatttttaagtttatttagtaatcgtatttctgtggtctgtgaaaattgagctactttcggcccaacgaaaaacttgcatatttaaacatataggcccagttacaactaaatcaaaagtatttatttttggatttacttaaatgtagtctttcatcctaacttctcacaaagacatatataaaattcatgcactctccttttatctagttggatcaatctcaagtaatttactgggaagaaataagaaacagctgctctctgttaggccttagtgttataccttaacaaattattaatgggctattagatattattttaggcccaattgaatcaagtactaatgcagatttaaggggggtgtattgacggcgttaaaacggtttctcaacggaatcgtacgtagtcacacgtgattttattgtttaccccggattggtcatgcgttccttcttttccacttgcgcggaccactcaatgacactctcttcttttgtagcagtggcccgacaccagaatgcagcatttaatctctcaaattaccattttgctcctacctcttttaccccttttggtattttgtgtcttttttctttctatttcgtgtgaaaaaggatctcttccttaatcgtattatttcttccgatatctacttttattctgttttctatttttggtaggttacatcttttttataaagaaaatatgagctaacacgacattagtgttgttaaccaaagaattggaaaaaagttataagagagataataagattctcttacagagactcacttcagtgaaaaaggaagaagcaagtggttcccttaagggaaaaaaaagtcacgtacgttcatatacaactttaatacgtactgtgtaactcaatagatcgtgcagtaatattcagtcgtattagtaagaaggaatttatttgctaagtaaactcaagcctcctttttctcttttttttctttttagtaaaaattaggctagtgttttttttgactcagcaacactctgcttaaatttaggagtaatttgacctattcctacgagtttctaagtgaattctgttggggtcaaagaagcaactagttgaattagtggaaaatcgtttcctttctttacgcatagttcacgttggacactcagtctcaatgctttcacgtttcacgtagcaacaacatatattcatcagtttgtgatcgtgccatcgtggataagttgcaattcagtgaaactctgcaccactttgtgcaattatttggccgtctaatctatttgtgagaattttacaatctaattgttctattatttcatttacttgtcatcaatttattatatttgtagccaatgaacgttgtaattaaagaaccaaaataaattaatatcttgaaatttgtaacagtcactagaagctgatttcttattaattgtatcactaaagtattattaaaaacggttacaaattatgataattatatatttaataaatttcgtgtgtcacatttcttttaaactacaattatgaatatctaaaactcattcatgcatatcttaaaatttgaattcaaaactttcttatcttatctttaggttcttaattaacagtcactaaaaatagtcaaagttttgaagtttatgaaaaaagataagagtataattaatggatacgcctcgtaacaaattcttgtaaagtatagataatatacatttgttaaatatgacacgtgtttattttttttttaaatatgatcaaaatatattttaactacctagatggtatgtatgtctccaattttgaataacaagtcaattgttattagaaatgtcataatataaagaagggaattaaatttgcaaagaaaaagtgaaaaacaaaggatttgtattttggagaaaattaaggactggatttgcaaaaacgaaaaagtaacttcatgtatattgtcttccttatagtctctataaactattatctcaaattttgtctggactctgaaactcacaagacttgactctggcttacttggcttcatctttttctctctggtaatctctcctgcaacttcaagctttcattttcaaataaatgtaatcaaatctgttattttcactcaagaactaattgagttctctatccctttcaattgaaattgacattaaaatgaaaagattttgaggaggtttcacctaccacaaccgaatcacttctttctccaaatattgtttctttcagtggccaagaatcacaatcaatttttgtatcttccacaggtaaattaattgtgattgaacagagaagaggacaagtgatcttggttcaaaagaa

SEQ ID NO: 9344 - DNA, 3000 bp, Unknown
  misc_feature (1)..( 3000): cDNA_ID_3041410_gDNA_ID_1972096_Annot_ID_178591 3000 nt of promoter + ATG
cccgtctcacccttttttgaaagaaggaagattgtatagtaaggaggagactcgaagttccattaaaacatttttatggtgaaatgggaaacaaacctgtccacggtaatggaaaagggtgatgttccaccgtggactgaaagagtccaagaagttcattagagcaccaggtctctcgggaaaggtgaatcggcatagaacctcgtctccaacagtagatcttcctcccatctgatatgtataaagtgtgattcacatgacaactttgcatcaaccaatgggaatgaattggaaatctagtaatcctaaaggagaaataagcacagagagaaatcaatcaaggacgcaccaagtaacgcaggtgatctttcactaagtcactggtagtgagattgacagttttgagttgagaagattccattctcttctgtagtgctttgagctctccagctgtgtgaactccgacactatacaacaatttacaaaattttgcagattagaggatgaataaactactcgggaaggaaggaatttttcaggaatggccttacctgtatagtacaacagcctccttttccgagctacatctatatttgaactcgcttatgttcattggtccaacctgcacccattaatgttttgtcttacatacactctgtaatgtgattaactactatatgctataataccaaacacacaccagctcacaaaattgcttaaagcttccaggtttttccggcatgagagtagcaagaacagcttcctgttgcctaccgacattggcgagttctgtcacaatccttagcttgtcaaagttcatgttagcgccactggttatggctacgacattcacgtcctttaggccataatatttacagtatgcctcagctccagcgagtgcaagagcccctgctggttccaatatgttccgtttctcctcaaacatatcctgtagagacaagtatctgattatctacaattcagtatgcatatgccaaacaccgtctgacaagggataacgtatcaaggatagtaccatacctttattgatgcacaaatagcatcacgagtgacaagaacaacaccatccattagatttctgcttatacgaaaagtctcttcaccaacttctttaactgctacaccatctgcaaatcccccaacctggtccaatatcaccctctcaccgtgatgcagcgacaaagccattgcatttgcgtcagctggttctacaccaatgatcttcacctgcataacccaaaagtcacaataagaaacagaagctgaaggaactcatttcttaattaaaattctggattttgtcacaagtagctgttattaacaacaacagaacagaaggtgacattgccaaagcagtcacagcaaaaagagtacctcgggagaaaccctcttcacataagcagcaataccagctattaaaccaccaccaccaactggcacaaatatagcatgcaatggacccttagcctgacgagtgatctccatcccaacagtcccttgtccagcaataacatcagggtgatcaaaaggaggtataaacgtcagaccctcttcttcagctcgtatcttagcatgtgcttgtgcttgatcatacgaatctccgaaaagaacaaccgttgcacccaaattctctacagcttgccactgttttcaatcccagaacaccatcagatactaacttcaagacatgagaaagcttaaaaatggaaaatacctttatctcaggagtcgtaacaggcataacaatcacagcagtgcagccgagtttactagcagataaagcaactccttgagcatggtttccagctgaagagcagataactccttttgccaattgatctgctggaagtttcaccatcatattgtaagctccacgaagcttaaacgagaatacctaaaacaattccagtcaccactcagtacaacaacacataaaacctcagatgtagtctcaattccatacataattcacctaaaaaatcaaccaaaatgtataaagggagaagcttcattacttacaggttgcaagtcttctcttttaagatacatacgaacacctaatctcttagatagcttcttagccaattggagtggtgactcaatggcgatgtcgtaaaccttagtggacagtatattcgtcaaatactccatagcttccgcgatgcttccgttctcagcctcgttcgtacgttctggtacagcaccgaggtaaccggcagggtattgcaacgaattcggagagaccttaagacgtggtaaaggaagctttggaggcggtggagtcatagatgtttcatctcgggacagaaccgccactgcgatccgagaacgggaggagaagtgagtgaatccgaccactggttttgatggacggtgaatgtggctacggagagaggattgcgccgtcggaagctgaacggaattcatgggtttagagagagttaaacagagaggaagaagctggtggcggctcttaataaacacaacaaacaaaactacgtgaccggtttggttttttaaaccttttattaccgattctcaccaaacactaaccagcactttttttgtctgtatttaggtttcaccggacacataaattacaaacccaacacaaaaaactattattccgtgattagccctaatgtattgcagattaattaataacgattatggacgcacttggtgttggtggatcattcatcatcatgtatattggaaaataaaaactgatcttttctaagttttagcaaaacaaatattttttatttatatggtctacgacaagaagtttggtggtgacttgagagaatcatgaaatctacaacttgtggatgagaattccagttttatcacttactctcttcttcgtctcacacacaattaagggcacactctgaaggaaggcaaacaagaactagtcagtttctttgttttagacaacaagaatctgtgaactaacacaaaaacattgaaagaatg

SEQ ID NO: 9345 - DNA, 3000 bp, Unknown
  misc_feature (1)..( 3000): cDNA_ID_3041427_gDNA_ID_1972096_Annot_ID_178583 3000 nt of promoter + ATG
gaagctcgtcagctcgtccgtctcaagtagctaatcagctcgcccttctcaagaagctcatcagctctcccttcttaagaaactcgttagctcgctcctcttcgtcaagcttctcaactcgttctcttcaccaagtccctcagctcgtcttcaagctatccagctcgtctttaatctctccaactcgcctttaagctcttcaagctcctcagctcgtcctcaagctcctcagctcgtcttcaagctcttcccatcacagcgaccatctcctcgtctagctatcagctcatccctcgactgcgaaactcatctacctcctcgcctagcggaagttcgtccattgactgcatagtccacctatctcgtcgtccagctcgtctagaccttcagcaaacaactcggtttgtccaactcgtctctctaccacggttcatccagctcatcgcacatctgccggctcgtcacctacctgccgacctacctccaacgatggcctagctcacttattctaatatgaactacgtgtggcttgatccctttctaagggtacgtaggcaaccttttacaaggttcagctataaaacgaataaactctattcttcctcggacatcaagatcgtcttccggcctcaagctcgtctttcatctacaatcggctcgttcttactccatttatgctcgttgaagaaatcatcctttgtaatccgtccaattcgcctaagtcgcgggctcgtcattaatagaaagattcttcttccttccctagagatcccattttcgtacttgtgtgattcgtgcatcaacagttggcgcgccaggtagggggatagctcgaagatatctctcaaaactacgaacccgcgacgaaccaaagtgacaacaaacggactacatggagcattcgataccgactcgtcaggctctggaagcaaaacgacaacgtcgatccccgggagagccagtcactcgacctcttcatccgatatcgcatcatgttctccgacctcttcatttccttggggtttagtaatctatcttggattttagggtatagtttttaattccattgcatttcctaaatgtttttagtattctatcttggctagtgtactagtctagtgtaccgaagtggtgtactgttctagtgttctcactttgtgtactatcatagtgtacgcatttggtgtactagtcttgtgtactaatggtgtactgttctagtgttctcacttggtgtactataatagtgtacccatttggtgtactattctagtctacttctagaatgtcaaagtatcaatccaaattataatacaatatatttcaattcaagtgttatgaagcataataataatctagggttatgactttgaattaggaatttatttatttacttggaattctaaattctagtaatctaaggctttagggtatagttttaaacttcattccatatgatatatggttttccttgggtttagtcttctctctttgtcttttagtgtatagttttgaatttcactacatttcaataatgtcttttagtgtatagttttagggtatagtttttaattccattgcatttcctaaatatttttagtataatagtagactagtctagtgcaccaaagtggtgtactgtttttaattcacttggttactaattggtgtacccatttggtgtactattctagtatactattatattctatcttggctagtgtactagtctagtgtactagtctagtgtactagtggtgtactattctagtgttctcacttggtgtactattatagtgtacccatttggtgtactgggtttctctcaaacgtctctcttctcgaactcgttcaccctcgatttgttgtacaccgactgtggctagggttcgtgaaaaaccaagaagagtaaagtaactcaatctcagaataaacacgggctcagaagttatttggataaaaaacgtaatgaaactatcgggctcaaatatttgggctcacttaatacgaattggagttaacgggcctaaaatgagttttaaaacccaatccaatttgtttcgtcgaacccagccggaatgtgtgtttttaaaacacaaggctactattgtatttgacacctcttttggatttttgctacctttttctatctcacatgaatcctattagacaaacccaataaaaagtaccctctcagcatatttccaaaaaaactgtctagttctcaaataattttctaaaaactgcctacttttacaataaacccttgtaaaaactatgatactgcagttaaatcctatggaatgattagacatatgatcatgaaagcgacatatgtgattgagttgtccaccaagaaagaataacagtaactggctcaatatgattttcttttgatttaaatattgttttaaaaagtatatcttcattacgaaaattatgttttggttttggtgtcttaatttttagtttggtttttcatatagagagggacatatctaccaattctaacttgttgatagccgtaaccaagattcaagaatagttacctgccaccacatcttcgcggcgtgtatctcaagcgtcatgatcgttgacgccgtctccaccagatgtttgtcgccgtaagctaaccctaataaagcggcggagtaataagcgtttacggcctcgcttgtgctctcttgattccggccgtcccagaactccgttaaccctccagcccatgagtgtagcttgaaaagatcaaaatttctcaaacgcggataactagaatttgaattattatcatcttttctcccaaacgtcatgaaatccgccaatagactgtacgcttgagctctgtatctctctccccacaaaggatcaaacttagcgagcacggcaatagcgtagagaaagtaaccaatatggtaatgatgattattatatataccgaacccgaaatcagcttgtttccacttcaggatcgaagtgaggaactaagcagcaatgtagaaa

SEQ ID NO: 9346 - DNA, 3000 bp, Unknown
  misc_feature (1)..( 3000): cDNA_ID_1696434_gDNA_ID_1972097_Annot_ID_178622 3000 nt of promoter + ATG
ggaatggattctacatagcaagcattattgtaaagaagtgaaagcttctgtaatggttgtggttatcggtgttgggatttgtactgtgactgatgtcaaagttaatgccaaaggtttcatttgtgcatgcactgccgttttctccacttctctgcagcagattgtaagtattcatcacaccatctctttgtttatgttagatctggaatttcttagatcagtattcatctttttacattctttgaaacagaaaggctcaaacttttcttagatcagtggtatttggagggaatcttttgtccctttgagctccatctatgtctaatctaactcagtattgtacacagattctcctgcataacgtaaactcaactagatttcctttccagatctgaattcgaaattataaatctaggagacacagttctgtattccttgctggagtcctggaaagggcatttttctctcgaaacttcttagatactatggcgtgtcaagtgttctgctgacaaattttcactttttcttttggttacagtctataggctctctgcagaagaagtactcagtaggatcctttgaattgctgagcaaaactgcaccaatccaagccatttcacttctcatctgtggcccctttgttgactatttgttgagcggcaaattcatatctacttaccagatgacttatggtgccatcgtaagtaaattctcaagttctctatgattcagatgactcaaacgtaaacacaaaatctttactttttatctctcatttttgcagttctgcattcttctctcctgtgcattagccgttttctgtaacataagccaatatctctgcatcggaagattctcagcgacatctttccaagttctaggccacatgaaaacagtatgcgtcctcacattaggatggcttctctttgattccgagatgacattcaagaacatcgccgggatggccatagccattgttggaatggtgatctatagttgggctgttgatatagagaaacagaggaacgcaaagtcaacgccacacggcaaacacagtatgaccgaagatgagattaagctactcaaagaaggagttgagcatatcgacttgaaagacgttgaactcggtgacactaaaccataagtgggtgcttataacccatttgaaattactcgtcgctactgattcgaattctttatacaaatatttcctttgtgtgccatttactttgttctttccacttcctatatatgtcttagaacattttgggcttttcagaaagcccataaatccttctttgcttgagaagaaggcccgtccttgaatagtaagtgtcctatatagtaaagtaaacagaaatgtcaactgaagcatgtgattttattcatttgattatatatgtctatgaactaccaaaacagatctcttgtatcatatgtatgattcaatggcatacaaatttgaaatttctaacaatgaccagtttctaaaattttgtggaaacgagcataactcaggtcatgagtcaggacatgtgatgtgtgtttaaaaatacaagaaagtacatgtgatgtggtttaaagctataagcaatgattaaagtaaaagataggttgttgtttcactggagctgtaaataattttgtcaatagtttgtgattgggaacattgaaaaattactggctttttaagttaaaaataaataatatacagggttaattaagatgaggaaagaatgagagaggaggagagaggtcctacaaatatgaaaccagaccccaaaaaagatccaaatcctacaactaggtaccatactattactaggccctcttttttcctctgctttaatgtctttattggaaccctcaatacctatagacaattcataaagatcaaaacaaaattttagggaaaagaatcaccttttattttttataatcccctcaatatgatcaattttaaacaaatttaaatcttaatacatataatcccctcaatatgatcaaattttaaacaaatttgtgtcactaatctttgcaaatttctttattaattgccactttattcttcttcttattttttgttccaaactctttattaatcaaaggtttgttttgtcaacttccaaagccaaaaaaaaatcacaacaatcttgttgttcttgataagtgtatagcatttattattaaacctcaatggtcgcttgactaagcagttatacactgattttggacgtgtttatagaccaaaccaaaaaagcaaaaactaaaaaaattgacttttacattacatgttctcccttaacccttattagtaaacgtccttcacgtgctcaccgaatcaactttttaataggtttagatgtctaataagtaatttacccatttaataaccaacttaaacacattgataaacctcttttttccaaaccaatttaatttccaaaactcataatttttcttttactgctatttcagagagtgtgaaaaccgaagagatttaaaacattattaatttctttgttcctttttctcttttatgtctttttttttgtgtgtgttggcttgagctttttgtgttttgttttgtcttttttttttgctcttgctttgtggtaagtcacattctgattaaaatagaaatgctttttccttggtaaggatcatcttttcatgccgattgcatcagtgcagatttccttatttactctttctcttctcaaatttccatttttttctttatctctcccactcccactcataaaattagttttgtctttctttccccaaaaatctttacttaaaatctttttcacccttttgctttaacttttgtttgctcctcctctggatcgtatcagtaaactggaagaagaaattgtgagaaaaaatggagaaaaccaagatgattacgtctatgacctgttgaagaaaccctactcagaataagagtaaaactctgtgatttttctgactaacagagagagagacacctaaatg

SEQ ID NO: 9347 - DNA, 3000 bp, Unknown
  misc_feature (1)..( 3000): cDNA_ID_2182177_gDNA_ID_1972097_Annot_ID_178643 3000 nt of promoter + ATG
aatcccggtacgacaaaatttctggctttaccaatcgtcgaagcagatgaaacaacgaggatcataactcatttaggatacgatgaacagaaggatgtattcaaggtgttatgtacaaggacaaagcccgaaactccacatcttgttttgacggtgggatcgggtaaagaaccttggcgagagatagtatgcaaatttccgcacacagtaattggtgctggagtattttacagaggaactttatactatcttgctgcttttcactcgaaaagtatcataatgaccttcgacgtcaggtctgaaacttttatgcccattacatcacctgatggagtcgatttgaatcaaggttcctggagacttgtcaattacagtcaacaggggggatttgcgttagtgaatgaatcaagaggtttcatttaccaatcgaatggcggcgatgcttatcttgaaacgtgggtttggaatgtcgatacaagaaaatggtcgatgaactccatcctgattcgtaaatggaaagattatgctcaagacaatgaagattatgactaccgtttccgaggaacccaaggaacatacgaacttgtttttgcaccaatcagggttaaagaagacggatcactcactgtcatcttatacaatactgatacacaagcattcagaagatctaaggttcaaatgatgggtgaaggtcatgagtttcgatttgtggacaccttcttggatcatgttgatagtactctgcttatatgaagatcaagagttggtctgtattcattaaactggttggttgctcaagctaaatattctctttaagtactagtactatgcttatttagtgggattgttctttcgtattcgcttctattgtccttgttaatctttatttatgatgttgctaaataataataatgttgcctctcaagtactggtcttattgggattgctagttttcatttctatataatttagttaaactttatttatgctatataataatgttttcattctggtattagttggattggtggtaaatgattgttcagctctttgtagtttgtgcgaaatgatcgttcgtctttcactcagatggaactttcattagagagccttttgatgaaacaaaagttttattaagttttataggtcagcctcagtactcaacccaaaaagttgtaaaatctattaagataacagaggaggaactaagtcaaatcttttggcacaaaagagtactatttacacacttgtatagacatattactcttctgttttacaactagcagtaattcgaccaaaagactgaacaaatgtttcaattccaataaaggactcatctacgactaataccatgcaacatacatatttccttaatcacatccatcataatagtgtcttgctcatgtttctcttcatgttatccttccaaaggttcagaatccacctcttgatgagtgttacttaccggtgaaatatgacctgaaacttttagtgtaaaaaaccataacatgttttgtagctttggtttcagatgtatgagtaagtcctcctcctcagccattccttgtggcttttcttttacgaattcttgattcactgtcttcatttattcggaagagcctcttgactttagtgccgactgcttcttctagctccaactgagtgtactcatccataagtttttctggtgttagattcagacaatgaccaacactcgcacaaccgactttagttatctccattctttcttctgcactgttgttctaagtgttgtgttcaaaaaagtttccatgtaaagttgctgcttgtacttccttctctaaggaacctttcacatcatcatctttgtttgagtgaatctccttccaacattcaactgagttttccaagattgctgtgattaaaatcagaaagaaacacggattagaacaaaattagtttagccataaaactgaaaaagtaactcaaatcaaatgaatacaagtatataccttctatagagctacactctcagatctaggagtgcaaataagagtttctctcttagttttggtagttttctcagcaatagatattgaaacgatattcttaacaaggtaacggccagtagacacgactagctcagcttcagtgctgctcactggtacttgcactgaagcaggtgataagcgcttgacaaaaagtacagagtgtgatgatacttcctctttgtcctccttaactgcagatattaaaactgtgtctcgctcaattttctcttcacgttgtccttccataagttcagaattcaactctttagtgcttattatttgagaaactatcaactggtttttccagtgtagaatccagaacattctcataatcataacagatcctgcacctttggtttctgaggaaataaggtgaatcatcaatcattccttatggcttatccttaatgcactcttgattcattttcttcaactactattggagcctcaaatgaattatgtctcgaagagttccttgtcaatctaacatttagcttcttgaatcttgacattttcaacagaggctccatttcgttcacagtcaatactggaacaacttttctgtgaattactcattgcttccagtattcaaaatgtatatctcagagaaggacaaatcacgtcgcaacgtaataattttttgcaaataatctaaattaatctaagagtcatttttgaggataaaatcgagttactgacatcttgtgtgtctgtccttcataccaaattatccggtcaaaaagccaccacaccggaaaatattattttcttatcatcgccatgttttgatttttccacgtttacaccttttaatctaaaaatcaatatttctggaagaaaaaaaaaaacaaattaaaattgtcacacaaatcacaaactgaaatctcaaaatcgaaactaaagcttctcagatctctaactatagctcaaggcggaggagactgagatcgatcatctgaatcgccgaaac

SEQ ID NO: 9348 - DNA, 3000 bp, Unknown
  misc_feature (1)..( 3000): cDNA_ID_3041466_gDNA_ID_1972097_Annot_ID_178640 3000 nt of promoter + ATG
aagacctccaccagcagcaagtaactggttcttaaaagcctccctcttttgagcttcagtcttttgctttgctgttagaagcttgccctctagcttcttcctcaacagtttctccttttccttttcctttctcttacgcttagcctcctcagcttgagcctcaagctcttcctgcctgcggcgctcctcttcctccttcctcaatttttcttcttcttccttcttttttcgctcttcagcttcttgccgacgagcaagagcctcttgcatctctctaacatgtttaggaattttcttctctgctgctttaccctttgcatccttcttcttcggctgtagtggctcagttactgattcttcttgtttttcctccttaacctctacagaagaggttgctgcagcagcagctgctgcttttttctccttctctttctccttcttctttttctttttcttcgcagcagcagtctcttcttctccttccttctcaccagcattctccacaggtgcaactggctcaggctgagctgctttctcttctacaggcgtagatgaagcaggtctttcagcagcaggggtttctccaagtgctgcaagaagtttgtccaaatcttcctcttcctgtactgtccttccactcttgttattcttcttctttttcttactctttccagtttccacaacctccacattcttagtatcagaagttttagtttcgtctgcaactgagtcatcacctactgaggccaaaacactgccgcccttctttttagaagatttcttcttacctgaaaacgttacttcagggctctcttcatcttcaattgtattttcgtcgtctctagagtttgaagcatcagtcccttcttcttcatcgagcaaatcagcggtaaacgagttagtgttcttcttcgaagacttagatgacttctttttcttaccagagaaggtgataggagactcttcttcctcatcttcgtgcacttcctctgtatcatcatcatcactaccaagtgcatcaaaagctgaagcggcaaatgaattaccgccttttttacccttcttagacgcatgcttcttacccgtaaaacttataactggctcatcatctttgtcaccatcagattcattatcctccttctcatcttcatcatcaagcaaggcaaagctaacagaaccaccgcccttcttacctttcgacttcttcttcccaacaaaagctatctcaggaacatcgtctttcacccccgcagccgaaaccttatcagaaaaatcatcatcatcatcctgctgcgtacccttcttattacctttcttacccttcttcttcccagtgataacaacaaccttctcttcctcaactttagactcctcagacaactcagtacctattgagtactcatcgtcatcaatttgagcacctttcttcttagatttagtagcaccaacgagagatgacgcaggaggttgctgctcagcatctccacctcgagcactcggcttcttccgccccattggaaaatttcaggtctggttcagaattggttccgaattcttccgactaatcaataaatcgaggtgaaatttcctacaattcgaacggaaacaaattaggttttctgggatcggcacaacacaatccttttagaaaatgaaaccacaagagagacgaggaagcgatactgtggctaagaggagagaatcgaagaagctttaccttattccggagaggaattaatcgataggctgagctaagtttagagagagagagcgcggcgcggagagagagagagagagagagagagagtagagaaccgagaaatagcgaagctttgagaaaccggcgtgaagcttcctagggttgagctaaacgctgtgtagattttaccgattctaataaaaaaaaattgtgacgtttgttaaatactatttttttctccgttttctttctcgatagtgttattttttcttttaaaataaaagatatgtcatattctttgttataaaatgtaatttctgaatgggattcaacagttgtaattttcacgttttaatatactgaaatctaacttatataattaagacacataaattttattaatatggactaaaataagggaaatcagcatgatttagctgtttaaagtattcatttaaaaaaataatcttctcgcgttatgatttgtttgaaatacttttctaaaacatatccgcatccaatgttttttgtttttggaagtttttaagagagagctttgttaaggcatgagcttctcgattcgtttctctaggaacaaaagaaaacgtaattgcttgaaaagacctaggattgccactcgcgtgcaagggagattgcttgagaccgggtttctctcggagagtcgtggcggtcgttgaaaattttctagtttcgggcaagtcagtgaagtatgatctcactccagctcaggtatcatggaacatgaacctttggcttatctctgatcttgactcatctctctccatcctcaacaatggacacatgcttctttagctgacttttgttagataggcataacattcatgcttgtgtggtttagtagaaacacttttcgactgtctatgattgattcagccattcaggtgagaacggggcagatatattattcctttttcttttgcttttgattttgtgaatttgggcttgttagaagaaaatgattaatgtttgtaaattgggttttgaatattgggcttgggagaggagctttaataattgggctaataatggattggaattagagttgagaaattagattaaaaaaaggattagattagtgatgaagtaagagtttttgctctctctcaaacggctcgctttgattactcacgtaaggtaagcttcttcgattctctcatctcctgtgtcctttgtgccgatcctcaaaaaaaactaatttttttttacctggattgattgattagccggaaagaatttggaaccggctctgtaatttatcc

SEQ ID NO: 9349 - DNA, 3000 bp, Unknown
  misc_feature (1)..( 3000): cDNA_ID_3041470_gDNA_ID_1972097_Annot_ID_178639 3000 nt of promoter + ATG
cttcttcctctttatcgtcaaaatcacctctgattttaagatcaacattatcccagctttttgcatcccattcatcatcttcctcaaccccattctcctgagctacatcagcaggtcctcctgatttctcgcctaagtttgctgactctagtaaatcaaccttttcagtgtctgctgaaccaacttcacctaaagcatggttttcttttggctctacctcaccttccacctggacagaagtgtcattgcctttctggcgagatgattttttcttgttggcataaatggggcgctttgaggaagtagcatcatcatcatcgtctgcaacaggaagacctccaccagcagcaagcagctggttcttaaaagcctccctcttttgagcttcactcttttgctttgcagttagaagcttgccctctagcttcttcctcaacagtttctccttttccttttcctttcttttacgcttagcctcctcagcttgagcatcaagctcttcctgcctgcggcgctcctcttcctccttcctcaatttttcttcttcttccttcttttttcgctctttggcttcttgccgacgtgcaagagcctcttgaatctctctaacatgtttaggaattttcttctctgctgctttaccctttgcatccttcttcctcggctgtagcggctcagttactgattcttcttgtttttcctccttagcctctacagaagaggttgccgcagcagcagcagctgcttttttttccttttctttctccttcttctttttctttttcttggctgcagcagtctcaacagtctcctcttctccttctcaccggtattctctacaggtgcaactggctcaggctgagcttgatctttctcttcttcggaagcaggctttccagcagcaggagtttctccaagttctgccagaagcttgtccaaatcatcatcttcctgaagtgtccttccactcttgttcttcttcttatgtttcttactccttgccgattctacaagctccacactcttagaatcagaagttttagattgactactttcttcatcacctattgaggccaagacactgctgctcttctttttagatgattttttcctacctgaaaacgtgatatcattatcctctgcttcctccctgttatcttcatcagcaagcagggcaaagctaacagagccaccgtcttttttacctttcgacttcttattattccctacaaaagcattatccggaacaacctcttcctccaccgcaaacttatcagcaaaatcatcgtcgtcatcctgctgctgctgcgtacccttcttattccttttcttacccttcttcttcccagtgataacaaccttgttttcctcaactttaggctcctcaagacatattgagtattcatcatcatcaatttgaacagatttcttatcagatttagaaccaacgagagatgacgcaagtggttgctcatcatctccacctcgagaactcggctccttccgacccatggataaattacagagccggttccaaattctttccggctaatcaatcaatccaggtaaaaaaaaattagttttttttgaggatcggcacaaaggacacaggagatgagagaatcgaagaagcttaccttacgtgagtaatcaaagcgagccgtttgagagagagcaaaaactcttacttcatcactaatctaatcctttttttaatctaatttctcaactctaattccaatccattattagcccaattattaaagctcctctcccaagcccaatattcaaaacccaatttacaaacattaatcattttcttctaacaagcccaaattcacaaaatcaaaagcaaaagaaaaaggaataatatatctgccccgttctcacctgaatggctgaatcaatcatagacagtcgaaaagtgtttctactaaaccacacaagcatgaatgttatgcctatctaacaaaagtcagctaaagaagcatgtgtccattgttgaggatggagagagatgagtcaagatcagagataagccaaaggttcatgttccatgatacctgagctggagtgagatcatacttcactgacttgcccgaaactagaaaattttcaacgaccgccacgactctccgagagaaacccggtctcaagcaatctcccttgcacgcgagtggcaatcctaggtcttttcaagcaattacgttttcttttgttcctagagaaacgaatcgagaagctcatgccttaacaaagctctctcttaaaaacttccaaaaacaaaaaacattggatgcggatatgttttagaaaagtatttcaaacaaatcataacgcgagaagattatttttttaaatgaatactttaaacagctaaatcatgctgatttcccttattttagtccatattaataaaatttatgtgtcttaattatataagttagatttcagtatattaaaacgtgaaaattacaactgttgaatcccattcagaaattacattttataacaaagaatatgacatatcttttattttaaaagaaaaaataacactatcgagaaagaaaacggagaaaaaaatagtatttaacaaacgtcacaatttttttttattagaatcggtaaaatctacacagcgtttagctcaaccctaggaagcttcacgccggtttctcaaagcttcgctatttctcggttctctactctctctctctctctctctctctctccgcgccgcgctctctctctctaaacttagctcagcctatcgattaattcctctccggaataaggtaaagcttcttcgattctctcctcttagccacagtatcgcttcctcgtctctcttgtggtttcattttctaaaaggattgtgttgtgccgatcccagaaaacctaatttgtttccgttcgaattgtaggaaatttcacctcgatttattgattagtcggaagaattcggaaccaattctgaaccagacctgaaattttccaatg

SEQ ID NO: 9350 - DNA, 3000 bp, Unknown
  misc_feature (1)..( 3000): cDNA_ID_2182114_gDNA_ID_1972097_Annot_ID_178625 3000 nt of promoter + ATG
ttatttaaaaatataaaaaaccttaaattttaaatattggtataaaaataaaaataaaaatatttttaaaataaaaatgtttgaatttaatatgtgcaaaagatatttgaacctaagacaccgcttaaggacctcatattatgggcgggatgttgtgttcagtcattttacacatattaaattttaacacataaaaacaaaaatattatgtatatttaaaataattaaaacattttgtctaaaatattacttaaaaaataaaaataaaaaccttaaattttaaatagttataaaaataaaaatatttttaaatataaaatattagaatttaatatgtgcaaaatagatagaacctaggacatcgctgaaggacctcatattatggacgggatgttgtgtccaattattttacacatattaaactctaacacttaaaaacaaaaatattatatatatatatatatatattttaaaaataatttttatctaaaaaatatgaaaaattaactttaaacaaaaactaagaataaaaattgcaaaaaaacttaaaatatccgtgagaaaatatcccattaataaaattataaaaatattaatttcttaatttaacaagaaaatgggatgaaaattaacctgacaagcccattggcactagccttgagccgttctctgccccgtttgtcgacgaagaaaatctatgagttttgtatcttcttcaacctcacagtaaagcccattgacaaggcccattaatgcgagtcgtcagccgttctctgccctgtttctgaacgaagaagatcgatgagttttttctgtaacttcttcatcgtcagccgtcgctcatctgtcgctttcactgtccctctctccatagtaacgaattacctaaaaatcgttctcgattaactggagacagaagatggaaatcaaatcacgaaagtgaattttttgaagagatcatcgacgtacttacctcaatatcggaaaggatcatcggcgatcctctctataagaacaaagaacttgaaagatttagggtttttttctgtttggaagaagaagaaggagcgtgcagaaattttgatttctcatgaaagaagagatgcgtgagccgacccttaaccgttctcgattaaccggagacagaagatggagatcaaatcacgaaacaagatgctttcctccgatcaaatcttacggatagatattgagatgaagaatgaagttattgagatcatcagcttatgtcaatatcggaaggatcatcggcgattctctctataagaacatagaacttgaaaaaattagggttttttctgtttggaagaagaaaaaggagcgtgcataaatttttgatttcttaatgaaagaagagatgacggttatctttcgactgatttcctttttttgttctttctgactaggttaacgttgtttccttttattcaattctgatgtaaaacaattgaaacgttattaagaaagtttaataacggtcatatttctcgtaataatttatcaaaaggtaaattatttatttgagtgactaaaccactttatgatacagaacttttgaaacagaggatatactctccaatggcgaggacagagctcaagctattattacaagtacctcacgctatgaagctttctaataagagttgcttgttccaaggcataagaaatctcaatgagctttgatgcgatgatcaagacgagaagaaagcttcattacaatcccttatctcttaccttcgggctttgaggccactagttgtcaaaaaccgccttcaggtatgaactcggacgcagttttcattgcctcgtccagtagatcataacccacccacaatagcatcaaggatagtaacagcatctaaaactgtccttcaaaacagagaagaaactaatgaaactatctgttgattctagaccggaaccattcttgaagcagtcctcgtaatttctttgattcgtaatagcgcagtgacataatacggtttcgaattgttttctcgatggcgatggcaagctggaggcatgtacgatagtgctggttgtatttcctctgattgcgttcgagccataagtacgaatatagtccatattgttacttggaatgcaagccgaaggagaatgtatgtgttccctggccctcatatggctgcgaaatcaagcagaagagtgtctcgtgatagagagagcgagattggtgatatattgagctaatgggaaaggaacagttaattcatggtgaaggagaacaaggagctaactcatgcattggctaggctacaaaaggattatgataatgaaaccaagattgacgataagtttgtctgcaaagttggtcagctaagctatgcctttgcgcaagttgagctcaagagagagaagaagctgataaggcacttgatgaggagaagaggcatgtagagtatcttaaggcagaggtttttaaatcagggaagatggttacaaaaactatgatatgaaataatataatctttcaccctaaaaaaaacaaagaattttatatcattgatccgtcatctttcttttttggtcgacatcgaaccttcatctctagatataatattctttttattaattgagttgttgccaaacaaaattgaattgaatctatacggggaaaaaaagaaagaacgaaaaagccaatgagaagctgacgaaaaaccgcgttggttaaattacatataaatgggttttgtgaattcaaataaagacgaagacaaaaagtttgagactttatctctactttgacccgaccagcgaaagtgtaaattgaaagatagatagaaagaaagagccaactttaaaagcttagcggttgatttcgaaatctcgtcgccggcgcgtggagtcttttcgtcggacaacaacaagagaaaagagatttgtggtgttcttctgcttagaattgttgttttccatctccggcagtgagatttggtggagaattttgatttgtgatcgatg

SEQ ID NO: 9351 - DNA, 3000 bp, Unknown
  misc_feature (1)..( 3000): cDNA_ID_3041489_gDNA_ID_1972097_Annot_ID_178628 3000 nt of promoter + ATG
catgtggattttattatatgcactcctaatacaccaataccaaaaccaacaagctggtcttcagttctttattgattcaagatttcaaggaatttatcgttagatttatatgaactctttgcttgtaacagtaatcagtattattcatttgttcatgagagctacgacatactgtttggacaaactgcatgtcaccggagaagctactagagattgggatactgagaggactaaagaagcggatggaaaataagattggtcgtaaactttggactggaccacctgaggaattatacctatacggtgactgatataatggcttctagttttgtccaattgatttcttgttcgactaaaccgtttggttttacctgttgttttcggttaatgttttattcgtacttacgagaaaacaaaagataatgtaaacgtagtaaaaagctaagcaatacataattggtgaggttatccattatcgaaacgcatttcaaaccattatagcaattataaccacaaagattgttttcgtctataaatttgtaaaatgtcaagaaatactgaaatacaaattctagtcagttatttctccataaaaactgattattaaagaattagagatacgctgattacgatttaatacattatggtattactattttagctttttgatgaagaaccataccgcaacagcttagcaaaaaaaccataccgcaacagccaccaaggctataacaaccgcggcaccgatgcctatccctagcgccaccgcaaaatccattttcccttacacttgttctcctcgccaaaatatatgtgtgttttgggggaggggttttatagttgaataaatcttaaaatgagttcaaaatatatttgcaatattaatcagatcataacatgtgtttgatattataatctaatattaaatagattatatgttaaatctagtaattagttaagtcacaacatatgtttaagtatatctaataattaaatatattgtgacctttataaagataaaaaaaaaagaatgtgacatttttcaaagaatttcataaaactatactataatttaacctttttttgttttgttttgttttgccatctcaaaatttgtaatcgaatatacaattcacaagcaagaaacaaaaataaaaataatggtttatttagttgtaattttttgttgggtttatagttgggctttgatgttgtgtaattgggctttggtcactcttgtactcttttttaaaattaatgaaacagtttgacgacaaaacaaaataacccaacaaggaagcccagaaaaagcccaatcgtaaatgaaacaagcggaagagacagagcacagtgaacagttaattcttaacgccgtgaaaaatacctttaacgccgtcttttgttcgtcgtcgtcgtgttctctctctcaaactctcaggtaaccaaaccttcttcagttttccggtggtttcgtttgtagaagcaagtttcttcctttcccaataaaattgtgtagatattaaaatcccagaaattgataaaaccaaaatttctcccttgtgacaaaatttgcaggtaagttgagatttcagaaaagattgagcttttaacaattttcattcttggaatcacttactttggtgataactgataagatttgtgtattgtaagtttgtaacatatagaggaagctactttcaatgaaacactgcggaatgagagttggaattggtgttgttcctgttaattttctatgtatgagtggaaatgtgtgcgttgtattttctgcttatattggatgttttggatagtgtttcaaaacgtaacttggtgttaattagtagaggcctcaaggatttaacttttcacagcttatgagagtgatcctttagcaaataatgaatctcaaaaagttaaacggaaatggaaaggaccacgatgaggatacctccacgtcaccaaaatccagtgaagcatctcacttgagctctggtcctcaggtatcatttcacatgaatcttttacttatctttgatctttctatttcactaagctcatctcatattcgacaatagataaatgcttctttatctgacttgtgttagatagacataacattcatgcctgtgtttatagtataagcactctgaatcagtctgagtctcttcaaaaaagttcaaatcgaaaggtaaactgttttcttgttggataatcttaggaaccacagagcccctacgtggaagaattcaaacttggagatgaacaattcaactattgcttcccacctcctgccgcagagaaacactctatgactggctatgattgattcaggtgagatcagaggtatctctgtagcagtttcttacttattcaaatcccgtttgtataatttatataccatgcagatgcagtcatattgatattgcagttgtgtgccatgtatgtatatttgcctttgtttctttggttttgggttttaatgtgaatttgggatttttagaagaaaatgattaatgttgatagcacatgaaaaggtctttgattaatgtgattacactgattattttaaagtaaaaatttaattaatagttaaagtaaattttgtttagattgagattcggtttttttttaagtttatattttacatttattaatattcaatatatatataaaagagttaatataataaaataataattaaatatgtcaaaaataactttatttgaagatagttttaactatgagttattttggtctcttttttagaatgaaatctttgagtttgcagtaaggtgagattttaataaatgtttgtaaatcctagattttgaatgattttaacaaatgctagattcaataagataagatttaaaataaatttaagaatatcatgattaaaaaattgaattaaaagattcatgagcttgattcggtaatgccatataaaaagatgtcatcacaatatacatggtgatttgttggaagatttcggaaccaatg

SEQ ID NO: 9352 - DNA, 3000 bp, Unknown
  misc_feature (1)..( 3000): cDNA_ID_2182136_gDNA_ID_1972097_Annot_ID_178631 3000 nt of promoter + ATG
ctcttagatgcatatataaaataatcttttaaaatagttattattttctatatttttaatcaaaaatgttacaatctatttaatagatatatcatatacttaaaggtattattcaaacaaagaaggatatactcaaacctataatataagcataaaatacataatttatagtactctagcatacatatatcacagtcaatttaatattagatataataaacacatgtcatcgtgatctgatgattgatattagatatagtaaaagctttatttaattatatataccatttttgtattgctaaagtgtacatcacataaaactaatcataaacagataaactactacgcaagacacacgcacacacaaattgttgactgtgaaaaacaattaagcgaaaatgaatattgcggtggcgtttgcgataggcgtcggtgcctgggtgattataatgttggtggctcttggtatatggttcctcgtcaaaaagctaacctcgtaataattgggatgagtgaaactttaacgtaatcagcttattttctttaaaaattagttttcatggacaataactcacgagccataagtatttcttgaataagagtttttttacaaattgttgatgataaaattatgtataaaggaaaaaatctatgtacgattattgctattatatggtttgaaatgtgtttggataacggatgaaatcaccaattatttatttgcttaatatacatatcttttgttttctcgtataatacagtaaccgaaaacaaaccggtaaaaaacaggcggttaagttaccggcgttttcgctcagccgtaggaggtaatttctcagatggtccagtcggaagtttacggccagtcttcttttccagtcgattctttagctctcttagtattcgaatctgtcgtagcttctccggcgacagtttgtcccaataaattcctgcaaaacaaaaaaacgatcagcatgttgtgattcaggcatagaattcagaaaacaatatagtgaatcactgaataaggctgatgataattcaaacaccaatctactgacagatcacatgaaaaacttgagttaataaggaaatcaagaccttgtggttttggtattggtgtgtttgtgaaaatgactcgagtaggagtgcatatgatatccacaggaacatcgtgaatcgccagtttctcgagaggtatatcatctacaagctgacaatcatgtactgcaaatgaagtaaaagcttcatgagccaaggtataaaagaaaaagtgtatataaaggtttcttctaaattgtatttataccagttgtaacaacgggtgtggaatcatcaatggctcccatgtaacgcaacattccatattcgagttccgcaaaaccctgcacacatagtcatatcaaactccaatcatatggtttggttcaactaatatcttttaaagttaaaatgaattgtaacaaatctcacctctcctttccctaatcgagcacccgtttgtgggttaaccgcaacagagccaatgacaatgagatccactttgattttctcatcaaggccaatcgctcttccatatttggctactcctacagaagtgcaagcctccatgatcgtttcgggtttcaacaaatcagattctagtacagagaagaatcctgttcttagcctcggttgaggagtcaacagcttcttttcacctacatttacacaacacaatgtctaaaatccgaattcaagactaaacttactaacatcatcagaagaaaagagaacttcataaaaaaaactgtgacaatgcaacaattttgcggccaaatgtttgaagtatgattgaacatgagttcaaaactctaaattgtgaagaatttgctcagatacatgtatacctatattaactaaccagaaagtgtaagaaacctgatttgcttttgaggcgaatcgggattaaccttcacgaccatagccatacgaaaagcatcaagctcggctaactgcaccaagaattcaaatttggcaaattcgctaactaaggcaaaacctagaaagtgaagaaggaaggtaaaattcgcaaacttttcttgcagcagccgatgcaccgacgaaattagggattcgatgatgaacaggtctagggctcatagcgtagttccgagcttccatgagatcccacatcttctttcggataacccatttccacgctttcgggtcactatctggatccgattctagttccttctttgcagtctccgccatatcctccatcgccgccgcgtcgaggctcaaccgatcagcctcataagctacagcatcgaaagcgacgccgtcgccgttctccgatccgattctagagagattcctccgctgtgacccgatttggacggagagaaaaggcggtttctgggaattgacaaaggaatcggatcgaaaacgaggattgattgcaaatccaggtgataatcttatcattggtagatccacgaacacaatcaattcagggtgtgtgttttcgaaaaatctcagctttgttctccgtgttgttctcttgttaaaagataagaaattaacggcttagatcatttgtttcagttcccgctgaaaacacttcaatccttcttgggtttcaatttcaaaacctctcttataaatgatttaattaaatgggccttttatctgcccaataagcaatcttcttctaacaatacgcttccgcgagcttttctctctaaccacccatccctccacgtcataactacacgcgctatcaatcttttgcattggacgggtaaaaaagcgagtacacaaaaagagcgcgtggtttgacttaaagagttgtactcgcgtttccaagagcgggtttagcaaattcaaattgaaacatttatgcccaaaattatctgagacgatttcgattctctaaactcttccaaaattaacatttgtgtggtgtttagtgatttatggtgagagaagaatttctcattgtttcgatctttgaaa

SEQ ID NO: 9353 - DNA, 3000 bp, Unknown
  misc_feature (1)..( 3000): cDNA_ID_2182153_gDNA_ID_1972097_Annot_ID_178636 3000 nt of promoter + ATG
aagaaaagatcaatcgtatactattcatctaagtttagattttagtaatgtttgacccaaaagttatcaataatgtagattttagtagtttgaccaaaagttatcatatttgaatggatatatcaaaatatgtaatattatactgaattaaaaagttatcaataaatttagactttatcagtgatataagttaaccaacattattttgggagttgttttgctgtgtgttacgaaatgcagttaaattgtatgtttggtttaaactgttacaacttaaaaagcgtttcactgatccagttattttatcataaaaaccgaatcagatgtttattcatacccatattcttatatccttgaagatcacaacgatcgataatatccgtttgaaagtgaaaaacccaaacaacaaatagatagtgaacaagttaaagtagggtttcttgaaatataaaataattaaaataaatattaaataaatggattgatgaattggaaagcactgcggaaattatatatagtgagataaaacaatggaaagagattgataagtaaagaaagaggaagagtgtggttgccacacgaagagcaccatccttcaccatcatcacccacgtatcaccacacttgtacatacaccaccactcgattcatactctctctaaatattatttttatgataacaactttataacaacataatatactctagatatatacatcatatgtaaatcagtatatcacccaatgaacatgcatacgtactcgcctacgtacatatatactcaccttgccacaatgattaacattgttaaaactaaaataatatgcatggtaaataattagcatgtgccctagcactgtcagcacttcctctaagccggacctgctgcgctagtgcgatataatgcctttcattttatattatcgattgatttaatagccgtgaaatccttaagtgttagtattatcatttgattgaggaaaggtttcatcaactttattttatctttaaaaaccaaaaaataggatcatgacttgtgtatggaacaacctgtagtggaggcttaagatttgacggttcatgctttccatttcaaggcttcctcttttaatgtaattactacgtgttgtctcgttttgtcttccattatcacgaaaagaaaaaagaaaaaaaattcttgaatcaattgaaataaaataaattttcgtttagtttctaaacaaatcatttttttgttgaggaaaattatttattaaattcttacttctggacagccataaaaatcaatggaagattaaaaattgaactagaatcgcaaattatagactatctctgtccctgacttttttgtcaaactcacacaaaaatatgtaggcctcaaaataatgggccgataaaccaaggctcaaaaatgggccgataaatcaaaactctttccattgagcccatttacccattcttggaagttcgtttagccattgagcccattcaatactaaaagtgattggcgtttggtccgccattccagtaaattaagcagaaactcacatcaattcgagacatttatatatctcgataattcagtattaaaatcttagatcagatttcaaccaaaatgaaattcttagatccagatggttggttcttgggtttggtactttggttattggaattgagccggtttaaaactgggttgttttgagtgttacaggcttacagccgggcttctcagatgttaaaaatatgggcttgagaattagctgtagacaagctcaagcccattcgattataaaagttgttaaaaaagctcttaagaaagaaaacagaggcgctacggaaaaagttataagcaaaattgtaaggaagtcatataaagctattatcttattttattttgaaaattgattattgttatatgtttatatacatgataatattatcataccatttgtgcaggaaaaggtagggacaaaaaatagtaaatgatgcgaaagctcctgattcacgtttttcaatgttggtgacaactagtcaatatatactaaaatattttattttgtccgataccaaaacgcagaaccaaataatttggtatacttaccattttcaaaactgtccacgtttttctccctcgctttcaaactacaaagacactacttacattgggtagtttatataactaataacttgttctacttatcgaacgttcaagacttgatcaatattcttagggagatggaatttatgtattcagagttaacgagattcaaactcataaacactattttagatgtgattggtaaaactgatgaatcgttcacgtcaccaggttaatcattaatcagagctcgatttgatcttaaaaaaggcactgagtagactaactagttaactacattttgtacatacattttaataaattcatttaatatatgtaagattagttcacaagtcctaaattttttaaaaataacacttgtttggatctagtatcgataatttcaaagcaaagaatcaaacatgataacataaaaaattgcataagatatatatttaaattattaatatatttggatccatccctacgatgttccaatttttttattttccaatcactcacaggccttgagtttttttttttttttttcttgttaacaagccttacaattttccacaaattatgccacttttttataatgtaaataatctttcaatatgtatcgaaaactttatgcatctaataatttaagagagagagagcgaattttttttggtgtacatgtggtaaaaactctttttttttttttatatgtgcgtgattaacgtggttcagttatttcgtatataatatccctatctcttttattttattttattttaaatagcaataatttcgtatgaaatatcttttacatcaaatatctctataagcctcgtctttaaaaccagacacagaaactcctcactttcgaaaaaaacaagatcattacacaaaaatg

SEQ ID NO: 9354 - DNA, 3000 bp, Unknown
  misc_feature (1)..( 3000): cDNA_ID_3041475_gDNA_ID_1972097_Annot_ID_178635 3000 nt of promoter + ATG
taataagcaaacagactacactggatcccaacatagaccaagtatactcattcatgatgaataatagtcaactagaactggttgatgaccactcaactaacacatgttatcatttgacaccaaaacaaactcaccaggttgcataatagtcaactagaactggtttatcagagttcacaagcagatcctcaaatgagtcaaatgtctgcttcttggcttcaatctgaagtatgaacaagaatggtttgtcatttagttcaatctaaatcaagaagtagataaaggcactcactttaaatcaattccaaactctagagaaaatcagctatagaaactaaaataagaaaaatttcaaaataggaaagctatcatcagctctaccatcagaagaaagtttgaagcttgaattcaataattcatagggtaaaattaagtaagctagaattgaacaaaatataagctttggaaaaagatgtttaagcagagaaaggcgattacacgtcgaggagtgcatcgagtcgttgaagataaagatggaaactttaagtctccggttcgaacccgacgaaccggaaactgaaatttgacggccgagatagaacgagaagcgaaagcagaaacacctgacgattctttcgaattcagcgacggaaccgtagaagaagagagagaaattgacgccatgaaagaatcagaaaaaaacaaacgatctcttgattcggcgttggcggttggttaggttgatgatgacaaaaaaagttggacacttgtggaaaaaaaactcgaattgaccaaaaagagagaacgaactctgaaagaaaatgacacaaggtactagaaagacaatgatgatccactacggtcaagtacaccgtatcttttttgttataggcccacaaacatgttctaggcccacatgttataggcccgttcccaaacaccgatcactcttcaatttaactttttgctcacaatcttcaggctcaatcatatgacatgacagatctcattgtaaatgcaatcgcaaagggttatcattatcaactagtactataaagatagctgttacttcccgccaacgcaactgggacagttaaaaccgttgagggtaacaaaagacaaaactcacgactccgtttttgagtttcctgaagatggaagttacgaatatgttcttgtgggcctcttcaaagaaacgatatgaaatagcctaatttaaacaaaactagaaaagtgtggactagagagagactttagcaaaaactaaaaacagatgtatcaaaagaagctcacaactaaaaaagatggagcttgaattaggtctgaagatcactcggactaaagacgatgtttcttcctctacagattttcgggttgccagagattcttttggtcatcgttcactttctcgagaaaccaactctgttttcttcctcattcttcatctcaaaggttctattccctctcatatttattcacctttttttcttacctagcatagagattgagattgaaaaccaaatgcaggatttaagaaggatggtatcgatatcgagataaacaaagaagggaatctgattaagatcagcggaagaaaacaggttgaagagatggttttggtaaagtgggtggaatggaaaaaggaaacagaaataaaggaattcaaaaaagtgtttcggattccagatattgtaattcttgacaagatcaaagcgaggtttaatgaagaagatgggactttaactgttacaatgcctaagaaagttaagggaattaccggtctgaagatcgaggaagaggacgaagaagaggagatgaaagagccgatagtagaagagaaaacagaggagaaaacagaaccagaagaagaaatcaaagaagagacaaaacctgaggaagaaaacgaagaagcagaagagccacagagagaagaggaagaagaggttgttgaggaaggaacaagagatcatgaggggaaaaaagaagaagaaatcgaagataaaccaagaaagaagagaagaaaaaagtttcgtttaccatgttttgcaggatccactctgcttatgtctattattgttttcattattcaactgattcaatccagaaataaatgaaaccacactccttaggtttttaagatagggttcttgttggtttttaaggatagaacccactttcttattatctgttcttcttagccttgttctttaaaacaataaaagtcaacgtgtaatacaatcaaaatacaatcagtatctaaaccaaaaattagtaggagcgtatcagctaataaatggaaagtatttgacccgaaccgtgtataacggctagattatcaccgaacctaaggtttgtgtttgctctggactataacaaaccctaagtgaaaaggaaaaaaggaaacttgaatgtcaaacaaataaatttatatacctgcgtctcgcgtctcctctcaagttaaaaacacaattgctctgcatttttttcaattctcttcttcgatttctgtctgcttcgtttgcctctctgttctcttcttcttcctttttgagatttcattattcatgtgttgttgcatctgcttgttggattcaccctaatctttggtgtgattcgttggtctggcctaagaacgactcatatatacaacggctctctctgttcacttaaaaagcaacgaagaagacgagagagatcacacacacaagcctcacgtcttaatttgtttgcctgcgatgataagatctatcatccaccgtagaaacagagacagagagagagatagacgattcgaaggacatgttgccgggattttaggcttcgagagtcatgatgttggaggttctatccggcgatggaggtgtcgatagattgaggaggtggagcgatcagaggattttaggcttcgggagtcatgatggtggagcaatcatcggagattggcgatggagatggcgatagattgaggaggtggagcgtattttccgttaacggataaag

SEQ ID NO: 9355 - DNA, 3000 bp, Unknown
  misc_feature (1)..( 3000): cDNA_ID_3041495_gDNA_ID_1972097_Annot_ID_178624 3000 nt of promoter + ATG
tacagaagctttcacttctttacaataatgcttgctatgtagaatccattccaacacgcataccaccggaatcatgctcaatttcgaaatctaaagtgaaaatgaataagcaaaatcaaaacaacaatctttcaatcgaataaccgaaagagcaaatctccaagacaagttacctgatagaagccaacagagttgagcataagactaaagttcatagcagcgatagagatattagcaacaattgagaaccagagaagctcccaaagaggaacatgcttagaagctgatagtcccgttgcgtttgacaccataccaacaagagcagtgaatgcaaagtgaaatcccgttaacgttgtagctgtggaatatataaacaaagaaatcgtcagattcatgaagtgtgtaagctaatgggagatagatagatcagagtcagagagagagaggcataccaaagccaaaaccgaaaccagaggaagacatgagctgtttattagccatgatgattccaacggagctgattacattcatagcccatgcaccgacatcagacaccgccgatttcttctcgctctccggtttctccatttggatttgagaaaattgaacaccgacactatcagatctgaatctcgtgcaagcgaaaacgagatctgagaaatctcgattcgcttgcagattttgacagaatcaaacactgaaagagatgagatctggagaaaagtcgattcacgccgttcgtggaatcagcgaagaaagccaaaaagcgaaaaacacagacacacactcacgtatctctctctgtctctgctacttatgcttcactggttcttcactcgacgtagctgaatatattatcacaagcaagcttcttctcccaccattgatgctttccttggagttgttataaattcttttttaattctctgagatttcgaaaataatattatatatattaatggaatcattttaagtattaatttcattcattgacgcgtgtcgtttaccttatttgaccttcttctttcttcttttggtccacttgtttgttatttcaatatgagttctgtatagggatagttttgtcttttcgtgccgctggtaacgtcgtgcttttagttttcaaattaaattttaacttgcgagattattttattaaacgtttacttaagtgcttaaattaagccacaaggaactgataacagcgaattgttaacggtaatttataacggagtacgtacttactacttaatttcaaactatatatttaatttagacaggaaaatatcgcgatgtgtaactaatagtaccatttgattaaaatgtagaaatgtgttgttcattttcgaataatgcttgattttattataatcatatcgaaagtgaaaggaaataatcacaatttgccattggtcatagtcacaccgtcacactcaaagccaaacaatttcgaaactaaattattgagtttgtcctttgttcttccagctattctttacttgattacagtctcatttatatatacaaatgaaaaaaaaaaatcattacaacaacaaaatatcgtttttgttgtgtgtttgtatatcaagagttttggaaattgtactgtgtgttttatcgaatagttttagaaataatgatgggtctctgcaattattaatgctttgaagatgacaaaacctgtatatcttagcctgtgcctcaacacaaatagtaattgagaacacatgatctccaacacattgtcacaaaagagcttttgcatgtgctttcaacatcaattattttcttctaacaagcccaatttcacattagtttatgccaaaaccgaaaaaaagagagaatagttttacataatggcacacacattaaggggtttgaatggacatacatagaagaagccttggcttataaatcataacttatctttcgtgtattttcttggaaatatcaagtggagcttttgatgccataggatcgatgatcgcatcactgaaagaagatgaagaaaaacaagtaagcaccgacggaaaggaccgaacacttttgcaccaagaagatacatgttacaagacaaagagaccaacactgagatatcctgacttctccacgtgcatcatagctaggcgctgtgctataccagtataccacttagcactttaataggcctctcccgacacctgaacaagagaacttgcttagttgaaaaaagtacacaaaacaaaacgttataggccgacaagttttaggaattttataactgggctcataacataaacaaaattaaggcccaaatctgattctaacaaaaagaaaagagctctgtctctttcaaactgttgcaaagtggcttctgtagtttgttcctaaactagtcaagcaaggtgggctaacataaactcccaaaatggttggtttattacttctgtttgatgtgataatgccgcaattcaatgtgtattatgtctcttgaaatctttcatttgagtctcaattcacattcttttgattttatctttccttctttactatgttgcatatttcagagcatataattttttttttttgtcggtggtcaaagtttataaaatcaaaccaaataaaagaagtgattgaaatcatacgagaccccactggttatgttctgtataagcgccaatgaatcacaaagtcgaatcggaactgtagatgataggaaggaacaaagaaaggaatataggttaagttcaaagtggttaagctctctaatgtcgtcaatgaatacgtcatcatgaagaaataaataatttccaagtggatggacttggggaggtccacacatacgtcgtcaatgacgaccacgtcccttaaggcgaaataaacacttgccttcctaaattctctgatcaatcaatgtgtataaatatgcgcagatatatccattatcctccacaattcagggaaaatcttcaaagtgtttgcagagaaatctaaattcatcaacagttttttacaaaagaa

SEQ ID NO: 9356 - DNA, 3000 bp, Unknown
  misc_feature (1)..( 3000): cDNA_ID_2182102_gDNA_ID_1972097_Annot_ID_178623 3000 nt of promoter + ATG
attgacaatgccggggatttcttcgataccaagccgtcttggaggggtaaagagagcttcatcgatgccattagagcgaatttgaggcatcaatggcttatccgaacaagagataggagcttttccatttggctgaaacccgctattagaaacgcggccaacatgccagatctgacagaagaagataccacctttggcatgtacagcatcaacgattggcttccatgcctccacatgctctttagtccatatcccaggagtatcttgatatcttcaagatcaaatcacacacatgtggtaaggatcagatcaaaaacccacaaataaaaacgtaaactttaatcaaaaggaagggtttttgagttacccttgagctgtatctgaaactccagtggcttcagtgatgagaaaacctcctggagtcgttctctgagagtaatatatggcagcgtgaggctgaggaacgtttccgtacgatctctgtctcgtcaatggtgctagaacaaccctatgggaaagattgaatcttcccatcttatagggagtgagaagaggtacactctgttttgcttctccgttttccatttcttttgtaaaaaactgttgatgaatttagatttctctgcaaacactttgaagattttccctgaattgtggaggataatggatatatctgcgcatatttatacacattgattgatcagagaatttaggaaggcaagtgtttatttcgccttaagggacgtggtcgtcattgacgacgtatgtgtggacctccccaagtccatccacttggaaattatttatttcttcatgatgacgtattcattgacgacattagagagcttaaccactttgaacttaacctatattcctttctttgttccttcctatcatctacagttccgattcgactttgtgattcattggcgcttatacagaacataaccagtggggtctcgtatgatttcaatcacttcttttatttggtttgattttataaactttgaccaccgacaaaaaaaaaaaattatatgctctgaaatatgcaacatagtaaagaaggaaagataaaatcaaaagaatgtgaattgagactcaaatgaaagatttcaagagacataatacacattgaattgcggcattatcacatcaaacagaagtaataaaccaaccattttgggagtttatgttagcccaccttgcttgactagtttaggaacaaactacagaagccactttgcaacagtttgaaagagacagagctcttttctttttgttagaatcagatttgggccttaattttgtttatgttatgagcccagttataaaattcctaaaacttgtcggcctataacgttttgttttgtgtacttttttcaactaagcaagttctcttgttcaggtgtcgggagaggcctattaaagtgctaagtggtatactggtatagcacagcgcctagctatgatgcacgtggagaagtcaggatatctcagtgttggtctctttgtcttgtaacatgtatcttcttggtgcaaaagtgttcggtcctttccgtcggtgcttacttgtttttcttcatcttctttcagtgatgcgatcatcgatcctatggcatcaaaagctccacttgatatttccaagaaaatacacgaaagataagttatgatttataagccaaggcttcttctatgtatgtccattcaaaccccttaatgtgtgtgccattatgtaaaactattctctctttttttcggttttggcataaactaatgtgaaattgggcttgttagaagaaaataattgatgttgaaagcacatgcaaaagctcttttgtgacaatgtgttggagatcatgtgttctcaattactatttgtgttgaggcacaggctaagatatacaggttttgtcatcttcaaagcattaataattgcagagacccatcattatttctaaaactattcgataaaacacacagtacaatttccaaaactcttgatatacaaacacacaacaaaaacgatattttgttgttgtaatgatttttttttttcatttgtatatataaatgagactgtaatcaagtaaagaatagctggaagaacaaaggacaaactcaataatttagtttcgaaattgtttggctttgagtgtgacggtgtgactatgaccaatggcaaattgtgattatttcctttcactttcgatatgattataataaaatcaagcattattcgaaaatgaacaacacatttctacattttaatcaaatggtactattagttacacatcgcgatattttcctgtctaaattaaatatatagtttgaaattaagtagtaagtacgtactccgttataaattaccgttaacaattcgctgttatcagttccttgtggcttaatttaagcacttaagtaaacgtttaataaaataatctcgcaagttaaaatttaatttgaaaactaaaagcacgacgttaccagcggcacgaaaagacaaaactatccctatacagaactcatattgaaataacaaacaagtggaccaaaagaagaaagaagaaggtcaaataaggtaaacgacacgcgtcaatgaatgaaattaatacttaaaatgattccattaatatatataatattattttcgaaatctcagagaattaaaaaagaatttataacaactccaaggaaagcatcaatggtgggagaagaagcttgcttgtgataatatattcagctacgtcgagtgaagaaccagtgaagcataagtagcagagacagagagagatacgtgagtgtgtgtctgtgtttttcgctttttggctttcttcgctgattccacgaacggcgtgaatcgacttttctccagatctcatctctttcagtgtttgattctgtcaaaatctgcaagcgaatcgagatttctcagatctcgttttcgcttgcacgagattcagatctgatagtgtcggtgttcaattttctcaaatccaaatg

SEQ ID NO: 9357 - DNA, 3000 bp, Unknown
  misc_feature (1)..( 3000): cDNA_ID_2182011_gDNA_ID_1972104_Annot_ID_178657 3000 nt of promoter + ATG
attttagccacaagaaaatctaaaacaaagtgtctactgtcttggttaaaacttacaaagtcgagattgaaatctttagctgtgagaaaaggatagataatgaaccaaaacacaccatctgtgagcaatacagctcctgcacaagtctgcaaatccaaaaacatgttcagacttcagaaacagagaacgtaacatgttttgacacttaaaaatctcaggaagacttacttgaaaaagaatctgatgaatgtaacccaatgtagttgcaacctgacgtgtagacatgttttctctatcgtgtccgcttgaagatttaaacacattcgagttttcggcattcccgggaggtctatacgtcccttgctcttcatctactatactaactctgttttcaccattatcaggagacctaaatctgtatatggacaccaatgatccaagctgcaatacatcaagccgactttaggtttcgaaaaaccaaaatgtgtaaccactactaatctcaggtagatgtgaagtaccatgataaggtgaagaaaagccataccccaaagtaaattgtgaccaatgtgaaagtccatctgatatataagaaccaatcaaaactcatcagaacaagtgaaattgttatcaactttatgtaatcaagaaaatatttatggagactcactgtgtgtagaagatgaaaatgccggttccatcagcaatagcattaccagagataagtccaagaagaacaacaaaaccaaaaacacgaaaacctaacaaccaattcggatgaatctctttgacactagtattccaagattcatcatcatatacaactcctgtgagttgttctagctccaggctttgatcatcaccacgtttcttgcgttttattggtccttcatatctccaaatcagataagaagatagaaacagagacgttaagacaaagattgcacagacgaagaatctccagttaagccagtaacttggaatgtttgtctccgaagtcattgttggttgccaagtatgttcagttgaacctgtaataaaactcgacaaatcaattctgctaaacacattcttcaccatttctcaaaaaaaatctctataactttgtgaaaccaagtgatcttgattttaagttttaacacatagagtctaataaattcacgtcaagaaaagaaaaagtagaggcgagaaactcatgatgagacatcacgggttttgattttgttttttggttagcaataacaatggacaacgagagagagagagagagagagagataaaacttgaaacataaagagaggtatagcattcaaagcaagagacagattctttacttaacgagacaaagtaaaatcaagaaaagaaaaaaaagattagataagacaaaaaaaataaaaagatacctgtagtgatgctttgcttcaattcagtatcagattctgtgagcaagaacaatgagaatctttctcctctgtgattttatgatttggaaaatggaaaataatgaatttcgaatctgatgtttttattctacactccacacgtttatgtattttattcgtcaatacttgcaattaattagagccattcgattcagaagcagtcatcaaatcgaacggttaaaacgaaacggtcgaggaagccgaaaacagaggtaggcagaggtagaaccgtactacgagtctcgtagtagactagactttatcattctttaatgggcttaaggccccattttgtttacaaaagtgtaagcccatgtgtagggggatctgaaaccctagttcactttaaaccctcagaatcatttacatattagattaaaatttcctcacaggctagagagtagagagtgatccctgtgatcaagctatcgtcgacgttatattttctcctcaaagaacaagggcacacacgcttaaagcacaaaaaacaaatcagttgttttggaaaaaaatgacatcgacgtgttgaagctatcatcgacgtgtctattatgctatgaccttatgaaatacggaagtgtgtccagagactatcagtcatgtcactccaccgatggactctttatctttacacaacattgatatgtctaattcttttccaaattcctctcttccttttaggtcttatcaggtaaaagggcccgttagagatgtattgtatatcttatgagagttataaacgtacatcaaattttcattaaccatcacacgttgaacacttgagttaatctaacttggtttcgcctatgtggtaatgtcgaaactatagtaaataggtctatatatatgggtttaaattggtcaaaggaacttaaatgagaatcaactgaggagtaaacttaaatgggtaaaaacctcacatttttagtatatgtttacgtctagtcatctatccattctaaaactgtatatccattctgtaaaattatcacaaggaacacttttttttttttcttcaaagactttagttacgagtaaacaacctctctaaaaaaaaaattttgaacgtatcaaatcttcaactcaaggttggtacaacaattgacctatagtactatatatatatatatatatatttacatgcatgggacaacaactatatgtttgatttttcgttttccaaactatatatggcaccatgtttaaatgtcacaagttaaaaaaaatgtttaaatgtcacatgtttagctttatgcgtccttttctcagagttaatgggatcaatatgttgaccaggaaaatatgtgtagagtttttggagtaaagcaaagaagtgggagccttgtgctttaaggttagatgaatttgtattaagggcttgtcttcatctactttaaagccaagccaataaaatcgccttaatgatctgcttatatatatattcaaaccatattatcatctcattacaaagaaatcatttttgcataaaatctcatatcttaaactatacaatcacttaatctttgcttggagttctttttttcttaagcataaaatg

SEQ ID NO: 9358 - DNA, 3000 bp, Unknown
  misc_feature (1)..( 3000): cDNA_ID_3041521_gDNA_ID_1972104_Annot_ID_178674 3000 nt of promoter + ATG
ctggtcatgttgtaggtaccaaaagaagacagcgaagctaattcaggagatcacagcttctgcaaatgaagtagattgctcaaaaacgcttatcgtaacttgtcttatatgcaatgaattctttcgttaataactgctctgtgatcttcaaggtcgctcaagagacatactctttgatgagaaccgttcgtgtatatgggacagagaagcaagagtttaaaaggtgcgatctgtttccatgaaaaccattgacagtctcttttttctttatttatcttgtgaaaattttgcaatatcggccctatctgtttcaagactatttttggcagccaagttactttttgacatggattttcttcccttctgtggtggaaaggtacaatcactggcttcagagattggcggatataagtttgagacagagtgctgcatatggtatttggaactggagcttcaacactctataccatgcaactcaggtttctcaaatataacccctgttttgctttatttctctcttttgactgtttgtgggaaggatcaattaattttgtggttcttaaagatggtgatgctcatgctaagaatgtgacaagatccatcattcttttcttctcttatagattattgctgtcctggttggaggattgtctatcttagctggtcaaataacagcagagcagctgacaaagtttctgttgtatagtgagtggttaatctatgctacatggtgggtgggagataatttatcatctttgatgcaatcggttggagcaagtgaaaaggttttccaaatgatggatctcaagccaagtgatcaattcatatcaaaaggcaaggttcaaatttttggctaagagcactctgtcttagaaacatgttgaccatttatgagattgatgagagagtgagttaggttgttatcagtagatattactcttactatcaaaccccttccaggatgaaccacttaagagtatatgactttggacttcctacctggaggcttatagtgattgctacgctctaccatgtaatgtatttttatttatatactgttctgtaggaacgagactgcagagactgacaggacatatcgagtttgtagatgtgtcatttagctacccttcaagagatgaggtatgactgtaccgagtggaatctattttctgataatttttttgcttttgtgtgaatgtccttgaaccacagttttttgcttccaacgttttacaattgtgtgaatgtccttgaaccacagttttttgcttccaacgttttacaattgtgtgaatgtccttgaaccacagttttttgcttccaacgttttacaattgtgtgaatgttgcaaattaatggccaaatatatggttttgcatttgcatcattttacatttttgttgagtatattagaatttatgcacacacatcataaagagttttccagtcatgtttatagtatggggcactggggctcatatatcagtttttcataacaattatatcatatgtcaatctctcaggtagcggtggttcaaaacgtaaacatttccgtgcatcctggtgaagtggtagcaatcgtaagtaaatctcaaagtagttcaacaatgcaactgttttccttagaatttagcggaagtgatatgtgtgcttatttgttttgtttaggttggtctaagtggcagtggcaaaagtacactggttaatcttttgctgcaactctacgaaccaacaagtggtcaggtactgtaggttactcaaactcactgtagaataaccctttaaagtcttccttcttaatagctggctttttgaattccagattctactagatggggttcctttgaaagagttggatgtcaagtggcttaggcaaagaatcggatacgtggggcaggttctcctcgcttttcgtctttgtagaacaaataaactttgatgaatttcactatccctttctaaagctgtcacaatgaaacaggaaccaaagctcttccgcacagacatcagttcgaacatcaagtacggatgtgatcgtaatatatcgcaagaagatataatatcggctgcaaagcaagcctatgcacatgactttatcacagcacttccgaatggttacaacacaattgttgatgatgatctactcagtggagggcagaaacaacggattgccattgctcgtgccatccttagagatcctagaatcctcatcctcgatgaagccacaagtgcactcgatgcagagagcgaacacaatgttaaggtaacctctctattaccaaaaagacaaattacttggatgcaagaattcttaagccttttgtttttccagggcgtacttcgttctatcggaaacgactcagcaacaaagagaagcgtcatagtgatagcacacaggtatctttttcttgcactgatccaatcttttacatgttttgatcattgatttataacattctgttccttcacagactttctacaattcaagctgcggatagaatagtggctatggacagtggacgagtcgtcgaggtaagccactatcttacggttttgataaatacatagaaaccattgatggctttgattttgactgttatatttgtacacaaaacagatgggcagtcacaaagaacttttgagcaaagatggcttatacgcgagattgacgaagagacaaaacgatgccgtcttatgattgatcctacacatgctaaactgttcatgaaatagtcatgattatgtttttgaatggtcatgacgatatgtaatggcaaaattatgtaaagtgtaaccatagagaattcttattatttcacacaaatcgtgtcgttctagtatagttgacataaactgcctgccgtttctatatttcctgttaaagcacgaaaatttatagaaagtggaaaccactgaagacgacctgtagtttatcaattcgagaacaagcaagcaagcgatctcaaacgcaagagtcaaggactcaagaccttgctgcta

SEQ ID NO: 9359 - DNA, 2203 bp, Unknown
  misc_feature (1)..( 2203): cDNA_ID_2182079_gDNA_ID_1972104_Annot_ID_178675 3000 nt of promoter + ATG
ttcttccgcaaagctttcaccggatttcaactccgaaagcggcgaaattttataagaaaatggtagaaacaaaacaaaacaaccataagcacaagaaggattagaatcaacaccatcatcggaaaacggagaggtatagaggaagaagaaagactgaaagactaaaacccggttaaaaacagaatttcaattgcgctttttagttagttttaaaccggttacgtaaatcttaaaccatactaaaccaaattggttcttggtttataacaaaaaaaatatctgaaacgtacagttcaagaagagaggaaaaaaaatatctttattgagtttccacgtggctcatattcattggattttcataaaagaaagaaattgtgtactggtaacactaaaaattcccaaggacactctttcaccaatcacaaaaggaaaaaaaaaataaaaaaatctagcatcatcatcaacatcatgatgatcttttacatctattggactcacttttttgggctaatatatatgaaactgatcctcacgttattaaatataattccgagaattcaagacttctatattgttacaatgtttagagagattgtttcaattgttgatgaagtataattggttatgacttggacttctatgaacgtaacatccattgttacgtatagatctctctacgcaactaggacatgtttccggagttgaaggcgatggaggagaacgagagcgtgattttgacgaagaagatgacgtcgttgaaggtggaggagacgagtttgctgttgttctcgttgatttaagcggagaaagaaagacgtgaatcttaacttgcgctgttatagcgagatcgtattcctccataagattctttagatcctcgtcggatcttaccgttacaagcgcgtcaagatcatctgttggtaactgacatcggagactagtcaccgcaatcccgcaaatctcaccgagcttcttctttagctctgttaatattatcaaacagataaccggtgagtgtgctactagacggctacactaaccctagaattcgtagggtgataaaaaaaaaaaaaactgattaactaactaaccggtgaaggatatggcgcgagtgacggagaggacacgtgtatcgccgccttgataacggagcttgccgtcgggataacgtggggtgattctgccaccgtagctacaaaggaacttgacggttgttgtatttgggaccatatcgtttttttatgcttagttgaaaaggtcggagttggagaaggttgttgtatagtttgtttttcttaaagccaattaactaatgttcaatcgatatatatagagagagaggcttttccaagaatgcaaaggagtgtgtaaagcgtagatatgtataaaattatttattctctgttttttttgtgtgtcgtgtaatttaattacaaaaaagctccaatgaaaaataagattttgccgacgtaatttttttctttttggaatattctctcatatgaaaacaaaaaacaaaaagaaaatcataggactattttgacgcgtgttataaaatgagtggagtttgaaggacccatacgacactatttatgttaaccggtctcgctcgaccatcggcgatttttgattttactttataggcaaatatgcagacaagcttgattttacttaataggtaagcaatatgttcttgaacacaataatgtgatggtaaataaatgcacacatgtaatacaacaaataagattatgtttgtttgataaaagtactataatatagattcttcttctcttatatggttaaaatgatataattatcgtagttcagtaaaattctagatattttttcgtatttttcttttacacaaaaaaacataaatgggaaaacaaataatatattttgctatatttctttctcctgtcaaacaaaatatttgatattttctattgacgtaggcctctcgtcttgtgcaaccggtcccttgaaaagcccacaacgaccatgaacatttgcattgcaatatcaattttttttttcacattgcaatatcttaaacatcttgatatttgttttgataattgaggagatattattacatgatgccacatagataatccgatatataagaggaatcaatcgggaaataacatttgatgtttgtataatgataatccatgtttattttattacttgattaatg

SEQ ID NO: 9360 - DNA, 3000 bp, Unknown
  misc_feature (1)..( 3000): cDNA_ID_3034260_gDNA_ID_1972104_Annot_ID_178667 3000 nt of promoter + ATG
aataaagcccaatatacttcaggcccatataaagcccaaaatagtaaatctcaggccctttttgccataagaaaagcgacagtcacatttgcaggcattaatcatcatttgcatcatgatgatgtatcagtaataatgtgtatggtccgaacaaaaatgtaataatcacgccgctttgtgaaacaccttgttcaaaaaatgatgactaatcatagtccaatgctgaatcgtataaaatataaacattcgataatcatagtcgaatgccaaatcgtacagtagaaatataaatactaagttcttagctaactccaagaaattgaaataaaatttaacctcgtggaagaaaaagctgagcatgggacggctttagacagcatcattgctcgtacatcaaattgttgtatcctccttttgcttcaatattcctctttttcttcactttttcacattctttctctgtcttcttttagttaaaaagaaagtagactataatcgaacagattaaatgctagctatatccaattttcattatttatattcgttcacacagaaatggaaatggtgtagtggaatttatgatgaagattcggccatgttgaattatacatgcctagttttctggagtatgagaacgacaatatcatgttgcaaacactttatattttgatcagggaatttttgaatctgcattgattattggagttactcagtttgtttctctaaccttctgctcaaagctgaatcgtacgtatacatttacaaagttagagccaaacattacgtcaaaaactggtaagcataaaagctagtgtgaacagataattttgtactctcggattagtgatctactaatgcaaatatgtagtgattcatttttcagttagtggtcgcaataattctccctcatgagttatgattcagagattcatatataatagtagtataatacttgctcctatgagccaccaaagctattaccctttgatgccattctttttgttgacaggaatcaaattctcccgctttatagaagaccttttattcttacacattcttcattatttgaattaatttctttaacatttcttacattttctcattttgttcgatcatacgatggatattaaactaagatagaattgttatagaccacaatagctggtatatatggatcggattcttcatactttctatgctacaagtacgtctgtatgcgtctttatgtacgtattcatgtatacgtgcacgcatgcgtatggccccaaccattaaaccctttgggatcgatacataaattttgcatccgccaaataagctgtgtttagatatgaattcacaattcagataaagatggggaaaaactttatatcctttactactttgggttaaaaaacttaaagcgagttggatctaactgtattatccaaaataaacgagaattgtcttcttgaggttaattagctattatataacgtcatgttgtgccattgtgccaaactcagtcataattttatttttctctcaatcataagttctctctggtcaactctgcttcggtattgagtataattaatcaaaagccaaatagaaaacagtatggtacaagactcaaatctcaaaagagacaaaaatctatatgcatgccatagtgatttttgaaagaaatggaagagaaaaaaaaatgagaggggaaaagctagaggagagcgatgacccattaagattaaatggactaacaaacgaaacgatcatcaatgtgtaagtgtccctacgaggaccgcacccacttaattccccaaattcaatacctattgaccctcttttcttataatgacccacttataattattatcgtatattgttgtatattgtcgttacaagattgtgaaatgttttatattttctatacacgacgaataacctggtcaagctatatatcgagattcaagtaagtatatataatcgcatgcttggttaaatcagtcctccatttcgagagacaatatgattatactttaaaaaatagagactctcgaatgtcgacaatcaaatgtcacaactcgtactatgctattgtaatgtttttcaatcaataaacttggtttgttttccacaattttatatatagttttattaaatttatatcaccggttggtgttgagcctaacaaataatatgcattattaatagtctactactactagtttgtgatatattctttttccagcttggagagaagattaagcatattttggtctctgattaaagagattacgtaccgtaacctcaagacttctataattaaaagaaaaaaatcaccatatttgtttgttagaaactccaagagattccataacaaaaacatttcattattctacaagcaacattgtgaacatggaccataaatttaacttgtacagtactctacataaacggtaaaaaacaataaagcgcttggaaaaagagagtaacaccagaaagcaaagagctttgaagaaacccaaattcaaaggtactcaatttcatctgactagctctgaccccatttcttcaaaccaaagaatgatcacaccaaatccaaaatttcccctataaattacctatctcacataaatataaagtttacttctcttacctctctttcctctttttatcatttacttcataaactttctagatatctgcaaagcccttaatttgaattcatcactaacccacatgcccaaaactttagcaacacacaaccctaataaatttttgttggagggttcgatgagttaattcattctttattgtttttgatcttctgtgttttcccttaagaaagtgattatgtgtttaataggtttgttgggagatgtgtcagtgacatcaagaagacgaacaacaattcaaaaccgtattaaatgttgtctttttgatcactcaagaagaaaacaacaagacagcagatgttttcatcattcttcacaacaagtttcgttcaagtctgatccg

SEQ ID NO: 9361 - DNA, 3000 bp, Unknown
  misc_feature (1)..( 3000): cDNA_ID_3041537_gDNA_ID_1972104_Annot_ID_178663 3000 nt of promoter + ATG
caagaagcaaagaggtttgttccataaagaattagttaagatttatgttccagaaatagcttagttttcaagattagtcatagagtttgagtggttataatagtgaagtcttgatcttaacagatatttgtgtgtgtgtgtgtgtaatgtaatgtagagaagaagcaactagggtcattattcatgcttgcgaacaaatctaatctctgtttctcctatgagaatctcgagagggctaccgattacttcagcgacaaaaataagttaggacaaggaggatctggctctgtctataaggtaagttctgttcttattatacattttctagagtttcatgttggaatgttcctacttctcaattggttaactctttgccctttttgtggagtagggagttcttactaatggtaagactgttgcagtaaagagactgttcttcaacacaaagcaatgggtggatcatttcttcaacgaagttaatctaataagccaagtagaccacaagaaccttgttaagctcttgggatgcagcataactggaccagagagccttctggtctatgaatacattgcaaatcaaagcctccacgactatcttttcggtttgtttttgtcaatcctaaaccttttactacagttaccatgtcttgatggatcttttattgacttgttcttgttgctttgttttggttcagtaagaaaagatgttcaaccgttgaattgggcaaagagattcaagattatacttggtacagcagaaggaatggcgtatcttcacgaggagtcaaatcttagaatcatacatagagatattaagctgagtaatatccttttggaagatgattttactccaagaattgctgattttggattggctagattgttcccagaggacaagactcatatcagcactgccatcgccggtacactgtaaagtctcaaaacttatctttgtaactttaatatctctctctaccgtttcttgtgttgtttctgaagattcttacttgtggaaacagaggctacatggcaccagaatatgtagtacgaggaaaactaactgagaaagcagacgtttatagttttggagttcttatgattgaagttataaccggaaaacgtaacaatgccttcgtacaagacgctggttcgatcctacaatcggtaaactaactctctacaagtagttcaaacattttcttgattttagatcaaatcctttttcttgaatcttgaaaacatattttaggtatggagtctgtacagaacaagcaatgtggaagaggcagtggatccaatcttaggtgataacttcaacaagatagaagcgtcacggctacttcaaattgggcttctctgtgttcaagcagcgtttgatcagcggcctgcgatgtctgtggttgtgaaaatgatgaaagggagtttggagattcatacgccgacgcaaccaccgtttctgaatccaggaagtgtagtagagatgagaaagatgatgatgactcccacgacgaatcagtctaattcttcaggatcaaggagtgactacataaccgagggttcgagtttctttgaacctagatgaggttttagatcgtgttagatatatcagtatcctttcgtgtggattctgaatcatcttgtgtcatatgtacaaaaattgagatgccaattaatcgtgtgttagctaggaactgagggttacttatgtgccacgacaatgtcatagaagctaggaagtgaacaatgtagagcttacatgacggggacagattccggtttagcctcggttttgattgtagtgattcggtttacggttcagtagttttattttgtgtgttaattttgagtagctttgtatattagtaagcggtttttgtgtttgttctcgttttaactttacaaaaagagaaagagtaaatgtcatatttaaatagaaaaatgcaaccacaaatgcaaagaaattcgagtaaaaccaaataatgccataaggatatttacctaagaatcaaaatatgaaacatattaaatgtacacaagaaaaaaatcaaatcactaaaaattcactaaatttattaccgcaaagtttggatcatgatctcctaatttttgcacaagtggattcgaatcaaggactttttatcagtgtttttgttttctttcaaggaagccataggagactactagatagaaacacatatactacatatgtctttattatagccaactagatttaacatttttagaattgaatgtccaactacttctcatttttctttgcaattgatcttgaataaaactttgaccatggcaacatgtaaatggtattttgttatatatatttttattatttgtacaacttttattgtactataccaactaggcctactaaatcaacccaacaaattgacaaaaaaaaaatcaacccaacaaacctatttctttatttaaagtagtctaacgtcactttatccattttcttgaatgtcatcttactaaacactacgcatatgtgacgttttcttttttctttaactaatcagaaaattgaatttttcatgataccggtaaagagatttatccaattaaaccgaaccggctccacataagataagctctattaattattagtccactggtttttaggtttatgaaaacgacaaatatttgaatgaagacaacgacttcaacaacatgatcgagctggtttggtttccaagtgtgaattcaagactaagaagaaatccaacaatctccattatcaattttttttattaactttttgactaaaccagtagagagagagagagaaagacagcaaatttggttgactctaacaaaccaatatcatcaaagtcaagcagttgaaaattcttcaatttcatcatctccaattcttaatctctctgcttcttctttcttcacaacttgaaacagaacacaaaacccttgatgagggaataaaaaaaggagatctctttctcaatcaaacaaaacaaaatg

SEQ ID NO: 9362 - DNA, 3000 bp, Unknown
  misc_feature (1)..( 3000): cDNA_ID_2182034_gDNA_ID_1972104_Annot_ID_178665 3000 nt of promoter + ATG
atggcgtcattgcacgtatcaaagtccgtcaaggaggcactaagattgatgttaagactaaacccatcattttgtttgatgtttttcaacgccttttgtagattttcgagtgcactatcatagtttgagtagcaagttttgagccctcctccacttttccggctaatcttggcggcttctttggccttgatcgttcttttcatcagctctcttatggaaacctccgtcgctgcgttaacattcttttggcccttaaccactgatctgcacaacactttgaaatctgacacggagcatggatcgcgtccgcctcccataaccctctgagccattgctacaccgctttggctcgcggtcaggaggaggaggatcaccgcggtggcaaggtggagatttgtagacatttttatgtaaaattgcgtggtatttgaacaccggttgttgattatttgaacaaatagagggtggttgttatttataataatgcatacgctaaaagaaaaaatgggtaattttagtaagttcttttgaggaaaagagtttcaataaattgtcgccggtgaataattagagagacatatcaaatttagttccttggttaattaggcctaatgatgggttatttccttcttatttttatttttgctttgttctgaaaaaacgcaattataaatttccatttcattttgtggtttatgttttctgacaatgcttcgtaatggccctgccatggccgatgaatcaacttacaaaatggccttatttttattcccaattcatactaatttgggcttttatgtgttgacaatgtttttaatttagaccatttaagaaagatagtgcagaaggatctagtgcagcaattgtcaagtccagtttcttgtgggctggacaaataatgttttattctctttgtcctgaacaaaaaaaaaaagttttaagtaatcttcgttagtagttttcgttctaactcatgagactatggaaatgagtctcgtttggggttattgatgctaacatatgaatttattgttctagtttgatgtataaagattttgacaaattacactcacgacgagagtggcttgattatcgtttcattaaaaaattatttaattcaaaagagtaatagtggtggttatgggtggagaaggtgcgattagtggccagtgctcacacaactaaacataagtcaaagctttcatcattatataattgccaacaaattctaatatcttgaaagttgaaactaattaactaacgtgtagaacaagctcgagattattcgtttcgtcaatccgaagaaaaaaaatcttagaacgtcgcttaatggtagactcaaaatgcatcatttcgtcaataaacaacaagaagaaaaatacaacacaacatcgctatcacttcagaacatggtttagcttgtactgaaaagataagagtttaataatcttagaatgacatgacttcgaaatagatctcaatcaatgtaaggattttgtttttgcgataagatattaatgcaatgatatagtaatacaataagcatgggttggatatttcatatttggagttgacgctgactttgatagtcacgggttggtcgctttgcttctagacgtcgaggacccatcggtttctattattttcgtttttctaaataaaattcgccgaaaattatctggtaccaataatttcacaaatttatgtaaatttttaagacaattattttctaagatctatctgcctgattgaaaaataacgaaacaaaacactgtttcattagttcacaaaaacgtaattttcaaaaagtgatggttgattagtttgacaggaataaaactgtcattttcagaatgtacaagtaagtcaaaatatgcggcaaattcagataaaatggctgataaaagtaagattgtcgatggataattgtggtggagaaagaataaaaagaataattgaagactttgaagttgctttgatttagagacgaccttcacaatacggcagacgagaacttacgccattatccattacgttgccttgttttctcaaactattcctacaaaaaaacgtaaaagaggaaatatccggaaaattactccgaactttagaagattcttgcattgatcaaaatctgtttttaatttcatatcactcatgaatttgtttgtgttggactattcagagtttcagacagtgcaaattagtaaaatattcttactattacgacgtaagaagaaaaagacaaagaggctggccgacgatggctagatataatgaactttagaggttatatgtttatcgtttactggttttgatcagttcaaacactcgaaccgaatggttaatcgataaatatacaagtttattatgaactgaacggttaacggttactaaaatagactttaccgttagtgacttagctcaattccctaaatcgaaattcggaaaatctcggtctggttcgacattctctattctgtttaaagttccatgcctagtaaatacgaattgcaaattggcaactacccaacgattgtataacttatataaccgtaacagaaatccttgttttttctatgttccgcattgtgggtgacaaaacagaacatacaaaaaagtgacaaaagcaatgacgtcatgatgccccgtgcattaaaacagaacataactcccacacggcgtcgttttctgctttcaataccccaatgcgatcggtatctttcgttgaatcgtaagaagacaaaagtccactctttgacttctcttacaattggaaaaactctcaaactggaaaattttccaagttttcttcttttgttgacccaacaaccaaaatctaagaatttcaatttcaacttcccgatcgtgtctccttcttgattctcaatcacccaatccatttcaagagagaagaaaaagaaaacagagcaaagatcaaaaaccttacacaaatgctttcttgttcaatttcaaaagcttaaccactaaacccagatg

SEQ ID NO: 9363 - DNA, 1705 bp, Unknown
  misc_feature (1)..( 1705): cDNA_ID_2038322_gDNA_ID_1972105_Annot_ID_178687 3000 nt of promoter + ATG
gaattctacgcctgcaaaaccattgacaagcgcgtgctcatcgacgcattagatcgcgagtgtatagagacggagccgaggatcatggcgatgttaccgccgcatccgaatatcatcaggatcttcgatctctacgaaacagaggattctcttgcgatcgtcatggaattagtcgatccgccgatgacgatttacgatcggttaatctccgccggggggaggttatcagaatcagaatccgcctcatacgcgaaacagatcctcagtgcgcttgctcattgtcaccggtgcgacgtcgttcatcgggatgtgaaacctgacaacgtcttagtcgatctcgtaagcggcggtgttaagctctgtgatttcggatcagcggtgtggttaggcggagaaacggcggagggagttgtgggaacaccgtattacgtggcgccggaggtagtgatggggaggaagtacgacgagaaggttgatatatggagcgctggtgtagtgatatacacgatgctagctggagaaccgccgtttaacggtgagacggcggaagatatatttgaatcgatattgagagggaatttgaggtttccgccgaagaagtttgggtctgtatcatcggaagcgaaggatttgttgaggaaaatgatatgtcgtgatgtttctcggcgattttctgcagaggatgctcttcgtaagtcatcttttttttctcgattttttttttttttttgagtttgctcatcaatttgtaatggtgaattgcaggacattcatggatgatgaacgttggaaacctccaaagcaattagtcgaagcttttcagatatgtgattagagagtgtaattagagaagtcgtaatatagatgtgagtgtgtaattgtttgattcgaatagtcaaacgtagttgtgtgtttcagcaatcttcctacgttttgtcactagagaaagtatgttgaaaactttttgtaacgattcgccagattcagaataaaattgattttgagatcattgttgagagttaggtcaaaatctgaattcgattatttgctccccaagaaacaaaaagaaaagattactatggttggtaaatctgggccagtagaagggatctttcggaaattgggcctaactgatgaagtttagatattttgggctagatttgtcgaattttggggcccgtttcaggctaattatgatttgttcgagaaaaaaaaggtttcgaagtcaatgcaaaggcaaatggagttcaattattctccagacctggttttcacattaactaatactcaagtaattcgtctagactctaatgtatactagggtttttaaactaaaagggacatttcgtttttaaaaacagccgtggactgatttactaaataattcttttctatataaaaatatcttatagccaaaataaaatattattagtatatatgtgaaagaatatccaccaatgttaagaaacaaatctttttttaagtcaaaataaaatatggttggtatattgatatatggaagatacatcaatggtgagaaagagaaatgtcaaccttgaacctaaatgttctataaattcatcttttacttacaatccagaaaatcacaacatcttttttgaatagattttatagctgatacaacgagcaagagaaaatggccatcacaaagacttcagtgactcttttacttttaataataatg

SEQ ID NO: 9364 - DNA, 3000 bp, Unknown
  misc_feature (1)..( 3000): cDNA_ID_2035756_gDNA_ID_1972105_Annot_ID_178693 3000 nt of promoter + ATG
tggaaaacataaaagaaactgattatggatggaagtatcacatgctcgcagtcacagacatttttataccaatgggaagttattaatcttttaaaaaggcaaacaggttaatataaaaagtaagaaaacagcacacctggtcaatagcacaaggaatcaagcagcggagattgtccttgccagggaacaaatgtgggaatgagctaggaaaagatggaactgcctgcaaatatacggaaaacaattatacagtctatatgcagttagaatacacatagccacaccaacagaacaaacgacatacctgcacaggagggaaactgagtttcgcgataggatcttcaccggaaaagccaaagattcccatagcctagcaaagaaggagatatacaaatgaaaaccacaaacacaaagtagctatacaacatatcagccgcattgtgcaattcaaggagatagatagtaaagtcaccttattaagtgtaacgcacttgccaaccttcaccatatttttatagaaagcactacacacaaagtttttgcatatgatcagccaaatatactgtgatacatcaatcaaaaaaaaaaaaaaaaacgaaggacaatatatgatcttacaaatcttcgccaaaaaaaaaataaaaaattgagctacatgcatgtagactatatgtactaccaagagctcttcaagcaatattttctacaaagcaagagcggtgctagttatttccatagaagattcgaatgcgacttacccgccaacatagtcgaagtccgagaaaatgaaggtctttgttacatcgaatccacaagcaataatatctttcgcattttctctggcaagtctttgactttcctccaccgataagttcttccatatacttttttcatcatccgtgagctgtataacaaggggaaccttgaaagcttcttgcaagtatctgcaaaccatttcaagtataaagagcaagcacaatctaccaaatccgtaaacatggtaagacaatactagctccaggatctcacttacttggtaaacatgaaaggaatcaaatgccccaaatgcaatgcttctgatgaaggtcctcttccagtgtagagatagaacttgtctcctctctcataagcgtccaaaatctcattgaaatccctgttaaaacctcacaattaaaacaagcaagacgagaaatttctacacaattaattaaaacagtgaatgtctaaccggtgggcgaagaagacactacggcggaggaacacgtgtggttgacgagaagtcagtctctgaacacgatcaatcagtgactcgtcaagcctttgacatccaaatttgtcaataagcttgtcgtaatcgatcttcccgccgtctttggcggacacttcccatggattcaccacttgctccgaagattcagcctctctctcgtccttcttatccacctccatcgcgacggaaaacaaaaacctatacaaaaacagaagtcagattcaaaatcctattagcaaacaagctgaatagagctgaatgaaattgttatatccaagtacctacggttgttgccggtgataagacggccgtggatatacggcggtggttttgcgactggagatagtctttagactgacgaagaacaaaacgaggtttaagtcatatatttattactatttgggagtcagaatattttatttttgtcaattttgccgtcaagttttagatatacacattacccctttctctctggcccaaaattaaaacaattatcgtcatttatccctttacttttagagagaacaaatatccccctctcgttaattttttcaattgtatcactaatcaaagtctttgacgccatgattgcctttttcactagaagttcattcatcatctaaatgcaccggtccggtttattgaatatcttcttcgtctttctttctgatccgttaataatctttccatagtctataagatgttatcataatttcataaattttcataatccaatagttgattagtttatgcactaaaataggtgttaaaagattttagatatgaaaatcatgttttgtgaatttgagaaagaagaagaagggagaagtttttggagtgttgtttagtgatggaagaaaattctgatgatgtttataactaaacaagatatgtcaagagataaaaaaaaaagagtggtgagtgatgggacgtttgattctctcattggtcttttcatctctaaaggatgcttcggttagtcaatacaagacttgaagatgcattaaatctgaaaaggccggcctttgagtttttatggagttcattttgtgctagctacatttttcagtacttgaaatcccatccgtttatgcaatctcctagccaaaacagatcattgagttccaaacagttacaaagtctttttttcccctttgtttgatgctttgttgcttgtttaggaagaaagtgaatatgtggcctaaccggggtattggttagtgattaaaggcctttgttgaataccaatgttgacgaatgcaaagttgaaaaaggagttcaatctttttgttacacccccattgactttatcattttcttttaatcattcaaatcatggtttctttgaaattggaggatatgttaaatcaaccatgtactaaatgactagagaaaagtgaaaaactgagaaggtgagtgagtgatctttcgtttccctctgaaaaaattaaatttctgtttcctcgagaaataaaaacagataaaaaagggtaaaaagaagagatgctttaacacacataagtcaaaaacatcttaagtcaaatctagaagatctaacggttgagattctatctcatcatcttccttcttatcgattaatatataagtataaaataataaaaccctaaaagaaaacaaaaaaaaatgcaaaaagaaaaaatgaaaaaaaatccctaactctctctctctagaaattcttatttttgtgcgtatctctctaaaaaggaatg

SEQ ID NO: 9365 - DNA, 3000 bp, Unknown
  misc_feature (1)..( 3000): cDNA_ID_2035748_gDNA_ID_1972105_Annot_ID_178697 3000 nt of promoter + ATG
tctgttaagcatcgtgtacataaacatccatacataagtatcaagtataaaatgatagagatgggaaaaggatacgaagaagcaatggagcaattatcttcgtcatcaatatgcttcttgttctcgggttgcaatggcttcctcaccgcgagaagaggagcatcctgctgctaaaaaaaacattaagaaacgggtcaaaatcggatttaggcctcaatcatataccatctacaaagcgttattctcaaaaccaagatcttatgaattagttttacctttgaaactttagcatttccattacgggttttaggtgatttctgagctccaactctctcagcagatccaacatttggtgcattctcagaaagagacttctcctctgtgcattctttgacttcaaattcctcatcagtctcctctgcagctatcttaggagcaacatgaactctagcgcttgaaacgtcggcgtttcggtccataagcacctcaacaacttctcttcccattccactggacatatccaccaaccaaagacaaaacaaacagattctctattacacagattctcaaagacccatttcaatttgtaaaatctcagctttctctataccctagcgataacaaaatataatcttctaaaagttcacaactcttttttcatctgacatttcaaaattggaacgtaatgaacagagattggttcaaagttagaaacattcttgaatctgtagaaagggccaaagaagaacaattcaaaagtgaaaccaacacgcataaacaaccaaatgaagaaagagtcaaattttcaaaatttaaaaatccagatgggcaataaatagtaagaataacgaataaatttgaaaactttgagagcaatttttacagatagaacaaggatttaaggaagagcaggtacccaaaaaacagaagataaatgtttcaaccaaaatgcaaaacaaaaattgtttcttacaagtcttgtaggatataggaggaaggattcttgtgcagcaccacctctgtctcctctctccgatggcccgtgagaattttgcagacaattaaaatagaaatgaattgtctttttatccagaacaaacttgtctccctctctctttctctctctcaagaagagaaaaaaaggatttttttttttttttttttttttgggcggtgactattttggaatggtgtttgatttgtttaagctgttggttatttattgggactttgcatttttcaaatttaatatattatttttcaaatcggtttactttaattttgtttggattttattggcgcttttactacctcatgattcttcttcattttaaaaatcaggatttgaaaaattgattcaccttatatataatcttgcttagttttattttgaaatgtgtcaattaatttccaattagtttttgagtttaatgtatcaaaaaaatcacaataatcatttgttaagcagcagtatcttagaaggaaattcaaactcatcaataatcatcgtggtcattaaagttacaagacggatacgaatgtgaaaaatacctcatttaataataatcataaatacaccaatgtgacaagttacttctatttaataaccacctctcgactaacgtgataccagtatttaacccgtcacaggctttttgagttttatccaaatacgtaatcctattgagtatttttaaccttgaaggctgtagtagagtacgtatatcactttatggagtatagtgtaaaagagaactataagctttaaaaatgcttcatgacgagtttaaacatcaagagtgtaattttatatactttccctcgctactttgtttaaattttcgcagctttgttctagtattatttttcgaaatatggtttggcttgtgaacgcatctacatatacactacgtagaaaatttgaaagtataatagcatacaattgtaaaacagtttatacgttgacaaaaagaaaaaaaaaaacacaagaaatttcttctatatttgtttttttaatttcaaaaatttagttagatgaaaacatataatactaattggtagcctagaaacgtccaattccgaccgaatacaacttttgttattgaaatgagaacaaaacaatggtattcaattgaataacgtaggacccacgttgcttttggaataacgtaggacccacgtcgcaactcaaaaatcacaaaatcttcatctatcctttttggcggcaaaatttcttaacgaggataatcaaagaaaacaaaaggcaaatcggtcggttggtccaacaaatggtcccagagaaaaagatattgcctatgaaaaatggctaccaccttcaacgagattggtctcatgtattgtggtctgtggatattataatataccacacagtctacacacaatgaaaacgaagttaaaatctctctctacaatatatcataattttgtccataacactattatatgatatcaacatctaaaagttatataaatcaggattataatatcaaaaaaattatattattaaagtttggtttaaatttttttattaacttacatgatcaatgggatccaaaatcagtttacctctcacattgttttggtgctgaaaagaaatatatagatgggtttttaaaagaaacttaggcccatttaggttgcaaacaaaataactcaggcccatttagatttacaaaaggctcaaccactaaatttttatacctcacaagcatagtggtctctctccgtcattcgctctttactcggtcaacgaaccgtttgaagacgaacacgtgtcacgttttagtaggacttacgagaagcgcaacgagtgctatataaatgccgttaagcgtcgtaacggttttctaattccccgagagtaaccaacaacccaaagcgatcaaagaacttttcccgctagagagagagagagaagaagaagaagaagaaaagttacgcagagagactgaaagaagagtgatcgatcggagaaagatg

SEQ ID NO: 9366 - DNA, 3000 bp, Unknown
  misc_feature (1)..( 3000): cDNA_ID_2035731_gDNA_ID_1972105_Annot_ID_178703 3000 nt of promoter + ATG
cttcacaagtctggtggagttgtagccagggtcaaagaggtccgtaaaagatcaaggaactttaagattcaggtaaaattttcaatctcaaatcttttaatatcccttttttcatgcctttggaggtgtaactcagaactcaaaaactgaattttccaggaatatttttacggtttatcgaaagaactctctccgtatgccaatacatcgagtttcagtgatctgcaagtgttccgaattggtggtggaccacaagcgccaaaatcggctcttccagccgggtctacctcggtttcaaatccgttgcgggtgacgcctgtaaatatcgatgatcgggatctgctgcattctgttcttgctgtctcatacgcagaagaaccagaccagatcatctcaaggtaatctctaaaagttcttgctgtttccagaatcaaaggctttcgtgtatgttttcttcgtgattttgatatttctttctctctgttttttctttgatacagcaatgtttctgggtttgtgtatgtgacggaagttaatgtgcagaagaagaagataacgtatttagcaccatcgcctgggacattacctagcaagttgttggtcgctggatcattggcatggcttgagtcagtatgacttacttagagaagagaggagccatgttttttgcttgagagaatgatgcagcagctcgattatgtaacgttaattacaaatagcctttttcttctttatcaaatgcacaagtttttgagtttaaaagatcattattgcggaatagatggttggttgtaatttgatgttatgaagtgagcaaaaaataatgttgatttactagtgcgttagttctgtttgtttggttcagcatattcaagtgatgtgtgtagcatttttaaatttgataggtcgaacatatcttatgttattggatgatttcgaaatagtatatgataatgttcaaagtcacacatgtattattattggttattaattcaactaaattactatcacattttaagtcacttcaattgtattgttgtataagctctgtatttagaatcggatccgaagaatattagttggtctgtctaaccaagtcgcattaatcttatatgattctcctagaatagaaaagaatattttattcttatgctaattcaattgaaagataattaaaacggatatgttttgagttcaaaatgttaaaattgtcattcatttgcaatagacaaaacatatttagaaaattctaaatttacatgctacaagatcttctatatgctttaatagcctcatttttttttttaaccctgcacattaaatacagaaaatttcaatcatttgactgatgattagagatttatagatataagaagaaagtttcacttatcattgtgaatatgataaaacaagaataataaaaatatcgtataattaacaacaagaacaacaaacacaaaaaaaaaaacagaaagaaagaaaacaaaaaagagctagtcaacaatcgtgattcgtgatacaacgtgctagagagacgaccagatgagatagggcacgtgtcgaaatctataccgttacttttctaactccgtgctcggaattcgaaatcaacgggagacacgtgggttccacaatggacgttatttccatttcatgacaatcgagaaatagttaaataaaaaataaaaaatattttctaaaatgaatacaaaatcaattcgaattttgctttggaattagaatcatttttaaaacatatgaatatagtagtacaagaattttactgagtcaatgtccaattatcattaaagatatttgactctaatccattctctttctctaatttttctttaaagatattatagttaatcacatcatttactttaagagaaagatatccgaaaatcagaaaatgttaagatacattatctaatttcctttaattgatacggtttatgattttaatcaattttctatttgtacgaaaaacagtaggtataaagtaggtccactagtaggacccacctaagaaactcttttttaacagagggctctgttttttttttcttcctctcctctgaaactgcgacgaccacatctctgttctgtattccacttatgtttttgtgtttggttttattttccccagaaattgaataactttagcttttaagaataaaaaggaaaatttaaaattgaaatttggtctccttgagaagtgaataaatgaagaaaaaaaggaaataaaaaggggtttttggtaatatttaaaaattgtagaaatggtggtggtgggggaattttaagtaaaagcaagtctaaactcttccccacccacaaagcaaaagtcataacctttgacacttttttatctcaccatctctatctctctctctctctcacaaagaakcaaacaagacaaatctttctttctctttattttatcctaaaatttcctatctgatttcttcctcttgagctaaatttgttaccttctgggtattcaaaaagatctcattttttcttctagctctaaattttcagggagtttctttcttcttcttttgaagaccctttgtcatgagctaatttttatcctctgtgtgttgagaaagatctcattttttagctttaggattgagggagtttcgatttttacttagcacttttccttggaagtgatttggtggaactcatggtgattggtttcttcctagggttattagagattgagttctggatttttcacgcgccttggatttgatctaatgtactctcttttttcatgtcttaatctggtttagatttttattttgagatcttttgttatataggttgcaagttctgtattttgttaggctttttagtttctgtgttgattatgattctcttggtctaggagagatttgggtgttgttaactgtttgagtttgagaattgtgaaattaggttttttttttttggttctctgatctgaaacttgggtagaagaaaaacatg

SEQ ID NO: 9367 - DNA, 3000 bp, Unknown
  misc_feature (1)..( 3000): cDNA_ID_3041600_gDNA_ID_1972105_Annot_ID_178706 3000 nt of promoter + ATG
ggaaacacaaaccagtttcatcttttgcatcagcattgagtttcagttcttccaaaagatatctgcatatttcagtttgtccttctctcgcagcgaagtgaagcgctccacgtttgtttgcgtctttaatactctccacagttttcgtcaagtcttttccttcatcaagctgcttagcaacatctgcttggagaagtgataatcagtacacaaaacatataactgctcaaagaaaacagagaaacgaaaagtaaataaagcactcactcttaaggaattcgagatttccggtacaagctgcattcaggatttgctgaactttctccctcgctagagtaagaatccaaagatgaaacgaaaacaaaaattataattagagattcaaactaccaagtgtcaacttcaattctaatctacttataccaaattaaagaaaattttcaattagtatttgagtttctacagttctagtaatggccatagccgaaacattatagccaacgaaaatttcacaaaaggaagaagaaaaggcagcagaggaagaaaaaatcgaaacttcaccataagatcaattcagctaaagaaaactaagagagcccatcaaggaatctatagttcatacgcattcaaaagacagagatcgatacatcattctaaaatatagaaaagagcatacctgcaagagcagtagaagcatcaggagccatggcagatactaagcccttcgttcgtgaaacttggagtgggttttggatatcggagttagttccgttcgtcgataccggtgtttgtttgtgtctgtctgtctgattatcagaaatctgaaaaaaagcttttgccttttaatttttcagttggtcggagtcggaggcttctaggttttaagaagattccagaggtttttttttggttatcttttaataaatttgaatcttagaccctcatatatttaactattacaaaatacacccaataatacgttttgtaaaaaatacaccctgacttctcaaatctcttcattttcattctaacgttagatcaaaatgggcttattttcagtttaagaatcgattatctagaaaaaagttcattttattatccaatccaagatcatattgtaatctttttttttgtatacatcattacagcttatgaacaagaggtgtttttctttttctttctctcatcttgtgagttatatacagagccacaattttcatctctttttctccaaaattttctagttgttttttgtttctttcgaatcctaattgtaaaagattcgcttcttcctatctctcaaaagaaaatctgagtgcttataatcttcaataagactgcataacagaacatgcaactgcttgtgcccaatgtctcaacctctgcttcatttgttgaggatcgtcccctgccaaaaaagatcatattaaaccattagtttataaatgttattgcattcaaaacaaaataccaaaaacatgagtttagatacctgggcataagattttaacagaatctgaatcagttttctttggactacaaggtatactgtatgagaaagttgacgcagatgcactgctgctacggctgctgctaggtgaaggaagaggcgagagctgacgattcactgcaaagtaaagatcaagagctggtaatgtattacaaagcttttgtcctgcttcttcattgaaaccgaaacctagctcaatcgatccttttagctcgtttaaatcttcatccgttagattcgcctgtatacaaagattgtctgaagcgcccttatgaagcagcttcttttcttgaatcattatcatctgacgccttcttctttcccaagcaacgtctcttggtgtttcacacatagatagttgtttcgataaacgatgttttggtttctgtgaggccaccggcgttgtcgctgctgatctgacctcgggaagcgccggttttatgattggcaatgtaagaccttctcttcttctcaccattttttacttgatgtgtatataaagcagaaatgaccagaagctaatgtgttaggtggcttgtgaatgcaaattggggctctagtttatggttttactacctctttaagagactatgatcaaagcttaagggctttgaatcctgtggatttttttttatgaatgttcttagtgtgatggccgcgctcgaacatattacgcggccaacaaaaaaaggttattatgggtcgggttgatcagatgtctacttttatgctcttctctagttggatttttcccaacccgaccagataaactttgaagagactcttagtgctttaatggagaataacaaactagtttccaccattgatctatgtaatggataaaagtcaaaaagctattttcttccattgcttaaaatttgacgattgattcatccagatctttagggactttctttgtttagatccttgaccattctaagaaaagagtttcaaaacatgtcgtagtctatctctatcaagtcaaactttcaaaagtttgtaataatgttattgaaacaatatggtctaagagttctatatttagattacatgaattttcatgttgtagtcaaagaacaaaagtcttttcagtttctctaactatatgctaaacatagcttgttcgggtaatcctctccaccacgaatttttctaactaattttgtttctctttcagacagaacgacggaaaatgagaaaaacaccagtaacctcataattacaaacaaaaaaaaactagacaaaacgagaaaatagaaaagaaaaaagagtgtgtaccttgtttttttttttcttgcaaggtttttgcttcttgttcatccatgcaagtcctgactttctatggttaggttacagagacaataagaaataaacttctaattttgtccacaagcgtaaaagtgatcttaattcttacaaaaaagaaagcttttctctcctcattttttgtttaaggcaaagagtctctacccgttgatgtgtcagccatg

SEQ ID NO: 9368 - DNA, 3000 bp, Unknown
  misc_feature (1)..( 3000): cDNA_ID_3041594_gDNA_ID_1972105_Annot_ID_178708 3000 nt of promoter + ATG
taccaagttcttgtcaacccaccggagtcttggcttccagggatgtcctgaccaccaacattaagtctaaacattgactgaagattcgcagtcttggcatccattgtttggtctgtgaaaccaacaagagccgccgtgtcaaacaattccggcatctgaatcacctcgataccgtttataaaggcaaatgcgtctcggtatttatctgaaggggtaaacttgatgctcaaaacatctttgtcagtgggtgcaagagagtattctttaaccagataagcttgagtcaaagcttgacacgtaatcgcggcgctgaaattgctcagtaaggtaacatcgttagcttccacagtgaaatacgagttggaaatgttgagaccggtgtatgttgatgggtagaaatataaccgaagcaaatgtcttttatctcctttaatcgggatttcataagttgctggagctgtaaagattctggctgtcatataaggaactgttgagagaagtgaagggtcttgatatgtagccgttgcgtgaattgagtttccagtctttaaaaactttgtatctggttcccattttttcttatcttggtcagcagaagcttctgatgtcccgcagctcagagctaaatcttgtccgttagatctagttggaaaaaccaatagaaaggagagacatgtgaggaaaaagagaatccgagttttcccgctcatggctgacacatcaacgggtagagactctttgccttaaacaaaaaatgaggagagaaaagctttcttttttgtaagaattaagatcacttttacgcttgtggacaaaattagaagtttatttcttattgtctctgtaacctaaccatagaaagtcaggacttgcatggatgaacaagaagcaaaaaccttgcaagaaaaaaaaaaacaaggtacacactcttttttcttttctattttctcgttttgtctagtttttttttgtttgtaattatgaggttactggtgtttttctcattttccgtcgttctgtctgaaagagaaacaaaattagttagaaaaattcgtggtggagaggattacccgaacaagctatgtttagcatatagttagagaaactgaaaagacttttgttctttgactacaacatgaaaattcatgtaatctaaatatagaactcttagaccatattgtttcaataacattattacaaacttttgaaagtttgacttgatagagatagactacgacatgttttgaaactcttttcttagaatggtcaaggatctaaacaaagaaagtccctaaagatctggatgaatcaatcgtcaaattttaagcaatggaagaaaatagctttttgacttttatccattacatagatcaatggtggaaactagtttgttattctccattaaagcactaagagtctcttcaaagtttatctggtcgggttgggaaaaatccaactagagaagagcataaaagtagacatctgatcaacccgacccataataacctttttttgttggccgcgtaatatgttcgagcgcggccatcacactaagaacattcataaaaaaaaatccacaggattcaaagcccttaagctttgatcatagtctcttaaagaggtagtaaaaccataaactagagccccaatttgcattcacaagccacctaacacattagcttctggtcatttctgctttatatacacatcaagtaaaaaatggtgagaagaagagaaggtcttacattgccaatcataaaaccggcgcttcccgaggtcagatcagcagcgacaacgccggtggcctcacagaaaccaaaacatcgtttatcgaaacaactatctatgtgtgaaacaccaagagacgttgcttgggaaagaagaaggcgtcagatgataatgattcaagaaaagaagctgcttcataagggcgcttcagacaatctttgtatacaggcgaatctaacggatgaagatttaaacgagctaaaaggatcgattgagctaggtttcggtttcaatgaagaagcaggacaaaagctttgtaatacattaccagctcttgatctttactttgcagtgaatcgtcagctctcgcctcttccttcacctagcagcagccgtagcagcagtgcatctgcgtcaactttctcatacagtataccttgtagtccaaagaaaactgattcagattctgttaaaatcttatgcccaggtatctaaactcatgtttttggtattttgttttgaatgcaataacatttataaactaatggtttaatatgatcttttttggcaggggacgatcctcaacaaatgaagcagaggttgagacattgggcacaagcagttgcatgttctgttatgcagtcttattgaagattataagcactcagattttcttttgagagataggaagaagcgaatcttttacaattaggattcgaaagaaacaaaaaacaactagaaaattttggagaaaaagagatgaaaattgtggctctgtatataactcacaagatgagagaaagaaaaagaaaaacacctcttgttcataagctgtaatgatgtatacaaaaaaaaagattacaatatgatcttggattggataataaaatgaacttttttctagataatcgattcttaaactgaaaataagcccattttgatctaacgttagaatgaaaatgaagagatttgagaagtcagggtgtattttttacaaaacgtattattgggtgtattttgtaatagttaaatatatgagggtctaagattcaaatttattaaaagataaccaaaaaaaaacctctggaatcttcttaaaacctagaagcctccgactccgaccaactgaaaaattaaaaggcaaaagctttttttcagatttctgataatcagacagacagacacaaacaaacaccggtatcgacgaacggaactaactccgatatccaaaacccactccaagtttcacgaacgaagggcttagtatctgcc

SEQ ID NO: 9369 - DNA, 3000 bp, Unknown
  misc_feature (1)..( 3000): cDNA_ID_2990461_gDNA_ID_1972105_Annot_ID_178712 3000 nt of promoter + ATG
gaagcaatagtaatactgtaatagtgtaacgcatgtaggagtagcaaggccttctcacttgtccaactaatttatgttgggcggcaaataaagaaccagcatgaatttttatatatactttgaacccaataccaaaaagcccagcgatgtgttcattctaatagttgtctacaaccaattttgacacactattttggtgtatttataattattattagtttatgatatttgcatattattgatgtaaaaaaatttctgtaagaaaaaagtgctttgttttcacctccatgtactggaagaacatgaaacctaatatattgatatactatattagagtacatagaactctttgaccaaaaaaaaaagagtacatagaactcaaatattgttgactactttggctataaaactgttttgtattagtattactatgaccacaacatgcatatctaaaagctagtttgactactttggctaaaaaaggactatatctataatacatgtattactaaagaattctgtaggtacattttctaccggtcaattcaacatcctattgtaatttccttttaagtaaaagttgtataagactctttcacaattatttattcactataaataccacgaactgtaccattcttaccaacaaatatatatttctcccacacacataaataaacacaaatcatgagcaatatgaaaataacaaataggtttatgctagtggcaacattcatagcatgtgtgttcataagcagcatgaacatgacggttggaaaagtaattgggtatccagggttgaagcctgatcttccttgtgatcatcatcggtatccttctgcatgtgcaccctccgaacaaccagtgaatccttacagacggggatgtagtaaaatacatagatgtagacgcgattcaccccctgcaccaatttctagaaaaatgttaatacgaggtcaattaatttataataatgcatataatgcatatatccaatatccatgaataataaatttatgggtttggttgtgtttaagccatgttgttctctacatctacacatttaccttaatatttttcagcatgtattattgtattacgatatatacagtggtgaaatcttgttttatcattcagttttgttcgatttaagctccttcttattaatggtaaaataaaacaaatcagatcacatatattcatagcatttaaggacctagtgtgtcacacgtgtgaacctgtaatgtttgttatacacaacaagacaatgatttttgactgggcccagcccacacgagggtcctaacatctctcaacagggttggtgtttttgggcccaggtggacccttttatctcattctcctcctcctcctcacgtttatatgaaatttttcacctatataaatttaatcaattttatttatataaaattcttgacatgtagattataagattaagatgaagtcgttgtcaatttggaccttcaattttttatgtcagattcttccatcgtaatcatgcatgggggcatgaacatgatgatgtttagcaataaatgatgttgatgatcattatgctgttataattttattatatataatttgcatggagccatttatttatcaacgctattattattatgctcctttgtgaaaaaatactacattaccatattttagggtcgacgaaatgggcatgacatgtaccgccgcccataccacatatggttgaccatttactgttgagttagtcgtgtttggccctccccaccgaagattatataacccaatacacataagaattagttagcatttgcacctgcatagaaaaaaattagcactagattaaattattcccagcattatactatattataatcattgatcggaaggaatgtttcctaattacataattggtaatcatgtttaacgcacaattacttgaattaacatgaatccctaattatctattgacttcacaataatccatgaatttagagccaagacaaggccacaggggcacatgggaagtatagtacgaaaatgctatggcagaccaggacttttagttcgtttaaactttaaaatttatttgaattcaattagtatttgtcggcattttataatataagaaattgaaaatagtcttaaaaaaaggcaagcataggccaataggccttgtgaatggcggaccccataagaaggacaacgaacgaatcgaatccacgggaatcaaaacacatgtttgaagctgaccactttcgatttctttcccatctgtgggctccattatgtcttagctgtcattttttaattccattttcatataaaccatcaccaattaaataaaaataatctccgacaaaacactctttatttatatatttagtctttttcttcttttttttctttgctattatttttcatcaaattgatatttctgtttttgatattttttcaaaagactcgaatatcttttgccgtaaaaactgattaaagtactaaaaagaagaggtatacctttttatgcgagtggtaaaaatgattcatatttcaagtttgattagaatttattttgggtggataaattcgacacagaaaaggagagactgtgccaagttggcctttgcccactggcttggccgcaattattctcaggaaaatgacgccattcgtgacatcattctctcccgacaacactccttacggtccaaccaatcccagcatccacctggcaacatcacctccgttcaaataatcatcctcaatgatcaattccatatataattttataccacacacgatccaatatttagccctttgtttctctacacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatg

SEQ ID NO: 9370 - DNA, 3000 bp, Unknown
  misc_feature (1)..( 3000): cDNA_ID_3041585_gDNA_ID_1972105_Annot_ID_178716 3000 nt of promoter + ATG
aatgaggcaattaaaagtttcgatttaaccccatgatcttaaaactagtgagaataagatagttaatcattttcatttttttcgaagaaatcaaattacttaacatacttaatcatttcatttcctatgtaagccacttagttccggaatggttggctcatgaagccaacattttcgaacgagtttaataaagtatgatgttttggagataaaaaaaaaaaaaaaaaatactttggatctacatgtgtgattgggtaatcgaggattggttggctaagcaaacgacaacattatataataaccaaaaagtggaatataattaaatttttaattatgttagccgaaagtgaaacggtatctaagtatgcgtgttatggactcactcaccattaaataatttaactgtgttaaccaaaataatttgaataaaatatccttcgcatcatcacacttttgcagtcttacagttcatggttcacatgctaacaccttccttaaagattaatgattttctattaaaaaaaaagttaataattttcttttggagtgtgagatataaaactttcgctacgaagaaaccctagagcaacaccttctttttctctctctctttagtagaacttcaagaaggttgacaattcgagctatgttaggcattgatgaaacttcgattaattttgttttttctgtatggcatttgaagacatatttcgtttggaattgaattatgttatgtttcgttatgttatagacttatagtaaaattgtgccggtttggtattaaaaaaatcgcaattttagtgacgtaactattatcataagattctttataaaaaagaaagctattagcaaaatattacagaataagccatgcaaaacgatgacgatcctcttgttacatgtgacttgaagctatttaaataacagtgtttggttttcgataatgtttgcatgtgacttgtaacttaagatatccgtgtcaacatggtgcatgaatataaccttagatgataattaataaatgtttctgtgtctaattttcaccttctaatcgtatatactagagaatggtgttgtatgtgtcagcatgcgttgtctttaggcgtggcaatattcaatttgtatccttctttttatctgtaattaataacacgggaccacaagttcatgttctcactttttcaactcccaaaatgctttctttgtttaacatactaaatacctacggtttatactaattatttttcaaaatgtaaatactcttttgatgtttacaattcaaaattcaaactgaagttctatattcatagatcataaagaaagttagaaattctacatttaacggtctgtgttaagtacttctacttactttttttaccatgggtgagaaagtgaaaagatatccataatgaaatggaaaaacatctaatacaaaaagtagaatgaaattgatttgtattggttaacaacctaacatatgtaaatgtagaatcatgacctattaagcttctctttttccttaattcataattttattctagatgaaaaccaagattatagacacgtgtatcttaataattgtgccttaattttctgaggatccaaacacagaaagtgttaattaaagagcttaaaattcacataagactgactagtaaacacaactacagtttaaagaaaagtactactatgtattataataattttcaaataatgatttgatcagtcacaaatcactctcttagctaggcttcttcataccatatatatatcattcttctctctccctcccactactcacacgataaacaagaagctaacacaaagcacacatatatatacacaaatccatgtgtatatgcaagtaaagatatatagtcgtcttcatgtctgtatgtataccatgtaccagtagcagttaagctgccagcatgatcttgtcttcctctcttaggtttcatatatagttaataaatattttatatatttcttgttcttacaagattatatgatcatagcttagagagagagagagactaggtcatgctggtagtttcacctgctaatgattgtagcatgaaggagaagaagaagaagaagaagacatacagtaaatactcctataatcctttacattcagaaagaggatctcatgaaaacagcagagattaattatattaagcaggtatgtgatcgctccgagatttcttattggtcttttaaatttgtttctttcatatcactttgtttttgaacattaaattcttttcattaactgatgtataacttgtgctagtgtgacaatcatgaattcaaattagaaatttaagctaggatcatcaagttattcggttaagattgaggagaatatataattaagaaacttaagaatgtgataagatttgtcagtgtgatgatccaatcaataagtttcaaaaacaaaattatattaaaaatcatactacttggttacaacttacaactggacagagagggcttgaattataggttataaaggaatattctattaccaaagacgtttttaatcttacatgttttaaaagacattaattagaaaatgtagattctttttctttcttttctttttttgattcaagagagtattcttcttctttttttgtgggccaaacttcaagagagtatctaaagcccaaaatctaaattttgagactagaaacgtcgccgtttatctcaacgtaatgttttgacctttttgacgttggaagacaaaagtcacggaagtacgaaagtacaaaattggactctatcctatcctcacaaatttgcattgagattacaataaaacgagtggtgttgctctgttctgttcttcccacttctactccaaaaaatcctaacttttcgcattatcttcggttttgcgtttcgattttttgtctgaaaatcccaattcgacactctgtttctgcccacaaaactatcttccatgaaaaatcgaaactttgtctacaaataatg

SEQ ID NO: 9371 - DNA, 3000 bp, Unknown
  misc_feature (1)..( 3000): cDNA_ID_2035703_gDNA_ID_1972105_Annot_ID_178715 3000 nt of promoter + ATG
taaagagtgttttgtcggagattatttttatttaattggtgatggtttatatgaaaatggaattaaaaaatgacagctaagacataatggagcccacagatgggaaagaaatcgaaagtggtcagcttcaaacatgtgttttgattcccgtggattcgattcgttcgttgtccttcttatggggtccgccattcacaaggcctattggcctatgcttgcctttttttaagactattttcaatttcttatattataaaatgccgacaaatactaattgaattcaaataaattttaaagtttaaacgaactaaaagtcctggtctgccatagcattttcgtactatacttcccatgtgcccctgtggccttgtcttggctctaaattcatggattattgtgaagtcaatagataattagggattcatgttaattcaagtaattgtgcgttaaacatgattaccaattatgtaattaggaaacattccttccgatcaatgattataatatagtataatgctgggaataatttaatctagtgctaatttttttctatgcaggtgcaaatgctaactaattcttatgtgtattgggttatataatcttcggtggggagggccaaacacgactaactcaacagtaaatggtcaaccatatgtggtatgggcggcggtacatgtcatgcccatttcgtcgaccctaaaatatggtaatgtagtattttttcacaaaggagcataataataatagcgttgataaataaatggctccatgcaaattatatataataaaattataacagcataatgatcatcaacatcatttattgctaaacatcatcatgttcatgcccccatgcatgattacgatggaagaatctgacataaaaaattgaaggtccaaattgacaacgacttcatcttaatcttataatctacatgtcaagaattttatataaataaaattgattaaatttatataggtgaaaaatttcatataaacgtgaggaggaggaggagaatgagataaaagggtccacctgggcccaaaaacaccaaccctgttgagagatgttaggaccctcgtgtgggctgggcccagtcaaaaatcattgtcttgttgtgtataacaaacattacaggttcacacgtgtgacacactaggtccttaaatgctatgaatatatgtgatctgatttgttttattttaccattaataagaaggagcttaaatcgaacaaaactgaatgataaaacaagatttcaccactgtatatatcgtaatacaataatacatgctgaaaaatattaaggtaaatgtgtagatgtagagaacaacatggcttaaacacaaccaaacccataaatttattattcatggatattggatatatgcattatatgcattattataaattaattgacctcgtattaacatttttctagaaattggtgcagggggtgaatcgcgtctacatctatgtattttactacatccccgtctgtaaggattcactggttgttcggagggtgcacatgcagaaggataccgatgatgatcacaaggaagatcaggcttcaaccctggatacccaattacttttccaaccgtcatgttcatgctgcttatgaacacacatgctatgaatgttgccactagcataaacctatttgttattttcatattgctcatgatttgtgtttatttatgtgtgtgggagaaatatatatttgttggtaagaatggtacagttcgtggtatttatagtgaataaataattgtgaaagagtcttatacaacttttacttaaaaggaaattacaataggatgttgaattgaccggtagaaaatgtacctacagaattctttagtaatacatgtattatagatatagtccttttttagccaaagtagtcaaactagcttttagatatgcatgttgtggtcatagtaatactaatacaaaacagttttatagccaaagtagtcaacaatatttgagttctatgtactcttttttttttggtcaaagagttctatgtactctaatatagtatatcaatatattaggtttcatgttcttccagtacatggaggtgaaaacaaagcacttttttcttacagaaatttttttacatcaataatatgcaaatatcataaactaataataattataaatacaccaaaatagtgtgtcaaaattggttgtagacaactattagaatgaacacatcgctgggctttttggtattgggttcaaagtatatataaaaattcatgctggttctttatttgccgcccaacataaattagttggacaagtgagaaggccttgctactcctacatgcgttacactattacagtattactattgcttcatagaaaaataaacctcgtaccaaaatctcaaataagtgtttcttgtggttccttatgaaaaattgttatacactattacagtattactattcaccgtttattgtcggaactcggaacaacgttttcaccgtccaattgttatacacactattcaccatatatacattaatacatcacacatcttctacttaagagtgtagtgtacattaatgataattttgtaattaacctttttaatgatggttaaaatgtctaattaataatttaatagtgacttacttgcttacgtggataaaagagagaccccacacaaaaattagattttgccgtctgttaaaaaaaaaggcttcttcagccgatttctccaaaaatcgtttttttttttttttttttcatcttccgttcaacgttttgcgttcgactcttccctgacccctttcaattttaaaccctttttctctgtctctcttgtccgaatcaaatccggttgctggaaaagggaagctttgtgcttttgtcgtcgtggtgggggaagcggaggataagaaccctaattttttacgaatcgtgagatctcctaagtttctgaatcgggtggtggcgattttgtttctttctccgcg

SEQ ID NO: 9372 - DNA, 3000 bp, Unknown
  misc_feature (1)..( 3000): cDNA_ID_1396989_gDNA_ID_1972105_Annot_ID_178720 3000 nt of promoter + ATG
catgtttatgtacattattcattaccattgaccaatataaaatcgttacagacgaatatttctaattaattatttataatttattcatctttattattttcgttataggttttgttaagttttttcgtcttacttcacacccacttataccatcgccttgtccatgaaacaatttatgagacctttagtagtttagggcaaaggcaaaccgcgtgagcatattaaattatagtaaccatgtcaacgtgaaatctatttttctttttataaaaggtcaccaaattatagagagatgttcaaatccactactttgtaccttagaaatgtgcaatcatattgcagggatgttcattgttcaatcccatcaacttgtggctatatcctcgtcttgtcttttcaccgtggtcgtattatagaattttgaaactaaagatatagatagaatagcactccttttcttatgtagtcattgtttgttttttatatcgattaatctttcattttcccaaaatgtactataactaaagaaagataacttgtttacattaccaacaataggaatgagactatttgtaactaacatgttaggtctttatctgagaaaattctgactttgacctctttagttctaccggttgctaaaagaaaattaattgacctacatagtttttgttttagaaacaaaaaattcttttaacctttagcaaaacaaaattccattgtgttgttgttaatggagtgatcagtgattcattaaaagatcggaacaaaagttctagtacaacaagagggcccaaaaagcccaagattagaatttaaagcccaacagttttaaaaataaaagataaaaaatttcggattgtccccgaagttattccttttgctgctcttgacttgaaagttataaaccctcacgattcatccttaaaccctaagcctaaagcagaaacgcagaagccctgataatggcggatccgatgaaccatagcaccgggcatcaacaacagcagaagtaccgtcagtacaatccttaccaacaagtcaatcttccgtaccgtaagctctacgaactcccaacttctcctgagtttctcttcgaagaagaagctacgaaaaaacgcttaacatggggagagaacctcaccttcttcaccggttggggttattgcactggatctgttctcggagccttcaagggtacaattgcggggatgcgagccgccgaacgaggcgaatccctaaagatccgaactaatcggattttgaactccggtggactcgttgcaagacgcggcgggaattgcttaggatccgtagggttgatgtttgctgctatggagagcggtgttacgtatatgagagacggagacgacggttcgttgacaactgtgatcgctggtttagccactggtgtgctttacagagctgcttctggacctagatccgctgtggttgccggagctgtcggaggagttgcggctttggctgcagttgctggaagacgcatcgtcaagcgattcgttccaatctaatgaaagtttctcaatctctcaaggttagggtttaagaactagtttaaaggaggggcttttagatagtgaatcattggtactggatttagggcttatgaattcaatttccactgtataaaagttgacatttttattgatctaattgctcaatccgactcaactttttgctgattttgtcgaattcacgaaattgaaatgatctcacataaaaactcaattgataattttacaaaggagaaaaatttgtcaatcaaagaagaagagaaagattgaacttttaacctcacttggtcataacttcaacgccattctttccagcgataatgacagaagtagccattccgagaaacagaccatgctccaccactccttgaaacttcccaatctctttagccgcagcgaatccatccttcaaaggagtcttaaaatacaaatcaataatgtaattactgttatcagtcacataaggcttgccatcaccatcaactctaagctttgattcacatccaaattccttgaagaggtcttgcaatctaatcaaattaaagttccagcagaattgaacaacttccaccggcatagctaatccacttccaccgagtcctgtaacgagtttggtatcatcagccacaacaataaacttgtcagccacagcttccaccattttctcacggagaagagcacctccacgacctttgactaaatcaagattcggatctacctcgtctgctccgtcaatagcgagatcgattctcggatgtgtatctaacccaacaagaggaatccctaacgaccgtgcttgttcctccgttcgtttcgacgttgggataccgacaatatcgtagagttcaccggaagagagtagtttcccgatctgatcaacagcgaaagctgcggtggatccggttccgagccctagaaccatcccaggtttaattgcctccacagctttctccgccgcgagcttcttcaaatcgtcctgtgaaagcgcgacggattgagccttgacggagaatgaaacggaggttcgaggagaagagccagtgctgcgtagggcaatagaaggagtgcgtagcgtaaggtgagaagaggaaacgaaggataaggaagccattggagagagaggattgagaatggttggagaagaaataaaatgaaatcgaaaggtttggtttttgacttttgagtggaagaggaaggtttagtggcaagttatagagttttgtagttggtttgagggtagtattggaatactagttttaaggttgttgtatttgggttggtgaagataataacctgctaaaccaatcagagtgttaaatatacgatgtcgtttttgtttctttgagaacagagttatataaaaaccttttttggtttggtttcgtggagagtctaattattttcttccactttctcgatctttgagatttctttcaaaggaagaaaaaaaaaaaaactcgcgatg

SEQ ID NO: 9373 - DNA, 3000 bp, Unknown
  misc_feature (1)..( 3000): cDNA_ID_3041592_gDNA_ID_1972105_Annot_ID_178710 3000 nt of promoter + ATG
aacgccttaagcaaaatgtttagctcttttaccataggtaaataaaaattgacaatatatctatctactaaaacatgatcctttttatcatatattgtttgaaatttgaaattttatttttcaggcaactatggaccacaaggaatgaaagatttcatgaatgagagtaaattgatcgatcttctaaacggatcagattatgttccaacatatgaagataaagatggcgactggatgcttgtaggagacgtaccgtgggagtgagtatttttatatctttaaatttatatatgaattattattataaatacgtctatacaaaatatttatttacatgttgtttggactattttaggatgtttgttgattcatgcaaacgtatacgaataatgaagggatcagaagcaatcggacttggttagtattgtttaatccaaaactggtggtgtaaaattatactatgaatctttgctaatactaattttctatatattgcagctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcattatcgtgttgtctatatggtctgtgtccgtaaggcatcttaatgtgttactttgacgtaccaaattattacttacattatttcatttctcaacaatctttttttatccaacattttcaaccaccttaaattatacctttttgtttgtttattctttattttagtaacttttcaataagtggagctaaatgacatgagatggttaacaatcgtaaaaccaacaaacggaagattagtagtgcggatctttttgtatcaatgtaactcgaagaccaattattgtcgtgcgtatatataaggttggcctcaacaggatccaattggtgtttagtgtctatttctttcttttttaataaggttggcctggcctcaattattgtttttttttatttctaatattacatttatcaatttttggtgttttttcggtgaaacacaaatgaaaaaactttaaatagatcaaggtaatgtgggtggtggaaagggcaagagcatgtggataatgtagagttgttgggggacaatattttaatgaattccgagtaaattaataatgtctttaatatgtatgctccattattgatgctttacgctgtcatcgacatccattgcctcaacaaacaatggttgataatgatgatatttgttttatttattatttatctgattttttagtaaatttgatctagtttgtatccttggttgtcaaattcaccacatgtatttacttgtttgtagaatacttagttcaatataaattggctgattttgctctcgttgtgaattacaacttgtaacttaacaagtacaaaatgcacaaaagatggttctcaaaaaacagattcacaaaagatgattacaagaagatgaaagatacacaaaaataaacaagaagcacagcttcgtcccaacaataattaagtaatttggggggaaaaacattttgggccatggttaacactagggaaaaaaaattggggccttacattttctcataataatgggcttttcatcaattttcttaaatattaatgggcctttggcccgataacagctaccctatccatttggtccgggcactctagaatactctcttcgctcttctctttctctcgtgtactctgttttatccaacttataacaatttgaagcggacttgatatgggctcagtttcggtaaaccaaacccgtattgcccgttaagcccatagacaaacaattcaagttgactttgactgaagtcaacacttaaagatctgtaggctcgccagcccagtctctatactattttagatcaaagctgaaaattcatctcgtgtcaataaagaaaaattacgaggaagcggatagatttgcttttttacttacgcatcatagaagaaatttgttaaactgctaagtgagttttgagaaacaaaattttaaataatccaaaatggctaattcaatggaccgattatgttaactttgattagtcaatgatcgaaattcaatatttatccaaatgagagcgactcttatctactaggctgctattttctacaaacaaacaaaaacaatcacaattagccgcctctcctcattagtcattatctgtatcgcgatggggaagatacgcaatgcttagttataaaccgtccgatcagatgactttgaccagtgaccttccgttcaaagaatatcgacggttcttagacacatttttcaccggagtctcaccctcacaggtcatcttaatttctcgtaaaagagcatattacattgatattccaaattataccacttcataatttatttttattttccaaataaaattaatttattaaaacttcagcactccaattctgtagagaaattttaagaggagaaacccaattttcttttattttgtaacgaatctcttttaaaaaaatctaacaacagaattatatattttcattattctatcgaatccaacgaaatttcaatatacagatatctatatacaaatatttaacctacatgtgtgtatcatatggtttaagcacgttacctgtaacgtatgtaattaaatcaattgcgtagaatcacaagaaaaacattattatataattaactattgatcctataattttattattttcatatatatatagatatatagatagatgcattagaccaccaagaaaacaaagacttatcgatcatg

SEQ ID NO: 9374 - DNA, 3000 bp, Unknown
  misc_feature (1)..( 3000): cDNA_ID_3041596_gDNA_ID_1972105_Annot_ID_178707 3000 nt of promoter + ATG
ttggataacccaaagtctgaaactttggctacccagttctcatctacgaggatgttagttgttttaacgtctctgtgtataatcgtgtactttgctcctgtgtgaaggtaatgtaatcctcttgctgctccaatagctatctctagccttcgtttccaagttaattgtggtttctttgtgttgtatagatgctcacggagtgttccaaatgccatgtaatcgtatacgagacacatttctcctccctcgtcgcagtatcctatcaaggagactaagtgtttgtgtcttagtcttgagaggagttcgatttctgtctcgaattcgttgagtccttgttctgaatttgggtttgatttttttaccgctactttagttgtgccgtctataactcctttgtagactttaccaaaccctccaactccaatgacgttggaatcatcgaagttttgtgttccgtgtttgatttctggtaaagagaatctacggcataaacctgctgcgagattggataggtgacttccattgttgctcttccctgagatggttgatttggttcctgatgtggtagagtttccatatataggaagccaacttgatgtgtgagagtcgcctccttgatatccttgtttcttcttgtaggccgtgaaacacaaggcaccgattaaaaccgctaaaactcctccggccgaaccaatgatgaaagcgtgtctcttttcgttcttgaattcttttttaacctcttcctcagcttgcataggcgatggctcggggtttggacccgcaagatttttcatggtgtccatcttgaaaatctctaacccgttaagagatgaatcataatattccggttgaccaaaagttgatggagtcatctgaagtgtaatctcttcgcctccgttgttggcatcaacatatatcgcgtagtctttgtacatcgggattcctttctctcctgtccaccctattatatctgcaggagtagtatctgcctgcgctgttctgttattgatgtaaatgttgaaaaccttctggttgatcttggaaagctggaattcgcagaaatggagtctcaaaatgtaggtgaagttcttatcgatttggaacatccatgtaagattggatttgaggttgatatctccgtttgggccttgagatcttgcggttttgtatatatcggctggagctatagacaccggcatgttctggtagttgatcctaaaattgttgcttgcttgaagtgtaacaccaagacccgcactaaagatgtaaggtgcatcattataccaagttcttgtcaacccaccggagtcttggcttccagggatgtcctgaccaccaacattaagtctaaacattgactgaagattcgcagtcttggcatccattgtttggtctgtgaaaccaacaagagccgccgtgtcaaacaattccggcatctgaatcacctcgataccgtttataaaggcaaatgcgtctcggtatttatctgaaggggtaaacttgatgctcaaaacatctttgtcagtgggtgcaagagagtattctttaaccagataagcttgagtcaaagcttgacacgtaatcgcggcgctgaaattgctcagtaaggtaacatcgttagcttccacagtgaaatacgagttggaaatgttgagaccggtgtatgttgatgggtagaaatataaccgaagcaaatgtcttttatctcctttaatcgggatttcataagttgctggagctgtaaagattctggctgtcatataaggaactgttgagagaagtgaagggtcttgatatgtagccgttgcgtgaattgagtttccagtctttaaaaactttgtatctggttcccattttttcttatcttggtcagcagaagcttctgatgtcccgcagctcagagctaaatcttgtccgttagatctagttggaaaaaccaatagaaaggagagacatgtgaggaaaaagagaatccgagttttcccgctcatggctgacacatcaacgggtagagactctttgccttaaacaaaaaatgaggagagaaaagctttcttttttgtaagaattaagatcacttttacgcttgtggacaaaattagaagtttatttcttattgtctctgtaacctaaccatagaaagtcaggacttgcatggatgaacaagaagcaaaaaccttgcaagaaaaaaaaaaacaaggtacacactcttttttcttttctattttctcgttttgtctagtttttttttgtttgtaattatgaggttactggtgtttttctcattttccgtcgttctgtctgaaagagaaacaaaattagttagaaaaattcgtggtggagaggattacccgaacaagctatgtttagcatatagttagagaaactgaaaagacttttgttctttgactacaacatgaaaattcatgtaatctaaatatagaactcttagaccatattgtttcaataacattattacaaacttttgaaagtttgacttgatagagatagactacgacatgttttgaaactcttttcttagaatggtcaaggatctaaacaaagaaagtccctaaagatctggatgaatcaatcgtcaaattttaagcaatggaagaaaatagctttttgacttttatccattacatagatcaatggtggaaactagtttgttattctccattaaagcactaagagtctcttcaaagtttatctggtcgggttgggaaaaatccaactagagaagagcataaaagtagacatctgatcaacccgacccataataacctttttttgttggccgcgtaatatgttcgagcgcggccatcacactaagaacattcataaaaaaaaatccacaggattcaaagcccttaagctttgatcatagtctcttaaagaggtagtaaaaccataaactagagccccaatttgcattcacaagccacctaacacattagcttctggtcatttctgctttatatacacatcaagtaaaaa

SEQ ID NO: 9375 - DNA, 3000 bp, Unknown
  misc_feature (1)..( 3000): cDNA_ID_3041604_gDNA_ID_1972105_Annot_ID_178705 3000 nt of promoter + ATG
tgattcagatgccggaattgtttgacacggcggctcttgttggtttcacagaccaaacaatggatgccaagactgcgaatcttcagtcaatgtttagacttaatgttggtggtcaggacatccctggaagccaagactccggtgggttgacaagaacttggtataatgatgcaccttacatctttagtgcgggtcttggtgttacacttcaagcaagcaacaattttaggatcaactaccagaacatgccggtgtctatagctccagccgatatatacaaaaccgcaagatctcaaggcccaaacggagatatcaacctcaaatccaatcttacatggatgttccaaatcgataagaacttcacctacattttgagactccatttctgcgaattccagctttccaagatcaaccagaaggttttcaacatttacatcaataacagaacagcgcaggcagatactactcctgcagatataatagggtggacaggagagaaaggaatcccgatgtacaaagactacgcgatatatgttgatgccaacaacggaggcgaagagattacacttcagatgactccatcaacttttggtcaaccggaatattatgattcatctcttaacgggttagagattttcaagatggacaccatgaaaaatcttgcgggtccaaaccccgagccatcgcctatgcaagctgaggaagaggttaaaaaagaattcaagaacgaaaagagacacgctttcatcattggttcggccggaggagttttagcggttttaatcggtgccttgtgtttcacggcctacaagaagaaacaaggatatcaaggaggcgactctcacacatcaagttggcttcctatatatggaaactctaccacatcaggaaccaaatcaaccatctcagggaagagcaacaatggaagtcacctatccaatctcgcagcaggtttatgccgtagattctctttaccagaaatcaaacacggaacacaaaacttcgatgattccaacgtcattggagttggagggtttggtaaagtctacaaaggagttatagacggcacaactaaagtagcggtaaaaaaatcaaacccaaattcagaacaaggactcaacgaattcgagacagaaatcgaactcctctcaagactaagacacaaacacttagtctccttgataggatactgcgacgagggaggagaaatgtgtctcgtatacgattacatggcatttggaacactccgtgagcatctatacaacacaaagaaaccacaattaacttggaaacgaaggctagagatagctattggagcagcaagaggattacattaccttcacacaggagcaaagtacacgattatacacagagacgttaaaacaactaacatcctcgtagatgagaactgggtagccaaagtttcagactttgggttatccaaaactggacctaacatgaatggaggccatgtaacaaccgtcgtcaaaggaagcttcggttatttagatcctgaatacttcagaagacaacaactgactgagaaatcagacgtttactcattcggagttgttctgttcgaaatcttatgcgcaagaccagcgttaaacccgagtttgcctaaggaacaagtgagtctcggagactgggcaatgaattgcaaacgaaaagggaatttagaggatataatcgatccgaatctgaaagggaagatcaatgcagagtgtttgaagaaatttgcagacacggcggagaagtgtcttaacgatagtggattagaacggccgacaatgggagatgttttgtggaatctcgaattcgcacttcagcttcaagagactgctgacgggactcgtcatcggactccgaataatggaggaagctctgaggatctcggtagaggaggcatggcggttaacgtcgccggtagagatgatgtgagtgatctctcctcagaggacaataccgaaatattctctcagattgtaaatcccaaaggacgataaggtaatttcgcaatacgtatactaattttgtttttcttctcttaattttggtgttaaagtttttgtttttgtgttaattgcaggattagaaaaggaatctgggtaacaaaatttgaagatgatttcatttatattgagtggtatttttcaataaaaacatttgtaaaattatatccctttgtgatgttacatgtaatcaaaaatacattgtattaagattcgtagttagaatttttctatggtaaatttttgtattaagttatattttactgagtttattaagctagaaacaaattattatattaaccggaaaactgtatagtagaaaaatggaaaaggttgttcaggtcggttaacggctcaaaccgggattaattcgttttccaattttgccttaatcgaaaaaatggaaattacagcgatataaacctaaagtaaattgatttcgtaagtcgaattcactgtttctcctcaaacacacacacacgtttgcgaatctccgacgtccgtttctcctcgccgtagaatcgccgttcattctttcgccgccttcagtcttccctccattgaccctttttttggtaattcgtcttctttttgctctctcgttctctctttttcgatttctgggtacagaaatcgatggctctcgtttttctttctctgttgctgttctattactttctcttatatatatatgattgttactctagtgatgaattttgatacattggttgtttgaaattgatctctgttgtgcttttataattccggggtcaagattggctgtttaaatctagtaaagtttgcatttttcttttctgtttgcagagattaacttgattatacttttgtttttaagaagaagaagagcgattacaagcgcaagtgtgtataatgacttaaagagagctcctgttactccgagtgatagatagtctacaattatatcttactctgagtgaaagcaatggcgtacggtggtccgtccatg

SEQ ID NO: 9376 - DNA, 3000 bp, Unknown
  misc_feature (1)..( 3000): cDNA_ID_2035738_gDNA_ID_1972105_Annot_ID_178702 3000 nt of promoter + ATG
agaatgtttctaactttgaaccaatctctgttcattacgttccaattttgaaatgtcagatgaaaaaagagttgtgaacttttagaagattatattttgttatcgctagggtatagagaaagctgagattttacaaattgaaatgggtctttgagaatctgtgtaatagagaatctgtttgttttgtctttggttggtggatatgtccagtggaatgggaagagaagttgttgaggtgcttatggaccgaaacgccgacgtttcaagcgctagagttcatgttgctcctaagatagctgcagaggagactgatgaggaatttgaagtcaaagaatgcacagaggagaagtctctttctgagaatgcaccaaatgttggatctgctgagagagttggagctcagaaatcacctaaaacccgtaatggaaatgctaaagtttcaaaggtaaaactaattcataagatcttggttttgagaataacgctttgtagatggtatatgattgaggcctaaatccgattttgacccgtttcttaatgttttttttagcagcaggatgctcctcttctcgcggtgaggaagccattgcaacccgagaacaagaagcatattgatgacgaagataattgctccattgcttcttcgtatccttttcccatctctatcattttatacttgatacttatgtatggatgtttatgtacacgatgcttaacagaatcgatattgtttccttaacgttatttaccacagcgttgcaacttccatgaggatgggtaagtctggattgacttatggaagtgctccaacgtttaggagtgctcaacgtgctgagaaacgcaaggaggtaagtacatattctatctttctgcttccacatctcagttatagatcacataagctctttaaagccaacaaaaactcataatcagaaacataatctgcattaaacgtgtagaattcactctgttctgtatactgattggaatttattttgtggggtctgcttggctcagtattaccaaaagctcgaggagaaaaaccaagcgcttgaagctgagaggaacgagcttgaacagaggcaaaaggtaaagtacacatttccggtagatgcagtttttttacctgattctagattggttgtgaaacctcatagatttaaatggtttgcaggatgaacaagaagcagccttgaagcaacttagaaagaatctcaagttcaaggctaaacccgtccccaacttctactacgaggcacctcctgcgaaacctgagctcaagaaggtatccttcgaaccaaaactttatctttgttcagagctcagcattgttctacttatgtgccaaagtaacttatgttatgtttctttctagcttcctttgacacgtcccaagtcgccaaaactgatcctttctcggagaaaaagcttcagcgacgcagtcagctcgtcttcccgtgaagagattctgaagacagtctctaaccggaaccgacacagcactggaacagttcagaacaaagacgatgatcacaggaacaagaacaccaatgctgcgcacgacagccctcgtgtcagatcaggcaaaggtaaatccggattgaaaccagtgaacgagtcctcagaagaagcttgaaatttcaaaagatgatgctttgttggtctaacttgatcttgccggagaaaatgtaaaatcaaagactctttgtttttcggttatttccggtatacgtttggttcactatgtaactgtcttttttcgattttaagttttaacatgaaaaactttatgttgattgttgaacaactcctcctaatgttgaaatttgtaaatctgaatgctgttggatttaaatttagcagctaaggttattttcagaaataatctctaatcgaattatttacggactgaaaccggcatcaaacatttatcctaaaccgaaatagtcctaacaaacttctgataaaatccagagagcaaaccagtggaaagcaaaaccggcatcaaacatttaacctaaaccggtaaatcaaatatagaagctttaaaaaaccaaacctaaaccggctaaaatcgatagacctaaccaaccactagcagtttcccggccgccgcttgaatgatgaccactgcggtgcgttccaccgccataaatcggaatcggacgtaatcctcctcctctgctagaactccctcctccgcctctgctagaacttcctccaccgcctctgctagaactccctcctccgccgaaactgcgtccccctccgccgaaaccgcctccacctctgcctcctcctccgccgcctttcttaacaacgactgttaatttcggtaaattggcttcgattacgtcaccgtctggcttcaattctacttcttgaaacgggagatcatcatggtttggatcaacgaaggctaaacttgttgaagatcgcgagaccgcgtgagcaaagtggtgttgcagttgcaggtggagacagagaagaaggaataaaaacaaagatgctttcttcaaatccataattcgtttcgtttcgtttctttctttttctgtgtgacttacaatttatacaccgaattgtttataaccgcgtgactatatgactattctaatttgaatatctgaacgcgtattttaatatatccgactaattacaaaatatatcatgtttagataactattactatctgagacccattttcctgtcggcttctgagaaatatcaaagatggatttgtatacgtatataccaattttccataaacaatgctacaggtttcgttaaagaaacgaaatgttatcaatcatgcatgatttcatacttttgattatcatatagttttgttatgaaaatctttagtagattaaggaaatagaatttaaaaaaaaaaagagagggtaaaacagtaattttgtgttccgaaagtttaaaagataacagataatccgctcacactcgagcaaatttatcggagcctccctccaaaattcaaca

SEQ ID NO: 9377 - DNA, 3000 bp, Unknown
  misc_feature (1)..( 3000): cDNA_ID_3041628_gDNA_ID_1972105_Annot_ID_178688 3000 nt of promoter + ATG
gacaacgtcttagtcgatctcgtaagcggcggtgttaagctctgtgatttcggatcagcggtgtggttaggcggagaaacggcggagggagttgtgggaacaccgtattacgtggcgccggaggtagtgatggggaggaagtacgacgagaaggttgatatatggagcgctggtgtagtgatatacacgatgctagctggagaaccgccgtttaacggtgagacggcggaagatatatttgaatcgatattgagagggaatttgaggtttccgccgaagaagtttgggtctgtatcatcggaagcgaaggatttgttgaggaaaatgatatgtcgtgatgtttctcggcgattttctgcagaggatgctcttcgtaagtcatcttttttttctcgattttttttttttttttgagtttgctcatcaatttgtaatggtgaattgcaggacattcatggatgatgaacgttggaaacctccaaagcaattagtcgaagcttttcagatatgtgattagagagtgtaattagagaagtcgtaatatagatgtgagtgtgtaattgtttgattcgaatagtcaaacgtagttgtgtgtttcagcaatcttcctacgttttgtcactagagaaagtatgttgaaaactttttgtaacgattcgccagattcagaataaaattgattttgagatcattgttgagagttaggtcaaaatctgaattcgattatttgctccccaagaaacaaaaagaaaagattactatggttggtaaatctgggccagtagaagggatctttcggaaattgggcctaactgatgaagtttagatattttgggctagatttgtcgaattttggggcccgtttcaggctaattatgatttgttcgagaaaaaaaaggtttcgaagtcaatgcaaaggcaaatggagttcaattattctccagacctggttttcacattaactaatactcaagtaattcgtctagactctaatgtatactagggtttttaaactaaaagggacatttcgtttttaaaaacagccgtggactgatttactaaataattcttttctatataaaaatatcttatagccaaaataaaatattattagtatatatgtgaaagaatatccaccaatgttaagaaacaaatctttttttaagtcaaaataaaatatggttggtatattgatatatggaagatacatcaatggtgagaaagagaaatgtcaaccttgaacctaaatgttctataaattcatcttttacttacaatccagaaaatcacaacatcttttttgaatagattttatagctgatacaacgagcaagagaaaatggccatcacaaagacttcagtgactcttttacttttaataataatggctgcttcgttgtctaatttcagcgtcttggcttcaggtatgtttgaaataattctatgctgttaatttcttattaggtttcatcacttgaaagcaatgacattgatatgtatgtatgtacttaaatcatgcatatatatatatatatatatatatatagtcatatagatatgatattcatgttgtgagtttgtggacatgcagagatcaaacctacaggaagagttgataatcaatgcaaggagatgtgttcggcaacgtttggggacggtaaatgtgccgcagactgtaggaaggctggtttctcatccggacgatgtcttacttcttctcctttcggaaataaatgttgttgcacctagtgatagctagaaccaatctatatgactatatgagttttctcttgttgtattgccacatattataattgtactgcaatagaataaaataattttattgttatatttttctttaatcatcaaaagtaggagctacaattacaatgcacgagtcgattaacatactcttatgactctttaactactcaattattacgtacgagaagttttctaaaatttcaatactgaagtggtgatattgtttacacaacgcaatgtcaagttttttcataaaaaaataaaataatcataaaaatatatgtttgcttgtgtttaaacaatcctaaacattttgtaaaacttcagaataaaaatgattaatttcaaattatgattgtcagttaggtcgaaatcccaaatcgaccatacccttatcggattggactttagatcttttgttaacaatgacgtgcataaatgaattatgaaaagttgagttaataaggctttttttgttcctgctctaaaaagatggccaatattgccagtaaagaaaagaaaacaaaaagaagcaagcaaataagtgttaacattcatggcttaactatgatgaatattgatgattacttttctatatccaacataatgatacctgttacttacattcataaacaagtttgaaaaaatcgcctagagatgctagattagtttagttattgcaaggagagatgagccattgatgtatgggtgaaagctcgattcgattagtcaacgtagctgagaaagttaagttggaaacattattttgtaacgtttcggaacaaaaaggatcttttgggcctatctagcaaatttgtgggccgttctcaggctaattatggtttgcttataacttagttattcgcatcactcctacgatttgttctaggatctgtggtcaaccttggttttgaaacaaaaagggacattttgtatttcaaaatagccacggattgatttgttaaacaatacattttacaaaagaaaaaatcttttagtcccaaataaaatgttattagatacatgtggaagatccaccaaatccaatgttaaggaaaaaatctttttaaatcaaaataaaatattattaatatagaaagatccatcaacggtcttcttttctacaaccacaataacctaaaatgttgtataaataaagcttctacttacaatctacgaaaacacaacatttttttgaatagattttatagttaatacaacgaggaagacaaaata

SEQ ID NO: 9378 - DNA, 3000 bp, Unknown
  misc_feature (1)..( 3000): cDNA_ID_3041624_gDNA_ID_1972105_Annot_ID_178689 3000 nt of promoter + ATG
gaaatttagcaaataataatcatagtcaagagagaacataatataatgtccacaaactatatagctcactagtaacaagtagcaactgactggttttcatcatcataataaacatcattataatcttattgttaacttctgtaaattaaaaaccattttaacgcacgttaaaatcctgacctagcttgagcccaaccataagcttcttggccgctcatctgtcctcctccaccactgccaccattagaaacaagatttcccggcatattatacaccggaagtccttggttaccgtcgcctccaccagcaccgctgcttagtggcgaacctccgcctccgagctgccccggaaccactcctccgctgcctccaccaccgcctctctctgctgcctcttcctcctccaatggcaatctctcgtaagtcgcgttagagaacgtggcggcgatcagcatcaccggacctgctgccatcaatgggcccaccacgcttcctccaacaacctgaccttgaccaccggctaagtaaatcgttaaaccggtggaaccaggtggagccggtcctggcaagaaagaaccggttaaagaaagaatctcaaacctcccttgtaaagccaaaacagccgcaccaccaggagccgccgcaacggcagcggtcgagggttgacggagggtgacgttagccactgtgccatttccgctcaagatgcagatgccacgttgacgccgcctagcaaaagtagctagggtttcgatgacgtcagtcccactagcgatctccatgacatggctcttgagagcatttggagaatcgcgagtgacgaagatcggtggctttggtttgttcttggaaccagcaggacgtccacgtggacggcgcgtgggggcttctacggctccttcacgtggctcgtggtcgtctccactcaagttgtctctatcgtcgtcgttgttgttgttatcgacttcttggtgatggtgatgattattgtgacctgagtccatggccatgttcatggagatgtggagatctggtttctttaactgagaggaaccaggcggcgtcgtttcgaggccggataggttcacttgtcctgtccaccatggattcgccatgaaagccctagagaggttaattaattctgattaaatgtttcaagaagtgaaaccctaagaaatataagttaatttagatcaggaaaaggaagaaaaaaaactgaaaaacctagaagcggtgataagatttttcagatcttgattttttaacacttttacaagtttttgtgttgtgagaaacacaagacaaattgcaaaaggttaattaaaagaacacgacaaagaatgatactaagcaagaaagagaaaagatgtaatggaagctaacttataaaaataagtggaagcatatgtatatgtgatacacatacatgtatacgtatagtgtttataagaaataaaaatttaaaacaaatccctcaactcaaggcttgagagagtgacataattatatttaagacagaaaaaaagtcgtattacaaataggatacaatatgcatcgtacgttttcttgggaaaattttgatgacatattgttttgcagttttattgtcatttgacagaaaaatttgttaaaaattggctttaaatattaattggttaagataattttttaaaaacctgtcattttgtattttgtcttttttaagttagcgttataattgatgtgtagggtcgagcgccgaggttgaactaatggggcgcacgatcgttttcccatttcaatatttatatcgaaagttgaatcataaggttttttggaatataaaaaacaatataaaataatatctacgaagtgtttcattggatccaaatataaatatatttcacgaatctataacagccaaaatattaaacaatcacacatacaaaagatttataatttgctaattattgaaatgtttgaatacttgaaggaaattaaaattcacttaaaaatgaaagtcaaataagcctaagaataatacaattgctataaataaaatactagtatttacatacacgcatgcatcgtaagaaacttaattaggagattctatattgatggatcaaagcataattatttcaagtaattacttactagttgtagcaaaattaagtttgtttcatattaatgtcaaaatgaaccaataccatatctttccagccacctccttgtcatattatccattatccattgtctaaagtaaagtttaatcgtcttctaatgtaaactaaactacttcttagatatgtacatatgcatattatcctaaattattttgtccaaagaaaaacaaaattttaaaagtcgtttataatattttagtctttttactcttcttttttttctactcaacaactctcaactaaaacataatttatgtataaatatagctaaaacataacttattgattaatttaattgaggtagacaaaaagccaaagggtggttgaactcctcgggactacataacacacaataatgaaacaaaaagaattaattgtgttaaataaacgactgtaccgattatatgatttgttctctattcttttctataaattaactttcacaagtcttatctctttctccccttaatatatttgtgtacttagctaacacttgtagttcactctttcttaattgaaaggcatggagtatgtagttcaattgtgagagactgtaaagtatttgttttttcaaaacgaaaatattatcaatttgaaattgtgtatgatgtaatttgtatattttctttctgcagaagagagaaactcataaataatataaaaaaaatttacccattgtccaaaaaagtattttttagctccaaaactatttgggccgagaatctggggctttatttcataaaaggcccataagacgtacacacaaatccagtttcggctccgtcttccccacacgcgtgcgtgaccgtctccgtcgacgaactggagagagatg

SEQ ID NO: 9379 - DNA, 3000 bp, Unknown
  misc_feature (1)..( 3000): cDNA_ID_3044202_gDNA_ID_1972110_Annot_ID_178737 3000 nt of promoter + ATG
tttggtttgatgaaaaaaaaacagagtaaaacaaacctctggatgatatctgattccacctttcatgggacctcttgcattgtcgtgttgaactctgaatccaacaaaggatgctagagttccatcgtcttttggtatggtacattccacctgcaatagttggttagttccgttcaaatgatcttgaaccggatcggttctgcagatctgttatagatggaagaagaaaacagaggaaaacatcgaaccttgatctctctgaagggaatgagaagacttttctcgagctttgagtctaaaccaagaagcctagaagcaagcttgaagtttctgttggttgctgctaaagcattcatggctttcttctctcttctttattttgggtttatttgatcagagagtctgatatgaagacagttggaaaaatgtgagtcttgcttatgttattgcaagtttatttatatagagtgatacgtacacacttcgtgttatggaatatgagaatgaaaattttgttatttatatttataataaaagataatttatataaggaatatgaataatcatataagatgatacccataattgatcctgattttgagtattcagaatactatgtgtctgtttagcaaagttctcacacaaaaaaaatatatagattatagaaatagcccatgtcttcaccatgtgtataaactagatcagaataatggaatattcattaatgaaaaggaaatccgtagactaatcaagcagaataaatatattcttttcattacaaaaagatcagaataaaaataggaaaaatcaagatttcacaagattataaatattacatggatgaaagagatagctcgtaaaatttatcttattgtgtcacacactgtcattttattcattttaaatctagattaaaggaaaaaataacatttcgtattacctaattagtacccacctaataagcaaggaccaagatattgtttttcagaatttgtttttttttttaaataagaaaatatgatacaataatgatctagcaatagcatgcattggaccggatgactatactcgtgcatgaaaaatcatagtcaaattgtaatacgttaatgtgggacgataataatactttttttttgttttattatctacgattatatatatattaataatcatttacatatttgtgatatacgacccgaaatgaatcttgcatgtcataagatctttacgtgttattaacttattcaattctacttgcccctacacatataggcatagcgtatacacttttgtgagagggtgacaaaaaaaaacgtatacactttagtgagctagtgggaaaaaaacgtataaacttatcacacacatacaatattcagttttaattgaaaagattctacggatatatgtttttttagatactcaaatcagaatctttttggaattagaggaggacacgagaggatgcaacaaatcaagaaacatatagaattacaagattccaccatgaaagaatctttttggaaaagagattccccatgatttatgcttccactaatataattgatttattgtggatttccaccaagatttctttctctttcaatttccaaaagaagatatcaatttcgtaataacaacattgaccgtaaatagtgtttccaaatttgatctcaccctctttggtcaaaccaatatatagaaataataccccaataaagaatccggttcatggtaggcttggtagctaatgtcaaggatttagtatttttaaaacgttatgcattagctttctatcactttttaatacatgaaaaaaaaaaaaaaaaaaaaaaccaattggactttctcctaaaaggccattccctaataaacaacaaactacgaaaagctaaacatgtatttaaaatattaaagtgatagaaagctaatgcataacaattaaatgaagcaatttttttatattctttggtcaaaccaatatatatacagaaataataccccattaaagaatactgttcatggtagctaatgtcaaggatttagtatttttaaaacgttatgcattagctttctatcactttttaataaatgaaaaataataactcaaacaaatataaaaggccattccctctacgaaaagcaaaacatgtatttagaatattaaaaagtctaaaatcaaacctaaaattcaaaaatcaattaaaggccacaattgtcctataaaattatgggcttgaagcccaataatatctaagtgaaaaactaaacttaaatgctctctcaagggaccaagtctcattattaccatcacctccgagcgttctcttctctccatctgtctgccgctcctttaacgtcggttcccattttcttattcacaatgaccccaagaaactcgaggagatggaaaaaagcaaaaggtaaaacaaaaacaaaaaagctttcttcgagaaccagagcacattgattccaaggtaattactttctcaatgccatggaaaaggacccattttgttcccctttcctgtaatctaatcgtttcaatccgtgattatctctgtcagcttggaggaaatgacttagatttcataaatcgattcatgagttgtcagaaaggatttaaattttgttggtttgttcttatttcttctgtagctgctatgaatttttagatttagtttggctatgattctaaacctacgtctttatgaaagcacttacattttctagacacaagatcatagtgagttcatatgatgcggaaaagttattattctcttggtcttccagtttatatttatggaggaacatagtctcattaacaagcttgcattgttctgttccattggattgttataaaaatattcattggtcaattgagaaatcagtgtctaattttttttgaacgtgtctttgcagattgaatgctgtttctggtggattagtttctctgagttttggtgatagatcagattaacaggcagaattttgagaatg

SEQ ID NO: 9380 - DNA, 3000 bp, Unknown
  misc_feature (1)..( 3000): cDNA_ID_3041647_gDNA_ID_1972110_Annot_ID_178757 3000 nt of promoter + ATG
aaaacgattataagcatagatatgattcatttcaaatgaacatgctccacctataattctagctaggtgcaaaattgttgacatagacgaatcaaaagtcacacgtgtggttgcatgcacgttgactatataatcttccatgcttcttagtttattacaacgttttaattggttgattatatattttaatatttgaaggagacttttggagtttcttaactttgacaatcttagtataactacgtatgagaaactccatttcatacaaaccaaaccaaaaagtcacattttgatcaatttcttgccgagtgttttattcgagatgttttgaaagacttgccgtgtaacatgtatcctttacttacagttgcagtttttgtcataggtttccttctatgcgaactttttcataatcagtatatttaacgttgatgtcacattattcgactattaataaaactaatgaaactaatttaacaaaaaaaattaactacatatgcagtacaataaaaaactgttcataaatcttttaattcgttagcaatataaatagtgcacaaaaacttaaacaaaatcaactttttaaaacaattttttttttgtaaataattaaataataaaaaacagattgagtaattgacaaccatatatttttttctaaatagaagaaacttgtttttgaagtatcttttatacggtgaagggtgaactaaagttcaattattgttttaatctctctcttttttttttatcaaaaactattgttttgattgactgcacgattaccgaaatataaatagctggaaaagtaaataactgccacgtataaaaatgagaagaaatcaaaatcaagggtattttggcttagcgtgtggttagcgtgtgtgtgtgaatgccgatgtggcatgtcattttttttaagtagaaaaacttatctaaattatgtatgtataaataacataattctaggatatttaacttagtaaactgcgttttaaagaaaacgttaactagatcatgtgggtgtttatgattccacgtttgctcttctgagaagaaacaaattaaatgttttaatttggtttgcatcccagcaagaaacatatcaaattaagattagtttaatacttgcttcattagacaaaacacgttattacttataagttatactactaacattaatcaaaattattggtatttgattttgtcaacaaattattgttgatctttagcctttacacatttatttttatatatggatttgattcaaacttttgggttagttcttatctcatttaatccaatcagatctcggtttgtttttatgttttactttttgactcgatttattatttttcatgatttttttttgttctacatcacagcaaagatgagatacatatcttgttaagcatgatatatgtataactatgcagtatactttttgtttatgcatatacattaacaactgtgtaaaggattttatcattttaagttgttcttatccctttagtttatatttgagggaagaagaaaatcactttcatatgtttgatttctatttttgtacatactacctaatttcaccatttatgcatgataattgctatatatgctagaaaaacagggaaaattcaattaacctaacaaaattggaaaagttcataaatcagataaagcagcgagcatcgcattcaaaacaatacgttaggctgtgcgtactgttttattaattttaatttctttacaaaaattgaagataaataactcaaaaacaaaaaacagaagtgaatttacagtctcatgatcttattttacattatatatacgaatatgcattatgctatagttcttctattcaagttttctcgaaatttttcactcagaaaaaggatacaataaactaggactatagtatgatgattgcgtcatcagccgcatctgggcttacgtggatatggttaggacaaaagtaaaactaaccaatcagatgtcatcccagaggacacagctgtctcatttgggtccacttctctaacaaaacttcttcaattattcacacacaatacaatgacacatataaacaatttaaataatttattaaatattgaaacggaaattttgtgttcatacttaggttcttactatgttattgtattttttggaaaagcttgaggactatttctcataagtatataaattttttgtactcaaaatttcggattcaatccctagaaatacatttatcaaacaaatccaatttgagttttatttacaaatacaaatttgcaatttaatatgacatgggtctcagactttacaaaataataaagtctagatactacgaactcgttcgtaattagcaatatatatatatatatatatatatatttttccacttagcaatctttgttttgaatgtataaacaatgaagcctttacataaaaagtctaattagacataaataatgcatttaatattaggagaatatatagactacgtgcacaaaacgaccaaaattgagtaagatattaataagaaatatataaattatatattcaagtttctgttcataaaacatgcttgagtttcgatgacgatatttgctagtttctccataaagttctaataagttttttaaaaaggttcttttatttggttgaagatattaatactaactgattttatttactttttatccactacttgacactattttggatcttttcctccggtctactttacagaaaataatattctatatttttcataaatatttcaatctcaattttctttaaaaaattatacattcaagcactaaacgacagaactctacacaccataaattgccctcaaaacctgctctacgaaaaatttcaatctttggctcacttctttgtttatctcatagctcttcaccaaaaccaatattttctcctttgttgttctttcttttctatcaaaactttctacttaaaatatcattcctttaaacaatg

SEQ ID NO: 9381 - DNA, 3000 bp, Unknown
  misc_feature (1)..( 3000): cDNA_ID_2181846_gDNA_ID_1972110_Annot_ID_178749 3000 nt of promoter + ATG
ccactgatactcatctccagcttcttgttcactcggtaccttccccaacaagtggaaacctttcctatccactgataccatataagcatcctactcgccaaaaaaaaataacaccggtcaatgaccaaactaacatagagaatccgaaatccataactcatcatataagcttttattttacccttgcgtttatatcaagaaaatataaacagaaaagaatcaaagctcgtcttcttgattcgttcttattgattccatccacaagttttgtcgaccaagtccctgcgatttagaatccaatgcaaaaagcttaagaaataacaaaaccttatctatagtttggaaccaaatgtctttagtttcattacctaatggatctggttttgacagttccaaaaccttcaagtctatttctttcgtaccatttgggtcaataaacatacatgagctgagaagaaaaccagataatcactacttgatgaaaattcattatcttttgaaatcacaagatgatcttagtaatcggttctgtatcattgtccacttttaatgcttaagaatattaaatgaatgtaagtaagattaaataaacagtaagatatattcttcaattaagcttaaacagatatattagtttagtcaagcataaacagagatgcgtttgtgtcttaccttggaacgaacttatagataacgtatttttcctttgcatcattgatcagggctctaagactgtcacaccgggaggcatacatctgatcggaagaattcaaaatactacggacagaatttggggtatcgctaatcgctttcatctctgactgtatagcttcctcgacatatttcttcaccgcatcaaccttttatcaagaagacaagcatgatgaagataaataaagatgagaaagtcataactttttgctctaaattagaagttctccatggttcttacccttttctctttaacaggaacaatctctccagtaaaagcaaccctttctggaagctgcaaagaaagttagccccgtttgagtgagagagatacagactcaagaacctgtaatctagagaaaacagagaatcgagtgtaaaataaacacacaacaaacctttcctatagacttgaataaagctgcaaggggaccaggatacggatgggcaatagaaaaggatccacgttcatcaaacattatgttctgccaatattagagattcagaacttagcttttaaaacccctctctattaagcattataagcttaccattcaaaactaagtaacaaaaagaagaacgcaagcttacgacattgtgtggttcactttctggtacccagagatatggctttcctcttctcatcacatacttaatctttgaagtatgtattatactaagcaaaacagccaaaaacactcaaattcaatatacaattttccagagtcccatgatcgagaatgaatgaaatcaacgaataaaaaagcttatttcatagaagaatctgaaattacctagctttatcttcaggtttgacggtatttaggtacccttgccagttcgaaacgattacagtctgcacaaagagaagaaattagcaaaaaaaaattaaatcaaaacaaagaaagagattcagtttctggaaaaaaagattaagatgagagtaattactttgcatttctccgctaaggcagagagattcgccttgcttcctttcatcatcgcgctctatgctcgccaagtgttcgacgaaatgcctctttgatcgctactcaatgacagagacaatgttcggcgagcgaaggaagttaacggtatgtttaggaaacagctacaagggcccattagtgctgttaaaaatacccaatgatggctcagtagataaggcccattaatgaaaatcacagcttagtaatattgatgacatgttgacctaaagaaaattcaacatgatcatattgtgataataaatatccactgaatgtcatctaaccgcgtacgggattttttttttttttttttttttcatgtcgactccctaattccattgatattttattaaaagtttattttataataactagtaaatttcaaatttttgttctatgatttttctggttgatataatcagctttttattatatcgaaacgatcgaccaaccgggactaattatatgtcttttttaaatgaattaattggtgttttattagtgtgctatcaaatcaagaatatctatcgtcatgtattgtatttggatgtttctgatatttaattgcaatttaatttacgtacatgcaccatcagggttacttctccaaaatacgtttgtactttgtacgtactcgatcttgaaaaagataatcaacgttttctacttagacatactaaagctatgaaagcgatattaacctgcaattataaggtttctctattcgtacgtgtaaacttacacaatatagaatcaaaaacttgaagtgttgtgcaaaagattaaatttcatatatacttaaaatagaattatgttagctaacacttcgccaactatgttggttaggtctaaataaactataaatgcatggtatagatcatagtgttaataatactagtctatgtatatgttaaccaaattatatatttttaattaaaaactatagatattttaatggtcggtttctgtttcaaaggccggttttgactctgtttctccttcttcttccttctatagtctctcttacctatttgatctcctcttccttctttctttccttcactcagatttttgtcagcttaaacaaatcatttctattctttattcgaatcatcgagctacaacaaacaaacagaacacaaaacacaccaaaaaatatttatatatctcttacacttcttccaattcttctcccatcagattcttctttcaaactttaaaacttttccaagatttctttttttctaataccaagcacaaaattttcccggaaaaaacagaggaaaacaaaggaaaaatg

SEQ ID NO: 9382 - DNA, 3000 bp, Unknown
  misc_feature (1)..( 3000): cDNA_ID_2181850_gDNA_ID_1972110_Annot_ID_178750 3000 nt of promoter + ATG
cacttccatgttaccgtgattcaacgcgtttaaagaagctaaaagcgtgtcgaaactagcgtcgaagacgttcgtgtagataacgccgttatcgttaacggtgttttggccgtcaaagaaagcgtattcgaaaggaaagtcgctgcttaagtagagactgaggaaaggataaatgttgactgtgaaaggagctttgttctgtgcgaggaagttaacgatttgtgtcatttcttggataatgtcggaacggaatcttccggcggatgggacttgattgtccggaggagaattgtaaacgtcggcgtttaaaggaacggtggctttggtaaaatcaccaactccagcctcgtttaaagcggtttggatgttgaagagtgctgggtacgttaggtttatgaatgatccgttgtacgctgtcaagaacggttcgttccccactgcaacgtatctgcaaaattaaaataaaaaattaaatcatactttagttcctagttttaaaatttccaaataaatttattcttatgatttaatttcgataaataacggttatgatgcatcatacatgtatttttacgtttgtacctatgtaggaaatttcacatagtatggtatgcatctttgcaataaagaggaattgaaaaagaaagattccgacttttttttttgtttcagaatacgtttagatcattagcaataaatacttgacacacacatgacggtccatatttgagtaaagatgaaatatgggatataacatatgacggtccatacatgcgatatgcataaaccaaattcaaataattcactttcagaagtatgtatgtattatattatttaacaaaaatatcaaaacaaaaaaactaatgcatatagagataaatgaaatatgtggtgctcaacaaataacatgtcaagaactgatataataaaagaaaaataaatgattcaactataatagtcgtccaataatagcagttaaagaaaaatattgagttgtcaaacaattcaaaactcaaaaccaaacgtgtaaaggattggagcttacctcagtttgtctaatctagtgggctcaggactattatagacctcctaatccaactattattattgttttcaacattttattttctatcattttgtcatcatttttaatttttttgttcatacaaaataaaataataatacaaattcaaaaataatcaactgaaaataatgttctgtgaaattccaatattccaaaagggtctaatatctgatttccccttttcagatcactacccaatatctaaaaacttaagtagtcctaagaaacttcttaccttatgttaaataacaaaacaatgagtttcaaacttacttgatcttaacgccgttgttaaagttgaatctagagacgtttctttggacccaatctttagctctttgatagtttcccatcgctaggagcagatcattagggatagccaccatcacttcgacgccggagccggcgagagctcccatggtgtttgtgtcggcatcgaacaacttcactttctgtatattgttgtctttaagcatctccaccaccgtcttcggcggtaactgatgactcgccattgttccccagtttactcccaaaccagagacaccgccggagagaaaacatacggcggagatgatgataaagacaacggcagagttagttatagcactctgttttcgtcgataattcatttttcctttgttttcctctgttttttccgggaaaattttgtgcttggtattagaaaaaaagaaatcttggaaaagttttaaagtttgaaagaagaatctgatgggagaagaattggaagaagtgtaagagatatataaatattttttggtgtgttttgtgttctgtttgtttgttgtagctcgatgattcgaataaagaatagaaatgatttgtttaagctgacaaaaatctgagtgaaggaaagaaagaaggaagaggagatcaaataggtaagagagactatagaaggaagaagaaggagaaacagagtcaaaaccggcctttgaaacagaaaccgaccattaaaatatctatagtttttaattaaaaatatataatttggttaacatatacatagactagtattattaacactatgatctataccatgcatttatagtttatttagacctaaccaacatagttggcgaagtgttagctaacataattctattttaagtatatatgaaatttaatcttttgcacaacacttcaagtttttgattctatattgtgtaagtttacacgtacgaatagagaaaccttataattgcaggttaatatcgctttcatagctttagtatgtctaagtagaaaacgttgattatctttttcaagatcgagtacgtacaaagtacaaacgtattttggagaagtaaccctgatggtgcatgtacgtaaattaaattgcaattaaatatcagaaacatccaaatacaatacatgacgatagatattcttgatttgatagcacactaataaaacaccaattaattcatttaaaaaagacatataattagtcccggttggtcgatcgtttcgatataataaaaagctgattatatcaaccagaaaaatcatagaacaaaaatttgaaatttactagttattataaaataaacttttaataaaatatcaatggaattagggagtcgacatgaaaaaaaaaaaaaaaaaaaaaatcccgtacgcggttagatgacattcagtggatatttattatcacaatatgatcatgttgaattttctttaggtcaacatgtcatcaatattactaagctgtgattttcattaatgggccttatctactgagccatcattgggtatttttaacagcactaatgggcccttgtagctgtttcctaaacataccgttaacttccttcgctcgccgaacattgtctctgtcattgagtagcgatcaaagaggcatttcgtcgaacacttggcgagcatagagcgcg

SEQ ID NO: 9383 - DNA, 3000 bp, Unknown
  misc_feature (1)..( 3000): cDNA_ID_3041654_gDNA_ID_1972110_Annot_ID_178751 3000 nt of promoter + ATG
aaacccggtgcggttcgttttttctttttcttgtcggcggttcgctttttcttttttgtcggcccaatatgttttataaaagcccaaatgggcagatattcggtacagaagatggccaaaagttagcccactaattgcaaaacacaagataagagaacaaaacagagacacgttgcaacgtgggatattgagagaagaagaaggtttcggcggttcgctttttcaatttagagactttcaggcttttttttttggtcaattaaaaactctacgttcaggtggaaattgatgcaaaaaaaagtttataaacacatttttgcaaaaagttaaaagtttttgcttaaccaagttatatttggaatctttcttccccattttctatggagttaaaaaacataaagaaacgaacaaaatattgaaccgaaaaaacaaaaattaaacaaaccactcgcggctaaagacaatcaaactttaatgttacaacttacaacagaaaaatgatttctgccaaatgaagttgatttatataagtaagttttattttttgtttgtgatatagaaatatagaattatagatcataagtaactaacggtgaacaacaaagacattgatgttaacaaataatgaaacaagactagctataagtggaaagaaaacgaacctctcatatagtttttttttctttccgttgtctatttctttatttttttttcgggttaagatgaataacaaagattcttgacttgagaatgcgactcacctttttcattattattttcttctgagtttttgattctcatattctcattctgaagaatcatcactttcttctttcctttttaaaaatcaatataaattgatgagcaaaagaatgtaattccgtgggtattttttccggcgaatgtagcccacgtgtttaagtatgcttcctacgcgagagcttcgaagcatcattagcaaagttagtcgtaaacaagaacaagaatctgctaaatgaatgtacaaggaagaacattcagtctctatcactccctctctcactctatctctttcttttcacttacaacagtgacctttcgaatggttaaaagataaacaaacaaaaaaagagagggtaactattatcaagaactaagaactaattgtctctgtaatatttacaaaattaacagaaacttaggtaaaaaaattataaagtataaccttgagaaacattttacaatgatccctttcgattttactccaagaaataggccctgcaacaaaagtgcataaaagtgaaacaatatcaagaattgtctctaaattctgaaatcttgattggattatgaactacttcactctgtaaccatacaaaggcgctgtaataaaacagataatttggtaagaaggaaagaatgtttatgagaagagtgcgtttgatgagattcattcaagtagacttttaaagaacttgcaacacacaaaatggaaagcatattctcacccacatggagatgaaactattttggtaatatgctctcatacttttaactcaaagattatgataggttctttcttcccgaaaccgaataaagtgttttgagaaatcacaaccatgagagatcgcctaaaaagtttggttcggtataaaataaatgcaaagatatcattcaagagaacattatatttgttttttataccttatgaacaatagaccatatcaaagcactcattaagcaaatgtgggactcaaaaaactggatatattctcatttgcacatacagtagtaatagcctacacaagtacaacatttggcagaccttattctattgaagatgagatgccttgacagtagtatgcacgcataaactattcgacaactcgaaaactgaagacatcatcgaaatagttgcatgaaatatacagtgtgagaaagttgccaagcaatagatgcagtaatgtttcacttctataaatgaatgaaaatatagacacactcacatggaccggagagataattgttattagatgagacaggaaaggctacaaacataataaaacagaggcatggaggggccaaaggttttgtgctaatcaaagaatgttaagaaaaaatgggaccctccagtaattttatagtgtgtagagagaataagtactaaacttgttgaaggagggacagtatgaaaatattctttatcatctttcaaaagcaaaacaatatggttacaacaaaaaaactttcacttgtttgctatctcaaactaaaggcttctttgaaggactaggtcaaaagtgtatcatcatcttgcactccaaacatagcaaaataaacccctattaatatcatcaatatcagctgactaaaagtcttgatataaatcattagactcataatgtacctagagaccgaaaatgactccatgaataaggaagaaaaacaatccagacaactgaaaagcattgggaatattccaagagagatagaggttattagtgttgtgactatgaaaatatcaaagaataagaaaagttaggaaaaattgggggaataagatacttccctccgccagaatgagcatatgatgcattaattgtggatcaattctggtatctagttgggttgaaaagttgtagtccataggaatcaatacatagaaataaaataataatcatctacaaacaaaaacataacagttcaaacgattaggacacaagtaacaaaagcatcgattggaccagtttttcatattccataccttaattatcgttctctaatttgccccctttttctccattcaacttcctatataaagcaaagttgcaccaaaccaacctgagaaaaatataaagcacaagtaagcaaaagcagcaaaaacatcttccttagtttttggagtttactctcttggaacttctgagagaagcaaattagatttaaacttacagttgcacagactttatgtattaccaaaaccagcaccaaggaaagaacatcctctcatcttcaagaatg

SEQ ID NO: 9384 - DNA, 3000 bp, Unknown
  misc_feature (1)..( 3000): cDNA_ID_3037283_gDNA_ID_1972110_Annot_ID_178755 3000 nt of promoter + ATG
aaataattcataaaggaggagagagaataacataactaaaaataattaaaaaaacgtttatgtagagagaaattttgtagtaatcattgagaaactatttgcataagtgactgtttataattagataattgaaaaaataaaaaaataatttaattagaaaattaagttataataaaatattacaatttaactcgccaaaaatatacgaatttaatacaaatatataaatggagaaacttcggctacataaaaataagaacagtgtacttttaaattctataatctccacaacttgcggtccacattatttttttgtaatatcaatttttatttttatacagttttctattgatggacatatacaataataaaggtgatattggaacttgtttaggaagtcgatcggtaagaaaataaaaagtcggtcaataatatgaatagaccaaatcgtgattgcattagaaagcaggagttaattgtttttgaaaatgatgaattaagtcggtgagttgctgcaaatactattattgactgactttttctataatatcggaaatagtacaatttaggagtttaattgttaaaatacgtacatatgaataattaattatgttaatcttcttgcagaccaccagctcgaaccatatgtgagttttgaacatgatattagttcaaataataagggattcagtaactaaattaaattgaattttgattacgattatcagtgcgttcatctagtaaatcaaataatatgatattttggaaattactatccattattttttatatgtaaatacccagacaattggaatgtaatggacaatatagacaaatagacagttaagttagttggagtttaggcgtcatatcgttgaaactttttatatatagcacccagagaattttattctaattttttttaataattaccaactatctttattggcacaaaccccaactagtagtcatcatatccagaaaacccaacgtgtattttcgctcattaaatccccaacttttaatatactcccttcgataaatactgaatttatatttatcgtattgtttgttcagtttcataggcaatgagccaatgactcgaaagtcagataatttatgaattgtagaaattgttgataataggactaaatttttaaaaatctacagcggcagtttataattgacaatcatgtttttcatttgaaatatggacagtcatctgagaatatttttgtgttcaatcagcacaaatatacaaattttaatctataatttcaaaaattaaattaggacgctttgatttggtattttttcctagttaatctttgcaggcggtggtttctttgacctttttattaaacacatgattatgccgacattaataaaaaaaagagagaatatgttcttattacggtgaatttactcattgaaactatgacttcaaaaatataatattataataagttatagtatatatgttcttattacttatggtatatataaaagttaacattgatatttaactctgtttaaatataagtataatttgatcattgtgttttgacataatatttttctccattgatatgaattctaaaataataaacatatatttatttatataccaataataaaattgaagattacgtcacactaccaccaattggttgataatttacactattttattccttcagcttaactggtaaggttaagaaacacaccacaaatggttgctaaactcttagggtcgtttgataaatgtctaatcaagctacaaagtacgatcacatatataatttagattatatatattatccattaaaccacatccaaataaatatccgaactgagaactcattgaaccacacccataggcatagctatatgtactgcatatcaattttatgtgatcgattttatcatttactctcgtatataaaccttcatagaaacttaaaatttcaagtttaacaaaatgaacattaacatacaaattcttttgaggttttcattagggattcctttcagtaggataataaaattaaatagtaataaaattttaaaagggacatattttcaacaatatgggtccacataacacgaagaggagccaaaccttttaacacttttgagtggtatattttccttcaaacgttttttctgccatacgactctttattttctttccaaaagaggttattttcaaaaggtagatgaaggtcatgtggctatcgaacccatttttttctggtggttggctaaggaaccccataagatgactatactgacatagtcctatgtaatgtacaaggaaaaaataaactaaccctcatatggaacataaaattattcgacagacgtgtcaccctatggatctaaaatttaatggtaggatctaaaatctaaaatatgaaaatttgtggaaaattccataaccatcccaataaattaattgttacatatagcaatattttattaattaaaatacagtttttatttgacactaagaagaaaaataatatttagcttatcttgaattatatatataaattgcttattaccctgaatttcatacagatatgagatatcatttaagatatttttgagtgttttctaattgtggggctttttcaacaagtaaggaagttgcttagagcttacgtgtctcttctacatcaccaaaaaaataagaaaaaaacaaaacataaagaaaagaaacattattgttttttttagctcttatcttcctctatataaagacattttttttctaccttcacatacttttattttcatttcctttaactgcatagttcttcctcaaattgctcatacctttgcttctctttctttctttattcaacctcttatttcttcttcagcaccaacgtgtatctgcagtaaacacatatccatcgatcgatctcctcaaaaagttattgttttcttgaaggatttttcttgttcttgatcaagcatacatatatatagatg

SEQ ID NO: 9385 - DNA, 3000 bp, Unknown
  misc_feature (1)..( 3000): cDNA_ID_3041651_gDNA_ID_1972110_Annot_ID_178753 3000 nt of promoter + ATG
gtttcgtgtttcaagcttatgatcctcattgttgccttgttgatgttggcttttgtgtccgtgcaatcctactcctattgataatctacctggacttctttctgaatatgagattctttgttctgcttcactcaccattgttgaaagatatggattccctcttagaccttctgtccatgtgagctccattctttggaacaatggttcttccataatctctttctgctccgatgttgaatcaccaatatacgttcttagtcctaatctgttgttctctagcattttcgagtttttctgcgttccctcgcttgaggtcaggcaactttcaagagagcaatcaggtggatagtttgtttgcatctgttgtgagcataggttttgaagttcttttggttctaggaaactagagtttgggtactctgctgatactttagatactagttccgagagttgaactttggcagcttcgatcccagctgcaccgaggttctgtcttccaagagtctcttgtgctttctccaaaaccgattgcaggtacttcccttgagcctctatcctaagctgcaaatgtcgctgtacctggctcagtttaaatacgaatatgtaaactgaatgcttttatatttctacatactacaaacttatcctctaaacactgactgataattctaagtgctttatgaactgcaagaatctttaacgtgtttaattggagtaaagaacagtgttgtagaaatatgatacctcaagttgctcatgaagccttctttggacctctatttgcatttgcagtgcttcacctattggtgaattcctatgtgtgtaaacagatttggtcagtttgtgataagctaatacattagatggtatatagacaaatattcatatttatacttgtttggctgtggtccaatgcttaaattctcgctttgaatttcgtctgcatcaggagtcttttcttccatcatggtcattatacctattttgttgaagctgttgttagcttgtccgttgagattcttgctcagcctgtatttctggtagccaatattgtaaacttaataaccttttgtgaatgcaaaaaaagagagcttatttctgtttttgcagtttttcggatctgcaacaacatcagcaaaggtatatttaagtgttgaaatgatggcttacctgaagatgacttttgagatggtataaggtaaggcctggaatccccatgactttcatgattgtcttaggagtagcttctgcaacagaacagacaaaaagtatactatattaatatcaaaaaagcgtgctagtcattatataatcctcttgctaatgatataacactcactatctgctccaccgagttgattgactgcttcaatgaatctctcatgaagatctggagtccattttaggcgtggctttgcatcggttgataggataagtccagaatcacctggactattccctctaaggaatggatgcctttcagaagttatatgcattcttgaagatgagaggatgttctttccttggtgctggttttggtaatacataaagtctgtgcaactgtaagtttaaatctaatttgcttctctcagaagttccaagagagtaaactccaaaaactaaggaagatgtttttgctgcttttgcttacttgtgctttatatttttctcaggttggtttggtgcaactttgctttatataggaagttgaatggagaaaaagggggcaaattagagaacgataattaaggtatggaatatgaaaaactggtccaatcgatgcttttgttacttgtgtcctaatcgtttgaactgttatgtttttgtttgtagatgattattattttatttctatgtattgattcctatggactacaacttttcaacccaactagataccagaattgatccacaattaatgcatcatatgctcattctggcggagggaagtatcttattcccccaatttttcctaacttttcttattctttgatattttcatagtcacaacactaataacctctatctctcttggaatattcccaatgcttttcagttgtctggattgtttttcttccttattcatggagtcattttcggtctctaggtacattatgagtctaatgatttatatcaagacttttagtcagctgatattgatgatattaataggggtttattttgctatgtttggagtgcaagatgatgatacacttttgacctagtccttcaaagaagcctttagtttgagatagcaaacaagtgaaagtttttttgttgtaaccatattgttttgcttttgaaagatgataaagaatattttcatactgtccctccttcaacaagtttagtacttattctctctacacactataaaattactggagggtcccattttttcttaacattctttgattagcacaaaacctttggcccctccatgcctctgttttattatgtttgtagcctttcctgtctcatctaataacaattatctctccggtccatgtgagtgtgtctatattttcattcatttatagaagtgaaacattactgcatctattgcttggcaactttctcacactgtatatttcatgcaactatttcgatgatgtcttcagttttcgagttgtcgaatagtttatgcgtgcatactactgtcaaggcatctcatcttcaatagaataaggtctgccaaatgttgtacttgtgtaggctattactactgtatgtgcaaatgagaatatatccagttttttgagtcccacatttgcttaatgagtgctttgatatggtctattgttcataaggtataaaaaacaaatataatgttctcttgaatgatatctttgcatttattttataccgaaccaaactttttaggcgatctctcatggttgtgatttctcaaaacactttattcggtttcgggaagaaagaacctatcataatctttgagttaaaagtatgagagcatattaccaaaatagtttcatctcc

SEQ ID NO: 9386 - DNA, 3000 bp, Unknown
  misc_feature (1)..( 3000): cDNA_ID_2181832_gDNA_ID_1972110_Annot_ID_178745 3000 nt of promoter + ATG
gcaacacagtttgcagtgattcctgttcctttgagctcttttgcaagaatcttgaccatagtttccacagctgcctttgatgcggcataggcaccaaaccctggctttaaagatcgagtctgggaagatgtcagaagtatgatccgaccaccacctccttgttttagcctattggcagcttccttgctacacaggaacgctccttttgtgttgacactacactccattttaaaagaaacaaacagaggattattggaaacaagaatgaaggaactttagttggaaattagacatacaaatctcacgaacatggaacattggatgaaacaagaaacataagtcgattaattagccacaagaacacgagacatgttgcatttgactcataattagacatacaaatctaaagaacacggaacatataatttcatggttcatggagagtgaacaagaacacagattccactaaaatctcagttgaaatatactaaaggaatcagctttctaactcaaaatcatagaacatgtaacaattgatcaagaacttatacataatcatcaacctaactaattaacaaaaaaaagtttacttttccagtattgagcgggaagacaagaacccaatcaatgaagataaattctctaaaggaatcagctttctataacgaacccaatcaacgaacagtatcgagtatatacctgaacgtatgatcgaaatcttcgactgatgtgtctgcgatcgtagggtactttggatcgagaatcccagcagagttaaccagaatgtgaaccggcgcttcaaaggcactctccgccgcatcaaacattgatttaacctggcttggctcagagacattggcctgaaccacaatagctcttggtccctttccagtgatttcttccctaactggaaaatcattgatctccgacgcgacacgctcggcgtctgcggctttagaggtgtagttgataacaatcctcgcaccgagttcagctaagtggatcgctatcgctcggccaataccacgggaagagccggtgacaatggcgactcttccggcgagaggaagcggcggttgcgagattgatgaatgtgtagacataacgatttgaattcaatgagtcttagcagtgatgtgattggagtgaagaagataaattgggattggccctcattataagttcattcatattgttttacaaatcagcccctaactttatattttaacaaattgacccctacccgctccttgacagttttcctctttatatcttcatatttatagattaatgacccattcatttctccatttaacaatttaaaccgtattctttcctctttatatcttcatatttatagattaatgacccattcatttctccatttaacaatttaaaccgtattcttgattctttgtccagaaaagccttacatttcgaattggggaaatatccttcttttttcttttttgtggtttaaattatagatatatatttaaaagtttataaacaaaacaattttctttgtaacattataatctaagcttagattttttttttttttaaaccgattatttttgccgacacagttttattgttttgtcaattgattgtatttactgtagtcaaatatttgttcccaaattgaaaccaaggcattggatttggaccaaatttttggggtaaattatggaaataaagttcatttggcagtaagaatatgaatgcaatttgactactattttccataaaatttggtcgaattgtatctggacaatggacaataatagagattttaatcaaacaggattcgatgaattaaatatttttttttaatttaaagacaaattgatatatatatatatatatagttttaattaactatgagactaacatacaaactttaccggtttgtgtaaaaaacattcaaaacaaccccataactaaatcaactcccatgatctttattttgggtaaaagacctccaacgtatcctatttcttagctacattaaattcaaaaggttcagagaattaagaagctaatcaaaaccattctatcaaattactaataagcagtcgcttcactaaattagtttctacaaaccatttgcagtaataacaccaaggttctacttggttgaaatataaatgttggtaccatttcgataaatacaaaaaaaataaaggggtagatttgctttagacccaaaaataacggagacttaccctaaacccgcccatcacaccaaactctcaacattcaaaaacaaaaggttgaatcctttttttctctggttttcttcttcttcgcgtcgtatcgtaaaaagagaagaagcgcgattctctattggtatctggggactctcagattcttgggtcttcttgatttttgctgggaaagaagaattggtactttaattttgttgggtcaatcttcgctgtatcagacactggttctcttcgttactttgctattcatcaactttactcttttcagaattcgaaactctgtatttctcgattagggttatcttcaattcaattcgattaggattcgaatttcaaaaaaggaccattttcgtgtatttatcaatagttcaatacggagtatataatccctttttgtgttcgatgatatttatgttcacagatcaagatgttcattttttgttaaaaagatcagtttctgggaagtttaaagtcatcgatttcatcaattttctgcggaatttcataattcatccggagaatgatgttttcatttttttggttagttttttttggaattgattatggtacatttctcatatgaaaattggtgttgattgatttgttttccttattcggatatgatttagaatcatttagtatctcattatgaaaaagttactaggatacacactaatatatccgatactgttgtcatttattgtctagcttactgaattcatcattgtggctttttttgcttttcagaggaaccaggagggggagaatg

SEQ ID NO: 9387 - DNA, 3000 bp, Unknown
  misc_feature (1)..( 3000): cDNA_ID_2181828_gDNA_ID_1972110_Annot_ID_178744 3000 nt of promoter + ATG
tttcatctgcccaaccttctagggttttccttctcttaaagcttatcccttttttttgccttctctcgatatggctggagccgcttcttctgatcgtctcgtcactagcttccctcttctgggtacgttgcttttagctcaaagattaaaacttttttggcatcggaagttatcattttgtgctcatcttataacttgcgattgatttctacccttgggtttagggtttagcgactagtgttatcagtatctgtcgtaggttttctgtttctgataggattgattggtgtctagagttctctacaaacctctttatgggatgctagatgaaattttgtgtttttctgcaagttagtgtttttttatctgcttatgggttgaatttcaccagtaatttgccttgtttagactgtgcaattggagtttgaggctttgtcattttaaaatattaactgggctcttgtatataatcgctgcagatacagcagatttgtttcaggacttgtctttaggttcagatgcaaatgaagttcctatgaactttactaaggtacttaattactacttctttttgaaaatttaaagtttttggaacttaaattgtgttgtgtcgaaggatctttaactacaaactgttctgtggagaggtcttgctgctcatttaatgtgaatttgatatactgtgagttttttttttgttaactgactgttttctgagaagggttcttttcagcatccgtatggtcatgcaccttatggtgcatcttctcatggaagtgaaagaaggccaaacatgaatgctggcaatctgctaaatggtggagactcgattggttcatacccgtggggttacatcccagcaaactatccttctggtggctaccctgatccgaggtttggttatgaccgcaacagcaatcacagttccttttcacatctcatggtatgttggttacttcacatgacctctctgcctcttttctgtcttcatatagtcaagagaatgtgtgttttgttctcttcgtcatctctgctgggacttgggattttttttttgtctaattactggctacaactgttttatttaacagaatccacacagctcacaagaagtaccaagttttgaccaattgggatataatgatcatttgtattccaaccatggattgtatggactttacgggaatgtaattgactctggtcatgcatatggaacttttggttatgattcctggaaacttgggcgaggatggtatcccgttgatggttatagaaagaccagaagcttcaatcatgggcgtggttacagtgatgagaaagcagataggcttaatgagctatgtcgaggaccaaggagtagtgatttcaagaatccacaagttcttaactcttcaatgctagatgcaatgaagcaagacgtttcagcagtagatctccagcgctacaatggggagaatttccctgaatcatttgtgaaagcaaaattctttgtgatcaagtcatacagcgaagatgatgttcataactgtattaagtatggtgcatggtcgagcacaccaactggcaacaagaagttgaatgctgcatattatgaagccaaagaaaactcccaagaatgccctgtgtatcttctgttctcggtcagtatgaggttacttcacgtcttgtgcaatatcctttcagatttacattaagtaactcactgtaatcggttttatctacaggtgaatgcaagtgggcaatttgttggtcttgcggagatggtaggccctgttgatttcaacaagacaatggagtattggcagcaagataaatggattggttgtttccctgtgaagtggcatatcatcaaagacataccaaacagtctcttaagacacattaccctggcgaataacgagaacaagcctgtcactaatagcagagacactcaagaggtccgttgaacttcccctaaaccctttcttggacatgtttgaagcctaattgaattctaataaataatgattatggctgttagtcaggcttttaaactgtacggtgatggttttggtacaggtgaatctggagcatgggaccaagatcataaagatcttcaaggagtatatgagcaagacatgtatacttgatgattacaagttctatgagacaaggcagaagatcatcagagacaagaagatcaagcaaaagaaacaggtacaattccttaaaccctgctgcatctaaagcacattaaccacccctcttgatacagtctctgggattgtttcattttgattgttttgttatattaggcccttgatggagcttcgggggaaacaattaacttgagttgaaagatggaatcaatgcaaggaaagaagaagatgacttaattaaaagaacttagttttgaattatgttttttcttcagggttgggatttctaaaaacctaatacacatctttaatctgtgtgttttctctgcttatctaaacaaaacttacattgtcttttgttcctcttaaggggacgcacatctgataaaacaaaaactcaggctttccttcaaagttcatatcatgttattttcaagttatttctcttttagtccctaaactttcatataataagactctcatccgtaaatgtcaaaaatctcacattttggcccacatcaccataaaagttaaaacgacaccgtttagcacaaaaaccagaaggaatggtgttctctattcgtccctaaactttcatataatacaactttcacccctaaagatttaagatctcaatttttggcccccatccccttaaaatttaaaacgacaccgttgtgaactcccattttaaaacctcgaaagttttctagggcaatctcggccacttttactcacagaaaaccttctctctaaacttcttcgaaaatctcacagagcttcttcttcttcgcttttagggtttttgctctattgtttcgagtgacccaacttcgaagcttatagatcgttaccttagaaa

SEQ ID NO: 9388 - DNA, 3000 bp, Unknown
  misc_feature (1)..( 3000): cDNA_ID_3041693_gDNA_ID_1972111_Annot_ID_178769 3000 nt of promoter + ATG
tccgtatgatatcctccatctcgtttgggccaaagtaaagaaagtcttcaatctttacttgcggcaccaagggctcggttgcgtatagctagtcggacgtcccagctttgtcggccatcggagcaagggtccttcggacaagaggcagctcggtatcgtcgggcaaatccaattcccgagcaatgacagcagtggtatcctcccgagccgtgaaaggggttatctgcttagaggcgttcgaagacgatgcaccatcatcctccgaggatgtccaaaccatctttcgcttgcagatagggggaagatcgtacagatggttcgaatcgctggagtcgaaaagagaggcgctcggggttgtgggagatccagaattcattctcggctcagagacgtttgacgagacgaagaactacgagaaaaaaacaaatgctttaaccggcaaaatcaaaacttataaagaaacggcggagcttcaccggaaaaagggaaaacaataagaatatcaagatcagagaaaaggaggcaaaccttgatttttcttcttcaaaaacttcaaatgaggatttctcaaagggacggctctcaatatatagaactttgaagggcgcgtcgggtccgcaataaatgatgaaacgcgttagaagcgcgtgggctcggcagaaagagaaacgtctgcgtgatcctcgggaataagcaagaaacgtttccacttctcaagagagagtcggctgcatgtaacagggcgcctgaaacgcctcaggcatcactacagagttgtcccgagccggcccggaaacgcctcagatatcacttcaaagagccatcccgagctggcgttggaacgcctcggatatcaccacagagccgttcgagccaaccttgaaacaggtcgggcgtctttccaaagtcatcccgaagcagatctcgaaacgcctcggacaactttcactcggcttttgatgcatccaggagacgagtcgcccaaccacagccaaaggaccaacttgacctggctcgggagaaacttcgtatccgaggagaagacttagaaccgatgtaaaatcgaaacgttactcctggaaaacccggaagtgatactggaaaatctctaaggatattgccgaatatggaagatcccgcaaaattctctaaggataaagttaatctccatcaccgactcttagatatctggaaatcttccgagaatatcgagggaggcgatttgccaaagccctatataaagcacctccaaggacaaacaaagaggacacgcacaaaaacgctctcaacttcaggctataaaaaacgctctgactttgaaggctaaaacacttattttatatatttctaaacacttgtacgatcaaatcatcattatctcaataatataattaagaacaccgtctgcggtaatcagcaattctgttgttctttgagaatctcacagagatccgttctttgaaggaaccctgtagtgacccgcgtaaggacattggccataggcaagagtccaaattttcgaaagttgcccgaatgcatggccaattgaccttacgtgcccaaaagaccatagaataccaaagggcaagtttgggcaagaacgggcgtgccacgggcaaaactttgccccgctgggcgttgaccgaccgttgaccgcgccaaggacgcgtggctcggcaagaacgggcgtgccacgggtgaaagtttgccccaccgaatgttagtagcttggagccgaagtttaggtggccacgtgtcactcatccgtttgagtagcaaacgtgtcatcgcggttagatgacacgtggattggtgattcgcccatactcatgacacgtggacatgctgactcgccattccctggcctataaaagcccaactcgaccccatttgattggtgaagagaaattgagcgggagtgagaggctgccgagtttaaaccgttagttcgatccaagttaggggcccatagccgagaactctgcctgaatcgttagaagctttccgttggttactgagtgagttctggataatggtttaagtttcataatcatatcctcatgcattcttgattgatttcatgacttatatgaattatgtgaatggttatattagattgcatatgtgatctttagattcttatgctattgcttatggttgagaggttgtgctgagatattgatgattctatgtgttgatttaaccgtatgtctcataatatcttaaactttggggtcttggtacgtggtgcttgtggtaggaggcaaagaccataagcgtgccaagatcttgatatgtctggccttcgtagtgaaccgtgctattgtgaggtgttgtaacgttgttacttgattgccatgaagtgcgaataactcggagagacgggactagctaccctggcagagtgtctacacgacggtgtagcgtttggtagtgatgctccggttgcataccgttgtggttgtaacgcgggagatcacaggagtgcgtgtttggtgttgggtttgaaggcagcatatcaagccctatttaaaagatttaataaaactggagtcctaatgcattccatatttatgtagttgcttcggcaagctacctttcgttgccattctctgttgcgtgtttcatgttgggtatttgtgttggggtaaactaatgtttgttgcagggaatcccgagcgcactgagtaatcttagattactcatgattctacttgttttgcaggaaacccgtagtgggaaatagagggcgtggtggacattaggaaacccggagtagttttgtgccttttgtaaaacaagtatgtttctaatatgtatagtgcttttggcactaggccttggccatgaaacttataaatgtttggtaacatgttgtgtaatatttatacttatgaaataaatcgggttttcttgtacaaattgcgagtaatgactgataatgacttagtccgagtcggcacaaaatttaaatatcgcgagggttggcaagcctaaacg

SEQ ID NO: 9389 - DNA, 2086 bp, Unknown
  misc_feature (1)..( 2086): cDNA_ID_3041709_gDNA_ID_1972112_Annot_ID_178792 3000 nt of promoter + ATG
aatcattttttttattaattacatagctcatttgtaaatgtaaacacaatcgcgaacgcaaacaaataatcaaggtctaaagagaatttacctaatccaaacatgcttgttttctgaatagagacacggtcgacttttgaccttttgatatttcttaaagccagggtatcttcctgctttcctttaaactcgaggaattcccctaacacaattttgctacttttaagctccactctgcagcataatcaacttttaatgaaaactctttgaacagaactacttcatcaagggttcaagagatgagatgtatgaccaactcagacaatttttaaattgaacgtcaataaagatgagatgtatgacctatcccacgttggtgctgtgccaaggatgaaattaagtttttgatgcgaagattcctgcatctcttttccggtgctgaatgcgcctttaacccaaccagaaattttactttttgatactggttttagctgttgccaatcttcataggtaattacctcactcgggaatgcatgaattgtactgaaaaaaaacaaaaagaaaacatatatttatgcaccagtaggaaaataaagaatgtctttacagaccaagatagccacgcccatgcacgcactacaagatgtcctgtacttcaaattgattgcttttttgtctacctcttgcaagcaggaagatactgacggtagcaaggataacgataacataccgaaaacttggattgggaatgacaactttgcaagacacatttccttctagtaaagtaactcccctctgttcaagatatgattcaagaactgaagcttgtttcttgacctccgccagctgagaaaacacacatccattagtcataaacaagattgcatagatgcaagatgcaggtcaactttcctaagtcgataaaaatacaggagatttgatcaagagacttgaaatgaaacgtgtaagaacgatccaggagaaaagaaaggataaccaagcacattcgtataaataacaagaatattctgtttcataatctactcaagcgacaatcatactctctactttgccaaaacatatacacatttacaattcgatggagaccttacataaaatgaacatatccaattcactgtggtcgtgcaaagagaaaaaccctataagcctctagaagtaaatcatcagtgctattttctcacaatgacataattatgcaacaaggagatagcagcagagttccaatatatgtatcctttacaatctagaacagaaaattatagagaatcactcacaagcactaaaacgacactctaataacttggatgttcaaactataagcattgtgtgtaatcacaaagaatcaaacaaaacttacaggatcagggaaagtctcagtagtatgatgcttgccaccttcacaaacccagctaccatcactagttaccgtaacaatccccgatagattcttcacagaaatcactacaacatctcctttagtaacaagaacaacatcaatgtcttgtctagaagcagtgtcggcatctggaattcgaagtcctacataagcttttccaccataaagtttctcaagtctgcaataacaaatggaaatcagaatcaatttcagtggaaatcgagaatcgaaaaatggagtatggggaaaatcgggaacctgtgagcaacggagaagagagcagtggaatcggaagtttcgacgtcggagaattcgtcgtcgtagaagaaacggcggacgagtttgtagatgacgagaccgcagatgatttcaatccacatcgtttgcttcgtcttgttgttgaaatttgggaattggaggattgagagaaaagagacgattcttggaaattaagaaaaaagaaaaaaccccagctgaagtaaacgaacaacaaagatgctaaaaactaacacaaaaaagtcggttcaatcgagccataaaccacaaaactaaccggttttggtatccggtttaatttacaaaacagtcttcctcttcaataaaaacctaaaaccctaattattttcaatcagacttccactttcgaaacctctcaccgaagctacaatg

SEQ ID NO: 9390 - DNA, 3000 bp, Unknown
  misc_feature (1)..( 3000): cDNA_ID_2182204_gDNA_ID_1972112_Annot_ID_178797 3000 nt of promoter + ATG
atttacacattttaggatcctctacccaaagtcaactctctaacacatttttcttttcaccatgaatctttaaaatcaaagaagtaaatcactggtcaacctattatatttaacaagtgcattcactaatcatatctcatcgaataggtgtgttgattctgccacggtgaacaacctatctgtccatttttagtttggtgtttaatcttcagttgcagaaacaacacaaaagcaagagaacgatttgattaattaaaagctaactaccatcatcccccatgcctcaatacagggaaataaaaaaaggaaacacatcttccactgcgaattctgaaatgagacaagagagcgtacctgaaagatatttactgagctgttggttacccagtagacaagacttccctgaaaaagaaaagaaatatttttatttactgagctgtttttatgaaaaaagaaggtgtcacaaaaacagaaagagattgtacttacctgtggaatagcatagccaacaaaaaacagaggaacgcttaagatctccagatataacttgtaatactacaaacaaaaaaacaagtacaatcttcagattatggacgcatgaaatctaatattaataacaaaacagaaacatggacatgagtaacatcactaacaataccaatatatcttcatgctagaaaagaattagtactccaagcatacaacaaaattctgtaagacttaagtaaccaaggcagcagataagacttgttcaactcactctcatgagcagcccagtcaagccggtagtttgacgaattgtggatgtatcaaaagaaatctggaaaaagggttaaaagttagaagcatacatatataatactgtcacctgcaatttgaatactcaacggaaacaatactgcaaaaacaaataaattgtaagagtaacaagtataatatcgatcccatcaacatatattttaagctccaagtattcgcaagaacctgtatattaatgtaatggaaggtagcaattaaaattgggaagactggtccaaaagagccaccaggaagatcactcaagttctggaaccataagacaccaccctgcaaagataggaagcagctcagtctcagaggcaacagcaaggaaatatgacaggacagactcaggtcaaatatgctcgaggctcaccagttttcatagtatacaggtgttaaatttaattctacaactaaggtctagcttcaatataatagtccttaaaacgtcgaactagcctacccttgtcaacatagattgcagccatgtagactggtattattcatcaattgcaactagctaacttagatgcccagatatgctaactcgaccaacgaaacccccacgaggaaaggggaagagaagagtttgacttgatcccaaagaaggattctttcctcatcacaatcaagaaggtcaaaaaatacaagtcattcttatgcagtctcaacttacagaatcaaagccagggtgaccatctagtgacatcttccggatgctagccatcaacaagaaaaagcatgggagctgcagataacaatagccaaagggaaagtgagaatgaatgcaaacaagtgacctatttattaaatgtatcaacatagaaaaaaagactatatcatttatgaagaaagccaaggatcaagtgacatgaaagagtttcatataaggtagtaaacagatatacaagcatgtacgatatggatctttctgcaaaaaggtcaactctaatcgtaaaacaaagcaggactgctcttgtccagattttcacaaaatcttacagacaaaccagaatcacaaatcactcaatagaagatgttttttacctggacagataagtatgggaagaaccacaaaaaggaggggcacccaattgctcgactctctttaagaaaatgagaaaactggtcaatagatcctttcaacgttggagtctctgggatcggcataggcactgtgtaagaaatgaagaacattatgattggcttttaacttcatcaacaccatacaagaatatacagaaccaatcacatagtttgcacaaccatagagcgatgtctgtcaattattgtttcacatgtaaacgagttccatgactaacattgaaacaactaaacctagtagaaaggtcatgactttggtatcaataaagaaactgcaaattataaaaactacttataaagtagagaaataatactaacacttcggtagcagctctgaaatggtcttcaatttcttgagttgaagtatgagtaaaggcaataaagctaatctaacagcaacagtagaagatgcaataatcatccaccaaggcaatcctgtgaattcatgaaagccttcgaggaaatcaacgacggcgagaacaggtaaagaagaatcatcggtagggatgatttcttgagacccaattgggaattctggtccagaagagagtaatcggtggagaggagagaaacacgtcggagatggtgacggcgagggagagaagagaggaggagaatgggagatgaaggaggagggtttgaggtggtgggagaagaagagagaagataaacggtgacgagaggaggaggcgcgtaaacaactcctccacactgccattccagtttttttcttttgcctaaaacccagacagagacttcaacaagaggtttttgacttctgaagaactagtttgctttgattctgtaaggctgaaccaatcggttttggtctaaaccaaaccgaagtttgttaaatgtacagaaattattataaaaataaaccaaaattacaaacaaaaaatcgatatttaacccagtaaaccgaaattatcaaagaatattgaccgaacaaaattgttaaaacggttcaatccggaacaatttcctttaacccgaacaaactgaagttccggacagaacctaactgaactgtgaaacttccgattgtccacatattaaaaaaggataatagataattcattcaccacaggcatg

SEQ ID NO: 9391 - DNA, 3000 bp, Unknown
  misc_feature (1)..( 3000): cDNA_ID_3041697_gDNA_ID_1972112_Annot_ID_178798 3000 nt of promoter + ATG
tatgtcctttttctttatgcgtactcttatcttaccatgctggactagaactgtatcatcatcatctccaggttcttcaaccacagtacctaacttatctcccagtccagttacaagaactttttcaccagcttgtggtgagtagtcactgtattcttcttctaaggaatcaggatccataggacagcaagcttcaataatctctgcaactgcctcttcggttttcaggattaaggaattgtattgatcagcttgagtgatttctagttgactttcaaattcagccaccagtctctccatctttgacttagcagagtttagatcttcttgcaccttttgcgtttcttttttcagaagagccctctcacgtttatcaagatcatgcgactcatgctcaagcttcaggaaaaatcaagaacagaaacatacattacaagagattaataatatcaataaaacaacattcttaaatacctcgtggtaaaggttcattaagtctctatgaaaagctgcagtcttagttgcctgaagctttagtttatttctttcttccataagggactgaaagagtgagcctttccgctctacatcctgctcgggattcaatttctccgtccacttatgcgcattctctaatattcttttattgaaaccaatggacttagctactctcaatgcatttgatagaccagtacttccccagagtactcgaaatgtaggctgcaaagtttccatggagaactccattgcagcattttggaatcgaggttcattatccttcaagcgacttaagtcaccgtaatgtgttgatacaactgccacattaacacggtttttaatatactgtaggatgctagtagcaagtgcaaccccttctgaaggatcagttccactacatatttcgtctagtaagacaagtgaattttctgaagcaatgtcaagtatctgtcgtatccgtgagatgtggccactaaaggttgaaagactttgctccaaagactgcaataagaagtttataaaagaaaattctcgcaaatgtaaacctcgataagaagataatcaagacgttagtagctctattatcttgcaaggaattcataaggtaatacctgaggatctccaatgtcagccagaataagatcaaaccaaggcaaccttgggcagttcttagcaggcaaatacatcccggacttggacataagagacaataatcccaatgtctttaacaaagcggtctttcctcctgtgtttggacccgagatgacgactactttggcactgctttcaactttaatgtctactggcacagggaaaatgtctccaccatttgggctgcctaatactgaaccaagaagtagcgggtgctgcgcagaatcaatgtctacagctaagcccggtgtttttgtgtgttctgaagttacgttgggatagacaccattaatccaatttgcatgtgatgctcttgcaaaagcaatgtcaagttctaatattctatccaacaaatgcaatatctctctctgcgccatcaccacctcagatgtcaaaatgctcaaaatcgccatttcctcagctttctcggagttcgcatgtctcacttccatattattaagctccactgcctctttcggttctataaagcatgttgccctagagctactaacacttaaaacaacaccacctggaagtaaacttttgtgtgtagctctaatagctacacacatccttgatctcctctgcgttatcaaaggcttgttaatccccccagctagaaaaatcttagttgatattttcttcaaaagagaatccaaattctccatgtttctcctccgttcagatcttataatctctaaatcttcactagctctatcaagaatcatagtcatgttgcagtctatacaaaaactaatcttctgctgtaatgtatccttgaaatcacaaccctgtagtatatctacaagtggagtaaccctacaaaataacagaagcaaaagctagaaccataagcatctcaatagcaataagaacatctaataactataactgattcggtagcgtaccacggttcaatcatcttataaacaattcaagaagactaaaaaatttcaaaatgtctacattagaagcagaacacaaacctgttatcactaatggctgcttttcggagtttctgaaacgttgatgtagcagccgttaacgtgcttcgaacggtacagagttctctaacggtaagcaattgaccggacacagcacgctcaacgatatcagacaagtcttggatttcagaaagacctaatcctcgcgatttcatcatctccatagcagctaatgcagctgaggtctcgttaaggagattcctgctttcttccggcgagtttcccaccggaatttcggcgtttttggtggcggaaaggcccatggttgtggaagcgaacggagagagctgattgcagagggcacgccattcgaggacttctagagtttggttttcgactgactgtgagtcgtctgaggaggcggcgcgtataattaacggagaagcgacgcgtaatgatgacggtgaggcggcgcgtgaggatttgagatgaataggcgtcggtatgagttggagtggggaataagtgttcatgcctgtggtgaatgaattatctattatccttttttaatatgtggacaatcggaagtttcacagttcagttaggttctgtccggaacttcagtttgttcgggttaaaggaaattgttccggattgaaccgttttaacaattttgttcggtcaatattctttgataatttcggtttactgggttaaatatcgattttttgtttgtaattttggtttatttttataataatttctgtacatttaacaaacttcggtttggtttagaccaaaaccgattggttcagccttacagaatcaaagcaaactagttcttcagaagtcaaaaacctcttgttgaagtctctgtctgggttttaggcaaaagaaaaaaactgga

SEQ ID NO: 9392 - DNA, 3000 bp, Unknown
  misc_feature (1)..( 3000): cDNA_ID_2182186_gDNA_ID_1972112_Annot_ID_178793 3000 nt of promoter + ATG
tccatcgtttaaattatatatataatatatatttaagagtcagctatcatgcttaaatttcaggtttaatacaaatcatgatatcattcacacagttttcttatctatacccgaaccaaaagaatgttgctaaacttcaatttcagatccagttagtaaccaaaccagaatgatatattgatattagactatagtcatccaatctcagttcagaaaaaataaagtaaagcagatatagtaatcaaaatcctttttggagatatcgaaaatgtccatcaaaccaacaatttaaaaacaaaccaggccagctttgtagctttaggcccattcgaacacattaatttaatttattttatgttttgtgcaactcttaaaacttctctatataaatcctatctaaaccctagatctaatattaagtgcccaagaaatctcttaagtctctctcgttgtctcaggttggtcgattccttctctagatttccacttgtttagtctttcaagagaataaagcacaaaactttctataactctctgtgtcattttcaatatctgagaattctataaaaacggtcccttgtgtatcacatttagttcatgtaactcgatttttgtcggatcttttctgattatgggtatgttttgttttgctctctagcgttgcaacatattgtgtagagaaaatgggttcaaaggcatcagattctgcaatgttgaaaacttggagaaggaaccctccttcttcttctcttgtcagactctctcagcttgctaacgacaaatacgaatcccctcctttctcgtccggtggacacaactggtatgtgatctttttcttagctaaagttcacatctttcttcgccaaagttcacatatttcttcgctaaagtttacatctttcttcactaaagtttacatcatgaagtttacatatttcttcactaaagtttacatcatgaagtttacatctttcttagctaaagttcacatctttcttcactgcaacatatattactaagaaatattgccttttttgtaaaaatcaggagattggttgtttacccgaaaggaaacgaagctgacaatggaaggggctttgtttcaatgtatgtggaatgcctctcatcgacaacaccacccattgatgtgtttgtctatctcactttctttgtctttagcgaagaagagaagaggtacctctctattcaaggttcgtttcctcttacccttattatctatctctttctctgtatatatataagaatgaagctctaatatgtgttgatacatgttgacatgtagatgttgaagttaagaggttcaattcctcaaaaacggtttggggattgtcacaagttcttccggttgaaacactcaaagaccgtgcaaagggatttatcttgtcaagattgtttcacaacccgcctcttttggtgaagttctcccttttcacaaattctcttggagtattcgtgatttcgctctcctagaacagaatgattgcgtatccaaaacctttcacatgggagaaaaagattggtgagttttttttgttctgatagatattgttgtatgtgtgcaatagtggtaacttgctaacaagtggatggttatgtacttatgtttcaaaggactctaaagttgtatccaaagggggactctgaggcagatgacaagttatcccagcatttgcatttagctgacggggaaactttatccaagggtgagctgattttcgtgcgagtgaacctgcaggccgcgtggatccaatcaccttaaaggatggcgtaagtcaaaaactattgatgttacgatttcgcatgggataaattaggagctgatgacattttcaatagacgttcttaacttgtgatgtcaaatgtcttactcctttaacatacatttcttgtttttgtagttaaaggttggatcatgaactcgaacaaagagatgggtcttcctcaatccatgtctttcgataaaattgagggggcttacttggaccgtgaagggactttggaggtagagatcgaatgtgaaattgaaaactcccataaaaaccatcccttcttttaggatatctaccatgccatgtctactactctaaagtctaggactactctgttttatgcgtaaaattgaatgtgaagttaacgctctatctatgtatttatctaccatgcatgtctgactattgtatgtctgtatgacttttcatgcgtttattaatgatctttagttatttaatttttgcttttggtatatcattgtttttggttgattaaagttcatgaaatcttgttatgattgaacttttgcatttttcatctattaaggtaacaccaatgctataggacatattagagtgaattagagattcacttaaaaatcaaatgctacaggacatattagaagggtcaaaataaaaatttctatacaaaagactcgaatgggtttctatcgagtatttttcggatatgatcttcgggtcgtgtttttccaaggcctaaagcattttcgtcgatagtgaagaaccccctagacaaagaaatagttgggctttaaagatttcaaatctaattgggccaaattaactcgtgattgatatgtctaactcttctacacgtgtctttgtccaaaaaacaaaactcttatacacgtgtcgttatatcattggttgcgcttacgcagacgaatttctaagagagcttttcttcttcctcctccctcttcgttcgtgatttctcatttccttaacggaaagcttaaggctttaatcattatatctcttcttctacctatacacgactctgaattatcatcttctcctgctagctcctgatttcttctctcctgtaagttatttgattgaaacaatttctgggttatggattttgtagtttacattgatcattgatcaatgagattaaagttttggatttttataatgttctttcctcttttatgatcctattgttgaaggagcttgaaggacaatg

SEQ ID NO: 9393 - DNA, 3000 bp, Unknown
  misc_feature (1)..( 3000): cDNA_ID_3041701_gDNA_ID_1972112_Annot_ID_178795 3000 nt of promoter + ATG
aggcaactaagactgcagcttttcatagagacttaatgaacctttaccacgaggtatttaagaatgttgttttattgatattattaatctcttgtaatgtatgtttctgttcttgatttttcctgaagcttgagcatgagtcgcatgatcttgataaacgtgagagggctcttctgaaaaaagaaacgcaaaaggtgcaagaagatctaaactctgctaagtcaaagatggagagactggtggctgaatttgaaagtcaactagaaatcactcaagctgatcaatacaattccttaatcctgaaaaccgaagaggcagttgcagagattattgaagcttgctgtcctatggatcctgattccttagaagaagaatacagtgactactcaccacaagctggtgaaaaagttcttgtaactggactgggagataagttaggtactgtggttgaagaacctggagatgatgatgatacagttctagtccagcatggtaagataagagtacgcataaagaaaaaggacataaagccccttcctcgtagcacaagtagccaaacatccaatcgttctctacgttcgaagagacaggtatacatcattctctgacttaagacttttcaggtcccattcttgcagtatctcattatgaaacctaaccatattggtatgtcataataaatagtaataaagttgaaagtttatagtttatagtttataggctatttgaaaatttgtgattttgatagtaatatgttgatttgagttataacatcagttctttgtggtgcctgataattgcacagataaacatgaaagagctaggcagtgtgttgcaaatgcaaagcgaaccagtgcggattcaaacgtcaaagaacacattggatctaagaggaatgcgggcggaagaagcggttcaccagctagacatggccatctcgggaagagactcgggctcgatcctatttattattcatggaatgggggcaggcattataaaggagctagtgcttgagaggttaagaaagaacactcgtgtctcaaggtatgaacaggcaaatcctatgaaccatggatgtacagttgcttacattaaatgatatatctctcaaacacattctttgtaaatcttcttcaaagtgtggtccactaactagtttcgatcgtgaatcaacgttcaaatgtacaagaagttgtctaaagtatagttattgatattgtacagaaaaatatagtaattctacttttccacaaacttcatggctttcgaggataacacacggcacgagtccctggagaaccctcgtaggagttgtgcgaatacgattgtgttcttccctttcttgcacagctgtggctacaacacttcgttggtacttgcgaaactaattgaacacaaaaacagaggcttggtgtttagattttcaaaaaaaagggagtttggatacatatgtatagatgtataggaacgagagagaagagtaaaggagcactcaagacttgtgtttttactttttcctttgtcctatatttttacaatgaagcaaacgtaggtatatacagagaggaagcttccactttcaaaacttaacaaactttttcaaagttacaccaatagattatctcaaggaacttgcactttcacaacttgacaaaatctttcaaagttaacaacaatgaattatttcaaggaacaaaggaatccatttttcataacaaaagaaattaaacgatcataattattcggatatcttcaagtttggtggcggatgaaacgttacaagtggtattagagccgaaccgaaacgagtttggaccgtttcaatttttgaaaaattctattcgggttaaaattttcataactatgtttaaaaaaataaaaacactaccaatgtttttctttacaaattctttaagtttttcaaatatcatgtcttttaattaagtacaacatgtgaatttaaatgttacatactattttgaaaatttttatgaaactatctcgcatactattgatttcgcaaaaacgaatgatggttatgttatttcatttcttctaacaacgtgagtctatgactattttaagaaaaatctttctctctatatttgcttaatctttgtgtttcatttagctattccttaatattacctataaaactatttgatatagtagttatttttatatttttgttcgtataaaacaaaatattaaaatcataacatgcgacttagtgatgtgtcgattttgtataatattaatttatttcgtaaaagaaatttggtagcttgatatttatatacgcaatatatttaacagaatttcagttttaagaaattaaataaatacaaataaaaaatagacatgcaagagagtataaaggaaaatatgaaacctaccaaaccaaaacgaccctccgttcctcttctaacagccattccctctacctaccccaatttcttctccttgatctccctctccccacacatttatttcttcacttttgtcgtatttttattttatattatacaaaactcttctttcatcaccacctaaacacgcacatttctatatattatttacatatattcatttctaaaaactcaaagagagtataatcaaacaaacacattcacattcttctttcttctcaaaaaaaaaaaaaaaaaacacttgttcatttacatcaaaatgatcactgcagctctacacgaacctcagattcacaaaccaaccgatacatccgtcgtctccgatgatgtgcttcctcattctcctcctacgcctcgcattttccggtcaaagcttccggacattgacatccctaaccacctccctctccacacttactgcttcgaaaaactctcatctgtttccgacaagccttgtctcatcgttggctccaccgggaaaagctacacctacggcgaaacacacctaatctgtcggagagtcgcttccgggttatacaagttaggtatcagaaaaggtgacgtcatcatg

SEQ ID NO: 9394 - DNA, 481 bp, Unknown
  misc_feature (1)..( 481): cDNA_ID_2182260_gDNA_ID_1972113_Annot_ID_178802 3000 nt of promoter + ATG
gaattccaaaaatcagatctcttgcccaacggtgagttcttcttatctaactttccttttcattcacattgggttttggtggatccaattttcatcttcccttttaggttggaattttgagttttatcttcccatttctggattttgtttctctctagtctattccttcaaaaccaagaacccaactttgttttatattcaaaagttgtttgctttcatcgcgtttggtgttcatcttcatctgggtattctcaagaatcaatctttatactttacttttgcaaaaaatttatcctttatagttcttgttgttttgatgatgatgcttttgcttatggatctgatttggttccaatcgattcttagaattagatcggatcaacactcttcatcatctttttaagattgggattaggacaaattcttgattaattgagtttttttttttggaatgcaaatagtttgagattataataacatg

SEQ ID NO: 9395 - DNA, 3000 bp, Unknown
  misc_feature (1)..( 3000): cDNA_ID_3041746_gDNA_ID_1972113_Annot_ID_178819 3000 nt of promoter + ATG
gctgattcgataagatttccagcggctgaatggtgtttcggaattggaatggcaaatagaatccccgcctgacggtttagcttcatgtttgcatctggcaaaagtggttttatctcaaggtggtaagggatcaaagtgcataaatacgttttaaaagaggaaattttgagagaaagactacacttgcctattactctagcacagtcttcagggctatttacacgggaaggtgcctaaagaagtcaatatatccacatcagaactaaatatctatgcagaagcacctgattgagttcagtgataatgaacaattttgcaccttacagccacttttttctgtgaaaaatgctggaaactcatcgctcttgtatgcagcaacatacacttcttgagtttcctgcattgtcaacaaatagctgttgtgaaaacttaaactcttgattgttgactattaaatatgcctcggcaacagactatataccaaatattcaagagtctttggaatatcaagtattgatttaacgcctgctgatatcactgctattggagtcctcccaagtgcagtaagatcagatgatatgtccatcgctgcatcacaaacacaaattagcagcgcatgcagggtgaatattggcatcaacaccatcatctaaacagagtttctaatcatgtaactaatttttttttgtaagaaaggaataaaacggacatgaaacatacaatggttggcatgtctatggacaccacctatcccgcccgtcacaaaaacttggatgccaacctacaataaccaaaaatcctctgaaatgcaataaatgataccaaaactactaaagaaagatcctcctaggaacaaagccaattaccattgaagcgaaaaacaacgttgcagagactgtagttgcaccgtttcctcttgtagccacctgaaggaaaacatttaggcatatggaggagcaaaaagtccatgcattgattgatagaggtgtggaaatgtaaataacgtggttgtctctatataagaagctagttcagggtaggttgcttagattgatgcaatttgattttgtgaactaatgtaagagactgttcctacatgactgagtgtgtaaacaaatcttaaactggagaataaacaagtttgatgtttttcgattcactgatgaacataatgatggtgcaataagtagaaaaacaaccagaagtgactcacaacatttgctatgtcccttcccgctgtcttttggacactttttccgagagatgcaagacgttctagttcttcctcgctcagacctgtttactatatattagcatctacattctataggacgtagaagaagtctagtgcagttgatccttggcgaaaaaaatttataactctgatctaagatcttgaaaccaagttggttttaggatatgtaaacggccaaagttgactaggagattagtgttaacaggttcgataagtccaaatccaagaatctaaaacattatgatccaccagaaataactgacctatgcaaggtactccattaaggatagcaattgttgcagggattgctccattttctctcacaattgactccacctcttttgctgtttgcagattttgagggtaaggcatccctaaaaatagccagttaaagagaaacaagtgaaatcagaccaagatccaagaatataggcttatttaaaaaaataaaacaatgttcaataaaaaagtctacagaatgcaattcaaacaaatccgaataggacaaggaagaacaaaccatgggagataatggttgactcaagagcgacaacagcacgtccattagacaaggcttcagatacttggggagaaatcttgaccagactcctgagctgcttcaaaactagttgttaagagaaagtaaatcaagattggaaaaagtcttaaaacattggaaagtacagaaaccttgttgtttgcttcaagaggtgaaagatgattctggagattcgagattctagattgagctaaagaagaagccattctccctgaaagatagagttttttgaagtcatcagaaaagccaataaactactcaaaaaaatccagcttccaaattctcgatgacgaatcaaaacacgaccctaatgatcagaaatgacaaaattttcgagtcaaatacataagaagcatgaaaatttctgaatttacggtaacctaaaactaaaaacactacacagatgaattgtcttctggagcatcataaattcatgaatttagaacactgaaacctctaagaggatccgaaaagaacgccctttctgtgttctagtctaatcttactgccaaaacagtggaaaagtaaccaacaaagaactcgtttggtagagaattacccaaatccagttccgctcactaagtttatatgaagtttggcaacagaatctgaaagagatcggaaaactgaagtactgtatacaaggacaccgagaggcgagagggatctttgagaaagaaaaaaaaagattgttatgcatataaaccgggtttgaggaagcggttttttaaaaccagtacggttcatttttagggatcggttcggatgatttcggtattgtaacaaacgttggaagtgcgagatctaattgagcctcctatagtgtttgcgagcacatatccgtacacgaaggaccgatccgatctccgtcgccggcgatcatcgccgccatttgctcttgttcttcctcatttacgcgttctctctttcatactcgtgagcttcttcgattttgcttttagaccatttataattcttattgttcccgactgattgtagaacttttttgacacccaattaaatcggaactagggatctaatggttgcgtcgacttgatctctgtgacgtagaagctcttatatatggggctatgttctcattagtatgaagaaagtgtccctgatctttgttttgcagatttttcatttcgagtgatttttggttttatcatacaaattacaagcc

SEQ ID NO: 9396 - DNA, 3000 bp, Unknown
  misc_feature (1)..( 3000): cDNA_ID_4258619_gDNA_ID_1972113_Annot_ID_178816 3000 nt of promoter + ATG
tgtagtgtttttagttttaggttaccgtaaattcagaaattttcatgcttcttatgtatttgactcgaaaattttgtcatttctgatcattagggtcgtgttttgattcgtcatcgagaatttggaagctggatttttttgagtagtttattggcttttctgatgacttcaaaaaactctatctttcagggagaatggcttcttctttagctcaatctagaatctcgaatctccagaatcatctttcacctcttgaagcaaacaacaaggtttctgtactttccaatgttttaagactttttccaatcttgatttactttctcttaacaactagttttgaagcagctcaggagtctggtcaagatttctccccaagtatctgaagccttgtctaatggacgtgctgttgtcgctcttgagtcaaccattatctcccatggtttgttcttccttgtcctattcggatttgtttgaattgcattctgtagacttttttattgaacattgttttatttttttaaataagcctatattcttggatcttggtctgatttcacttgtttctctttaactggctatttttagggatgccttaccctcaaaatctgcaaacagcaaaagaggtggagtcaattgtgagagaaaatggagcaatccctgcaacaattgctatccttaatggagtaccttgcataggtcagttatttctggtggatcataatgttttagattcttggatttggacttatcgaacctgttaacactaatctcctagtcaactttggccgtttacatatcctaaaaccaacttggtttcaagatcttagatcagagttataaatttttttcgccaaggatcaactgcactagacttcttctacgtcctatagaatgtagatgctaatatatagtaaacaggtctgagcgaggaagaactagaacgtcttgcatctctcggaaaaagtgtccaaaagacagcgggaagggacatagcaaatgttgtgagtcacttctggttgtttttctacttattgcaccatcattatgttcatcagtgaatcgaaaaacatcaaacttgtttattctccagtttaagatttgtttacacactcagtcatgtaggaacagtctcttacattagttcacaaaatcaaattgcatcaatctaagcaacctaccctgaactagcttcttatatagagacaaccacgttatttacatttccacacctctatcaatcaatgcatggactttttgctcctccatatgcctaaatgttttccttcaggtggctacaagaggaaacggtgcaactacagtctctgcaacgttgtttttcgcttcaatggtaattggctttgttcctaggaggatctttctttagtagttttggtatcatttattgcatttcagaggatttttggttattgtaggttggcatccaagtttttgtgacgggcgggataggtggtgtccatagacatgccaaccattgtatgtttcatgtccgttttattcctttcttacaaaaaaaaattagttacatgattagaaactctgtttagatgatggtgttgatgccaatattcaccctgcatgcgctgctaatttgtgtttgtgatgcagcgatggacatatcatctgatcttactgcacttgggaggactccaatagcagtgatatcagcaggcgttaaatcaatacttgatattccaaagactcttgaatatttggtatatagtctgttgccgaggcatatttaatagtcaacaatcaagagtttaagttttcacaacagctatttgttgacaatgcaggaaactcaagaagtgtatgttgctgcatacaagagcgatgagtttccagcatttttcacagaaaaaagtggctgtaaggtgcaaaattgttcattatcactgaactcaatcaggtgcttctgcatagatatttagttctgatgtggatatattgacttctttaggcaccttcccgtgtaaatagccctgaagactgtgctagagtaataggcaagtgtagtctttctctcaaaatttcctcttttaaaacgtatttatgcactttgatcccttaccaccttgagataaaaccacttttgccagatgcaaacatgaagctaaaccgtcaggcggggattctatttgccattccaattccgaaacaccattcagccgctggaaatcttatcgaatcagcaacacagcgtgctcttacagaagcaaggttataagaagatgtctaatatctttcatacatgcttgcatcagaatactgcaagggctttgcttctttttcttatttcagggtttgaaatttaaatttggttttggccagggaacaaaacgttactggaaatgcagaaactccattcttacttgcacgggtaaatgagttaaccggaggcacatcacttgcagcaagtatccttctttagaggttcccttaatcattaatattccaccaaattactttaaatagttcagattttttcttatctgtatccaaaatccgaatcctttccgtggcttaacagtagcgtagcaatgtctcagcattgtaaaaccttgagttcctttacacatttccagacattgcgcttgtgaaaaacaatgcccttatcggttctcagattgcagtagccctttctcagctgatgtgagcttccttatcaatcccagactcaagctcaagcgcaagttattcaggttcatgattcaggacagatcaaagatgttttggattggtagttatcaatttatattggttatcaaagatttttctttagctaaagaaactcgttaacttattatcacatgttatatattagtcattagatttatatcatgtggtacccttaaagattaaactattgaaattttaatttatatcacaaaggatctcaaggaaagatctgatctcaaggatgtaataataaaattgttctgcttcatttaaccctctcttcagttttggacaacaatg

SEQ ID NO: 9397 - DNA, 1534 bp, Unknown
  misc_feature (1)..( 1534): cDNA_ID_2182351_gDNA_ID_1972113_Annot_ID_178829 3000 nt of promoter + ATG
ttctttcaatggcttttttttgtttctaatgggttctgaatttttgctagacaaaatattcgggatccaagattcattctgaaattcgatctaaaaataggttatccaaaatctttggatttagatattttgatttaaaaattaggatatccttattttatataaattgctcaaaaaatcaccaaaaaaaatattttaaatttgttgtgcaatattttaaatttaatccatttgaaaaatagttgataattaaatttgttttatgattaatttggatacaaactttttatttgttttatactattattttaattgtgagttatttatggtggatttgaatccgatattaacggatttggatctggatatgtcgtttctcatatatggtggatgtggattcaagatccatgtatcttaaaattccaggaaatattagtagtgtccaccttgattaatgtaaatgatatctcggaagctcaattttttttatgtcaattagtatttttgaaattataatttacttttatataagaaatttttagtgatatattacattcaaaaccaataagaaacagtactagtaaattttataacaatttttttttttgatttcatacccattttatggagtgagaattcacagtctaatttgtttaattatgttctcaatgatttttttcttttttttggtcaacaatcatccttaatatatatatatatatatatatgtgaagttgaaataatatgggccgagaggtttgggcctggttctgtttttttgttcctactattaatttaatttatttgttgagatttttcctcgttttttaaaaaaccgatgagagcgtatctatatttcttttttcatttttctctccgatcaaaacgccgccgttgcgtctctgattcttcctttgggtcaactgaggaaaaaacccttcctatgaagaacaacaattggcttcacactctctcttttctcaattttgcttcttacttctttccccggtactcactgattctccccaattttccttatttcgtcgtgcccttagggtttcttacatcgaaagtttggtttttgattatgttgtcccgccattgcatgacgttgttctgttttgttctgtcctaattgcttatttgggtttctgaataatcttcaattggagttttttttttgttcaagctgaagagtttcggtgatcgtcctctagagattgatgctaattttttcaaacattacaaagtttccaaagccaccgcccacttgaaacattcttttggtgattatgattgtttatatcgatttagcattactttacaataagcaagtgattctcttcataaagtatgtagctttactttgtttgatcctactcttttggtaatcttagtttcggatttgcctttctcgcaataacagagcgctttgtaaagttttgcgttttagatgattaacattcctttcttgcgtatttcaggctgattagaaacttgaccgcttgattctcttaaaggaggtcttgcgatg

SEQ ID NO: 9398 - DNA, 3000 bp, Unknown
  misc_feature (1)..( 3000): cDNA_ID_3041732_gDNA_ID_1972113_Annot_ID_178828 3000 nt of promoter + ATG
gagagaaatcgtctttgtgtgttaatccaatgagaaacttttaggataccacttttttatacgaaaaaaaacaagtaaggttgagctaaatgtgaaaatcccaatttctaggaattgcacttaactcttgttattgaattacttggtatcttccattacaaaacagacgggagagagtaaagtgtagattgttgatcaaatgctcgttgcatattatgctcatgattgtagttgccagatatcagtttttctagtagtagaagaaagctgttcatgaaaacaccactgatgctacgatcatcgggacatatatgcctatctccgtacctaagacttcactatatccgtctttggttgcagttggcaatatacattctcgttgcaggaattctgtgcatttacataaactatgactgtgatagacaaaggcaagagttcaggaggacaaacgggaaatgtttggtttggggaagggccccgtcaaaggtgtgatcataataagccccaactagcttagtgaacttagctatattccttttcagacctaaacattttgatgtgtatgaatctctcttggtctctcggtttgttgcagattgtggcgtcgtatactacaacatctggtgaaactaaaactagtcttctcttaacgtctggatggtgagactattctacattatacagttacaaccataaaagtagacgttgttcatcatcaatggctttgaatgtgcaggtggggattggctcgtcatttccattatgttcctgagatcttaagtgctttcttctggaccgtaccggctctcttcgataacgtaaaatactatccatctatttgctatattcgaagctcttcttgcaagttaaacgcacttaacatataaatcatctttgtttaaaccagttcttggcatacttctacgtcatatttctcacccttcttctctttgatcgagccaagagagacgatgaccgatgccgatcaaagtaagcaccaaatctaaatgatttattttacacatcctctttgatcttactctgatttgctgacaatattcgggttttgttttggtaaaaaggtatgggaaatattggaagctgtattgtgagaaagtcaaatacaggatcattccgggaatttattgattgtaacgaagtctgttgttctcattttctacttattacgttaattcgaacgttggaatcatcaaaagaccgtgccaaaacaaaaatgcaaattgatgcgatagacattcttttgctgatttgtatgctataggttttcaaatctctagctacacttatgtatttccctagattatcaaagttagcctgccgttttctaattttattatttgatattttgattatactgcttcttaatgcatcaaataagttgattcatccatctaatattttaactacatcaaatgaagtcttttataagtacaggcactaattgaacttgaaccctataaaatacatgaataatcacaaagaattgatagtgttctttcagtttttcaatcacaaagaactcaccgacattatcaagttgacttcacttttagacttaattggtgttctggaggatccacaaaactactattacacagttttcacaaaattgtgattctttattttttattttctttggtcaaactaacatttcattcaactttaaacgagagttgcctccacgtggagagtatacacaaaaagctacgaggacaaatgctcaaacaaaaagacataagaaggggagctcagaagctcaacccgagtagcagcatccaaagttgctaaaacagaaccatcatttacttctgaggcggtcttcgtaccaagctccttcagcaaaattgtgattctatgtttggatatcatgagatctaactacaaagtttttaataacaaaaacttaccattctctaatttgtagtcaaagctaaacaaatttcatactaaaacaattttactgtgttgttatggatgcatatttttctcactttatagtactattttactattgataagatgaaaaaaaagttgaggtacaatagtagtaaaatagcatcattctttttctgtagaatctctctggtcaatggtctttttagtttaaaaactgaataatgttctctctcacacagtaaaaaacaaagagagagagaaagaagagaagaagacaaaaatgtaggcattaaaaagaagaaaaagacaaagagaaaagtaatgaaaagacaatgaacatttaaagaagacagacaaatcccacacccaagcctcagcctcatctcttttattgttatttgtttttctaacaaaacaacaaaaacaaaagagatggtttttgggttttgttttgtctttgttagggcgtgtttggacgtttccttcttctcagaatcaatattttaccaaaacagctttctttttttctctttaacaatttttttgatgtagaaatatatagtcatgattccaaatccacctcatgccatgacaaaaacccataaaagtggaggttccaatctcgaatacagacatatatgttgtattcgtgtatgtatctattataagataattccaatttgtataatgccaaatgggttcattgaacttcttcttccttcataattaagtgttgctttttcttcttagttcctctaaatcaagaaaattctaggtgaaacttctcttatcttgactttatataaaataataactataaaaataatcaataagactaattcctacaagtcttacaaatttaaaagaaaatgaaaatgcaacattagctaatacacataatagtataagattgatggatgtattcttattcagttttatttataaatgcaacataagctaatacactctcattcagttttatttattaatgttacaccactttaagagcactcaaaatcaaaatacgtattcttatatgatattcattcatgtagtactagtacacataatagtataagatag

SEQ ID NO: 9399 - DNA, 3000 bp, Unknown
  misc_feature (1)..( 3000): cDNA_ID_3041736_gDNA_ID_1972113_Annot_ID_178827 3000 nt of promoter + ATG
tgtctcaatgagggtaagtgaaaaaacagataattgcaaaataattttgcagtagttatttcggtgactcattgttacttatgttaaactctttgggaaggttgatttggagtgctcggatggacggaccacagttgggttatttagtcataaaaaactatcagtgtgagtctccttaacatcccctatatacaacattaatacatatataaagctatgtatgagaaccgatacatgttgtgtttacagatccgttggagtttcgaccgcagcttttgttgcagcaatgcttgaaggaagcacacaaccaggggtttggtttccagaagaggtatttctctctagattccctaagagaccttcatttttaaaaatatttgatttatgatgaaatataatgtttaaattttgttctacagcctcaagggatcgcagtggaagcaagggaagttcttctcaaacgtgcatcacaaggaacattcaatttcatactgaacaagtgagccatttttgttcctcttattgcagatatcgattctttatttcctctattttagtttaataatgtatttgctttggtttcttctgatatataggccaccctggatggttgagaccgagccgaaggaggtggttttagggatatacgtatgagttcgactgaggaagaagaaacatagatgatcatcgatactttactttgtaaaccaatttacttctgatatgtatactcgaacagataaacatgttcatcagaagatatacaacttaaaaaaaaaaaaaaatcaaaaaaccacttggagatgacacaatcgttcgttgaagcaaccatataaatcaatgaagaatataatttacaggtgacatgaagagtaaagatccaacaagctcttttcttgtagtatatgttcaataaagtcccaacatttttagttccatcacatgactctgatcaagctcaggaacattcttgcagtcgcggtcttccactatatattcctgttgtgagtgacacgaaaacagtgatgtataccagaaaagtgattaccgtaaatcaagaacagaaaagctgcaagatatcagacctttgtgagttcttgtttggcgagaacatggtaatgccgctcgttgatcttttggccacatattatggcgatgaagaatccatatagcagtcctaccaagacaatggccaaaactgcaacaaaaaatagaccatcatgttcattatacgctcaagtggttcagcacaaagatgattctgattgactctaatcctggtgactgggctaatgtccatgagcctatagaaaacaaaaatagttgtaccagccaatgtgtagaacccataaggatgttcctcataaccaaacatttctcgtagttcttcaccgtagaacttgtaaactagtaaccccaagaatgctacaatctgttgatacgagaagcctttgttcattagtatataaatgcattcactaagagcatcaaatgtatcatccaatccgaattcatacaagggatctcctgtttcggtgttcaaatgcgataagaaaccaatagtttggtcataaactgctatgtggcaattatagctaaggatttgcattctcatgattgaattctagtatatagtaacattatagaagaaagtctataaacactaaactcaatcatgagaatgcaaatccttagctatatgaccaattttatagctaggaaacaacgaatttggtcataaaatgggagattgggagtcaagaagctagtaacatcatagaagaagaaagtgtattaaacactaaaatcaaaaaaaggaaacaagtcatgtaccatctggacagaaatgaagatgaaggcatgatctctagcaaccagcagctgaaatctcaatctcaaccaccatctatcagcaggcacattggctcggagtttgaaaaaggctctacactctgtacaatgcgaaaatgcaaaaccttcctgaaacatatattgcatagaaacaaaatacacttcataagctaagtaaaccattcattcaaaagaagaagaaactttctggaaacggtgacgataatataccttggtggagcgccaattatcgagacaagatctgtgaacgtgcttttgagtacctttacaattgcacggagcaatcagatcttcccctgcaatcaaagaacaaaccaagtcgtctcattgtatcctcactcaattgagttaaggaattgcttttattatacctccaacatcaaggcaaattcgacattgtggttgatctccagaaacaagaagtgtggtttcgtcatcatcagtctcagctatttctgaaacttgtccttcctccacaacacgatctcctctttccgctgctacgatttcgtttgaggatgttgattcgtcgaataaaatctgttcctttctatcatcatcatcatcactaggcactaattgcatctcttaaacatactaaaatttctggaaatgaaaaaaaactgagaaacgcaaaagaattcaacacagcatcagaaaactagatctaggtttcgccgggagttaccaaaaacattagaaaaaatcgatacttacacgaattcaaccaattctggagaattttcttccaaggcaagccattgcttgcgagttagaagaaattggtaaactatgactgcgaatcagagtgaagagaatttgattttgttagtctcgattcatcactatgtgttgaatacagagatgacgaagatcttttgagggttgagagagaagaagctaagaagattgggatcaatcaaaaacgatggcgaagaaaagtctcaagggtaaaattggaattagaaaaaacatgtggagagcacgtgacacgtgggatttatctgagtttcacagtagacctgtgaagttcatcgtcttcatcgttaacttcgcagactctgttgattagtcaacacagatcagaatctgaggctttggccgagacgagagaagcagaagaagaaa

SEQ ID NO: 9400 - DNA, 3000 bp, Unknown
  misc_feature (1)..( 3000): cDNA_ID_2182335_gDNA_ID_1972113_Annot_ID_178825 3000 nt of promoter + ATG
tttattttaaaattaataataagaaaacagaagagatttttttttcattttttctgatcaaaatacacaaaataatttgtttggttgttaatttttttgttgtcataatgttaggcctgggatttcggcattaaccgtttaaaccgaaccggacaaaccgaggatttcggttttcggttccgaaccgatttactgttataacccgatcggtggaattttaaattgatttcggttttcggatttttcggttcggttcatcaaaaccgatcggtttattcggttaaaaggggataccttataaaaaatagaaaccctagatctaccacttcatattttttgtttcctcctcacgaacctttctttgtcctcttctctaaccttttttatagtttttatcttcttcaatcttcttcttcttcattcttcttccttcttctccttgtgttccttcttcttctccaccattttctttcgtaggataccttctatcaagccgccacgacattaattctctccggcatcgactttagcggcagcaatttatttcatggatttctacatttcttctcgacaccgcgtcgcacagatccatcttctctgttacgttgttgttcttctttacacatcttctctgttacgttgttgttcttcttcacacatcaccgttgttttccttcacttcacagatccatcttcactttactccatccgtattaccgtcaccttaaaaaagtgaacaccgaaaacctagatctgggtggtggacttgagttgatctcaggggaaaaaaacatttgggcttttaaaatctaaaaacatatttaggatttgaataacttaagcccattatgcacaaaagttaagcccagaatgcataaattgacccacaacgatttggttaaccgattaaaaccgagaaaaaaaatattcggtgcaatttcggtgaataataaatcttattaaccgaaccgaaaaacccgagtaccgaaccgaaccgaaccgaacttttattctgttcaattcggcagaattttgtgtagccgaacaaaccggaaaaccgattaaaccgaaccgtttaacccgatttaaccgatctcccaggcctacataatgtagttaacttacgcttctttatcaacctaattatcttgaacatggccaataatagaaacaaaatgattaaacatatgacaaaaataaaattcataaaagagagaatttaaagttttgtcaataattggttccactctaaatattaacgatgtttttttttgtatggttaccaaacaatattgttttgcatttctaccctctatttgtataatattaccgtcgtgaccggtcgtctatatcttttactttaatcgcactttatttcaaggtcagttacaaataggagatcaccaaacgtaactaaatttaaattccaatcatttttaagaataaaataaagtagaaaagagtaatacaactagtttgacctttgaccgttcgatttattaagactctgctttgaattaaatttcaacggcgtgctctttttgccgttgggaatctctctctcatcacccaaacattaaataattagaagaattcttttaaccatcggaataatttaattagcaataataaaaccagtccatgatctaattattgataatgactcgtggctaaatctagtccaataaaccctactgtataggggttcaattgtaatattcacctttgttttgctcctttttgtaccatgccctacatttttagccaacttggcaatattatgtgcatttttttcacattggcattattattttctgccagccattattgcaatttttattatgtaacttaaattaatttatttcacataaaaacatcttaagtttaaccgttttatgaacagtatataaagaataaatgcaaacggtaaaaatctgaagtatataaattataaaccgttggaacatatatacttagacaaaaaaaatatacaagattactataaacgaaaaaaatttctataaattttttatttttagaaaatttaaatggaagattctatagttgttaaaaagtttgtaaatatatgagattattaaatactaaatagtattcgaatgtcctttggtgtatgaatgtggcgaacagcagcataaaagctggcaattttaattttacattatagttttttttttttaatatcaattttgtttgtttttaaaggaaaagaaatgtttaaattgttgggaaattaaaatatctacaaatggtgagggacaaatagcgtcagagcccatgaaaacgcacgttgcaatttaagaagaagaagcaataaccaaaaaaaaaaagttgaagaagaaaaaaaaatgaaaatgaaaaaattcgttcttccccagtttgacagctcgctgccactcaacagtaggacccataggtttcataatatttacaagtttgaccctagtaggggtctacttcgtcctccacctctataaccctagaggttctccgcgttttggtctctctctcagattgtggtcacgtgacttgacacgtcacctgcttacccttcgctgacgcaacgcctctctctttgcctttccagtttccaccattacaacgttttttctttttctcatcttatttaatttcgcatttaagtttatgattgattgcatttaattttaatcaaatttttatccacggtgttgaatagttacagatttgagctacatttatatttaaacacccgacttgtattgtctgatgtatataaaactcaagataagaataacaaacaatttacaaatgaatgaaaaacttgacgggccttatattatatttcctcttttggaaccacgatttataaggcccagatatttatttattaggcccagatataaagcccaactaagttatcccgttcaaattcttacacgtcatcatcgtctacgataaaactgcaaaaggagatgaggtgagtgaggggagggagagaga

SEQ ID NO: 9401 - DNA, 3000 bp, Unknown
  misc_feature (1)..( 3000): cDNA_ID_2182327_gDNA_ID_1972113_Annot_ID_178821 3000 nt of promoter + ATG
aaaacactcttcttttatccactcttattgttttaagtatccattcttcttgttctctacaacaaacccaataaacattcttctttcaccaaataaacactcttctttaacctaatacacactcttcattttacccaataaatactctttttcacaaactaataaaaatttctcacttaaggatttcacttaagaattccactattggacagtaaaaattataaagtttcaaccaaaaactctaaactctcatttactcaaaatttactattaaaaaattgtaaggagtccttaattaggactcctcaatggggatgctctaacaagtagtataatttagatacttgcaagtacaagtcaagtaacaaataattgaaaaaaaactaatactttatgaaatttatttttatattactatatgaaatttaaatatagtttcatatagtaatataaatatataaattattctaaaacgatttaaatcgttcagactacgactaaatgttttaaacgttatggcgaagggtcaccgaccgcgcttatcactttcttaaacaccgaaaaaatctcatagatatgcataatacaatgcaaggaagttcacctagttaatataataaatcaacgttaaaagaaggagctcgatcggtatagtaatattatgattgacggcttgacgctgaatcatgcaaatctctacctctttacaaggaatctatgactaattgactatgagactttctcattatttttaaaggtactttgcttgtctctctggactagtcaaattaaatcttgttatgtttttttttattagatccagaagatgtgaataaaacatttaagatgataatatatacaaaatgatcaatgtccaacaggatattacatattgttggatttaaatcaatctttgaacatacgtaaacacacttaaccgaccatcaaagctaccgaaaccagaagatcgatataccttgtgtatttatcttctccaacaatgtatatcttgttgtatatgactttctcaccgcaaacagcaactttcttctcttcgtcaatgtggaaacttagggaactcgaaaacaaacaaccatggggttttaaatccactgtctcaatctcattggtcacccttatatccatctttagtttctttgcactctgatataataaggagagatgttcttctctaacaactgagagagccttaatatcatttacttctgcagcttcttgatgaaagggcacacatagtagttgaaacctctctgttgaaaaaaacaaaactgagcaatgagtaaccatttcccttcaacgacttgccagtggatactaagtcgtcttcgggagagacgacatcaagaaactcctccataaattagagctaaaatcatagacttccaagcatatatctataaacctcaagattttgtagttatggcacaagtccttgttattgtaaccgagagcatagacctcgaatatcttgtcatgacgatttatcggttggatccatatggttttcttctagaatgggtcccaaaccacaatggtaggttcaaagaaactatcttaacaaaaatgtcctccaatggtaggttctcaagaaaaaaaaaatcaaatttttgcaagacaatatctttcaatacaaatacaagtattcatacaaccaaactcatacaagttttggtatctatcactttcattaaacttgtctcttgcatgctgcttctcttcttcttctcaatatcacttttcactaaacctaccactttccctaaatttgtgtttgacacactttcccggaaaaagatttctgcaaaaaaggtttcagcatcattgatagcatcgagctcctcctttggaatagcccttttctgtttattattctcagcagcatcatcatatcattgttatttgggattttcttctctttatgttcttctttcttttctgtttcaacttgatctactacatttgtattgcttttaaactacgttatctatcacacaataagaatgtcaaacccatcctaaatcaaaattctgattctctttggttgcatccattttatcttctttaggaaatggatggataactttatattaaatgacgtcgtttctttgcctcattttgggtcagaaaatgctaaagctgtaagcccattttatgttaatggactaatatgacatcgatttcactatgtaagatacgcaaagaaggcttagtcctagacatattccatagggcttttatatagattgcttaaaatatatattgcttcaaggttactgattcatcaatagttgaccctctcgtgcctcttcaattctaagtctaaaactctatacaccatatctgtcgagaggaaaaattggcaccatttatcaagacacctcggaatccgttcaccccaatacattatacatgttgacaaaaactatcatcgttgtataataaaatagtattggtgcaatgaaaatgatggtttaaatgaaaagaaatgtggcttcctgtaaatctatagaaactgtattggaatagttcaaaaacaacagtattttattaaaaataacaaatttaatagtacagtcttaagaagtattatgtaaagattaaagaaaattggtagcctaacaaatccgagttccattctcttttctagtatagtactagtttaaattgacgacaacagtgggccaaactaaactatagtggctgcgcttatagatcgagggcgaaaccgtcattttctggccttcaataattatgtgtgttgaaaatatatttattaagaggtgaaaaagagggaaaaaaacaaaaacgtcatcgttctcattggttaatatggataatgatctaaacatgtatttgctacttactgtaatatattaggatgtgctttaaagttttataaaacatcatcaattcatcagagtccctcatccatcttctcatcctccaacgcgagatcagacttcgacagagagtgcgatg

SEQ ID NO: 9402 - DNA, 3000 bp, Unknown
  misc_feature (1)..( 3000): cDNA_ID_2182279_gDNA_ID_1972113_Annot_ID_178806 3000 nt of promoter + ATG
ggcaattgataataaatctttgagaggtgtatggtggcaggcagattcttttcgtgtttgacccattagattagattttgtgttcggcgttaccctaaaattctagtatcttactttactttttctgccacaaacactattaaacgacctttgggtcctaaccaaacccacatatttgtttttactgttgtccaaaactaatttctttgaatcttttgttagatataaaacaaactttattagtgtataaatatataatgatagaacatttacgaaaaaataatgtgatgtaattgcagcgattatactagagataaatcatagaagattttttgttcaaaaaaaagtatgtagaacatttaagaaacaatatattagtaattaattgcagggatattgcaaacctttattattattaaatatttgggaaatttgagatttgattatttcattccacaattacgtggattaaaaatcataactttattttagtataagagactagaatttattctataatataatataccgtagatatataaaatttcacacaactctaactaaatcaaccaattcgacataaataataaatttggtaactgtaacaaagaggcatgagggtcgtgtgatgagatgggcaatgggagaagagtttgttttcatatcggtccatttgtcatctttgttggtgtcttaggattcaagactcatatgccttatatgtggaacttatacaaacacggtgtccccgcctcgacattgaatagcaagaattttatgcttcacaaagaatcaactaatatagtggaagcgacacacacagaagccaaaaaagacgacaaatgcaattaagatcaccattgaagacattaacaacaagcttgatcaattttgcagctgagaaaaatgaaaaaaaattgcaaccgacaagaatgagaagacttcatagaagactagtttcaaatcctaatatatgttttagacaagttgttttgatttgattgacttattttttatttgttaattttattagaattttggacctaaatattattggagcatcaatttgatttttagattaaaaaattaataataaataataaaaatgtattcataatatttacaaagtttaaaatatatcgataataataataacagtttttagaagttaggttttaactttcacccaaggaaacatttataaaaatataagtaacattataaaacactaatgaaaactacatttacgaatttgggaataaagcgagtgatgggtcaggtacaaaaaatagaattaatactgatatttgacacttacttgcagataagaaaattataatactttttatcttcattcgatactaaggtttcaaatatttttttgagacgtgtacgagtcggataacagatcaaatttggataacaaatatgcctaatcttaacttataattatatgtaataatttatctaaagatattgttttataaactgtaattcaaaagtgttaatattgattagaaaaccctttcacaaaaccaaaaaaagtgttaatattgattatcacttcgaatttgagaaagattgaatatttagtaaggaacgagatacagtttgttggctaataatgggcttggagccgtgggctattcacaagctcgggcctggctttttagatgtccagattaattaatatacaaaataatcccaagacaaacactactatggtcgtactcggtgaattcgtcatgtattatgttagacgaaagaaatatgatcatagaaatgatttcgattagcatcataatggaagtccaaaatcgtatatgatgaaaagagaaagatgatcgttgtaataaagcatgcaaaaggataatttaacataaagatcatggaaggagttaaattttgtcaacaattggaacattttcatttatgttctttcactaaaaccaaacgtaggtcatcctcactcatcacgttaaaaactgtggtagacaaatcaattcataaacatgtgagataagtaattgagcaccgttttgttatatggttccatatggtgtctataaaacatagccactaagtaatcaaccagatacaaacaaacgaatttatttcaaataattcacaattattaacaatttcaattaaaaatttgtaaatgataacatggtattcgattcgatcataagcattatttgagttaaacaatcatatgctcttaaatgttaaacttttttcaagtaaacttaagatatcccccgccggtgattcaaataagaaaatcaccgtacattcaaaaagagtgtatagctgttgtaatgactaatttagtgattaaaaagataatatggttatttaggaacagacaaacggcacgcgtggcgatgcttcaacggtggtctgaataaaacacatgggttagtgggtccccactccacagcctgtgttcaccttttgcttaaactatcttctaaatcaagtttgtgtttgtagttttgacacaaacaagttattcatgttttgttaataacattaactagatctagttaattaagactactattttgatttgaaagcaatcatactagtagttaattaagactagatctagttaatttagccatccaatcccgcaaaatttgtccaaatagtctcatttacattcatttttgtatgattgcattaaatgacttagtaaaatggcacacaattaactgtttatttggaaacaaaatataggcaattaacacttttctctgactaattgacattgacccttaattttatactccaaatattatctctcactaactccttcctatttagacaacaccttacacgcaaacaaaaaaattaacacaaacttataaatagcgtttcccatctcacttctattcaaagatcgcatcaccaatcgcagtcaaaagaaacgcaaacgcgatctctctctcttaaaaactctgattcattctctcccgcagcagcttttcctaatcg

SEQ ID NO: 9403 - DNA, 3000 bp, Unknown
  misc_feature (1)..( 3000): cDNA_ID_2182291_gDNA_ID_1972113_Annot_ID_178809 3000 nt of promoter + ATG
ttgaagttattgttcatgaagcttatggttcgcagattcttcattggaaccaatgggtcgaggtttagtttcccggtcaaacccattccctcaagttgtaatccccaaacgtaattgctacaaagaacaccaaaccaatttgctgtatttccttgacatggtgatgataatggatcccaactacgaaattctgaaccatttgctaatgtatctttgaatcgcaagagacaatctgcatctgaatccggcacaaccacctgagacattgccaccggacataacacgctgataaagatgatgatgaaaatgcaagaaggtagattcttcttcaaggccgtgttacacgcaagcgtaaacgggtcctcccaattgcgcattgcggttacacgcgcaatggaatcgatttgattgatgtgaaatctcttgttttcttctttttcttttttgtctttcgtgatcgccaagaaattgtgtgaacggaagagagaaaaacaaaacctaccaagaatagacaaagcaaagtatttaaatttgcaaaattgtgattatttttttttggatttgtggcatcttaagattattattaggtgagagagttctttggataaccattcaattatcttgttttaactttttaagttatatatacatgtaatcgttgttgtactgatttgtcatttgctttagttccaaccaaatttatttttctctctatatgagaattattttggtataactgattttaagaatcaggcataactggtggattgttctatatgatgatgataatatctgaaccaattaaacaagtaatgtgatataactcggtagagttttagagatttctgttttatcaccagttacccgttaaaaacaaacaaacaacatgttttataaattaatcgacaaatatggtcagtcaaactaggagtaaaacttagtagtctcttaattttcttttcaaaattctagtaatgaaattataaaggatgactttgttattcctaaattatgtgactgcgcacgattaagagttgttattttcggacagtgttactcgaggaaagacataaaaaagacaaaagacataaacaatgataaaattaaactttatggggagaaaatcaaatgtaaaaaaatgaagaaaaagaaaatggaaggtcaaaaagttgaatgctgaaattgttcttctgaaagaacgcggaattgggttaaagagctttaaagtgttggtgggccgacacgattggtcggcatgaaatcttaaggtgtgaacctttcaagtacacatttctgctgcttatgcagtgtccatactccaatttcggttcgtactggaaaacatactaaagtggatgtatatttgataacagtttttgtttttgtttttgaatactagtattatataaaagagatttttcctagtctactaatgtttcaatccaatccattgtagttatcaaactagttatttatgggtattcaaagctgataatatggtactgcggggtagtagtataatactaaataattacttacgaaattaataatgaaatgagtaattatagaatgaatgcatataattaagtgtttttttttcacaaaagaaagacgcctgaatttaataataaagtgtattaaatattaattcacatttgtcgtaaatacgtggattgtaaaagtgtatcaatcgtatgtatgtaccactggttaaacaaatgtatgatgcatcaatagtcaaactaaaaaactcgctgatctttgaacacgaagttgaaaaaaaagtcgaaaaaatctcactgatgtatgtaaaaagaaaatatgttggtaaataaaagaaaaaatgggaggataaaaaggcagggaataatcacaaacttttaggcctaaaaatgataagtgttggaccaacccatggcttgcacgtttggtctcatctcgttacttttgttttcgatctcatcgatgtctgcgtctgtgcggaccattttacccttgccttttattacttcactaaaagatgaacacacgaattatttagacatgcggcacacaattttattacggttaagtttacagttttaaggcgaaaatatatcgttatgctttatgctacattaattatgtatagtagtactccctacccaaaacaaagttacgtatagtactttgattggccatcgaggactcaaggtttactaaatagaaagtaaaacaaagagatgtttattgcattcgtcgtccacacatagaataatcaatcatcatcatgatttgttttacattcttaagttctcgtaattattcgtttcgtacgtttttttaattttattccaaagaatttaacattaatattttgaagaaccatgtgctactagcctactattatactcaattgacaacaacccattttattttgcttttgctcgtgtttcattcatttcgaacgattggatttacataaaatagtctatacacaaagacaaaacaaaatcgctttttttttttttttttttttcattttgtatactattattgtggaaaacgcaacatttatatatcatactattgatcttgcatggttccatgaattttctaggtaaaaaaagtgtgttaatagaacaaacaaaactgttaaaacatgttgaattacttaatgcaatttgactctggtaaaacatggtcagccacgacatttcaactactctcattaactcccaaatgtttcatcatttaatatatgaaaatcattatataatactcgtatgattcaattactcagataatagtgatgtaatgcatgacacttgtttttggaattttattttatttccagttatatattacagttgtttactcgtcagactaatattgactgttattagaaataaaggtacttaattcttattctttacgcgctacaaaataagcaacaatggcaaaaccgtaaaaatgagtagtcaaaggggtatttggttttagaaagagatgaggataaaa

SEQ ID NO: 9404 - DNA, 3000 bp, Unknown
  misc_feature (1)..( 3000): cDNA_ID_3041768_gDNA_ID_1972113_Annot_ID_178812 3000 nt of promoter + ATG
cagtcacttacatgttagaggtattgatctcttctcatcttcttattcgatttctcaagaatcgccacgcgtaactcttgatgaatatgtatacatagggagagattttgcatgaagactgtgaaggacacaaaggagtaataagagaaggaggattacaatggatgactgcaggaaaaggcattgttcattctgaaatgccttcttctaattccaatggcattactcacaacaagggcttgcagctttggatcaatctctcctcaagacaaaaactgtaagcttcttcgataagaaacatttgcggattaaccaattgacaatgagtggagtgatccatgttattttatatactagattaggtttcttcttacttgaaagtccgtgaattctcagagtggagccgagttatcaagagatagagagtaaagacatagcagaaacagagaaagatggtgtgagagttagagtcatagcaggagaatggaatggagttaagtcaaagatctgcacaagaacgccaacaatgtatttagacttcactctctcgccgggttctcgaatctctcaacccattccacttcactggaacgcgtttgtctatgttcttcaaggccatggtcactttggggattccaagttacaacattcagccgctgctgcgcaccacttgctggttctaggcctaggtggtgacatgttagaggcttggaacggttctgattccggtttgcctcttcggtttatccttgtggctggtgagcctataggtgaaccaatggttcagtttggtccttttgttatgaacacacaagaagagattgatgagaccattgacgactttgagaattttagaaatgggtttgaaaaagctagacattggaagtctcaagctgcttctgccttgggactgttctgaaatctttttgcctctagttataattttttgaatacttctttacctgttattgtaatgatctttccaaaattattagagaaaaattggagtgtgagatctctaatcatttcttagtaagactttatatcaaaatgtaagacgatactctttattcataaaattgaagtaaacattattttggaacattcaaagtattcagttcaagaaaatttggtgttgttgacttcaatctccaatgcttctacaaacttatcagcataaccacttaacaatccaggactaactaaagtctctttcaatttcttatgattcctcttcactaagttcccaatctcactatctatatccatcacagatttaacagtatctctcaagtcctctttcgagaaccatccggaatcttctctctgcactttcacagagacttcgagttcttcagtcaacaatcttgtgatgagaacttgatctgccaattgtggaataaacacaatctgacaatcactaaccaaagactcccacattgaaccaaagccacaatggttcacaaagcaacctactgatggatgagacaatatcaaaggttgttccaaccatccttcccaaacgattccatgctttttaacccgttcttcgaatccttttggtaacgcttcttgaaccgttggtgagccttttggcggcataaccgatattaaaaacggtagacccattagctccattcctaaacagaattcttgaaattgatccttctcgaaaaagaattgagtgccaaacgcacaaaacactaccgaccctggttcaaatccgtttaaccagtgattccatcggtcttctagaaatttaccactcttattttgcggttcagggagcattggaccggttaagagaagtttcttttgacattctttttcgatgaaaccgcatagcttaccttcaagttccacgcaggtccttatggaaacgacgtcacagttcttaaggcctttggtgatcagaccgaaaagctcatgggaattcgcaaagagagaacagacgttagcttcatgtccacgtaacgccactttggataaaggataatccggcggaggaaaccctaattcagccctaggtgcaagaaccatagctacacaagctgccgatatgatctggtaattgacactctttattccaaactcttctgccatttctggaacccaatgaacaaaatcgaaaaagattagatctggtttcaaagcacggacctttgcttcgatctgatcgcgtaagagatccatggcaacgaatatgggtttcttagttgagtttgggagatccgaggctgtctcggcgccaaaagggagaccatcgacaggagggagagtaagaggctcaaagacaatgctgtctgggaacagattgagaggttggagctgcttatgagctttcttggggaggaagaaagtgaccctatgacctttctcagctagtttgttggctaaatgaagatatggaatcatatgaccaaaaccaaaccatggatacataaaagcatgaaattttgatcccatttcttcaagagagccaaattgttgaccctttttttttctttactcaagttatagaagaatggttgcttttctttgtgtagttgatattaaaagaatgtgtcttaaatattaagtgggattatttaagctgtgtttaggtgctaattgcttgattgcatgtgccaccatgtgttgaatgtataaagcttgcaagttgcaacaacaaatctttaaaatatagatcagtgttttactgttaacttgcattataaattttactgttaacttgcattataaattttactgaaataatcaaatctcaatgctcaaaatccaattttaacagttggaataggaaatccacgtgtaatgattctattagttaatgataaaagccctatgctttggagtggggcatagtcatggagctaccggtgaagttgaacggagataaaaatataatctttttgtctgtcaagatcttaaattgacaatttgagagagcctgagagtagttttgttgggtacccagttgaaggaagtgagaatcagaaa

SEQ ID NO: 9405 - DNA, 3000 bp, Unknown
  misc_feature (1)..( 3000): cDNA_ID_4258623_gDNA_ID_1972113_Annot_ID_178813 3000 nt of promoter + ATG
cttctcgaaaaagaattgagtgccaaacgcacaaaacactaccgaccctggttcaaatccgtttaaccagtgattccatcggtcttctagaaatttaccactcttattttgcggttcagggagcattggaccggttaagagaagtttcttttgacattctttttcgatgaaaccgcatagcttaccttcaagttccacgcaggtccttatggaaacgacgtcacagttcttaaggcctttggtgatcagaccgaaaagctcatgggaattcgcaaagagagaacagacgttagcttcatgtccacgtaacgccactttggataaaggataatccggcggaggaaaccctaattcagccctaggtgcaagaaccatagctacacaagctgccgatatgatctggtaattgacactctttattccaaactcttctgccatttctggaacccaatgaacaaaatcgaaaaagattagatctggtttcaaagcacggacctttgcttcgatctgatcgcgtaagagatccatggcaacgaatatgggtttcttagttgagtttgggagatccgaggctgtctcggcgccaaaagggagaccatcgacaggagggagagtaagaggctcaaagacaatgctgtctgggaacagattgagaggttggagctgcttatgagctttcttggggaggaagaaagtgaccctatgacctttctcagctagtttgttggctaaatgaagatatggaatcatatgaccaaaaccaaaccatggatacataaaagcatgaaattttgatcccatttcttcaagagagccaaattgttgaccctttttttttctttactcaagttatagaagaatggttgcttttctttgtgtagttgatattaaaagaatgtgtcttaaatattaagtgggattatttaagctgtgtttaggtgctaattgcttgattgcatgtgccaccatgtgttgaatgtataaagcttgcaagttgcaacaacaaatctttaaaatatagatcagtgttttactgttaacttgcattataaattttactgttaacttgcattataaattttactgaaataatcaaatctcaatgctcaaaatccaattttaacagttggaataggaaatccacgtgtaatgattctattagttaatgataaaagccctatgctttggagtggggcatagtcatggagctaccggtgaagttgaacggagataaaaatataatctttttgtctgtcaagatcttaaattgacaatttgagagagcctgagagtagttttgttgggtacccagttgaaggaagtgagaatcagaaaatgggggtttcgatgttggattcctcatggagtttccgattatcctcgaagatgtctccttcaccaacacaaaaactcgctagctctttgacagaaagagatccaatttctctgaatttgaggtttgatcattccattagggcatattcagctcgagctctaaagtgcaggtctgttaagtctgaggattttgttgagagaagtagcccatttgaggtaacatactaaaatctctgcttcgaatctgagttagaatttcattaaattggttctcatttctagtctttgcaatagaatttcatgaacaagttcatcacagcagaaagagtttgactttgcttagatagccaagtccttagagaattagaaacacaagaacaagcgtaaattctgatatctcctgttaaagtcttggccttttttcttgttcaattgaatgaagaagtaaacttcactttatctttaatcttctttggagatttcggtttttaagtactgatagtttccccttgaaagaccatttcgatagaggttattctcaacttattctgttgaattctcattgtttgaaaggttaagaaagagcttgagatttgcttcgacctcgtacataggctcgggagaggcattgtgtacttaggttccgccagaatcccaccaaaccattcacattatctgcaagcacaagagttgagcagagaagtaagtaagacccttaacactccacaagagcttagtttagatatagatttctcagagttgtgtattttatcaggcagcaactctgttggactgtactacatggtctggtgctggaccagggcttatggatgctgtgactgaaggtgctttggaagctgagaaaccggtcggtggcatcaaaatagaaaaagaagccggtgaatggaccgcatcgaagtttcatccatatctccctcctcagaattaccatacttgcaggtaaacatagccacacaccattggttattacttactgtgcttgcacaagaatgagtgatccctaaaatgcaaaatccatgttaggtttttctcggcgagaaagcatggattagtagatgctgtgattagaaacaatgtatctgagaagacggcgataattgcacttccaggtggcattggcacgctcgatgagatgtttgagattttggcattgattcagctcgaaaggattggatctgcattgccggttccattcattgtgatgaattatgatgctttctattcaaagctgcttgaattcattgagacttgtgaaaacttgggaactgtttctaaaggagaagtttctgcactgtggaaggtatgcaacaacaactttgaagctttgacatacttagctgaattctatgacttgcctgacggttctgcaaagctggaaactgaacttagaaaaaccactcccactcgtggatgatgagtttcgtaatttttaactgtaagagatcatatttttgaccatgagcaaccaatttgaagctactcatgtggcacatgtagcatatagattcgtgtgtttgatacatacaccaatcagatttgttgttatcactttcaatcttatgtttcttctcttagcttctcgtgttatccttctacttcactgaacttatggtaatgggaatgttaaagctagtgaagacaaca

SEQ ID NO: 9406 - DNA, 3000 bp, Unknown
  misc_feature (1)..( 3000): cDNA_ID_2182283_gDNA_ID_1972113_Annot_ID_178807 3000 nt of promoter + ATG
aattataaatataaatatgtcaattaattttggacctaaatatccaaaacaactaaactattcaaaaaatatttgttatgtttgtcaaaatttagtaaaatatattcaaatataattaaatttattaaaacttaacaaatttaaaaaaaaatttgtttggacactcgctatctacataaaaatttcccgtttctttttttttgggtatttttagggtctgaaactttttccaaactgacccaaacccaactggatctgacccaaaccagaaccgaatatttagaattattctattaggtagtaaatcaatacccattaatcccaaacccgaacgggttctacccgaactcgaatgggttactcatatgcccaactctattctgtgatttaattatctaaaaactcccaaaaacacatatattttgctgattacttttaaaaaaaaaatttacatcctcttctgccaaaatcatcttataagacatcacaaaacctttgcaataataatttcatgaatgaataatcctaatttgaatataccaagaggttttgaaaggttttaactttttgataggtgtgtatgtgagaaggtacagacatcgtgatattaatctgcttatttataatttcaacttgtagtataccgtaggtaggcttatattttacttaaactaaaaacttttattgtaaagatgattataaatatatgatattattttatttgattttaaatgtacagtaaactgcgagttgtatatgttttgttgatattatttatattgtttagtgtttaaaattatacacttgtattttgattattaattttagagtttcacctgtagtataccatcttgtattaatatcgatttaaacccgtcaattctaggattttctagcttgtattaaaaattgaatcacatcatacacataaaaaaatctaatatgttttttttttaacacaaaaaatctaatatgttattaattattgtagtatataagattataaaattttaaaataatatgtatgaaattgaatataaatattcaaattgtgactcagtactcagtataaaattttcttaaatctatttttgacccgttataatattttttcatgtattgaacagtttatattcgtttttaaaaattcaaattatagcatatgcgaaaaaactctaattattgttttataacgatgatattattttttcgcaaaaatagaatcatataaagatgagaggtgtactataataattaataaaaaattaatatgataatttggatatcaaatctaattagttgattttaattggttacttttttggaaattaataatgtatttcgttttttaattaaatttaattaattaaattagtatttgactttttaatttttaaagagatgaattaatttactttttaaattttatttctaatggcatacctatgtaattacttacaaaaaataaggttatatttaaaatgtacttcccaaataatatagtagaatgtgctttagttggttgaatacataatacattacaacaaattggaaaaaattgtatgtacttttttttatttttctaatctatttaattaaccgagtttttttgtcttctttattccatctttttcaactgtagatcggtaatatcctctcccaaggtaatgaatagaaaacatgagttgtagagattatattgatgatgtcgtaccattgcatgtacattatagatatatgttaagtcaagaggagaagaaggaagagaaattattcgaatctcgaagatgtcttgataagatctcatgacacttcaggtacattacaaagctattcttggatacccaaagaaatttctcttcaaaatataatttgaaatctcaccatcgatttcacgaaacctgaatcatgtagacagagaggtctgtttttgggctcgattatgcataaaaataggactacatatcaaaggccaatatttttttggttaggatgaatctttgaggtggtgatgaaaatttatattaagagtatgagagcatttgttttctaaaccctaaaaataaacttatataaaacatttattagaatgtgatctgtattcatatctctcaatccgataagctattataatacaacgaatacaaatctgaaattctacactttattgacatgtacatctaatcatcggggtacctttatatatcacctaatcacaaccattcataaatatacaaattgtttccataaatatcaacctaattaaattgtaaatatatatttttaacaaaatatttgctgtagcacatggtctaaaacctcggttgatcaatttgatcattggattttcagattcgaagcctgacagcggaaaatattttgttaatatatccaaaaataaaaataaaaaaaaagactatagccttataagaaaaccaaagtactgtatataataagatatccaaatacaaattatcttcctctaaaacttaaatttacttttgtgttaggtatgagattttggcataattgaactcagcatatcaaattgaacctctataatatgggcttatgggaataagaaaaacttaaaaacccactttccctatcctgtttagtagaagtatatactaaaggcctaatatattcaggcccaactttatttgatttatctctctagaaaataactaagccgaagcaccacgcctctccgcaacccctctctctctctctctctctctctctctctctatcttctagctgctgcaaaactcttttgtaaatttcgttaatcgtcactctaaaaattcccccaaatttttacccgcgaaaaattaggttttgtgacgttttaatcttttaattttcttttcaaaattttgaagaacaaaaaaaaaaacctcagatcttccctctttctctcttctagggtttctctctcactcactcactgattcgtttctttcgcggctctctttctctcctctcgtgttgagaatg

SEQ ID NO: 9407 - DNA, 3000 bp, Unknown
  misc_feature (1)..( 3000): cDNA_ID_2182263_gDNA_ID_1972113_Annot_ID_178803 3000 nt of promoter + ATG
gaaaaaaccatgattctatccataaaattatagtataaataggcgggctttatgtggatcaccacataaactaatttcttcataaatactcacaattgactcaaaataattatgaaattattatttaaacaatgtcatttaataaaatagcatgtcatactaaaaaatataggagtaacatgtgattgttatgcaggtgacaatatatagtgactgttcatggttacgaaagtggtgatagaaaaaaattagtataagggaaatataccttattatataattagtatgatatattttaatttttcaaagttagtaattaatattatcatgaatagttatcaatcaaagattttaccatatgtcatgatttaaaggaatttagtcaacgttgatcaatcatctctatatttttaacgtgcctaatttaaaaccattttgaaatcattcgctaactttatgataaaataattttaattttagttttcatataagtatatcaaaagttattgctatttgatatacttttcattcaaataatttgagcaattgctatatgatatatttttcattcaaataattttttattcaataattttagtggtgaaggaaacaatacaacattaagaaaaaaaaattacttttgaaagataattattatattttattaaatttgattttagttataagaaaataaacccgtccatcggacgggtccttatctagttaattatataattggtaataagtaataacatatactagtgcgaaagtctagagtacgtggaaactagtcgagtgatagaacatggatcatggattagggtaaaaaaaaaaaaatacatggattagggttagaagcaaatgaaacaattaagaaaacaataaaatttaatgagacacatcaagaacaaggaatagcatgggaagtacccaaagatggcacatttaaagaggctgacccattaatcaactattgtttgcatgttcattatcatattaatacacaaatataaaaaataatatactataatcctcaattaaaagtttgatgggcaatccaacgtgcatagctttgttgatctattcaattttgtcgatctaatataaagtagatatttgtgtaataccacactaccacaatttttaaaatcatagtggtatataaattaagggtttactatatttattctagtctatccatttcaatgtatatatcattttaacataggcacacgaattatagtaaatttattttattttatatcctgaatatcaattacatatcgaacttaaattatatactatatcaatatttttttttttcttttttttgtttgaaatccaagaggttctgcgctgaagcccgtaatccctctaggccagaaaccacatcatgtaatattagtttcgtcccaaacatcactcgaaccggcccaagcatgtaatatactatatcaattttaataatacaaattagacatgttatttttaggatattgaatttttattacatgttttcagaattaaaaaaaaaacaatctaaaaagcatattgttaatattaattacctgaaattggatgcaataaaattttaggatatttgcggtttatcttttaagagagatcaatcggaactcgattgatataatgatatgtatgtgttagctgaaaacaatagtataaattacaagatattaaatcacataatacaattacaaaaattaatatacaaaagcttccaaactaattccatatatacattagaataaatttcttaaatgcattctcaaaatataccacactttttgtaatcatatatatataatatatctaaaaaaattcaaattttttttacaaaaaactatatctacaagcatattagatcggatcgaaaaatcttaaattttaaaaaaacaaatatttatctaaaaactccaaatatcatacttttttggagcgtaatatatttaatctcgaagttgattttaaatgttttttttatcaacagtttctaattaaaggtaaaaaaatcattttaaagcgatgttctttacatatatgattttaaatgttgataatatgtattgctgcgtaaggtaattgaaaagttacatctgcatgtttattactagacataagcttatttataaagaaaatcacctttgtatataagttttgttagaaagaaaacgagtgaaatatataagtcttgttagaaagaaaaagagtgaaatgtatatagatcatgtgtaggcaggctgatgaatccaatgagccgacatcttaacttaggataccctttcatgtcttcgtcgcctctttgtttgtttcctagtcaatacctttttctatatatacaatacaatagagattaaagaatcgagatctaaaaattgacttataaatcttatgcattgcatgttcatgattaacattttcttttctataatttttttaaaaaaatgataggttaacatcagacaatacaatatccattccactcttttgatatcctacatgctacaatcttttaattaacaaaaaaaaaacacgtacaccaataatttattgaaacatttttgtttttaaaatacattctttaatcatatattcccaacgtctctctgcaaacaacacgcaccaccaagctagagagctctctccctccccatgtagtttagggaaacgctccccacgcgctactacgcgcgtacacatccactctctaatgatacgacgtcgtcttggtcttataccgttgaccaatacacatgggttttacaaatatacgtattcatatactcatctctctctctctctcgtttcagtcacaagactctcacaacaaagcgattttttggcttcacgaactcaaagctatctctctccctctatctctgaggcacgcattttcgtctgtgattctcgagctcttttggggtttctccgagatttttggtcggttcttcacgttttgtttatggcggtgattacgtgatg

SEQ ID NO: 9408 - DNA, 3000 bp, Unknown
  misc_feature (1)..( 3000): cDNA_ID_1012357_gDNA_ID_1972118_Annot_ID_178841 3000 nt of promoter + ATG
agcgttcatttgctactttttcccgtaacttatccctccctccttaattggttattcctctctctcacatttaggaagactgtaggggtcaggtgaatgtagtaaaaattcaagatgatctaggatttaatagtactagatgagtacccacgctatgcgtgggtttgttgtgaaaattgttaagaaaaatttatattgattgttctttatgctaatttatatttactatttgtttattcttgtattgttaagaaaattagatccataatatgtagttacaatttttatggttagattcatttgtaactcgaaatatcaatttatatatttttgtgtataaaactgattatttataagattttaatattttttcacttcatgaatacatataacaacaataatgatattttgatacaattctgtgaaactatgttacttttgtggtttaaaattctcctaactcgtttataaatccttgttttatgtacttcaacaacattgtgatagactcatgattaaagtttggattgacatcaactgaaaaagatctgaagagtattcgtacaaaaaaataaaaagatagcaaaaattgtcatgggcgtgctcttaatattggtacttacttgacttttgttggcgaggtaagggaaccccatgttccttttggttcttctttattcaggaaataatgtggaatctttaagaatattggtgttttcggggatgtgcaagctaagttacatctgatttcgtccctctttataggattggctttccttcgggtggaaggcaaagattgttgaaatgcttggagaggctactggcatacttgcctcggtgatgcaagatacactgaaactttttagtttatggtccttatatttttattatgttttaaatatgacccataacttttgtaattacaactattgccccattatcctcgagcttaattaactaagactagtaaaatcatttgtgagccctttcgtaatcaaatttcagaccaggtttacccgaactccattatattatgcgaaccgtatttcagtgacaaaatgttgaaaagtttttctcatcgaatttcggggttgagggccttgtgttgaaatgatttggttgaagatttcggatgatgatctccataatcaattgtgggcttcaggtggatggacggagaagaccactgcgttatgggcttcgttgatttcaaattgggcgttttcgtgagattaggcccattgttgaatagtcagcttgattttgttgccttagtattttacaaaaattgttgactggtcagctgatactacattattcatcgaatgtttatgaatctattacgaatgaaccttgagagaaagatagtttgttatgaattcattccacattggtattacaatagattgattcgaacttatacttattatatctaataagtacatattagaagttaactaatagttagctaacttggaaggcgagtcatgtgacagtagcatatttttaatattgattaataacatgtttacaaagttaatagtctacttttattaatgtggcaagtacgtgaatgtgttcctaatcctaattattcgtaaatatatttaaattttattagttaaactaccttttaattaatcaaacaatacgaaactccatcaaacaactttatacaaaagaacgacacttacatcccaaattagacaaccatgttaaaaaatgctgtatgcaaatagctcattagaccatgatgaagagcaaaccaaacaaatacatattgttttaaaatcatttccatgtgtcatctgatgattcaacatgtcaataaggtcgaaacgtgaaatggagcaaactgattcttagacaacatccggaaacttaattattggtatgaagatcaaaatgtttctttggtttcgacgttataccattaatctttctgctaagtatctgacaacttgtgatacacgtcaagtatctcccaactgtgactaacttcttcttctttttttcttcttcataaaaacaactgattgttcttttgaggataaaagcatcaacgcctcattttacttacttacccgcaaattctaatctgcaaaaagataggaaatacatagtcatccatcctaatgtagttctaacttctatgtattaaagctttgtagagtttgatttgaatataattcacatgaaaattaacaaaaacatgtaaaacagtagtataaacaaaaccaaaataataacaaaaaacattaacgattaaacaaatcagataaagaccctcgctctctctacggtattaagcttgaagcattctttttaactattagtagtataatttaactcattattaactagagattaatgacagaatattgtaaaaccatcaattttgtttaaaatcattatttttttttaatctttagcctttccattatattgatcgacagatatggatattatagtacagttcttaaacgttaatcacagtaaaactggcagaaatttactgtattattacttcagttcgttgtagaacatgcctcaggaaaaaaaagcgcacataaatattgacccaaaacaaaagaaaagtaaaacgactttatatttctggagtgaattaaataaatagataaatacaggttgtgactttaaaaaaaaaaaaaaaaagttgagatgttgtcgctttaatctattcttccaatgcttccaaatccctcaaattgtcttttgtctcctttccttttcgtttttagggtttttttttcttagcacagctctctcttctcaatttccccaaatgaaataaattcctccgaaagtttatagatttcactctcccccgaactatacaaaattccctcaaaaggaaaaactaaaaagccgatcttggcttttttgtttctgagtgcatctcgatacttggaagcattctttggtgaggctgattcattctcatctgtgaaagtctttggcttttgaagcaatactatg

SEQ ID NO: 9409 - DNA, 3000 bp, Unknown
  misc_feature (1)..( 3000): cDNA_ID_3041798_gDNA_ID_1972118_Annot_ID_178853 3000 nt of promoter + ATG
atataagcacgagttcttccaaaaagagacaaaggagaataaatagtaggggaaaagaaacatttatcctctataaaaacagaaaccttttgtccttttatatctttaaccttcactcacaaaatcacaatcctcccttagtgttcttcttcttcaacatctttcttcctctacagaaggcaaaaaaaaaaaacgttttctttttctttcaagaaatcaagatcaaaagaattagggttttcgaatgggtaggtgtggaagaagcaacgacggagtaattggtggagtaagaccatacgtacgatctccggtgcctcgtctgagatggacgccggagcttcaccggagtttcgttcacgccgttgatttgctcggcggtcaatatagtcagtctatttaaccaatctcttttttttggtattttttttagatatctttaagttcggtttttgtagcttttacttgggcagttatataaaatcgcaatatataccaatattcattatcgccatagtccagtttttaaatgttttgtatttttgtgtttgaatgaaacagaagcaactccaaaacttgttctgaagataatggatgtcaagggactaaccatatcacacgtcaagagccatctccaggtcaaagaaaatgctaaaaaaatacttttttaatactatttattgtcttgtactgtttattcgtatacatcacactgctctttccacctttatcttttattaatttgaatatttttaaaacgttttttcattgttttgattatactgcagatgtataggggatccagaatcactcttcttggaaaaccaggtaatgagttctacatattttgttgtttatatgaggaggcatcaacgaattacactctcaaacgtcatagtttcaagattaggacatttcttttcatatacccaccattcacataaaatctgtaataatgcataaattgaaatctcactcccaccattgtcagaaatattcaaataatgtaaagtatttattaaaacaaggatagagagattaacaaaaaaaaatgaaaaagaatttggttatagacttataggtaaataagtgcttcttttaatttattgccaaaaacaaaaatactcctaccaaagagtgaagagaatattcatcatggtcataaattaattaatgtttttataatatattttttgggggacagaagagagttcttcaccatcttcaagaagaagaagaagacaagacaatgaagaagatcatcttcatgacaacttgtctgtacacgcaaggaatgattgtcttttgggttttcactcttttaactttaggtaaaaaaaaaaattatttccttggcaaaaaacggaaagggaatattaatttgtttctgacaagtgttttaattttattccagaaaataggtatgttatcatacagttttgtttgaatatgaattgtcgaatttaaagattttttttttttttttgggggagaagagagcagacttcagcgactgataatgatgacgatgactttcttaacatcatgaacatggagagaacgaagacatttgcaggcaatggcgagtccatcaaatttcagtctcatcactctctcgaggtattaaatatattcaattttatcatatggtttcataaatagccgttgcgaaaagttgatatcaataataaaaatatttaagactcagataaacactcactaaaccactgaacattgttatggtatgggtcaacactagggtagcatggggctcggtactgaaaattttcagatagagattttattgtcacaataaattcttaagtagtaagcactaatataattcattagtaaaataatttataatttggataaacaactaacccattgtatgggtaaaagagttgataaaatcattagtaaaataaaatcaccacctatatttgaaggagtacataattgttttgattaggttaattcattgattttagatatactataatctatagacaattagaattgttgaatccgttgattaatgtagaagaattagtagatttattacaaatactaatcttatgttctcacggacattctcaaatttatatattgaccaagaagagtataacctatagtctctaatttataagagcttattatgtctttggaatttaggctgagaacacgaagaacatttggaaaaacacatggcgagaaaacgaacacgaagaagaagaagagttatcgctgtctctgtcgttgaatcatcctcataaccatcaacaaagatggaaaagcaatgcttcatcatcactcagtgaaacaagcgaagcagtctcatcttcttctggtccattcatcttcagagattgttttgcttcttcgaagattgatcttaatcttaatctctccttttctctactccatagctgaagctttgttcagctttgttcctttgttctaaattttagcgtagtgaacatttagattgtttttaaaccaccttaaaagttcctaatcttttagttaggcctcttgatttgtgattgtgatgtttttttttttggctgtctacaatgtcacaattacatcggatttattaacaagactgaaaggttcaaaccatttgagcaaaaaagtaattcgactagttatgaactttattatttatgttggccttcttatgtaatcagatgttatgatatgttagagggagattagtacttgttggatgagaaattaatgttttatgcggagattagtctgtgctttaatatgaagtggaaaggaaaaggataccttcaaacgcagcgttttgatcctccttacacgcagcgttttgatcctccttacacgcagcgttttgtagtgggtgtataatttatggaacacattaaatttgtaaccgtttatgtttgcaaaaattgatgattaataatagaaattaaaattattgggcaaaatcctaacgttgatcgtaagtgacgatggtcggtggtgatg

SEQ ID NO: 9410 - DNA, 3000 bp, Unknown
  misc_feature (1)..( 3000): cDNA_ID_3041795_gDNA_ID_1972118_Annot_ID_178858 3000 nt of promoter + ATG
agtgttaatactttttcttacaatacatatatgatgaggtgtataaatacaaactatatgtcaatgagaaatgaattgatattgaccaatgtgtaaaacaaaaatggaacaaatgtaaactaggttttgaaatttgagtggggttaggtaatgggggactgaataatggctaaaggcgatgaaactatcatcatgatgtctttgttctaatgctgctcatgcatgttactcatggaagagagagaaagtggtactgtggtagatgcatgatatatcacttgattaattagtcgtgttatgtatataagtatattagtacaacaaatatatgaatttttgtttattttgtggtttgtatatctactacatgaatcataaattttcaatcatatatatgaatatgatgggtttaatatgcgtaacctacttatcgccaattgcaatattgtccttccacttagaattagctgatagtgaatatatatatatatacacttgaaaaacatgattaggacaaaaacgggtttagttgtttaactatcataaaacgtaaaaacaaatgtcgtttaaacctatcagtgctatatataatgatttatagttacaatttagataagtgaaatgcgaaactatgtaatcctatattcaaccatattctgcttaaaatacaaaattctacatagaatctatgtaatctgtattgatgtgaaacgtttaacataaatacaacgacgagatgcaccggtttggtaagatgggttatcaaagtcatgcatgttgacaaaataaatgaattcagagatacacataagagaggatttcaaatttgcagctttatctctgtatgtattattcttcaaagcaaaatttgctttctgatttggtgaacaacctgttcttctattattaggtacttttttccttagacttatatactttcatttcttctccatcgtggggtcatgtcatatcctgtcacgtttactccatcattacttaccttttatttcaatttttgttatttctaaggacgagataatatagcacaacgcaagcataattactaaacacgacttaaaacttgataagaaatttagagattatcattacttacctaagattcttgaagttaattggatcgaacaagtacacagtatgacttacttagcatttgttgacaacaaaaagagaaaataactttgcgtttgtattaatgggacaaaaaaatagattacttgtcaccgagtaagaatgctttttctcgattgtaatgcatatagccggcatacggattttcagtggggtcgagtgtaggcatgccggagggacccatttggaaatttagaaagattgcaaccgtatcatctgtgggtctcttctttaaattcgagtttgaatggtcccaaatatatatattggtcaaattttatgattgcaaatttgcatttacttggttttcttgacggttgtccctagaattgagaaataatgagttgatatttaatattttggaaaataattacacacgtatcggagttgtgatttagatataatatccaaaagtttcgcaagttttatggatcaaataacaacttttgtattcgatcatgtagtaagtttttttttgtttgttaatagtttccaactatatgtttattcaacaagactaccaattgtaagctaaccacattggtcatcatcgaactacttgtctcaaatttttaatgaaacgttatagatgttagttggtatttagaaatagttgattttgtaaaaccataaattatttattttcatacgtagcattgaaaacgttaccaatacgatatccaatatttagtatgtataattttcaaaatttcaaaccatatgactgatccatgatcgaatcctctttatatttttttcatgggtccgagtagatttttaatatctcatgttggagaatcctgagattattttaaacaagaaccatttacgacaaaaaacagaaccatttagtgggggtagattttaggtaagattttataataccatcaaccaaaagaattatgacggataaacaaactgctatcacttaattgaatcctcttgttaattatatatatagacagattaggagaattatgttattaccaaagctgtgctatatttgtctttgcatgtgttgttcattggacggttcacgatcgccgatcggtaatcatggtgaatcaaacggtgatgattgaagcacaggtttggcctcggtcggagattttgtctcttgctattatttggacccattgcttcttctttgtttttgctttattaataatctattcggaccacacacacaaaaaaaaagtcaagtccacacaacatactttaaccaaaaacacagatgcttcgatttaaaaagaatcgataagagagtgttgtcacggaccattcttctgcatagtccgagacatgtcgcgttgttttcccaagactttacgtagattgataagtttatggttcagtaaagtgtatgtattaagtgataaactaaagttttatgttttgatgtatgagtcgaaataatgttacaatttcttcatcagattcagctatgtaactttgcccaaaaataaaataaaaaaattcagctatgtataacacagattttataccagtatcttaaatatttattttccgatgaaatatatgtgtagttaattttcttaaaggtaatctaaatatctattactttttttgtcaacaccgtaattacatgaacgaaccaaattttcatctatccgaatgcatagcaaaccggattctggtttggttatgtaatccaattttaattagatcaaaccggattctggttatgtaaaccaataatttttcgattccgtcgaaattgttttacctgaaaggggatttggaaaaaccctctcactctcaggctcaagcgccggcgttcactctctaaccaaactcgatttcgtttctgggttgtgagattgagaaatg

SEQ ID NO: 9411 - DNA, 3000 bp, Unknown; identical to SEQ ID NO: 5537
  misc_feature (1)..( 3000): cDNA_ID_3077649_gDNA_ID_1972118_Annot_ID_178862 3000 nt of promoter + ATG

SEQ ID NO: 9412 - DNA, 3000 bp, Unknown; identical to SEQ ID NO: 5538
  misc_feature (1)..( 3000): cDNA_ID_2025342_gDNA_ID_1972118_Annot_ID_178863 3000 nt of promoter + ATG

SEQ ID NO: 9413 - DNA, 3000 bp, Unknown
  misc_feature (1)..( 3000): cDNA_ID_2182405_gDNA_ID_1972118_Annot_ID_178861 3000 nt of promoter + ATG
gcaggtgagacctacttctttattattatcacccatatttttttgaggcatatttattatttaatactattaacatataaatgatcaatacattagtgctgttttaatataaatagtaagttaattgaataatctttgtgaataattttcttatatttaaacagacgaatctccaaattcttccatcaatatatgttctgaagaaaaatcctcaatttcgtcgagaaactctttcgaaccatcctcgtccacgtcaagtaagcatattgtattttcttccgaagtagtgaattatatgggactttttcgtttttgtttatgcgtaattgtccacagtagctataattaaacaaatcaatcatgaaatttcacttttattcatttgcgttttgcgtttataaaatatttaatattaataaaattatgtgtttctaatcacatgcaaagcattttaaacacaaagtccgatcccgaataaacactgacgtaacacttgtgcattacagaaaagaatgactatgacgagaagaagagggtggtgtatccatttggagtggtaaaaccaggtggtcgagaagaagatataactctaaatgacattaataagaggattttaatgccatcggctaggccggttcgacatccggttggagactttgcatgtcgtccgtgtgtctctgcagatggaccgggtctatcaggcaaagccgtggttgcattcacgaagatacaaacattagggaggggcacaattactattataagaactaagggatgatatatcatatatgtaattaatattggctattagaggggggtcgttataatatgtactggagatgtttcaaaaagactaatcattggttgacatgttcaaacctattgttgtatataatgagaaatggtgtatattagtatacatgcttttccattttcttagaaatcttccttctaattatttagaaacctcttaaaaaagaatcaagataatagatatcttagaaacttactaaacaaattttcttaagaaatcaagattttgtatgtattgacaaaaaaaaaaagttctcttctttttttcgtttgatatattatgttttttgcatgttcgtgctttttgttctttaccctttttcccctagccaacccttttgttctttagtaaaagaaaaattcagtagacaccaaataaataaacgaagcgtgaagaagaataaataacaaagaaattaaagcaaaagagaagaatatgctgaaaagcaagaacaaacaaaagagaaagagagagtatttataagtaccttatcaggaaattctcaaagatggttatatgattttaggcaacaagctttcttatctatatgttcgaaatacttaaatgattattaattattaccatatagtcaatattcttaatgtatcatatcgaaaaatctaaagtggattttacttttaaaatttgaattgaaagaataaacaagtctataattagtaattttaaaattaccaagcttctactacaatttttgaattataacaagtacaatgaatcattttgtttcagcaaatttaaatttcgaattagaacaagtattgtctccaaattttattttatactaaaccaccaatgtataattagtttaaattaaatgaaactaaaatataatataatacctattttgtaagatcaatgtcattatgggcccgatggtaagcccaggtcgatttgcacacagtcaaatacatgacgtcatataacatatatgacgtttgtcagcattttctggtccgggacaaaagatcagcaatcactcgtactgtagtcagtactagtaatgtaatgctcaagtgtttagcatgtgggaaaaataaaacacattttcaggtggttagtgacgtggattggttaataattaacaatcgctagtgctctcttttttaaagatttcttgaaattaaatggaacaccttttttgtcaatcaaatggaacacctaactactaatttaccggtcctttccattatttttcatctccaaacgaccaagatcaacgtagcttttgaccttagtgggttgggtccatgttggtagaccatggttaaaaacttaaaattaagtaattaacaaagctgaataaacaacaatattttgaatttttttctttcctcattttttaaaatattgtttttgggggtgagaatagagtgtttttttctttaattaaatagatgaaatacaaaatcaaacatgtaaaactccataatattatgtaactttgacttgtaaataacatccaaatttgataaaacctaatttaaaatcaagtatttatcaaatttcagttcaagataaaatattgaattaacaccagatttaagccaacaattcaaaattttaacctaaaaacttacataatctttttttttccaaataaatttagattaaatatagtatgaatttaggatttttaaaaaaatattatgctattataataaaatatatctttctaatttatattcatgcatttgattccttatctgtatcaaccatatacaatcaaatataagtctctgttgttaacagaaaaaagaaaaagaaatgatttttttataaattaatataatgatgcagatcgttgacgaatcgaaaatagtcggtttaggcgtctagcaacttatatggaacaactttttaagcccaagtgaaaaagcccaataacaaacttgaatacagagtatatatatattctagggtgcggtttcttccctcgaagatcgatttccattgaatccgtcttgtacgcttttagatcacgatttgctccgtccctctcttcttctccacgtcacggcgattctcgcggcggtgctattccttatcggttgagatacggtatgtttcttaggtcaattatgctcaattttgattttcccaatgtcatcagaatctgatgctaatgtgttttttttttttgctcgctgcagaaaatgttcaattcg

SEQ ID NO: 9414 - DNA, 3000 bp, Unknown
  misc_feature (1)..( 3000): cDNA_ID_2182394_gDNA_ID_1972118_Annot_ID_178857 3000 nt of promoter + ATG
aggtaagattttataataccatcaaccaaaagaattatgacggataaacaaactgctatcacttaattgaatcctcttgttaattatatatatagacagattaggagaattatgttattaccaaagctgtgctatatttgtctttgcatgtgttgttcattggacggttcacgatcgccgatcggtaatcatggtgaatcaaacggtgatgattgaagcacaggtttggcctcggtcggagattttgtctcttgctattatttggacccattgcttcttctttgtttttgctttattaataatctattcggaccacacacacaaaaaaaaagtcaagtccacacaacatactttaaccaaaaacacagatgcttcgatttaaaaagaatcgataagagagtgttgtcacggaccattcttctgcatagtccgagacatgtcgcgttgttttcccaagactttacgtagattgataagtttatggttcagtaaagtgtatgtattaagtgataaactaaagttttatgttttgatgtatgagtcgaaataatgttacaatttcttcatcagattcagctatgtaactttgcccaaaaataaaataaaaaaattcagctatgtataacacagattttataccagtatcttaaatatttattttccgatgaaatatatgtgtagttaattttcttaaaggtaatctaaatatctattactttttttgtcaacaccgtaattacatgaacgaaccaaattttcatctatccgaatgcatagcaaaccggattctggtttggttatgtaatccaattttaattagatcaaaccggattctggttatgtaaaccaataatttttcgattccgtcgaaattgttttacctgaaaggggatttggaaaaaccctctcactctcaggctcaagcgccggcgttcactctctaaccaaactcgatttcgtttctgggttgtgagattgagaaatgccgagatcatctttgcggctactagctaagcctctcttggagagcaggcgagggttttgcacgagctctgataagatcgtagcttcggtgcttttcgagagattgcgcgttgtgatacccaaaccggatcctgccgtttacgctttccaggagttcaagtaagctctctcatcgctttgcttgtgttctgttttttctttggttgaggaatggtgagattttgagagaaaatggggggaaaagtatagttgtgtgattcaaagactgcttttttatgttgcggaatgaataagatttgagtcattgagcaccgaaattttgattttactctctggttcattttgattttgatcacgttttggtcttgattttgttgctctatggcagattcaattggcaacagcagtttcgtcgtagatatcccgatgagttcttagacattgctaagaacaggtaaaagtttctgtttttctcaatcttcttttgatatcatcatgtgtccaagcatataatctgctcgaaggtttcttctgcattcaactttgtgtcatccttgttagttattatgacaatagcaaagaatgttagattgggagtttttccgagtagctccgtgagttattgttgctcaattcttcagcagaattaccttgcctgaagtgaactatattagaagtgttacatgctcatagatatatagtgaaggttctgtataggtcagtttcatttttctccaagtgcggtgaagcttctatgaaaatttcatttcgtctttggttaatcttatgatacgtgaatacagagccaagggtgaataccaaatggactatgtacctgctcctagaattacagaggctgacaagaataacgataggaagtaagttgttggcacctcttaaagcttcctggcctgttgtatttctcttcggttgatgattgatagttacttttgggaaaatgctgctattataggtcattatatagagccctagacaaaaagttgtatcttctcatattcggcaagccatttggagctactagtgacaaacctgtttggcacttcccagagaaagtctatgattctgagccaactcttcgcaaggtgtttgtttgatttgatgcctctatttcaacacacaagaccataaaatttcattcatgtgcttattgttaatatgtaaattcggtatttgcagtgcgcggaatctgctttgaagtcagtcgtaggagacctcactcacacatactttgttggaaatgctccaatggctcacatggccatacaacctacagaagaaatgcctgatttgccatcttacaaggcaagaacgaacgttaacggggttttactagtattagtaatttcagaagctcaagatttctaaactgaattttgttgttgtgtagaggttcttcttcaaatgcagtgtagtagcagcatcgaaatacgacataagcaactgcgaggattttgtgtgggtaaccaaagacgagctcttggaattcttccctgagcaagctgaattcttcaacaagatgatcattagctgagccactcacaccacaaaaactcctattttcatcccttcttctccatcaatgtcatctctctggtattagacagtgtgagaaggtcaatgtaataaccaaacaaaaccatgtctctggttgtgacgtgaaggaaatttttgttgacagttgatctgaagtacgtagttgaatgtagttgtggcttctttctcaacctttttttatacatctctccgatagatattatattacgtatcttgataagaaatcacacactcgttgattcgagaacagcttgaaatatatattgagtattgaccgtcgtaattccaagcccactgggcttaaaacgaaatacccaacttgtaacccaaatctctaattttttccggtttaatttctaatttttaaaattaaaaatgttttttgtatagtgttaaaaaaaaggagcatttcaattagccctagcaggttttttgtctatg

SEQ ID NO: 9415 - DNA, 3000 bp, Unknown
  misc_feature (1)..( 3000): cDNA_ID_3041810_gDNA_ID_1972118_Annot_ID_178849 3000 nt of promoter + ATG
ttcctgaatcttctccgataacttcgtcttatatacatcgccacagaaatttcggttcctgttcgtgaattagcggtagggtttcatttgtatctccgcaacgaattttcctattgattggttcgtttggatctgagaggtattgatttcgatcgatctcaaaagggtagttgttcgtttgctcaatcgaacgagattgttattgttttctgctgtggaatagtatctggatctgtcagattaataggctagtttttacgattgagctatcggaaatgatttgatcttcatgtgtggttgatcatcgaagagtgtttcattgagactgttaatgaatattgctgtaagagaggaggaggagaatctgcttttaagcttctcgtcgtactcgtttctgggatttctcaggttctcaagtttggatttcaataagaaatctgcgtccaccgtaaaccctagatttagatgggataaggtgttctttcagataaaaggtgagaactttccgaatttaacttagttgaactgagatgggttcgtcacaaggctccacactctcggctgatgtgatgagccttgtggatacattgcctgtgcttgcaaaaacccttatcgctggaggagctgctggggcaattgctaagactgctgttgcacctttggaaaggatcaaaattctattgcaggtgattctccttggtcttgagcttattatgtttcaatggctctgactatatctaagttgtattcagattgcatctgttatgctgaaaattgggatattgatttggtgtttggtaggattttgaccatctattgatttgatactgtgctttcaataccagactagaacaaacgactttaagacccttggtgtgtcccagtcattaaagaaggtgttacaatttgatggtcctctcggattctataagtaagtatctagtggtttgactcttattttgcagcttagctctaccactttactaaattcttgtgatgtgcataactctcgcagaggaaatggggcgagtgttattcggattattccatatgccgcccttcattacatgacgtatgaagtttatcgtgactggattttggaaaaaaatcttcccttaggttctggtccaattgttgatcttgtggctggttcagctgcaggtggaacagcagttttgtgcacatatccccttgatttagctcgtactaagctagcttaccaggttggtgattttgaataccttgctctgatagaattttattgttgcttacttaactgacaaatgagcaatatctttttgtttctcctcttatgtgttgttatttgcattttaggtttctgacacaagacagagtctccgaggtggtgcgaatggattttaccgtcaacctacttattcaggcataaaagaggtgcttgcaatggcttataaagaagggggaccacgcgggctatatcgtggcataggtaaagctcataaaatttgcttgcattaatgttaaaagtgtatatcaaatcaatgtaggaagtctattcatcttagctataataaacggttggcatcaaagtaatatcaatcctataaagaatttcttagtctaatcttggttgatttagtttagttacaaattatcttaaactcttatctctgtgtgtgcacttttcctaatttggatttgaagatgattaacaaaggttggagctttcctgtgtctctgcagggccaacgctgatcgggatccttccttacgcggggcttaagttctacatatatgaggaattgaaaaggcatgttcctgaagagcatcaaaactctgttcgaatgcatctaccatgtggagctttagctggtttatttggccagaccatcacttacccattggacgttgttaggagacaaatgcaggtaaaaaaacaaacaaaccagaaacaagattcaaactatgcaccatttcagaactcagaacatattgggcgtttcgtgtgaccacaggtagagaatctgcaacctatgacgagtgaaggcaacaacaagcgttacaagaacacatttgatgggcttaacacgattgttcgaactcagggttggaaacagttgtttgctggtttaagcatcaactacattaaggtaaatcagatgaagaaacaatgaatccaatatctcagtctcggtttcacttttttcctctatgattcgtttaattgtctttatttgctagattgttccatcggttgcgattggattcacagtctatgagtcgatgaagtcatggatgcgaattccaccgcgcgagagatcaaagccagcatgagggtctttgttccttcactctcttatagaagacacagaagacagaagaaaacatgattgttagacagatttttttttccctacttcttttcattttcaaggccaatttgcccctaaaaatccttgatagtgataatattcttttgagaaattatgctaaaatttataaatctgtgatcaaatccaagcgaaagataaagttgatatctgttgttgtgcagcaaggatttggaaaatttccaattgacaattaagaaaaagtttcttagaataactcgaacttaaattgtagtattggagatttattaagtttgtaacaactttaatgatggacaatttcacatgcgtatgtgtaattgaaatgtcataaacaaccccacttcgtaacacgacctagggttataatcgtctttttgtgaacaaatccgaccgagagagagagagagatatatttttggcagtaagatcaaattttggcattggtaagttgttgttccttcttctcctcccgcaggattcgactcttcagttccttatttaatcatctcatcttctgggcaagtcctcttgttccttgctaaaatttctgggcttttttccctttgtttttcttcttagatcactctgataatttttcgttttttatttctcagaaattcgaggtttttatagggttgtggtcttagca

SEQ ID NO: 9416 - DNA, 3000 bp, Unknown
  misc_feature (1)..( 3000): cDNA_ID_2105933_gDNA_ID_1972118_Annot_ID_178842 3000 nt of promoter + ATG
tttcttgtagattctgcaacatatcttacttgatattccaagtcttgctttcttcactacatatgcgcttctggttctcttttgggcagagatttactaccaggtaaaccttgattctgtatatattttcaatttagtttttcctgcattgttgttgatatttactctatcttggcaggcacgtgctgtatcgactgatggactgaggccaagtttcttcacaattaatgcagttgtatacgtaattcaggtgaaactaactacctatttggcctttgtaatatctgagaaattttcaaagtttagagttaaccttgaacttggtggacctgtgggcctgagcttcttattgaatttccttacgatccatttgtgttgtgggttccttagctttaatctttcatttgaatgtattaatttcagattgctctttggttggttttgtggtggaagcctgttcaccttatggtaatcatttctaagatgttctttgcaggtatagtttgaagtatagatcattttacacagagattgatttttttaatgcactctatgtctcatctcttgtgaatgtatattgcaggtgtctcattgtttgcggcccttggctttttattatatggaggaaggtaagtatgttgcacttgcatatgctacacgatgatggtagcttagtttaaacgcttgttacctgctgccacatgttttcctgccacaaatgagttgatgatatcatttggaaaactaggattcctgccctccactggttgctagctagacaagatcctttttgtaccatatcaggatttatcatatatcatttctgttatgaaggaagtttctcatgaagtcgccttgatttatcgtctttgatgattatttctttgcaggcttttcctgatgctgcaacgatttccagtagagtctaaagggcggcgcaagaagctacaagaggtgaaccttgaatattaaaccaaagttaccccgatctttaaattccgtttcttggatccttaccccctttatgtgttgtacgaattgcaggttggctacgtgacaaccatatgctttacatgtttcctcatcagatgtatcatggtaaagatatacacatcatactattgataccattagaccatatcttgttgattgaattctctgtgttggtggatctccgaaaccacagctaaccagatctttcatatcatcttctgttaatggtctagatgtgctttgatgcgtttgacgatgcagcagatcttgatgtcttagatcatccaatcctaaacttcatatattacttggtaagctttccattcacctcttcagctaccatatatgtgcatgtgtatatagacacactatgtgaatcttagaatctaaatatgaagcttcttttaaaaatctctaaacaaaaagtgtgttctgtttacttacagttggtggagatattgccatcgtctctggtcctctttatcctaagaaagcttccgccaaaacgcggtatcacacagtaccatcaaatccaatgaacatgttcagagaatcgaaacactgaggtaacctttactggatgatactataacagagaaaaacataagaaacagctgaaaaaggggtcaaaagataaactgtctttctttttttttggttaaaaccggaagttaatattgtgtaggtaccggtaaaccgaggggttcatgtttctttcatagacaaaagtgtaaattgtaaggggtttcagaacaatggattgtgatttctctctaactaattcaatgcggttgattagtataagtctctcttgtttatactgattcaaagtagtttggtgtgagaatgatagaatcatagttactgagatatccagcttctggttctgacttctgagacggaagaacaattggtattttgatgatatattatggacattggcttgttgtcagttcatacgaagtagttttttaagaaatgcaaatagtcatttgttgactggttggtcttttctctaccggtcttttccacttggttaattgaaagttaggtgatatctgcacgtactaatttcggttattattaattaattacaatcggtattttatgatttttcttcattttgtctgccatgagaatttatgtaaacaaaattttgttcaattctaaatgaagtctgcttaatcgttaaagagagaaaactctaaaagagagctgatacaatacaatacatgtctattagatgaattttgttgtaatatgaatttaaattagagacaacagaaaccgtgaatctcgacttaaaattgtgggattgtttgtttggtcacggaattgtaagaaaatacaaatgtggaagacgtcttcctcttttaatttttttgtcgtctatactctacaacactcagagacaccatcggatcatagaaaacaaaattgtcatttatgaagccacgtcatgtagatcccactataaaagtgacgtgatttcttcttcttcttctcttttgtgtgatctttctacggctaatagtcttcacacgtgtaaaataatcagcagatatttattattactcaacatagaagtggttttgaagtcggactgttgtgaaatagaataacaaattcaaaatttgtagttaataattagtggattaaaaaagtctgacgcgtacgcaaatatcatattttaaaaagattaatgacgcgccaagtcgttatctaactcatctaaacggttacagctgtttcttagcctttctgttttctctgcatgaaccctattccaataaaaaaggtgagatttttttgcatattttgccatagaaggacactttgagagtccttctgatgaaaatatggccaaggactcacttcttcctttattcccacttcagggctcgcttttcacctatttaaaccatcattttcctttctccattttgccgtcatcacccaacaacaaaaccctagttttggtttctctggatctgaagaatctccatg

SEQ ID NO: 9417 - DNA, 3000 bp, Unknown
  misc_feature (1)..( 3000): cDNA_ID_3041814_gDNA_ID_1972118_Annot_ID_178848 3000 nt of promoter + ATG
taatagggacattgcaagtcctctagttactaaataatcactctttttatttttcacaatatatagctcaattccaattttatttgctaaaaaataccacatcgataaaaatttgtccaccaaccaaattcataacgtgtttcaaacgaatcattcactcgttctgagaccaatatatataattagctactaaattaaattaaaaactattttttgtttggttaatgtgttatattttgactttctaattatatgttcgtcaactattcctttcaaactaatcgcacaaaataattgttcgttatattcttcagatccgaacttcaacctgtattattataagaataaactatttaagcgcttactaatgatgttcttgtttttcttctcaaacttttaggttatctgtttttataagttaacaatttgacaattgaccaaaatacaaagtcagagcccaacaattaatttattttaatccaaatattctctagctaacatatgatagatctaacatattttaaattacagtctccaaccttgaacagcgacaccgcgtgaaaactctcatgcacgtatattatataaacccctagggtttgtaacattcaacatcaatctcaaataattcatcaacgagaaaagattaattcttactaccaaaagaaagaagataaattactattttgttttacgtacgaaatatataccaagtgagatctacaaatatggagagattttcactaaggtttgtgctaatgatggtgagcatcatcctcacgtcatcgatttgtcaagcacaactttctccaacattctacgatcaatcgtgtcggaatgctctttcgaagatcagatcctccgttagaacggccatcgctcgtgagagaagaatggccgcgtctctaatccgcatgcacttccatgactgttttgttcatgtaagtttttattcttctaaatactaattccacatttttaaaaaaccttacccaatcatttaataatagttttgtgtatgtttaggggtgtgacgcgtcgatattgctcgagggaacatcaacgatagagagtgaacgagatgcattgccaaacttcaaatcagtaagaggttttgaagtcatagataaagccaaatccgaagtcgagaaagtttgtcccggcattgtttcttgcgctgatatcatagcggttgcggcaagagacgcttctgaatacgtatgtttgtgattatatatgaatatacccaatatcctttatatatataaaccatgcatatgtataacaactctccaaccaatacttaggtgggaggtccaaaatgggcagtgaaagtcggaagacgagattcgacagctgcgttcaaggctctagcaaatagtggtgaactcccgggatttaaagatacccttgatcaactctcaggtcttttcagcaagaaaggtcttaacacaagagaccttgttgctctttcaggtaggtccaagaatcatatttgtatatacattaagttttttttttgatgactccttaaatgtgtgaatagctatgctaattgcatcactagtaataacaatgtactagacaaatttataatttctaatttatattctttgtcacgataactattcaggagcacacaccataggacaatctcaatgcttcttgttccgggacaggctttacgagaactcaagcgacatcgacgcaggatttgccagcacacgcaaacgtcgatgcccaaccgtgggaggtgatggtaatctggcagcattggatctagtaacacctaattctttcgacaacaattactacaaaaacttaatgcaaaagaaaggactattagtaaccgatcaagttttgttcgggtccggtgcatcaactgacggcattgtgtcggaatatagcaagaaccggtcaaaattcgcggcagatttcgcaacagccatgatcaagatgggtaatatagaacctctcactggctctaatggagaaatcagaaagatatgcagctttgttaattaatacatgcatgcgataatgcattttatattgtttgttaaatttattcgttgatctctttgttgtaatgttttgtgattcttactaccaaattgtgtattatttgtttttaatatttgaataaatgccaattagttttatgattatatagtcatattttttgataattcaatccaagttacaattgctggttcaatgtggtttgggctaaaccaaccaccgaatctgtatggttttatttttagagttccaccatatattgggtgcaccatgccacatggaattcttacctaaaaaggtatctctgtttcttcaagcctgtgaaaatgcgcgaccaatgagtaaacagagcatgtgaccgaattttcgaatcgagaaaaccatcgtcttccttatttctacgtattttacggcgagcctctagtcgctcatcgtcagccccataaatttcctgaatcttctccgataacttcgtcttatatacatcgccacagaaatttcggttcctgttcgtgaattagcggtagggtttcatttgtatctccgcaacgaattttcctattgattggttcgtttggatctgagaggtattgatttcgatcgatctcaaaagggtagttgttcgtttgctcaatcgaacgagattgttattgttttctgctgtggaatagtatctggatctgtcagattaataggctagtttttacgattgagctatcggaaatgatttgatcttcatgtgtggttgatcatcgaagagtgtttcattgagactgttaatgaatattgctgtaagagaggaggaggagaatctgcttttaagcttctcgtcgtactcgtttctgggatttctcaggttctcaagtttggatttcaataagaaatctgcgtccaccgtaaaccctagatttagatgggataaggtgttctttcagataaaaggtgagaactttccgaatttaacttagttgaactgag

SEQ ID NO: 9418 - DNA, 3000 bp, Unknown
  misc_feature (1)..( 3000): cDNA_ID_2182365_gDNA_ID_1972118_Annot_ID_178847 3000 nt of promoter + ATG
aatcttaatttgtacattatagatattcgttttcaacaaaagagtgtttgttcggggtatttgattatttcgctttctattttcaactcttgcaattacttgacatttgcattaacgaaaaaactgaaataataaagtatccgaatttggtttagattttgttgaagctggcctacgttgaccaaaccataacttaataattaaaaccgttacgcttacgcggaattttgaaaattgacttttgacttttataaaatagtcagaaagaatctttcgtaaggataatgtgatgtaacattgtccataccgtaaccactagccacaagtgcttcttaacttgttcgttgctttcctatttaggtaagcttcttagtttgtttcagtaaataattaaaaaaattaagttccatttacatttacacctttgaatccttttattttttcaattccattccattttcttaaattctcatcaggatctttcagatgaaaacgatatagaacaaatatctaaaatatcattatgttatgattatatcttgatttctgtttgactattgttttacccatctcccaaaaaaatgcatatattaattcaaatgtttactgaatctcgcggacaactaatcaataggctcaaagacgacaacgtcgacaagcaccatttgatttacaaataaagttcgttttgtaagctttgtatcaatatctatatttgatacgagggagtgaattttattctctgcaaaatatatgtatatttctttttttttgttaaagaaaatatatgtatatgtcttacgtactaagagttatcatgaaggtattttaatttcagcccaacttaagtttgaatgtgtggatatatagcaatacaaataattattgacaagtaaaattaacctcagacgacggtaaaaacaaaaaaacaaaaaagataaaaaggaaccaatttgcctgaagttcatgttgatgatatcgtttttttctcagtgcgtagtagtgagttttcttcattttttctaaagaattatataaacgaatatattaatatttcaatttgaccggtaatcttaatcaatatataaacacacgtcatttggtgtgaatttctaatggaggacagcttttagtctaattagatcatgtaagacagttccatacatgcactgatctagtaacatattcgaacatagttgaattgaccttttcatcaaaggaaaatgaaacttactaaacacatatatatactcacccatatgggcagacgacctagtttgaagaagagctagatgaaaatgacacccctaaaataggaaagtaaatatatataatttttttttgacaaaaatgtttgaaaacatatttggtttagtacgtacgaccccgttaagtattatggtttggacttcgaaatctccattatgttatgctttggtcacgatatcaaaaaaaaatattattattataataaatctaggcctgccatcatatggattaatagatattagccaattcatatgcatacatgtatatattatgtaccatgatactttttcttttttggttgatatgctactattatatttttttcgtagttgagcggtgtctacccataaacataactgtttcaaactatttgtaaattgtaatcataaaacttcgaaattctataggcgagatgttagaagattttgttaaatattatagaagaaattctcttagctaatttttcccttttttcgaactgtggaactatttgaatgctcatctagttgtatatatgctaaaagatgggggttttccaatcgttcgaacataaatacataatgaatcaccacgtactaaaatcaactaaggaaacaaatgaaattacaggtatttttgtgcgtaaatcatttaagagatgaatgattcgaatttcgattcttagggaaaaacacaactactaccgtactacgtatgagatgcaaaacactacaaaaaaggttaaacacgactacgcacaataatgactgtccatagcgatatgccgatacatcgaaattcctaacaaatttatcattattataaatcaaactactgacgaatcaaatttgaggagtggattaataaataacttttaatgttatcggtgttagcccgcaaagactggattatgcgattttttttttaaaggaaagaaaagcgacagtacatagctagcttcatatatgatcgccattgaccatgcattgttttctttcatatatatctctaagaattgtcatcgtaatagggacattgcaagtcctctagttactaaataatcactctttttatttttcacaatatatagctcaattccaattttatttgctaaaaaataccacatcgataaaaatttgtccaccaaccaaattcataacgtgtttcaaacgaatcattcactcgttctgagaccaatatatataattagctactaaattaaattaaaaactattttttgtttggttaatgtgttatattttgactttctaattatatgttcgtcaactattcctttcaaactaatcgcacaaaataattgttcgttatattcttcagatccgaacttcaacctgtattattataagaataaactatttaagcgcttactaatgatgttcttgtttttcttctcaaacttttaggttatctgtttttataagttaacaatttgacaattgaccaaaatacaaagtcagagcccaacaattaatttattttaatccaaatattctctagctaacatatgatagatctaacatattttaaattacagtctccaaccttgaacagcgacaccgcgtgaaaactctcatgcacgtatattatataaacccctagggtttgtaacattcaacatcaatctcaaataattcatcaacgagaaaagattaattcttactaccaaaagaaagaagataaattactattttgttttacgtacgaaatatataccaagtgagatctacaaat

SEQ ID NO: 9419 - DNA, 3000 bp, Unknown
  misc_feature (1)..( 3000): cDNA_ID_2182439_gDNA_ID_1972119_Annot_ID_178875 3000 nt of promoter + ATG
atcacacataattctctaaaatcctgaacaaaaaaatgttttcaaacgtcaaaagttgtttattaattcatatagttttttttttcttgtttttgttgtttcatcatctgcaagatttagtacggagattacaaaaagtgaaatcaacagtatctgcacacatacagaagccaataccaatgcttcattgtgctttgagttcctgaactcatcccctgaaattgcatcactggatttctatggccttaccaaatatatacttacttataattctcgaaaaacttcagatatgctgaaacaattccaggcactcgtaagaagcacaacggatcccaacgctaaaggttcctaccatgtatgtgcagaaatgttcgacaaagctactgattgttttgatgacgccttcacaactttggcatccaaggactatatcactttagaacaaagggttgtttgtacgtttgacatgggggatgggtgtaaagaagagctgttaactttcactcctagcccacaactcttcaaagatgtttctattgtcaaaaatctttcttctatggttttggtgattctagattattatctgaaaaaataaataaaagttattttagttttggtatagtgtgttttaattatataattagaatgactatatattaccattggagaatatctatggttttggttatatatttttacagccgttagatcttcaaaccgatcaatctaacggttcttaacaatatccaattctcataagaaaagagtacaaaaataaaaagagtcgctgtcactataccgtaccgtacagagtcaattgaagaaaccgagagagagagtgagcggaatcatgacttctccgggaaaatctccgagatccgaccggaaatcaccgacggttgtcaccgtccagccgtcttctcccagattcccgatcagcacacctactgctggagctcaacgtaagatcgggatcgctgtcgatctaagcgacgagagtgcgtacgcagttcaatgggctgttcagaactatctccgatcaggtgacgccgttgttctccttcatgttcaaccgacgagtgtactttacggcgccgattggggcgctatggatttgtcgccgcagtgggatccaaataacgaagagtcgcagaggaagcttgaggacgatttcgacattgtcactaataagaaagcgagcgacgttgctcagcctttggttgaggcggatattccgtttaagatccatatcgtcaaggatcacgatatgaaggagaggctttgtttggaggtggagaggttagggctaagtactttgattatgggtagtagaggatttggtgctacgaagaggagtagtaaagggagattagggagtgtcagtgattactcagttcaccattgtgcttgtccggtggttgttgttagatttcctgatgataaggatggagaagatgagaaatccggcgacagtggtggggagaatctgatggacagtgataaacttcatacagtgcctgaggtggctgaagaagagggagataaggatgagtaccatgatgcttcggataagcagtagcagcaaggttgactttgaatgcatgtcagtttcaatttacttaggaatattatatacaatcagtaatactctgctcggatcaagctttgacctttagaatgattggatattaggaagatccactaagatgctattttattcctgatgcttgaggtgtgtatgtttgaacatttgcgcatatcattgctttagttgtattcagtaatctcttgatgttaatgaccaataacttacatatgcatctattgatatgctagagatttgctgtttgtgagtacttttttttgtctcagtgatgtctggatatgtcaagttatttcttcaaaagttggatcaatcaatgatgtcttatctgtgatcactgatcttgtgcaggctttcatgttgcagaaggagacctccctaaggagacttagaaagaaaagaaagcgttcctttgcccttggtttgtgttcttgagtgtgcttaattgtgttgtttttggggtttggggtattctagatctcttttgtaagtattctcttgtttcttggttttgttttaaactctatggaatttgggatgagtggattcgatgtcttttgtttgtctttgaaaaagcagtgaaaagaatttcagtggtcttgtatatctctgcagttgaatagttggtacaaaataacatctttgacggttccaaataatatatcttgtcagtaatgaccattaaataaactttaccatgaaatggctatgcttgcatctttcagaaccattacatttgtcttgtcctgtttctgacttttctcttgactgtgtggaagttcataagatcaatggtaccgatgtgtctttgtttgtatctttgggaaaaagactgataatggttccgaagtttcactgtttgtacagtctcaaataagttctattttgtctctctgcagtttagttttccccatagaaagcatctctgatggtttcaaatgtaggcatcattaacattttcaccacattgtccctattctcaagcagcgaactctcttcctatgatcaacgtccactatctattcccaactttgaagagttaagagacatttacctaaggaatcggtaaatccttgtttgcatttgtcgatttcatgagctcctgttgcctgttgttgcgcgacctggtttcaaaacggcttccaagttcgatttcaagtttgcaaaatgtgaagttgtctctgatagtgactccttgcatgcccctatctcacacatgctcgtaaggccccatcacactttccaattatttctgagcggaaaagtcaagtgtggtgcctctgccagtggcaattaaatgtaaccaccaaacattagatgacataaagttatttcaagtcttaggattaaatcaacccttaaagctctacgtttctctcaaagttgctgagaagatg

SEQ ID NO: 9420 - DNA, 3000 bp, Unknown
  misc_feature (1)..( 3000): cDNA_ID_3041880_gDNA_ID_1972119_Annot_ID_178883 3000 nt of promoter + ATG
caaggtcgttaagaagtgtattcctcttctttataatctaagaagactataggtatcaatttatagtaatacttgttatatagaaaattatgtgtttaaagcgtatgcaaacttatttgtataaagtttacaaatacctaatgaaaagaaaagttagcctcattatacaggggattacatggttagcttcatttcttctctacataacccgacttttatcaaccactaaccaaccatattaataatgatctcataaaaatctttaaatcaacttagaaagtgctcaccataggtttgtttttcttaacttaccaaggagccgacaaaattgtctcaaactcaaactccacatcttcaagctctacattgagatcttttgcacatgactccatctgacatatctttttccaggctgcatctttctgttctttttctgcttccttttgttcttttagagcagcttcttgcctctgcagctcgataatcttgtgtttcacctcaagaatcttttgttccatgtcatcaaactcttgtttagccttgctaaattcatttgtcatctccttgtcaaaaccttttagttcctccattatatatagttgtctatctttgagtgctaacagcttgtcgatccgtgataatggagttgtaacattgaagccatgtttctcgagctccgaaaatgaatctttaaggctatttagttggcttacaggaacgtcggcttcaagatctttaaatttctccagtaacccaaaataagtcaccatcatacctattgcatacccttcacggaaatcttgcttagtctcaaacaatgggctgaaatgaagactgtgtgatacacttttgaagacctccagtgattcataagtcttccagaccggtgacttctttgcaaaaggcaaaaccattattgtgtgttttgcatggttttcctcagcattagaagcagaattcttcaccacattgggggtccgatccgaggataacactggacagatgaacgcatacacaacacaatgagaaaataaaggcttatctaccagtaatagtacaatgagaccattgcaagcgggtcctacattccagaatgtgcaatgagagttaagacataccagtcttattgatgtatgaattgagctttagacctcctcttttcctctttcgagtataatatttgatcttaggctcctcaggcatctgtgcatagaagtgttaaaccaaaaggagagccatctcaaagataaataacaatcataaacaataccttctctcgagttgactcatttccaaagccattcttcattggcacaggggatacctttccttgggttttgttctttgttgcagttacccccagggttataggtaaaccagattcttttttctggaaaacaaagaccatagaacaatttcagggcgtagaaaacaaacaaggttataaaagaatccactagcagggttatgaccatataccacatcatcagccatctcatttcccggtggttcctttgtctgcacatttctgttgccgtctaaagaagtttctttctggcgttttggctgaaaatggaaataacataacaacacttcaattaatcctcaaagatgtcacactaattaaaccaaaccaacacaatgttgcctgcaactagtgatacaatttacctttgttcttttatgccaaactccatcttcccactccattggaggcctaatatcagagtgattaaattgcgatgcctcctttgttgccccgaaacttaccatgtaccttccctcaaagacaattcccctgaccacaccttgacgccattcaaaaccactaaacgcctctacatgatccagcaattcatactttccaacagataaaggaggctgcataggccttagtcttagggaatcaacaattaaatttttcgattcccggcagctataggacttattccagtacttgacaagaaacctcttgtccttctccaactccttaatgacaattaccggaatccaagcacaatcaaatctcaattccaccattgtcccgcaactaaaaacagacttgaccaattccttcaaagacaaaaaacaaacatacaacaacggataaagttaacaactttttcatgcaaaggcgaaacgatttcaaaaaaaactcatcataccttattatcaggtcggatccatttgaagccggtccaatcaagatgaaccctcaatttctttttctcaaactgaataatgtctggtgggcaatcgaagtaaaccaaaaacttctcatcctccattgtttttaccaccacaccagtccaccacccatctttgagataagcgtcgaccatcaagccttctacaaaaacgacgccgtcgttcacatcctccgacgggacaggacgaatgaacctctgatcgacgaattccgttaaaggagccaaacggtgttcattgagctgcgtcaagtaacgaactttaagcttattgtgtcctgatttcgttggattatcttccagaatcgctctgtaataagacccttttaactcttcttcttcagaaaaaacttctactttgtcgtcttttctaatgaatatcatctgctccatctcaaaaacccttgaatgaaaactaataacggctcatttttgctctgctaaccctaaatctaaaaaaagacttttctgctgaaacccgaaaaccatagatatgattatatgaaggagactttttgcaaccaaaacacagtgctactgtgtctgtgcttagtgtcgatattcacgatacacatcggggaaagtgtgttttctttttttctttcccaatttacttttctttttttttggcgcttgaaattatgagaaaatgatttaagaaattatcaggcccaaactatctaatgggcctaattaaaaacggtgtcgtttcataggatcctcatcacgaagcaggtaagtaaaaatatatcttatcttctccaaaactctctcttcgatttcagcaattgca

SEQ ID NO: 9421 - DNA, 3000 bp, Unknown
  misc_feature (1)..( 3000): cDNA_ID_2182459_gDNA_ID_1972119_Annot_ID_178882 3000 nt of promoter + ATG
tttccataggttgcaacaacatcgtagccaccaccgtacggcgtgggatcgtattcatcgaattccggctcgttgaagtcaagagcagaggctacagagcaatagatactaaactgaggaggagattcgtaggttgtatagagattcggatcatagaacaagtgtttaggctcagacatggtagaaacagagtaagcaacatatgcagaggttgtctcagactcggatccattccagttataacaattataactcattggatcatcataaccagagtaagcaacatattcagattcagattcagattcattccagttgtaataattataactcattggttcgaaaccaagctgctgctgctgttgattgtaatgataatgattttgatcgtagagattattaacctgattgtaatcgtaaggactctggtaattctcatagaagttggccatttgagagagcttgaaggatgatcttgaaagtctttctctgcggttgatgagagaaaacgattcagctgagcagtgatctgtcgattaaactaatttggaatgtttggttccaagtccgtgagagagtagtgtattatttccatgtgatgtgttgataaggtagggacgactgatgtagatggtgagttggtgacgagtgtgtgaccctacaattgttttgtcttgtctgaaattggtgttgagaaaacgtggggaaaaagcagtggttgacaaagaatcaaaccaaaccaaaaccgaacattacctaaataaacaaatggttcaagttgaatttcatcctaacataacaatagctattgttcaaggtgtgatgatacagtatcatcatttggtactagacgattttacacacgacttcaacaagctaagtgctaaccaaaagatcaaaacttgcaaacactccattatcttattatagtttaagaggaatcagaggctgctggttcttgtcttggtttcctctgttcaggaggtggaggaccgtctctttttctttcgtatctcttactttgatacttagtgttattgcgctgctttggttggtatgttgggtatgtgcacgggataatctctccattgatgtacttgtcgcctaaacccgagaaagaacgattcaattatcagaacatggatactgggagagagagagatcctagaaagtttaaaatcaggctttgatgggttacctccatagtctttgttcttgacatctatgtaggagtcaggcaagacccagagaactccaggcaaacctgtgaaaataatgaaaagacagaacgatcagtatcttgaaggttttcgacgaactttcaataaggggactaaggctcttcttgctcactaactaacccttgaacttctcagatgtttcttcgtcgatggtgcattggaatccagtatatgtcgtggtactgaatgcatacatgttcttcttcgcctcttccatgctggaaaatagacacaagtacatataataagcaaacacgatgaactggttatgctggaaaatggacacaagtacattaattggttatcacatcagcaggatagtgtaaaccggaatcaaagttctctaaaatagagagtagcaccaaataaactaaagttttagtcattagttgtgtaacacaaactcgttccctgccataccaagaaatttctagtcaggagtcccaatctaatgctctgcacaattgtacactccttttacatacattactagcttacactgtccacatcaagtttttaacaaacagaaaccatgcacaatcacctacaatttatacatagcttgaagaaaatatgcaaaaatagatgcttctattcttccccctaatttcattcataattacgctaaagagcacaaagttttagatatcaaatcagacaccaatgttttgtgttcaatatgcagcaatgttcaataagtttgcacatatcaagagacgaaaaacaagtcagctaaagattacacctgatattaagaacaaattctggaactaggtcaacttcagagcaaatttaaagctgaaagctttactcagctcactaaacccttaccctaaagtatcatcaaaaaccctaatctaacaaaaaaccaaatcttcctatacgcaacattggattcaatcaaaggacaagtccattagcaacacaagtaaatgtcgtctattagttaactaattcaacaacgaagagaatcaataagaaagcgaaaacgaacctgccaagaacagtagcaagagtgttaaggtaagtatcaatcatctgatccctacttggcgctggatctttaggaaactccattacaatgagccaatgattgtaatcgcaaccaggaagcataatcgtctctctctgctcattgctattgctccgtttcgacgagtaatccgaatccaccgtcgcagctttcacaatcgccactcgacgccgagacccagcggtggagatgttccggagcagaggagtccatgaatcgccaacgcggataccagagagtgtagagaaacgattcaggtggcttacggggagaagagttttgaggagaagcgaggaagaagaagttgttgtgaaggaagccattgcaattgctgaaatcgaagagagagttttggagaagataagatatatttttacttacctgcttcgtgatgaggatcctatgaaacgacaccgtttttaattaggcccattagatagtttgggcctgataatttcttaaatcattttctcataatttcaagcgccaaaaaaaaagaaaagtaaattgggaaagaaaaaaagaaaacacactttccccgatgtgtatcgtgaatatcgacactaagcacagacacagtagcactgtgttttggttgcaaaaagtctccttcatataatcatatctatggttttcgggtttcagcagaaaagtctttttttagatttagggttagcagagcaaaaatgagccgttattagttttcattcaagggtttttgagatg

SEQ ID NO: 9422 - DNA, 3000 bp, Unknown
  misc_feature (1)..( 3000): cDNA_ID_3041849_gDNA_ID_1972119_Annot_ID_178903 3000 nt of promoter + ATG
gcggcagcaccggagaacagcaatacaagatacgttatatacgtaaagaaaggggtttacaaagaaactattgacataggaaagaaaaagaagaacttaatgcttgttggtgatggcaaagacgcaacgatcataaccggtagtttgaatgtcattgatggatccaccaccttcagatcagccactgttggtaatataacatttttctttcatttgtgtcttttaagttattacattcttgtatccgaagaacttaaaatattgctttgaaaacatgtacagctgccaatggagacgggtttatggcacaagacatatggttccaaaacactgcagggccggcaaagcaccaggctgtggctctacgagtgagtgctgatcaaactgttataaatcgttgtcgcatagatgcgtatcaagacacgctctacactcacacgttgagacaattctaccgcgacagctacatcaccggtaccgtagatttcatcttcggaaactctgctgtggtattccagaactgcgacatcgtggcacgaaatcctggagctgggcaaaagaacatgttaacggctcaaggacgggaggatcagaaccagaacaccgccatttcgatccaaaaatgtaagataacggctagttcggatcttgctcctgtaaaaggatctgtgaaaacgttccttggtcgaccgtggaagttgtactcaagaacagtgatcatgcagtctttcattgacaaccacattgacccggctggttggttcccatgggatggtgagtttgcgctctccacattgtattatggagagtatgcaaataccggtcctggagcggatacgagtaagagagtgaattggaagggatttaaagttattaaagactcaaaagaggccgaacaattcactgtggcgaagcttattcaaggaggattatggttgaaacccactggagttactttccaagagtggctttgattttaatgtctacttgttcttgtactttgtgttgtgttacctctgttttagtttgatgtattttttctggtttgttttgtatgacttacccaataaataacatgctctgtttcgcaagtattaggttaataatgtttaatacaataaatttagtgatgtggcatataatattttgaataactttaatactaattaattgaatttttttaatatataatcatactgccactcatcagttataacaccatcattctacccaaaaaaaaaattataacaccatcaattttttttttttttatgggattattatatgtactagatgacccaaactttgagaatattttcatgaataatataaattttttaagttgattacattatttatcaaaaacagtagttaccaaaaataatagtttcatattaaattttacacgttggtcatataggggatttttgcgtactgcattctgcattgcatgtcaacacagtgtatcagcatgtgatataattttactataagtagagcattcaccagtcgtgaattttcggaatatatattgatgataacgtcggttgttaaatgacacaaaaataatgacgtcggtttgagaaccgtcgttacatcgtccgacgcaaattatattggcttcagttaatcaaatgacggtaagttttacgtcattataatttgcatcggtttaatgagtttagcgacggttttcaattttgacgcaaaagtcaaaagctcatgctttgtatcacttctacaaccgacgcatatccactgtatttattttctatttttttccgttttctattatttctgtatttctcaatacaataaaaattcaaactaaccaaaattcagaaaaaaacagtatattatatataaaatcaattgccgcccaaaaataataatctgttttacaatgaatataactgaacaattatacatatatctagcaaatctatctcttggcatttctaaagtaataatctccattgaagagctacaactttgtgtttgctaaaactttttcacctggaacaaaatgagtgtaatgggagatttaaaaatcaacatatgcatacaaaaatattccagaaagaagagagagataataaggacaacaaattttgagtcacatcatatttgttgtgatgggctccatcccattgataaataccttaatcaaccgattgtcagctgaattcctcatgctaatacctaactatacaatattataattgccatatactagaaaactagcagattacacaacaatatagaaaagacacaaacataagaaagaagcctatgcgacaattactacagatagagtgtatcttttcgggtaaacattgtaacgtagtgaaagttgagagtgaattgcctaacaaccgatagaatgaaccaaaaagaaaaaaaagaacatcttttctaacgcccaaaaaaaaaaacctagagttttttttatttattaggtacatattgtcttttctagtactaaaacaataatggctaagtctcatcctcacacgcaagagattaaggttgagaatatattgtattgttgttagcataaactaaaatggatgaaaccaatttctatcaaatacatattttttttagccatttagagtacattggaaaacaagtatttcaactaaattactctaagacaatttttcttcaatcttttatgagataaaaattttggaccacttttcttttctgttctttgtggataataaaaccaaacttcactgaattatagcttcaattcacattgtactgaatttttagattgatctcaaaataaagttttttttctaaatattatcttttatcgaatacaattaattaaagggtaaattgattaagttgctttgctttgtatataagaccaccatcgctccatcctctttcatcagttaagataatatatattcagtaattaagagagaagaaataaacacaaaaatgttggttaaagttttctcttttttcatccttatgataaca

SEQ ID NO: 9423 - DNA, 3000 bp, Unknown
  misc_feature (1)..( 3000): cDNA_ID_2182510_gDNA_ID_1972119_Annot_ID_178901 3000 nt of promoter + ATG
atgataaaagtagtgttttaatcattgaaaattcaactaaattgagaaaagtgcatctagaatttttattttctttcttactttagtggacatatccctttggaaattgaatactataaaagaatgaccctagtggcccggacaataacaaagttagaaaacaagaaaattataattaatttacacttgtagatcgtatactataatttacactagcagacagtcacaaacgtcgaggacaataaactatcactaaaaactaaaaagtaaataaaattaaggagaaaacaaaaataaaataaaatattctgcatatttttatcaataatagcaaatcacacagtacgagtcaaatggatcagacaagtgatctcaaactcgggaagaaaatttagcaaaaaaaaaaactcgggaagaaaaattgataggagacaaatataactaaaataaaataaagacaaatcaaaattttaaagtattttctttaacatttacaaaaataatcgaagtttaaggattttatagtttctatcatatgtagacgcacaagtgaaagaaaaaaaaaaaaaaaaaaaacgcacaagtggtatcatccattgttcttcgcaatcgaatctccaatattttatttttattgtttcttaattcttaaaaatgggtcgggttccgggccgactccatctactccaaaaccacatgttaaaaccgtgccaccactcagagctattgtagatctcttttaactttttcataacacttgtagaaaaataggaaacgaatctggtttaaaatgttttttttttttggataaatcttctttatatgttatttaaggttaattacaaaataagaataaaacttttcgttgtatttagaaaaactgagtagacatggctatataactagttatcgtcatctgaccattttttttttttggctaattattatgtaacaaataacaatataggaagttcttacttaacgatcaatatggctaaaagataattgaataagctaaagtcgttggttgatctgatgaaatggttatttcctataaattctattgttacgaaaacgttttagaaagaagaaccgtttaaaagttatcaatcaataaagcaattaatcgaaacagttaaagaagacgattagagaaagtgactgaaagcactgcaagatggcaaatctagacaacgttctttatcatattttttttttttggattaaatatgttgaattggtgaaaaaatgcacatgtttttatcagtcatcgttttccgcgcatctctaacattttcttcattggtttttttaacagaaaataaaataaataaagccaattccgtgtactacatataagaccacatcttttaccaagccaccactccaacccattgcatgtctctttaacctttagttaacattcttactatagaaaatttcgaactgattaagtcacagaaagtttcaaaatgattatacttaatcagttttaatttcattttaagttaataatatatatattacgataaggataaggtttaaaaaaaaaaaacagagtaggtatagataaatcagataatgactgataccacttgttatttttcattgtagctatagtcaaacgatatatttttgtgttacttttttgttgtcagttatctttactggctaattattacgatgtaagtaaaaataggtatagccgagttcatacttataagtcaatatttctaaaagatagtttgaaaagatcgatgagctaaattctttagtttaactgtttaataaaaagtcattggttggttgcgttcaatgtaatggttatttctttcgaaatcaatttttggtttattcagaaagcatatgtaacgtatatattttataaaagacattacgtgaatatttttataaaacaaaaagccattattaagatgatattacgttacttatttaattcaaacgtgaaaagtacaaacttttttaccgcgtgtttattgtcaatttttgccacataatttagctatctagcaaatttatatatatatttttttttatcaccatcaccaaatattaatggtggtattttttaataataattgatatacatctttggtggttgtcagagatgaaaaacgccagtgatagaaatctatagttgtcgtcgttagtgtgtcgagcgtcaatggatcggatcagatgtaatgaatttcaaacaactgaataagatagctagcactttatattttagaaaacaaaatagtttaggtgtagactcttttttttatattaaaaattgttttgccactgacttaatagaacaccaatttgtcgtttttcttttttcttatatagacggaatcccgtgaattcgtgaaaacacgtatatttgttctttttaataaatgtggataacttttaacagattgatggggaacatggtctttgttaattcagtatctcgtaaatttggtcatgtagttatcaaaaaaaaaatttggtcatgtgtacgttttattatatgaatagtattgcgatttcaatctgttaacgttatctatcaaatattatatttcaagaatgtaaagtttcacacatacgtcatttggtttacatgattttaatcaaataatttttttaaatttttttttagtaattaaaatttacgataaaaaagaattgtcgtcataatataaataaaaattggatatgctaatttggttatatgagtgcttctctatatttttaattcgagtgctgggcaaaacaagagtcaacatgttcatttaatttgcttttaaaaaaaagacaagcacattgttttacattaatttatagagtatttggtgcaatgataatgaaaaagcatgtgcaaagaaaaggaaatcatagcacttcctcatgtactccactcactagcgttttctataaaatgtcatgatttgcggtagtgaaaggccaacacaaagaatcattttacctctaaagccaaagaccaac

SEQ ID NO: 9424 - DNA, 3000 bp, Unknown
  misc_feature (1)..( 3000): cDNA_ID_3041861_gDNA_ID_1972119_Annot_ID_178898 3000 nt of promoter + ATG
ccatagtcaaaatttccaaaataaaattgattttcttagcaaaaccaaacagtagtaatattaacatgagctctcttaagtaattaaattctagggtgtgaaggaattagatgcttaactttaaacaaagctggaagaaaagaacaaagagagaatcttttcacttttaagaaggtttcttgtgggtcaagtattgcatacaatctttttccaaaccttcacacatagtaaagcaacgattatttggtagagtactctttctcaatggatgcaaagcaacaccataagcattataagtcttcgagcaatcattcctctagttagcacaaattcgtgaatcctaaactgcaattattgaatctttaaactataaacttggctatatgcatgttcaagtattgaaagccaaaacactaactaatcagttccacaatcttgaaaaactaaccttacgtgaagatcactcatccccgccaactcgatggccaatatgggtaaatttcataaccagtcttccaattatccaagtaaacaactttcctcacagcccaaaacgatatagacagagccaaaagcatagccatcctttgctcatcgagtttcttgactcgtacaactacattagtaacaaacgccaaaagcaatccaacaacagtatacaaaaaccctacaaagaaaccttctgctccaagctgcatctctgattcttctataaagaaaacaaacttacttgaatcttcataatctttgatatacattggcatttctctaatgatgttatgcattgtccccgagacgctgaagaagtagacgaaaaccgcgccaactaaccagattctatggtcatggagaagtgtttctccttttagaatcttcttgatgagaatcggagtcgagattatgattatagcaacgatgattccgatttgtgtctttgatatgagtggtggtcgttggattgaacaaacggtgagttttgtttgacgttcgacgaactctgccattgattcggctaatccagtgaaatctccaccgtccatttgatctgattctgttaaattctctgtcgtggggctaacgagggaaatgtgtggtagtgactcgacggcgaagcggcggaaagaagcctcggagtgagttgattcgatctcgcagaagaagagctttgtgccgttagattcattgttgttgttggtgatgaaagtggcggagacgagtctgaattcgcggcggaactctggaagacgtagctggctattgccgtggagatgaacggcgtcgaagaagatgatgagtgagtaaggtctaggagtggatacggaggttatgaatttggaaacgtcgtcgttgttgaaggagatcacgcctgattcggcggttgatcggagggagactagttcgtttttgagatctgaatctgattttggattcgctagggtaaataaaaacacaattaagatgaagaaacgatatgagagattcgtttgaatcaccatttttagatcactctctgattggatttgaagaagaaaggagatagagagatctggaattgccgggaaatactggagaagtgaagaactgttcaaaattctaggtgtttataggtttgattgaaccttcttgatgagttagagggtttagttttaaagaagggaaaaaaaggaaaagaaattgacagctgtgggatttgaacccacgccctttcggaccagagcctaaatctggcgccttagaccactcggccaaactgtcttgttgtatgatatgtgaaacttaaacattctataattaacaataaaattgatgatcacttctggtttctcttattaggaccgacatgccgacaagttgagattcttttacaggaaacatatgagaaaccacttagtaatacaaaaaagagagactcatacatggattagagagtttacataaaactagaccatgcatatttatttcatcgctcgtaaatcatttaaatggtattattaatgtataagaaatcatttttgtcattatcataatcttaatactactctattatagtctaaagtaacaaggtcgagttgcatatacttgtggtattatataaacctcagtctacaatcttagatctgaaacattcatatccatacaaaaaatagtaattatgtaaaaatgtaagaataccggattatgcaagagacaatccaataaactaatctttgtcaacctaataatttagtaactccaggtgtattatttccctgctttcttattcataacgtgcttgtttcacgtgccttgtcttgggctaacaaaatatgagagaggcaaggcaaactctttcttttgttgaacaaaatattatgttccgaagcatgttcgcctatattatttgggttttgttagacatattcccatatcagatttactaagtgaagattaaccaaagaattaaagtacagagttaaataatgtttttggttttgcttttacatgaacatttctatggatcccacttccacttggtggcagcctggagatccaattctccatgttctgctgttgttttctatatttcctatagtacccttgctagctcatcaatatggttcaaatgacctatctcagcaacttaatgaataaaccggtcggcttttaattagctaaaccgtgtgtattataaccaaacagtttacacttgattaacataaaaatcattgagttttactgttagttttctttaattaaactttttcatttaccctttttgctttcttttacaaattatcgtaaacatcattattacatgaaaatcttagaaaaaaaaccgtatcaaaagtctaaacgcaatagcatattaaaagaattattaatggtcaaaacagtcatttccccggtctttataataaaagcaagaaagctctatactcttctcactcacggaacaagtgtagattgcattacctctctctctctctctcttcgaaatattcgaagtagagacaaccaatg

SEQ ID NO: 9425 - DNA, 3000 bp, Unknown
  misc_feature (1)..( 3000): cDNA_ID_2182487_gDNA_ID_1972119_Annot_ID_178890 3000 nt of promoter + ATG
cccggtcgttgttcagagagatttgatgttgttggctctgacatctgcggtttcggagttcttgcttgtcaaaaatgtcatgagagagtcagagatcttgacgcgtttgaagcacattacctctctaaccactctggtaagacttgaattagatgaactttttcattgacttttagccaatgttgtgaggagaatttgatttgttttttcttttttgcagtcgttagactcttagcaggagatttctcaagaacaactgtggaactaatctgcaacacaggctattctcacaagctaggcaaaatgaaagggaacaacatttcagcgatctttaaaatccagaacttgcagagagttgttgcagactttgaagattacagagagctcgtgaaaataagagcaaacaagctttcaaagaagcactctcgttgtatggctgatggcaacgagtttcttgggttccacggtacaactctttcttgcactctcggtttcagtaacagctcttcaaacctctgtttctcggatcactgtgaagtttgtcatattctaagacatggtttcagtcctaaaacaagaccagatgggataaaaggagttctcacagcatcaactagctctacagctcttgaatctatcgaaaccgatcaaggaagaaatagaggttcattgatagctgttgtgctatgtagagtgattgcagggagggttcataaacctatgcagacgtttgaaaattctttagggttttctgagtttgattcactagctttgaaagttggacaaaattcaagaattgaagagctttacctgttgagtacaaaagctttgttaccttgctttgtgataatcttcaagccatgaaacaagcccgtatatgcaaaatttattctttaggtttttgtatagttttctcatcttcttttttcttgcaaaatttggtgggcctgtaataggttaaaaatgttgggctttccccaaaattgaaagatggaaaacttgctggacaagtctatgcccagcctctatatttaaagggtgaagaagactgtaactgttagtgctaccattttcttcaattagggtttctttgactagctcttcgctaagaacactcatgtctcctctgcttctgagccggccttcagtgttctccctccggaaacctctgtttgtaagatactattctcttctctccccaatcacactttgttctttttttttttttttgatgatgttttgctgatgtgagatcactacaattatactcagagacgccctagtgttgggtgcttgtcatctcgacgctgaaccttgcggattgggtatgggaaaactcatgattgcaattagtagtgataattcgatgtgggttttggagaagaaggcccctgtggagttggtggaaggaggaaagggaattgtaggagcatcccatgggtgggtagctactttgaaagacggagtagtgtgtctccaagatgatctaaacccaagcacatcgaattcagacccgaaacgcatctcattgcctagtctagtaactctacctcattgccaaacccaagttgtcaccaacatggccatgtcttgctcatctcctgaggaaaatgactgtgttgtggctataagtcttaggaccacaactcagcttatgttgacccgctcaaagtaaccctgagtggatcaacatcgagattcagaactcaagcttcttctcttcccctgtcatgttttccaagagagttgagatgttctgcataccttcttctggaggtcacgttactggatcgtgggatctccacaaacacaagttgcagagggtgcgatttcgaaaccttgctaagttgacaaagaaggaatggaagcttttggattcgtgtagcaggagcgaacatttggtggagtcagcagaaaatgaaactttcttggttaagtggtacaggaagaaaagcaaagatttgaagagaatgatgacaacaaaggctgtaatggtgttcaagcttgacaaagaaggaaatgctaaaaaaaaaaaaaaaaaaaaaaaaaaaaaaaaaagaaggaaatgctgtttacactcgagacattggagatctctgcattttcctctcaaaatctgaatctttctgtgtctctgcaactagtagctacaaatccgttccttccctagtccgtaaccacgtctatgtccaggcttacgacgagtatggattcatggatatcgccaagccttttgacgattcctgggtcattcctgcctcacctgatgcgaacccgaatcctttctatattccacctcaaactatagaatatactttatctacgatgcacccggatctatgaattttttactttgtcgtctcccgttactagttttcgtacccgtttcaatgctacttagtcaggtagttctagtagcaatatatgtattattgttccaattaataaattcaactcgcttaaaaactaaaactcaactaaacatttttctataatacttttgtctaatcctagcaatacacactccatttactaatatatacattacctataaactgtgttgtatactaataccccatattcaccagaagacttatagagcatttcagtttggttccgtgtataccacatcatcagccgaatcaacaagtgtaaaaatccacgtgtgcatcagactgccacgtaatcaatcgtaaatagttgatttcaatagggatagtttcgtattttaattctttttaaggggcaaaaaaaacatttttccgtccattgaggaagcaaaggttttcgatattaataaaatccgagagagagagagaggaagaaggagagaatctgaagaagctgaaccagacgaaccataaaccgaggcgagagaggagagagcgagggaggtgatctcttaccacctcttcgtctccggcggcgagaaattcagtttcaatcggagaagagaggaaaaacaaagcgatacgcgagagaaaaagttgtgcaacgatg

SEQ ID NO: 9426 - DNA, 3000 bp, Unknown
  misc_feature (1)..( 3000): cDNA_ID_2182483_gDNA_ID_1972119_Annot_ID_178889 3000 nt of promoter + ATG
tatatgaaaaatggaggaagccatgccatgaaagaacgtcgatgcattcaaaatgagatttgaaattcctaattaaagttaagaccagttgtattagtgttatgcagagtagtatattattctacttggattaattcacagtaaagaagagatatacataattcaaaggcttattgttatttcaaagcaaaacatgaagaggtcacccagttaagaagagatacataataaattcagaggcttataacatgaaaaggtattcgacaatagatgaaatgaaaagagaagacaaagagtacataagaaagcgcgcacacacagacacagacacagaccaaattaatagttaatcattcacttgggagggcgagtagcgtgaactatcccgttttcctttaacagcttagtctccaacttcacgagagacacgaaagcaggccaattctcggtacgattgtgcatttggtcgcagtttgggtctactttcttcaagtaggagtgagcagcagctatgccgatagtgttaccaatgatatccacaaagagtgcaacctcagaggtagagaaactcatctcctttctatgcatccacataaagatctaacaacaaccaaaaaaacaaactttcataaatcctaacacaatgatctctaactagaaaagaaatagagcgatgaatacaaaagttagatagatgagaaagatacctggagagcatctacatgtttgccttccatgtaagctgctttgccgagctgacgagatccgcctgggtgacgggaacacccttcttctcttcctccgcgatgatgaattctaaggtctctcgggtaagagacctcagcttcttgaaaataccactctttgcattctcagcatcacaagaggaagcagaagaagaagctccgttgatctgcctgttccctttgttctcagcagaagaagaaaacggagccgttctcgcgatcttaatctcagcagaagaagaagaaaacggagccattgttctcgtaagcgtagagatcttcatctctcttttccatagatgaagagaacctgatgataccattcggcgcaaggccaacattttccaaaccctaattttgataaccctaattctctaatatataaaacaatcaagttgccttgttaaaatcaggatatgatctctcttatattagtaggttacttacacaattacctacatctttgtcgatttgtcagtttgacttatgaatcagtctactagattgtaaaaataaataaaacgatgaaatgtctataatacccctaactctacacacgtgtgaactttttgaatagtactggacccgggtcaaccacacacagtagacacgagccttcttcttcttctctaagcgagtgaagtaagcttaccagtggcagtgagtgagctcttaccagtgtttagggtcttctgcaattttccttgttttgatcgggagcttgatcaagactactgatgctgagatttacgaaaattgccaacggtctctatgttcccggtgacagtgaagctctttacgcttccaagtttcaagactccactgctactttgacttcgcctatctcgctggtacaaggtctgtggaggttacagtatgggtgataaccttttccttctgcgaggaaagcattgtctcggcttttacttttgttcataacttgtggatattggatagtaaagcctaccactaatggcataacattcaggatgcttcttggtgtgctatgatttgttataagcgaatcactctcgttggctaaacactttgagaaaatgactcttaaaatgctctcttgggctatactggaaacttgctgtgttcagtggatcttcaggtccttgttgacaaccattaacaagcttaaggtaagaataaagaaaccaacaatactttcagtcctttgatgatttataattccataacagactaagggcagtgcatatagatatctttcgtactcatctgctttttctggtctccatcacaaaagccaactaggtaatcatatcaatctctctttaccgtttactcgaccttttccaatcaggtgcttctggtgtgtctactactatcagttttaggtctttgtatacctgatcttatctgctactgaggcttgtaaaagtgattaaaactgtgacatttactctaagagaagtaacctgtttgatgcatttccctaatataccggtgtggaaaagtgtaggtatctgtactcagctgaaatggtggacgattttgaagaagatgaactctcattgactgaaagcgggttgaagagtgaagatggcgttattatcgagatgaatgtctcctggatgcttttattatcatgtttgggaatttaccaagggagaggtatcagaatctatcttagaaggttacatttagctcaagcttgcatcaacatctttacttagagctctacgggttttagtgtgtttgaagtttcttaactcctagtataattagaatcttctgcagcagactttagagttttgggatgtagagctaaccagagtcggtttgtttaaactagaatctttttatgtagcagacttgttcagtacctgaataccagttttaaattaccgtcagatgttgatcttgttggtaataatggagaaacggaagaataattagacgaaacaaactctttaagaacgtatctttcagttttccatcacaaattttcttacaagctacaaaaatcgaactatatataactgaaccgaatttaaaccggagggagggtttgactttggtcaatcacatttccaatgataccgtcgtttggtttggggaagcctcgtcgtacaaatacgacgtcgtttaaggaaagccctccttaaccccagttataagctcaaagttgtacttgacctttttaaagaagcacgaaacgaaaaaccctaaaattcccaagcagagaaagagagacagagcaagtacagatttcaactagctcaag

SEQ ID NO: 9427 - DNA, 3000 bp, Unknown
  misc_feature (1)..( 3000): cDNA_ID_3041888_gDNA_ID_1972119_Annot_ID_178877 3000 nt of promoter + ATG
aatgaactctgttgtgtgttgttagggttgagatgatgacattgttgaggcaataactggaggcgaatgcagctcgagaaaagcttttccttcggaatagccgcctatacatagagtgtctcctcgaccatgccagataccatcatgaacattgttcatctccagagttttagattcctgcatcacatcacatcacaagcaaaatgaaccaaaaggacataacggatgtaacttgtttgcaagagaatgatctgtgaataacacacacctgagttaatgtacagaatggacatacgagatggtggataaaatcgtccaagaaactatcagtaccctatcaaaagtaagagtatccaaaagtcatgatgcagaaaagaagacaaataacattcttaacacactccatagaaaagaaacaaaaaaacaaggaatgtgcttactctaatattaaacttccttcttatcaacatacggaagaaacccaagtaggatccaatcaaaagaacgaaagcaatagccagatagagaaagcagtgcctcttagttacagcaaaagcaacaacattgaataagaaaccggcaataagaatcatatgaacagcaccctgacacatacaaaatacagttaaagtcagtatctttcaatgattgcaacacaagaacgaaggtaaacaaaaggccagagatcaactgtattaagaggatattatacctgaagaaagcaagaaccaaaaccagtccttgtcatgtttttcccgaatctgtagcatggacagctgaaacaagataaacaaaaaaaagtctcttgctttataatcacatatagaactcaattgctctaattacagtaaattatatgaatttcaatttctggagaacaaaaaaaaaatgcttttggaattaaagaatgatatgagaagagaaaacccaataccaagcagattcgatacagagatgacgatcttcaaagcaatccataacatcgccttcccaaagccgtaaaacgccaccgccataatcatcctccgtcgcatcttctccctccgagctctcaagcttcctccatttcccctgagtctgaagcgcaaccgttgagcaaagcaaatcgaaatccaacacagaaattccttcaagttccgttaacctctccctctcctccaccgctcctccgccttcatcggctctaatgtcggcgattacgacggctcctcctcctcctccaccctcgagtttatccaaatccgccattgatgagagatttaattagggcttttctctttgatgatatcttctcccaaaggactttgtaccttttttggtgaacgccttttgatactcttttatttatttatttgttttcttaaagttgttgttttttttaaagcgttagtgatttggcgggtaattaattattcataaacacagctaaaaactgtcattattaacggtacagctgttgccacgtaagatattcgtctagtggaaagagtgattgatgtttattcttatccaatatgctcaattataaatacgtatcaattcttatatttagattttataattttctgaaaaagcaagttttattttttaattgtcacatgtaaatatggtaagaggtgtgaatcaaaaataccgaattaataacgtttctaaagacagataatttggctaatttaaggctccagactacgtatattgtttgtttaaattgcaactttagtttataggtaagtttttaatttagcaattactatgagtttatagtcgcatctacctccattaatactgtgttttccgttttaagatagtttgttaaatttggtaacaagatactgagatggagttgaatagctccctaatctctccttctgcgttccatagtctagcttcttcttcgagtgctctgtggcatatagctttcactttacaaaatcagagtagctttggaattagggatttttaactcaatttcaatcgatagaaaaccctaaaagtcaggaaatatttttgaatgaattatcaagtgtttccggtactatttaattaagtgagatttactcccacctctatagccgttagatcttaagcccatccatctaaccacacacaaaaagaggactatagtgtaagtgcataataaatatggacaagaatatttataattctctgattggataagaaatacgatttgattggcaacatatgttagagatagaggtatcaaaaaaattgagaaccaagtttatttttacataattcattgaaaatgttggttacctttttgtaaaaagctccataacatcatctacattgttcttttgtcaattataacttttgtttgtttcttatttatgcaattaactacattgttgacttataatttatgtttatttatgcaatttattatttatatatatatgttgatcctggcactgcagtgagcgtgactatatatagatcagtggtccacctaacctcaggtcaatgaataatgaatttcattagtcatttatacatttgaccaaaaaagaaaaagtcatttatacgtacatttcttattctaacatcatacaaagccataaaatgctgagaacatgtacttcaatatacttacatatatgttaagtgtaacaacacaaacatttggtttcgtgtctggtttaatatttattgttaattaatattgtattatctatatgcgttcacactcatatgaggaaattttgtcgtcatggaccattcaatcatgacaattataggatggacaattataggatgtattccttattcgtgcatgcatgcagagatatatagacgttccactagcgtttaaacttggtatatataatctgtataaactatatgtatgagaagtaattataagactcaaaagtcataacaaaattaagttctactctgcaacatctcattctctcttcttcagttacacttcctcggctgatttttattttcgagagatagagaattagagacctaatg

SEQ ID NO: 9428 - DNA, 3000 bp, Unknown
  misc_feature (1)..( 3000): cDNA_ID_2182451_gDNA_ID_1972119_Annot_ID_178879 3000 nt of promoter + ATG
ccaccttcatcgggtgatgttactacatgtatgcagatggaagtgaatgattgatcaagtgatgtttgctacaacggctttacaattatatcatcagtttggaatcatattctttagattaggaccaaacgcaaacacaatgtgaaatcaattcccatgaagattcaggcattgcgccaagttcattaatcagatctgacaaaacctaacaagtaacaacagccttcttttcattgatacaaatttggattggttccagaaatttcatgagagaaactgcagcctgcctaaaagttagacaattcatgttgatgctgcagcaagttaagccgccttatcctccagagccttgagttcttgcctccattcttccaacttagagaatttctctaactgctctgggtttaggtctcgggaagcagtcttctgctgttgagcttctgtgagtcggatctgcaaatgttaacagaatgaagcaattacacaaccgctagactgcagatttctgctatacctcaaacacaattttgctgtaaactgaagaaaattgattgaaaaccatttggaacatacgctgttacggcttaccagccacaattaggaatctagacggtggagattatatcttcaaagccaaaggttctcgaatgtcttattttaattaaagcaactgagaaagatggaaatcttactttcttcttaagtgcgcggattcttttctctacgtcttctcctgtggttcctggattaggtgctcccccacatacatcattatttgacgaaacgtccaaagcctccatttcagaagccaatacattcaccgattgggatccattactagctgatccatcctcagagctgttagctttttctgcagtagcctgcagaggtgataattagaaagcatgttccattaaccgaagaccaagctagtagcatatgaattgagttgaaacacatacctgtaatcgcttctcttttttacgttcgttcctcttagcagctttagtctttggtttaggagctggatcaggttcataacctggaggcccttgtgaggccatctccttcttcatctattacaaatgaaatacaaattagaaaaaagatatgttctatctacatttttgcccttattcaaaccaagatagaagagcaaaaatttggtaacaatttctgttgagcactcgaacaaagaacataagggtggtacaaataatgaaagcaggctatccacaaccagtactgactactgagaaaaatcaaatttaaacgattcatttccacgagaaacaatgagtccaagaacagaatagagtgttgagggaataaggattccataccagagaacctttggactgatatttgacaacttcatcttctggagtatatccaggtcgaatccgaatgggtttccggagagtaccatcaggtctacgtgtgggctccagaatcctctcaccttctttaagatttttgctcagttccgccattcgctttccttgttctccgcttctgcttcccatctgagtccttcaacttttcaatcacccttgtcacttctcttgttcctcagctatcaagtatactgttttctgtatcaaatttacagggttcattaaacaattcatggagttaaacatttagacaggaaaaggaatctagttttggtttaacggtgagttacaacagtttgttagaagaagctaaatgcacaacagtgtagttcacacattataaagctttctaaactctgaaacatgtaagctcgtgtatcaagaatgagtatacaagttatagcagatattcaaaagatcacacaactcagtagcaaacatctgatcaacaattcaaattcaacttaaaaattgtttagtgagctgtaagcattagcaaccacaaaagaaattcgccatatcaaacaccacttcctataaccacacaacaatcagttatttcaaaaccatgcaatacaaagtcccagctcatttttctgttttcttatcatcaaagtataaacctttggtgatagaattcctttggctgcatttaataacctcacaagcaaaatcttcattacagatcctaaaaccaaacataaccaaaaagacaaactttccagattccagtttcaatcaaccttaaagctcaattcaatttcctctaatttcgtctcgttgctgttaacaaaaaccgagaacacaccaaatttagttaacctattttttttgccggcggccagagctccctacacctcggccaatcatacagagatatgagagagaggaaagagaagaaaaaaaaagaaagctgacctacggagatggtggctattctccgtcgccggagagcccaaatccggtgaaacgaaaccggtaaatattggatggaaaagatgtttttatgtcgaccgtgacctgacaccctaaggaatgggatcgagacagcttaatgtggtttaactatgttttgtgtattctgtttcttcttctttctaaagtataaaattaaaaagatatgtggaccaatcaaaatcaaaattagacaagttaataaatacttagggagacaaaataaaaaactttggaatgaacattttaattttgacgacaagctgtcttttagaccgacattaaggctttttatgttcacatcattccttggtttgacaatgtcacacgtcgactaaatcaagcgttaagcccacgagatatcaatttcctttttttgggcctgtctctctctccgaacgaaatcactgacctgacctgatctctctctctcttcctccgtctcttctccgtatcggctttaggtcttctccgggaagaaagcttcgaacccaattaacgccggacggtagactgtgaccgactagtccccaaaagctcaagtcaatgagaaaatgctcctcaattttaacgttttagagatccatacccaacaagccctgttttcgcatattctttccgttggtttctcaccatcttcgtcgctatg

SEQ ID NO: 9429 - DNA, 3000 bp, Unknown
  misc_feature (1)..( 3000): cDNA_ID_1034523_gDNA_ID_1972119_Annot_ID_178880 3000 nt of promoter + ATG
cccgatgtgagccaatctagtcttaatccattcatgtccttccattccatcaacataacgtgccacactttctccatgctcatatgtctccaccaaaacagcaggatgtacaagaggatacacaggtttagggaaagagacatccttccatctacggaagttatatatgaaccgactcaaatgtgaagcttccctcgcgagatcaacttgagacaacatgaagacaccaaactgttgcacactctcgtccaatctcaaccatttcaaagctggaattaaagtcgatatctttgccaccaaattaattatcacaaaatctctcctaatcgattcaccaacacccggatgtctaactttaaccgcaaccagcgaagacttggacttttgtcctggatactgaaaccttaaagaagctctatgtacttgggcaatactcccagatgccactggcacctcatcaaactcctcaaatatctcagaaagtttacgaccaaatgccttctcgatagttttcttagtgtaggcgaagctatgctcaggagcattactgtgaagctttgagagctgtgaacacaaatccttggggaatagatcaggtcgcgtggctgcccattgaccccatttgataaaagcaggacctgctctttccagagttcgatggaccatctcaagccatattttcctaaaacgaggcccacatgattccacaaccagccccatcagaatagtaggagtaaacaaacaagctatataaaaagccctcccaatcaagataaaaccctctataaccgaaaacaataacgaagacagaaagataggaccattcttagcccttgtatagagagatttatctgaagcatagtgatttatccccgaaccaggagctctttgtgcccatgctacttgtccacaagtgacagcaacgatcccaggtattaacaagtgcgaacgggtaagagacaagctaaacgcctgagcaatggtactaatacgctcagaatacttataatgaagccttctccaagcaatttgggcatgatgactaactacatttcttgcaggggcagtagtataacttcgagacagatgattacttaaaaaacttcctttgagatctctaaaggcaaaagtacaatacacattactcggaatcctaccagatgaagagtaagttctgagctgaggcgaccttagagcagctgtaaaagcagttctatagcttccccattgagacactctatctttctggttcgagacaagagattgtgtttgctttccaacgattttagagatcaaaactctgcaataacaacaacaaatcaatgatgagaaagtaagcaataagcagctaagagagtatacagaaggatccgatcaacattaagacgtatgaaccattgaaactcgtaaatgtcgaaactttacagataaaatgagtctccgaggaaatgggaaacaaaaatccgatcagaaatcatgaaagacccacgaaagtggttaagcccgtttgattaaacaaaccttgacatagcgacgaagatggtgagaaaccaacggaaagaatatgcgaaaacagggcttgttgggtatggatctctaaaacgttaaaattgaggagcattttctcattgacttgagcttttggggactagtcggtcacagtctaccgtccggcgttaattgggttcgaagctttcttcccggagaagacctaaagccgatacggagaagagacggaggaagagagagagagatcaggtcaggtcagtgatttcgttcggagagagagacaggcccaaaaaaaggaaattgatatctcgtgggcttaacgcttgatttagtcgacgtgtgacattgtcaaaccaaggaatgatgtgaacataaaaagccttaatgtcggtctaaaagacagcttgtcgtcaaaattaaaatgttcattccaaagttttttattttgtctccctaagtatttattaacttgtctaattttgattttgattggtccacatatctttttaattttatactttagaaagaagaagaaacagaatacacaaaacatagttaaaccacattaagctgtctcgatcccattccttagggtgtcaggtcacggtcgacataaaaacatcttttccatccaatatttaccggtttcgtttcaccggatttgggctctccggcgacggagaatagccaccatctccgtaggtcagctttctttttttttcttctctttcctctctctcatatctctgtatgattggccgaggtgtagggagctctggccgccggcaaaaaaaataggttaactaaatttggtgtgttctcggtttttgttaacagcaacgagacgaaattagaggaaattgaattgagctttaaggttgattgaaactggaatctggaaagtttgtctttttggttatgtttggttttaggatctgtaatgaagattttgcttgtgaggttattaaatgcagccaaaggaattctatcaccaaaggtttatactttgatgataagaaaacagaaaaatgagctgggactttgtattgcatggttttgaaataactgattgttgtgtggttataggaagtggtgtttgatatggcgaatttcttttgtggttgctaatgcttacagctcactaaacaatttttaagttgaatttgaattgttgatcagatgtttgctactgagttgtgtgatcttttgaatatctgctataacttgtatactcattcttgatacacgagcttacatgtttcagagtttagaaagctttataatgtgtgaactacactgttgtgcatttagcttcttctaacaaactgttgtaactcaccgttaaaccaaaactagattccttttcctgtctaaatgtttaactccatgaattgtttaatgaaccctgtaaatttgatacagaaaacagtatacttgatagctgaggaacaagagaagtgacaagggtgattgaaaagttgaaggactcag

SEQ ID NO: 9430 - DNA, 3000 bp, Unknown
  misc_feature (1)..( 3000): cDNA_ID_3041884_gDNA_ID_1972119_Annot_ID_178881 3000 nt of promoter + ATG
tatactttgatgataagaaaacagaaaaatgagctgggactttgtattgcatggttttgaaataactgattgttgtgtggttataggaagtggtgtttgatatggcgaatttcttttgtggttgctaatgcttacagctcactaaacaatttttaagttgaatttgaattgttgatcagatgtttgctactgagttgtgtgatcttttgaatatctgctataacttgtatactcattcttgatacacgagcttacatgtttcagagtttagaaagctttataatgtgtgaactacactgttgtgcatttagcttcttctaacaaactgttgtaactcaccgttaaaccaaaactagattccttttcctgtctaaatgtttaactccatgaattgtttaatgaaccctgtaaatttgatacagaaaacagtatacttgatagctgaggaacaagagaagtgacaagggtgattgaaaagttgaaggactcagatgggaagcagaagcggagaacaaggaaagcgaatggcggaactgagcaaaaatcttaaagaaggtgagaggattctggagcccacacgtagacctgatggtactctccggaaacccattcggattcgacctggatatactccagaagatgaagttgtcaaatatcagtccaaaggttctctggtatggaatccttattccctcaacactctattctgttcttggactcattgtttctcgtggaaatgaatcgtttaaatttgatttttctcagtagtcagtactggttgtggatagcctgctttcattatttgtaccacccttatgttctttgttcgagtgctcaacagaaattgttaccaaatttttgctcttctatcttggtttgaataagggcaaaaatgtagatagaacatatcttttttctaatttgtatttcatttgtaatagatgaagaaggagatggcctcacaagggcctccaggttatgaacctgatccagctcctaaaccaaagactaaagctgctaagaggaacgaacgtaaaaaagagaagcgattacaggtatgtgtttcaactcaattcatatgctactagcttggtcttcggttaatggaacatgctttctaattatcacctctgcaggctactgcagaaaaagctaacagctctgaggatggatcagctagtaatggatcccaatcggtgaatgtattggcttctgaaatggaggctttggacgtttcgtcaaataatgatgtatgtgggggagcacctaatccaggaaccacaggagaagacgtagagaaaagaatccgcgcacttaagaagaaagtaagatttccatctttctcagttgctttaattaaaataagacattcgagaacctttggctttgaagatataatctccaccgtctagattcctaattgtggctggtaagccgtaacagcgtatgttccaaatggttttcaatcaattttcttcagtttacagcaaaattgtgtttgaggtatagcagaaatctgcagtctagcggttgtgtaattgcttcattctgttaacatttgcagatccgactcacagaagctcaacagcagaagactgcttcccgagacctaaacccagagcagttagagaaattctctaagttggaagaatggaggcaagaactcaaggctctggaggataaggcggcttaacttgctgcagcatcaacatgaattgtctaacttttaggcaggctgcagtttctctcatgaaatttctggaaccaatccaaatttgtatcaatgaaaagaaggctgttgttacttgttaggttttgtcagatctgattaatgaacttggcgcaatgcctgaatcttcatgggaattgatttcacattgtgtttgcgtttggtcctaatctaaagaatatgattccaaactgatgatataattgtaaagccgttgtagcaaacatcacttgatcaatcattcacttccatctgcatacatgtagtaacatcacccgatgaaggtggagtgcatgctgaaacggtgtagagttcgatcctaaagcttttgtgagttcatgaagatgtctacgtatttgtagacccaacgacataggtacatatacatacacatgtagtcatatctatgattctgcttacatatattatgtaactcttttctgtcttatgctctaagagaacatctctaccattaaagtacatgtcaatacagaccttaaaatgttaaccatttgtatgcttcctgtttcagatttatttaataaacatgcttcatctggaaagaggaagcccatggtgttatgcttaattatggataccgtttctcattttgctaattggaagttgcatttactgactttaatcagtcattgtcaactttatattcacctgatatgatatgcaagtgtctctagctcgaatagttaatatatatctaggagtagtggttaaaatgtctcatagagtcaattattataaatctttctgcattatgcttatggagcttgcttttactgagtccttatcaacttaatcttcactggggtggtaactgtttcacggtccaatagttggtcttaaagtgactattgtttctaagtttcagttctctgtaaatttgtgtataaaataggtctttatattacataatttgcttgtcattttgtatataagtacttatttattattgtaggcaaattgtggtggcgtggaccatttcctgcagtgaaagaggcaatgattgaatggacaaggaagaaaggtttcacagtgttggtaaccttattagttcgtgtcatgttctaagtcacatgaatcagttttttcttacaacttttgaaagttcaacctttgagaaaaatccggaacaggttgtgactgatttcgatgtcagcagttaatgttgttagttgaggtaagccccacttggcttttaacaagaaacatcatttatattgtttcatcaaactatgatcagaaataatcagaga

SEQ ID NO: 9431 - DNA, 3000 bp, Unknown
  misc_feature (1)..( 3000): cDNA_ID_1379075_gDNA_ID_1972119_Annot_ID_178878 3000 nt of promoter + ATG
tgcatgaatcatgatgacaaactgatggaaacaaataatcagctggaaggaaatgatgaggcaaacgactcagggttcagatctagctaccaaaatcacatgtcaatacacatgatcatctaagtaaattttcacaagtgtcttttcaaacagttgaatgagtatgcaaaagatgatgagataacatgtaaagttattgtggtagctgaattagttccagtttatgattagacacatcatcagaaacattattgataaagaggaaaatgacttaccaagtgttgcggagtcgaaagtcttgatgccatcaacgccgttcaaatcgccgctgaggaccgtcaagtctctgccgtcgccaacgagggttaagttagttttcttcttcccgatacgaataacttccttgtataacccttctttgatgtagatgacaaaaggcttcacaccattctctggagctgctgcaaccgcttcattcaccgtggtgaagttgccgctgccatccttggcgacaatcaagtcggctttatccttcaatgcctgcaaattatgtttaagagaaaaaaaaatgaaatagttaataaaacatatgaaagtcaacaataaacatatgaaacatatgaaagtcaacaataaacaacaattcaaagataaaaaaaaaaaaagaacgaatcggagttttaggcttcagatatttgaggtattatctcaaaagacaaatatataataaaacaggaaaattaggtttttacagtgaaacaaactctgtaagaacatggttcgtcggaagtgacaacccaaagctcagatctgatggataaagttaaataacttgttcatatttcaacaatggtgatatttgttttgctaacacaaaaaaattgaagcttttctgctaattagagaaagttggggattatttctttaacaacaaaaaaaagttggggattattttgatcatttcccattgttgatttgttgtccataagtttttcattttctaatcgatttctgttttcaaagctggaactttattagttataaacgctagagagcctaaaagttggattcgcggatacaaaacaaaaaaaaatcgattagcggacacacaaacaaaataaaggttttcctagttacctgatcgggcgtggagatcaaacttgctggaggagccaccgttgccccaagaaacagtgaggctattacgagaaaactcaatactaagagctgcatggtactggtcatcgccattaggtctctaattctctatctctcgaaaataaaaatcagccgaggaagtgtaactgaagaagagagaatgagatgttgcagagtagaacttaattttgttatgacttttgagtcttataattacttctcatacatatagtttatacagattatatataccaagtttaaacgctagtggaacgtctatatatctctgcatgcatgcacgaataaggaatacatcctataattgtccatcctataattgtcatgattgaatggtccatgacgacaaaatttcctcatatgagtgtgaacgcatatagataatacaatattaattaacaataaatattaaaccagacacgaaaccaaatgtttgtgttgttacacttaacatatatgtaagtatattgaagtacatgttctcagcattttatggctttgtatgatgttagaataagaaatgtacgtataaatgactttttcttttttggtcaaatgtataaatgactaatgaaattcattattcattgacctgaggttaggtggaccactgatctatatatagtcacgctcactgcagtgccaggatcaacatatatatataaataataaattgcataaataaacataaattataagtcaacaatgtagttaattgcataaataagaaacaaacaaaagttataattgacaaaagaacaatgtagatgatgttatggagctttttacaaaaaggtaaccaacattttcaatgaattatgtaaaaataaacttggttctcaatttttttgatacctctatctctaacatatgttgccaatcaaatcgtatttcttatccaatcagagaattataaatattcttgtccatatttattatgcacttacactatagtcctctttttgtgtgtggttagatggatgggcttaagatctaacggctatagaggtgggagtaaatctcacttaattaaatagtaccggaaacacttgataattcattcaaaaatatttcctgacttttagggttttctatcgattgaaattgagttaaaaatccctaattccaaagctactctgattttgtaaagtgaaagctatatgccacagagcactcgaagaagaagctagactatggaacgcagaaggagagattagggagctattcaactccatctcagtatcttgttaccaaatttaacaaactatcttaaaacggaaaacacagtattaatggaggtagatgcgactataaactcatagtaattgctaaattaaaaacttacctataaactaaagttgcaatttaaacaaacaatatacgtagtctggagccttaaattagccaaattatctgtctttagaaacgttattaattcggtatttttgattcacacctcttaccatatttacatgtgacaattaaaaaataaaacttgctttttcagaaaattataaaatctaaatataagaattgatacgtatttataattgagcatattggataagaataaacatcaatcactctttccactagacgaatatcttacgtggcaacagctgtaccgttaataatgacagtttttagctgtgtttatgaataattaattacccgccaaatcactaacgctttaaaaaaaacaacaactttaagaaaacaaataaataaataaaagagtatcaaaaggcgttcaccaaaaaaggtacaaagtcctttgggagaagatatcatcaaagagaaaagccctaattaaatctctcatca

SEQ ID NO: 9432 - DNA, 3000 bp, Unknown
  misc_feature (1)..( 3000): cDNA_ID_3041892_gDNA_ID_1972119_Annot_ID_178876 3000 nt of promoter + ATG
aggaagttattcgtatcgggaagaagaaaactaacttaaccctcgttggcgacggcagagacttgacggtcctcagcggcgatttgaacggcgttgatggcatcaagactttcgactccgcaacacttggtaagtcattttcctctttatcaataatgtttctgatgatgtgtctaatcataaactggaactaattcagctaccacaataactttacatgttatctcatcatcttttgcatactcattcaactgtttgaaaagacacttgtgaaaatttacttagatgatcatgtgtattgacatgtgattttggtagctagatctgaaccctgagtcgtttgcctcatcatttccttccagctgattatttgtttccatcagtttgtcatcatgattcatgcattatgtcataacatagaatctctcctcgcagaagtcagaaccaatagcttgtctaagtaactgttgaatcctatcctatcattatgcaagaacactcttgttggtcttgtctaacacctttgttgtctatccaagctttgctgtaaccaattgtctttgataaatatcccgaaagctcacctgaacatagtactacttcttgtgttagtgtgaacatgtcactgaacaacccaaaacaaaagtcacctcaacacataaagtcctttccttgaactatgcttgttgatacaacaacctgccattatctcaaatgtttcatgagccttttgttctgattaatgtacaaagattaagaacccttactgctgttctccatacagaacaccctctgtataagtaaacctgctacttacatagccaaccagcaaactcaacatccattatcctttgtcatgatctggttgaaagagaaactaccttacaacctgtttttataactagaaccctctgatgaacatgagactgcagactttccctcaaacttgaaaccttcagagagttttagaattccctgtttaaacagcctgcaagaaacgtattttagaatcacaaaaccttaaaaccatagaatcattactcctaaagcgtccctagacctgagaattccgttccaacaactcatttatctgatgaaaattgttcctttaccaaatcagattgatttttgattctgcctaactttcgtgaatcagaaatcaactcgtcgcccagtgagaactactccaccttacccatcttaagcaccctgtttttcttccgtcccagaatcttcttcttccacctgtcttcagttttcacacttcttcccttttccgttgtcaaaaatcgccgaacctgacacaattttgatcaataatcccggaaattaccggcggttccttttggagacgtttggattctgccactcttgaacctccatgactttgtactctgttgaaacgttttatcaatcttatcgttttatcttaatgatgttgttcattaatcttatcgggtttttttattatacaaagtaattctatattaatgatgttgagatctgtgtgcagctgtagatgagagtggatttatggctcaagatttgtgtattcggaacacagctgggccagagaagcggcaggccgtggctctccgtattagcactgatatgacgatcatttatcgttgcaggatcgacgcgtatcaagacaccctttatgcatattcgggtagacaattctaccgagattgttatattacgggaaccgtcgatttcattttcggacgggcagctgcggtatttcaatattgccaaatcgaggcacgtaaaccggggataggacaaaccaacatcttgactgctcaatctcgcgaggaagatactgcaacttcgggattttcgttccagaaatgcaacatcagtgcaagttctgacctcactccaattaaaggaactgtaaagacgtttctgggacgtccgtggcgtgcattctcgagagtagtattcatggagtcgtttatagacgatgtcatcgatcgagcgggttggactccatgaaacataactgatattggaaccctatcgaccttgtactatggtgaatacaaaaatacgggtccaggagcagatacaagtaaaagagtcggttggaaaggatatcacacaatcacccttaatgaagctacaagttttacagtggaaaaacttctacagggacatttgtggattaacgctagtatagttccattcgaattaggactttgattattttatgttgtttattaactagattataattgtgctggtgcaacacagatcaaattttagttttaaatatttattaaagttggattgttgtctattttatagtgcaactttaatcattttatacataatactaatctttatttgttatgtagagatgtgtgttcaatttttttagtttagtttagtttaggaaaaattctttgaaatgtcttttttacagtaccccttttcaattctacccttttctatttactattttcatttatactctatttaaattttttaataaccattttacccttatttgtaaattgatttaggttaacaaaatgaaatattaatattttttgcctaaaatattccaaaataaaatttcccgccaattttttttttcaaaaacatttttcccgtcaaaaaaaaaattctaaaacatttttcctgtaaaatttttttttttggcgggaaatagatttacaaggaattttaaaagggttttaaaatattttaaaagatttacaagagattttaaaagggtttaagagaattacaagagattttaaaagggttttaaaagatttacaagagattttaaagggctttaaaagacttacaagagttttttaatgatttttaaagggtttaaaagtgttttaaaaaatttacaagggattttaaaagggttttaaaagatgtacaagagtatttaacagattttaaaagaagttataagaaaaccttttaaaaaatcttgtaaatttttttaaaatcttttgtaaaagttcacaaatg

SEQ ID NO: 9433 - DNA, 1482 bp, Unknown
  misc_feature (1)..( 1482): cDNA_ID_2053370_gDNA_ID_1972120_Annot_ID_178919 3000 nt of promoter + ATG
gaattcttcacataagtaccatgtttggatcgacaaaaacaacaagggaatttttttgttataccatgataattatgttgatcatttgtaataggctagataaaattaaagatacctttaaatgataatgtaacaattccatgtttaattaataggtgtccatatttattatccgaattacactatacaggtcacatatgctaagacaatttggtgtcaaaaacgaagaatctaagattattcaacaagctatcattattccttaccgatataaaagactttgaactattttttggccgtaaagctgacatatttcaccggagatgtcgttcaattatacacttgaccaagtcttattctaataacaaaaataataattatacacgtgaccaattctagattgaactttctaaccaattctacatgaatcgttcaccgaataaaaacaaaaacataaaattaaacctcgcaaaattgagtcttggagcctttgctaatttcttgaatactaaaagcagatcactgttgatctacatataattatttatttctgttgttcgttatttatccataaccaaaccatgattagaactaaatcagttctgtggatgcggtaaaacaatctcttcgtcgaatgaccccaaccaaatattcaaatgtacacttgctaaaacccggttcattggtagtccggtttggttcgtagtatttgagtcaatttcatatccctagatgttatgcagaattttgccacctagaccgaacagagcgttttcaaaacttggaaaggaaaaaacacaaagcatttagaacatgatggaacacatgttagccgcaaagaagtaaaagaagaaaaccttcattttgtcttctttccttgttttgcaaaatcgtccaaaggaataacttgtgtatatttatctgtttttgggtataaaagatatatatatatatatcgcctagtcgtcgctgcttgttgttgtcaaggcacacatgtttattctttatttttgtcaaatatttgaatcaagatcagctactattctaagaaactggctatttctaaaataacactcacgaattagccattatttataaaatggtaacggtatattcgagattccagtccatacatgttattaataaagaaagattggatctccatataaaaaatagctgtctcttacattgtagcactagctaaagatctttcaatactacgtacctagtcatacaattctttgaatatggttttaaattgtatgtgaatattattaagtgagaatagtatcgacataacaagtatgaaatcttttatttctatatattttatttaacaacctataacaaacatttcacttcaaattctcactatatgtagtccatcatcaactactttcttttcgcatatctttgaagtttttggttttactaaactaactctatcataaaaggagaaagctttaaatttaaccagaaatg

SEQ ID NO: 9434 - DNA, 3000 bp, Unknown
  misc_feature (1)..( 3000): cDNA_ID_3041908_gDNA_ID_1972120_Annot_ID_178926 3000 nt of promoter + ATG
caaataaaccatgacaaaaattcgtatagccggtataggtattattgatacaatagccaacaaccaaaagaaattaaacaattaattagaaacgtacagtattgaaattaatttaatctcctctgtttcgtatatcatccgacaacacattgtagtttacgttgttagattatcaaattccccattttaattttattggaatatttgtttagtaactaccaagatgatcaacgcttcatgtgataaaattcttgtcacaatatatacgtatctatttttttatttattttttgaataatttgaagaatcagaaatactcctacatagccaacagctttttggctgtcaagaagaggactctgtcgaatcacatatatgtgtgttcatcacatgatattttactattgcagaatagtaaatgaatgattaaccacataatttattattattctaaaaatccaggatgaaatttaaataatacagtatagtattagtcaatttgctctgttatgacaaaacaagtatacttagattttttctcattacagcatttgaagttagcattcttttgtatttattttttaattggactaggttttacttgacagagaaatggtgtaaaactattagcacacaaagcttttcctgaatcccaaagatggtttatgctgatccgtgcatgcttgatgattgcaaatgtatatatcaacaaatgtctcaatatttttcagttttaattaacttggtttattaattagctggtcataattgaaaattagcaacatataacagtataacactaatccgagaaccatctatttttctatttgatttttgtggcttgatcatcaaatactcaaatattctaaaaaaatcacaatatatatatatatatatatatatatatatatatatatatcttttttttttttttttttttttttcgtttttgtaatttctggatcaaatttgttatatatcaaaaccagatccaactaccaaactgttgttttttttcatccaaacataaataattggtaaagtactatagtgatatgtacgattttataataaatttccgttaagaactatccatcattacaaaaatcatcaaattacattttcgttttttttttactaatcttaatcatcaaatccatttaatatgtagtattactcaattccaaaatattatctcacggttaccatatgcagcacaatatatattgccgatcaaagtctttagctatttgatatactagtatactactaaaaagaaacaaatgatcattcacaattcacaaacaatgccgacagctcgtgaagaaagaaaagaaaaacaatgccgacaacgttttgtgtcaaaaatttcattatagttagtgtattatacaaatatgagaaaaaaataaaaaatatgaggacctaaagaaacaagcttcggttactttctgttttctgtttcttctctttcctttaatagtagtctgtttttttttcttgaataataaatgaaatttcatctagaatggattcgacataaaatataaaatagtaaaaatgagataaataatcaaatactaataaataataattggaggagttgtgaatacaaaagcaatgcccgtgaagtagtgcatgtgagtactaaaagagatgttataatcagtgccccattgacaacatatagacccactcacgagtctctttcgttttatataatattcttctatatatatcactatattatttagtattttataaatcaaattcttaagaaaattataatgagacggataatttatcagcatttttttgttttttttcttgaatcaaattttgagattttgatatccacttcttcttttggttaaagattttggttgtccacatggaatctgaatagctaatatgtaatgttgcgaccagtttacaaactacatatgaaatgaataatgcaaaaaaatctaattcagtgatttgcattattcatttcatagtgatttgaattaatcattctgttttgcttgtttttgctagtaatttagtttactagaattcagtaaatattcaccacactgctacagtaaatatgaaaatcatacgacactctaaagtctctactcatgccaatacgacagatccaacacatgcaagtattacatacacacatgcttgtacccatctatatccacattaaacaaaaagcaagatccgaaaactgaatatacacctcattttaagtatccccacttcatggtgttcctatacaacagtcattggcacatacatgtgtttatctatgtaattatgtgaagtcttggcaaccaaattagatgagcttttaaccaacctttagtttccacgtggtatacattcagtgtatcatcacccctgactcatttacttactcagttactccacaattcaggttttggctgattcgggtaagacttttacacattggtaaaaaacctctactataaaaaaagagatacctctgctttgttttacttttcacatattagtacccgtaagctaagctccaaatactaattcacgagtgatcactttacatcactgtcaatatcagcattatttaacaaaatttctactaaaatcaaacattatggtcttattatcatatatggataacttgtacaaagcctagatttattcgtttgtatagtaatctattaatttatttagaataagttacttatcaacaaaaataaaggacaccattgattcaatttcgttttctatcttttaagaataaaattccatttcgaaaacccgtgagcctctctacattcttggactacttccttgtataaatctcaccaaaaaaccttctctttcttcaaccgaaaccagaaaacaaagaaaccaaagtctctttagtttcttcaaccaccacaacactcttcgtttagacaacaaaaaatgataatgagaagaagtctaagtctgagaagcatcacgatgatgatattaatg

SEQ ID NO: 9435 - DNA, 3000 bp, Unknown
  misc_feature (1)..( 3000): cDNA_ID_2182578_gDNA_ID_1972120_Annot_ID_178931 3000 nt of promoter + ATG
tcttgcaataatttctcgtaggaccgacaaaaaaaaatgaatttaagttttaaatttggttggttcaaaacttaatatcaatttttatggtttagaagaagaattatagctgccaaaagtattttgtccggtaattactaattactctttgtaatctcatttaacttgcccgtttaaataaacagacaaaattaaagaaccctaattaaagtttggcagaacctatgtcccagaaagtaagaaaaaaacaaagtaaactgagaagtcatagtcaaaagacaagttagttccaaccaaaataaaataaaatgtgatatcaagttgaaaaagtgacggatagagaatctatcctttggatcctctcctctatttttagcccttcacttggatctctcttggataactcattaaatgacactatccaatataaccacatgtgtatctgcgtatgtatatgcatgtgtatttatatttagaagcttcctagttttgtctaagaaaatatcttcttgttttgttcctttcagcgctataactcataattctcttccaaagttcttggatttgttccccaaatcaactggagatctaagaagaagaagaagaagagcgaagatcaaaggataaggaagaagagaggaaaatgtgtactcatgctgatgaatcacaacacaacaatctcccttgtctccattgccaaccacattcttacattcgcatggtacataactacatatatacacatactgtatatagtttatacgttttgtatttgatgtaacaatcctcacaactagtggttgattttgttaggttcaacatatgatagagagatgcattctactccgtatgacgcgggacgaatgcgtcaaggcgttagaccaccacgcaagcattctaccactcgttacactcactggttagtctttacaacgttacacatataacctctatatgattcctcaaaactgttcgaaagcttcgttaactaaaaggaattaataatgatatttagacatatgtttcgattttgcttcgtacgtcaaattatataattatatggaacaattgaagaaattgattattgttttcttggatcatgtatgttcatcattatatattcgacataacttatattgttgagttcacaacagtttttcaacgtaactagttaatttatgcagttttcagctatatattaggctttgcaagtgtgctacaaaaaaaattacatgatatttttcccccccccgcagtttggagaggacttcaaagagaaaacaaggacttctttgaaacgtatgggcatttcgtctctcctaggcccttcttaagtaagagattgtgggatcaaatgtcctcttctaattgttaacaaatttcaattaattcctcagtcaacatataaaccacacatcaagtatgttgttatatagttcattttgatgagagttatgttttctttatcaggcggatatgttcgaagatcgccgaggtttgcgaaaaggatataatgaagacttggtttaggctcgtagctagatatataggagaaaaagcttgaactttatatatacctaggcatatgtattacatattcctatgatgaaatactcatgcttattatctgtggtccttttgatgtcataaggttcccctataagattaagcagataagattgattttcgtgtgtaaactagttttaaggttgcttatttagataattagatgcagtctgtttattgaaaaccctcgattataagaggctttacgatttatatatagcaaatgtgtaaaatatattttttaactaaaccatgacgagcgcttactaatttgagtaaatagactgcatctaaataagcaaccttaaaaatatgacactaagactaaaaccaatcccgccggcatagaaaacgaccaatctggttcgaattctgaatactaatttgaatctaaactaaaacactttatttccttttacgaaagaataagtgcaactgacgatcattcagttagttgtttataatgtatatttttaagttccaaacgaggctggctaggtgtataaatgtaaaaaaaaaaaaaaaaaaatggtgacaaaagataggcaaagatttgcatatgaaaagatgttggaaatttggttatttcctttgacaaattttttttttggatattttatttcaaagatctacacgatttcatgagtaggaaataagagttggatatttgagcatattcctcctaaaaacataatgcagcaacaaatgttttaacaaagtgacattaaagtccggttatctccggtttaagaaaagtgaaagacggaattgatttgcgctcacacctgttcggttcttttttttttgtcacaccaacagaaatacagaggtacacacatatcctaaaccgaacaaaaccggggttgtaaaaattaattgcgatttgtggcgattccgtttagatcggataaaaaatctgcacgacaaaattttccatcttcctcctcttcctctgccaacttataatcccgtcaaagatctttccttttttcttcttctggtttctttgtggtttcctggaggctctcagcatcttcgagtcgttgcgaggatgcgttagaagagagtctcctctcaatcttcgaatctccaagtaatctttctgtattttaggattcacctctctttttgttctgtttgctcgatacaatgaaattttgaaaaacttcgttaatttatgaaaattgaaatggattctatatcgcaagttcttgttccaattatatttgtccgttagtgcaaaaaggtcttacctttttcgccatcttacagtcttgtgaataattcaaattctaaaactttttgagattcttacagagacattttgtcactctttgcaacagaacagtgtgagaatgggtgaccaatatgtttcttagtggtgatgttctcttttgctttgttggtggaatcttaggactgtattgactggcc

SEQ ID NO: 9436 - DNA, 3000 bp, Unknown
  misc_feature (1)..( 3000): cDNA_ID_3041896_gDNA_ID_1972120_Annot_ID_178933 3000 nt of promoter + ATG
atgcaacggcacataaataataaaaaaatctccctagagtgaacagttgtgtattcagctaatacgagcaactgtgtttttgaaataaataaaagtaataactagaaaaggtcaaggcccaaaataataagtccagcgaaatagttaaacgcaagtcctttcataaatttgtttgttaaggaaaacgaaattgttgaactatcgtttcagaagtcatttcacaaaagttctattaaaacgatgtggccttcaagaataataaaaaccacattatacgttgcatatcatttctattttataatttaaaatatatataattatcatcaagtttctttttaatgccattgactttgtacgatctctccagtccattgtactactttttcatgcatttttggaattttaaaaaactatatacagtatatagcaataatataagatactgaaaaagccattggaagataaataaataaccagagtgcatagacatgaaaaatgtggaaacatacaaggaacgcacaattgcataaagaaagaacaacgtagcatgcacttgtggagtgagcatttgtttcttccagtagaaatttctaaaatgttcctttcttttgttaaataagtttctaaaacaaatgtattcttttttttcgttaagggtatatattgctgattttaatgtttcctctactttgaccaaaaaacatgcagaaattttgctataatcggcgttgcgtataatccgtttactaaaagtctaaaactcattttgacatttaagagcatctctattggtgataaatggagatgtcttcctagttttttaatatttaattaaagacacaaatgaagaaagagaaacgaaaatgtctttaaccaaacattgaagacatctttgaagaccctcttgaactatgtgtaatattctgattggttctaatttttttagtttaatatttaatgactaaaattaattaaaagcatatcagatgaagttgtgcaatgaggatgatcttaaatagatacacttgcatgaaagggcaaaactgtcattcacaacaaacatgagaatctaccacctttatttcccacgaatgcgatgatgcagcaccaaacttttaaggactaaactgaatatttttttagaagaaaagaagaaagtgggaaactttgagttgaactatgactaggaccaatcatagaatgtgatattattatctaatagttatctccccactttcagaaaaataatcagcctccttctatctacacatctctctctatatattagcttctttagatagagatttcacccacaaatctctaaattcaaaaccttgaaccaaataattcataaaaaaaatcttcaagggaatgaaaccggcagaaaaaatgcagacaaagccatttaaggaagagacagaggaacctcagtttggaaaatctccccaacagtttgtttagcttggccatgagaagcaaggaggagacaaaacggcaagtcatatatcggcatcaggctcgtgtttttcgagttctattgatttgattttggtggtatagtggatcttgaaatgtttaagattcagttgctaccgaaagaatcatctttaaataatagtatgtacaatgggaagaaaattatattttagatcgtcttcatgtgtgttttctttccggtttttgggaattaaattggactatgtttgctcatgtgtctattattaagtttcatgtgtgatgtgtctaatgtctatgtttgtgaatttataataaaaaatattagaaatctgtttttcatttcctcgtgtatctgaaaatcttgaccgtccataaactgtttgttctatggaaattttatattagtgccaatttaccatcacccaatcatttatatatgacatcaaagcttcaacggagagcaagaatacatcagcagtgcatattttaatgcaagaactaattttccattgtaaaacatatatttggtgtgaaagagaagctcaaatattaaagttgacaatgtaccggactaaaaccaattaaagtcaaattttatctgtgccactgaaaaaattgatagtacaaaaaaatataagtattgctattagtcggactaaactatgcatgtatatataagttatagataatacataaatttttatataaaatatgcatgtaagtatttttactgatcaattatagatgtatatatatagaattttatattatatatatatatatgttggtgtgtgtatttggattgttattttcttttgagtctgtgaaaaaaaatatttcgtttgagtcttctctaattgaatataaaattgaaattgtgtacttgaaatgagatatattttttatcaaaagtaaattgaatatctaatttttctatctaaactttttgttattagtatctgtcattatcaattttttccattattttaagatcttttctataaaatttgatatgtacagtttaaagatggtcagattaaccattaatagaaaatccagttaattattaccctttaaaaaaaaaaaaaatcagccagcttataagttaaaatattaccaacaaaaaagcatagtatatacatattttctatttcttacttctttttcaatcaaattactctgtccatattttttacctttccgattttttttttcttttttttttccaatttattacctttccgatgaaaataggatttcttaccaattgtttatttgataaaaaaactttgtttccggcataagtagttttagaggaaaagtctttacatgtttattcatgaattttcttagtaatataaataattcagtattaaaaagaaaacacgtcgagacatgaaactctgttaagattcaaattagatcctaattaatacctcttccataagtttccttgaacttcctcttctatatacatgccttctcatttctagtctccctcgaaccaactcttctttctctccatatccaaaagtgaaaatg

SEQ ID NO: 9437 - DNA, 3000 bp, Unknown
  misc_feature (1)..( 3000): cDNA_ID_3046607_gDNA_ID_1972120_Annot_ID_178939 3000 nt of promoter + ATG
attttaatcaaaatatactgggctcaaatctaatttaaataagcccaataatatgttcatttgggccccaatagaaccacaattataccaaactaaactttgaagacagattattgggcttgggaatttgggcccaaatgaatatttttaatctgagcagagagcgactatggaaatataaattccgtacagcacgcttttcaaatttcattcgtaacagaaagacaacgaagaaaaaagaaaatttcgaaaaggagaaaaatatctttggaagatggcgggatctctaacagcatcaaaccgccgtagaaacgcggaggattcttcagaaatttaccggtggacgatcggttttgctcggtttgttcactatccatcttctccttctccgcatccagttctgaaacctctcggaaagagagagcagtatcattcgccccacggaacctggctgtcggcgtcttcttcgacggtttctctccacattgtcgacgaattgaaccgatccgatgtgattctatccgtcaaactcggccagaaagtccttgtgagttggatttttactctctctctctctctctttattatatatagttctatagatcggatgtttaggttggtgtttcgcgatggtttaagcttaatcaaattttgaaatcgggatctatacatttttgattaaacgtcatggtgtttaattgttcaatatctacaggaagaacactacatttcaaagctgaacttcacatggcctcagatgtcatgcgtttctgggtttccatctcgtggtagtcgagcgattttcgttacctatatggattctgctaaccaggcaagctcttaacacttgaatctcttttggattttatggaattaagatataaataagcttactatttacttactagtgatgaatttgatttactgttcatgagttagttgatacttcagatttgtgattgaaatcatgtggtttgtttgtgcttgttgttgttctccagatccagaaatttgctttaaggttttccacttgtgatgcagcgttggagtttgtggaagctcttaaggttagctattattgcaaagagtttccttattatatgttgatcagatggagacgatgtttcattaaccttgaattcagttttataagctattttcttcaaatcttgagccaaggattcctgtttttttctgtttgcaggagaagattaagggtttaaaggaagcttcgactcagaaccagaaaaataaaactaggtgtgatgtttctttccagtcagattacaacccttcagatgcgattatccccaggttagatcacattagagtgttgtgaatttgtactagttctctagtcaaaaatttagatattgtaaattcctttttgcagagccactcagaaagagccaaatatggttagacctcttaatagttatgttcctgaaatgctaccaagaattgtgtatgaagctcagtaccagaaaagtgaaactaggtccgaggtttctttccagtcagattacaacccttcaattgagattttccccaggttagatcacatttacagtgttgtgaatttatacaagtgcttgagccaaccatttagacatggtaaattcttctctgcagagccactgaggaagagccaaatatggttagattttttgatagttctgttcctgaagtgctaccaagacctgagtatgaagctggacaagccttatacccatcacaatccacgctaaatcaaatcccaagtcttcctccgagtttcacaaccttactctctggctgcttccccgactccactctaggtacatttttcattgtatctttacttatttggagtttgagacatatcaccctctttcacacatttcctctctattgaacctactactatagatgcaggccaaacaactgtgaagcagaatcctgatctaaagtcgcagatactggtacagtataaacaaacccgagtttcttttctctttcaacacatcaatacaattcaaatgatatctccaactttttgtttttggcagaagtacatggaagattcttcatttcaaggtgaacattctccccattacacacacacacaaacaatattgacccatatagattccaacttcacattcaagcttcaaacttcacttaataagtctttctaacaagtggttttctcgttatccagatatgctgcagaaagtagagagaattatcgacgaaattggaggtaactggattacctgatttatcataaacatatttactaggtatcaatcttattatccattttgagtcttttgttcatatattgcttaaaacaattgagattaaaaggagcaaaccaacattggtggaggacaaatgtagtttgtattttattttgtttcaactgcggacaaatgtatcaatttgctctattttcgtccaacaattagccgagaagatttttgatttgccttgagtttcaccttatggtgaaagcatgtgtttattagcttccacaatactcatatattatacgaagattttcttagattttgctatattacatttccttttcatttttgataaaaatgatatgaaaatttcgactgcctgcaatgatctgtaaacaggggaggtaggaatgagaccataatttttgaagtcacaatggttttggaaactaaattcaagaacttcctgttttgattttagggaatatgtttaataatttgcaaacagtgaaattcgagaacttccagtttcgaatttagagaatatggttataaactagatatatccgaaatgaatcgaaaataagatatttggaaatcaaccgaaatttctagctgtatattctctcgagtgaggtctttcctaattaaaatttctctatatccatatataaatagtatatactgattaagttttgtattacaaactagaacaattctacaaaacaagaaaaaaactcataacaaagtcctttgagacagccaaaac

SEQ ID NO: 9438 - DNA, 3000 bp, Unknown
  misc_feature (1)..( 3000): cDNA_ID_3041932_gDNA_ID_1972120_Annot_ID_178936 3000 nt of promoter + ATG
gtgaaaccaaatcttttgaatctttttaacaaaaaaaaaaagaaaaaaaaaatctttgaatattataaactatgaaaatgatatcaaagtcatgaatagtttatggatgcatgtcttcgaaacaaaattacaaaatacatgaagtcgattcttataggattaatgttgatttgtttgacccgttgatattcattagaaatttaacgattttattctaattaatattatatatatgacatattaagaggtatagcacatatgtatatttttatataaaaaaaagtaattttgtttttaagatgatatatagacatatgttatttttttaacgtataatacaccttggtacaattttagaactaaaaaatttaaaattttaagttatatatatatatatattgttactttggttttgttttcaaaattgtataattatatttcgattgttaattatatgatttcatccgtagtatatataattccatattaatatcaactcaaacgcgtcctaccgtataaccccgtcatgtgaaattaaacatcattttgttatttttctaaaatttaaatatttatggtattgaaattaaaatatatatatatatatatatatattgatccaaactttataattgtattttaattgttatatataggatttcacccgtaatatatattgtctcatattaatatatatatatatattttaataaagtataactttttaaaagttttaaattttttgatatttaacttttaagaaactttaaatatttataatattttgaaatttttaaagattcagttctttaaaatagagattcagagtaaaccggataacatttttatttttggatgcctgataaatcaaacttccagttcattgttattcaaaattattttggttctttttataataagactctaaagcattgcccaatttcttaagtaatgtgggatctttcacacttacttttttctttatacatagagtaatatatgtctgtttacaaaaatttgaattacatcatatgcagaaaaaatctaatattttataaactatatatattttatataaaatcaaataaattagatataagaacaacaaaaagtgaaagaaaaagcatatatttatatttaatgtagatagagaaattttagaaaattcgtaattaattgattgtagttcaataatgataagatttaattaaggatttagacacatatttgttttagatagattttgtagaggctaaatatgtaatatagaaaagagttaatttaagtatttaatgcaaactaacaaattataaatttttagtaatagaatatttggttgaaatataactggtaaggacctaaatgttattagtaaatagttaagggatttttgaccaaaaagtctatcaaaaatgtatatgtagatataaaaatcatagaaaactctttaatgtataataacactatgacaatgccgcccattaacaaactcacggaaaaaaaaaaaactacttttctctattttctctcagtattgcttgcttcaagcatatttgtacttagtgtaaatacacgcccattaacaaacgtgaaccataatcttatccggtgaaatacatacgccaccaaatataataatatatcatgtggtcaaatcctgcaaaaaaactcatcaaagatattttgtgtattgtaaaatgattctatagtagtactaattaataggtaatatatactgttaactaatgtggacaattgtaaaacgacgacatagtcattgaaaacgaaatggagtatatctaatctggctgagagaagagttgatatgaaaagagagagcccgtgaacggatatacaaaatgagttttaaatgagaatagggaacccgaggaaacgcgtgacctaagctacgtaaattataaaaataacttatttttatattcatagggtgtgtttttatttacacaaatatatatagtatttgtatcaacttctatgtattaaatataaagagataaaaataccctttagatgcaagtaataaatggagtaacgagatggaaagagtcgttgagattcacacttcagttggcggtcctatttttgactttctaattatcaccggtcaacatattttgtagagattccatcgccgatgctcaagttttttgcaccctgtgaaaacatatatagaggtttttggtcggtgtttgccggcaacgacaaatatgtgatttcttagtttcttcaacaataaactcgtgtttgcctcttatctagctagaatgacctttgtttagtagttttctgaattgcagtttccctaaaccattatcttagtgcacatacataaattatggtgcaatatcattttggtaacgttactatttgttagatatttatttaacagaaaatgtcataatccttaaacacaaattcttatttaaatatgtaaacgttttctaaaacttatggcttcttctgatttattggatctaatatattggagcagccttttgtttaccattggaatactcaagctaagaataatattgttagcttgaaattttctacattctaatgtattctagtttcaactttcaactaacacatcatctttccacatagtaggcgcgtataccttcccaattttgtccctttaaaccggaaactaaccgaatttccctatccacattctaactaaaccgagacaaaccgtttcatttcgagcaagtcttgaacaaattagtttcagagtgctgctattcgtttttggtattcggacaaattaaacttgaaccgatggttagctacttagccaattaaaccgaaactatccaacatcttcataacgtgtctcatttgacagataggggcatttacgtcatttcggagtctccgccacatgtcagatttgttttataaacgaaaaaaattcggtatatttaatttgaagatatccgccggaaaattcgtaaatttgacccttcgtcttcggaa

SEQ ID NO: 9439 - DNA, 3000 bp, Unknown
  misc_feature (1)..( 3000): cDNA_ID_2169255_gDNA_ID_1972120_Annot_ID_178946 3000 nt of promoter + ATG
acagaagatgaacacgcttgaatcactagtgaaatacgcgagaggtctgaaacgaatggtgataaggattctccggatgaagagcaatcacagcagtgcagatgatttctgcgatgatatctgcaagttccggcacatgaacgagcatcttgttcatatagaatgaaataattttttgctgctaatcttattttcagccatttgatttctgtttctctttctggtcgctgagcatttcttatattgaactcttgagtaattgttgtttcctgattcatggttatgatgaacttatgacaattgttttttaaacgaaaaattatggacacatttcttaattagctttcttgttttcttaatctacattaataatatactagtagtgatctagcagaatataattacagtttatgataaagtttgtttttggagtatacttatgtatcaaagaagtattgtcctatgcttaaaaaagataaaagaagataatctccttaaaacaagataaacctcagattgcattacattaaaataaaacgagaaaacgcaaaacgcgcaccaccaacaatttcaaaaccaaaaaaacttgtctatatataacgtgattaactcctgcattgaaaaatgacctggtgataatttcttctcaattcaaatacataaataaatatcaataaaatggcgggccgcgacacattccagctgcgttttgcagcagtcgcggcatccgccgccgtattgatctttctcatggctggtcaagtcgcggagtcgcgtatgatcaatatctgctctcacaccgcgtatccatctttgtgccgacctctggtgaaacgtgtcacgagccctagaaaagccacgcaccgaaccatccaagctttggaggctaagacgaaactagctctagccgaaacagctaggttcaaaaacggtaaccaagcggtcagcacgtgttacgagacattgggcgacgcggtttacaatttggcaagcgcgagaaagagcataaggaaacgtgatgtgccggcgatgaacacgtatctaactgcggctgtgtctgattacggtgcatgtgtggacgggttcattgaaacacaacaggttaatgcgatccaaaatgcagtggttgacttgagaaaaattagcagcaattgcttggcgttgtctacattgattagatgatcgatttaagagaacaattgatttaatttttctcaaaacaaaaactaattaattgaagaaataaaaaatctcaagcaattaaaatttgggtttctttttgttgtttttgttttgagagagatgtttgttgttgatccatcattcgtatgtaacgccactgggtgtaactaattatatttgaatttcgtgtaattaataatcgctagtagattttttcatattcaacaatttgccgatagaaatgttttccattctcctttcttgaacccactttactttttcactatcaacaataagattaagttttgaccgaaaaataaaacaataagtgacaaagacaaacacaaactatagtaatgcacaactttttgttttgttaactactatcactaattcattattgatatggatatcattatgatgtttttagaaagtatatgtgtgattatgttttacttttcccaggatccataacaaaaaaatatctttgagaaaataatttggctatatcatatattggataaaaatattgccatttaaaatggtcttttaactctttttcttaaaatctgtatgtatattatagtttgatatgatcataaaagcattcaataatttttctttcatgcaaaactgatagatcttgctcaatgatcatgtttcaatgtctttaagtgttttaagaaagtgagaattgctttgatttggattgaaaaatattggaccataataaacacacataacattatacaaaattatcctttgcttctatatttaacatacattttgttttccacaatgtgtaaaactctctatagaagaaacaccacacaaaaacaccaaataaggtttagctaggatataattgacatgattgaacaagtgggcttgggatatatatcactacaagaatagaaagataaacaaaaatatcttctgcaattcgtggtttgtgaacacaagagaaaaaaaaaaaaaaacatgtcgaccaataaaaaaaagatacaagagaacgaagcataaaaatatcaaaacaaaaagacaaaaacaggaaaatagaaaaaagaaagaaaaattaaaaaaagctaaaatcaacggtgagaagattctgtatataataagaaaatatcacccaaataaaaaaaaaaggtggagtccacagataccgtccatcaacgtatcactgggctctctttctccgtgccgttcctcctacgtgctcgaataacgatgtgccacgtggtggaatcgaaggataaagtgtcgttttttacttcgattacacgtgagtgtatgtatgtgtgagtgagtgaagaagaacaaagagcgaagaaaccccccagcactcacttcatccataagatcattcaaattctgggatcttctctctttctctcattgtattcagtttcttcgtctcggttcgatcatcaggtatctttttcaattgaattttaccttcaatttcgattgctttcggtgtttttgttatttgattcaaattgcaaattttcttttgatagatattttcgttttgactataaaagacgattcttttcttcttagtgtatattgcacatgttccattcgcagaatgaagtaactgtttctctacaaagtgaaaataaaataaaaataacaagtgtggttctcttgtctaactctgtcagattcttctttttgagacaaatagtataacttgttccttttttttctcatctattgcaaaagcttcattgttttccttattatcttattatataatctctactttacttaacagatccggcaagtttgattcagtgacaagaaagcatg

SEQ ID NO: 9440 - DNA, 3000 bp, Unknown
  misc_feature (1)..( 3000): cDNA_ID_2169259_gDNA_ID_1972120_Annot_ID_178944 3000 nt of promoter + ATG
gagatgccattgagaaactctatggaactgcacaggacattgaaggtgtgatcagagacgggaagctctatgtcgtccagacacgaccacaagtgtgatcaaattctctgaccacttcttaatgtgtacgttacgttttctgtccagtaaactccttatttgctctataagcaaagagtataatacagcataagcatatagtggattacaaaatgtgtagtacaaagacatttggcattaccattaagatataaataaaaaaactgtttattggagttggaagtttctccagcttttgcttcttgaagttgagtgcaactgaaaactgcttgtcgtttcactggtcgagcgatatgactacttagtgtttggcttttgtgaattagtgactcaactgtattcccaattcaaattagggtctaaattgtaataaaatatagataatgtttccttttttcctgaataattttcttttaagctttgacacacgaccgcaattgaaggcgattctttttttgtttctagattaagttagctgccaaatgatacatgccatgccgcttcatccacctctttctttgatcttttctacatttcttcacaattttttagtttgtactaatttaatatttgtattggaatctcgcgaatggccttctctaaagccaaccaccaccacatcagtagttcagttaatagatatgcatatctacggacatttaaagctcacaaaatcaaatgtgtgtatgtttgtagatatcacaatgattcataaaaattacacaaccagtttgaccatatgatccaacaatgcaataatgcaaaatcacacaaccagcttgacctcaccatatgattcacaaccgatctcgtattcatagtatggcgtatatatgcatgcacaataaaaaattatcatatacgtgaaaaattgtgctatccacgataaatatatcgcaatgagtttgttttgacatttacgcaaaagtaaactaggattagaatgtataatcgattttggtgctcaatgcttaactaacaagtttaaggttgtttaattttttcttctctcttaagaatccactaatggtggaaatgtggaaggaagaatatggatttttttataatatgattaggatcttgaacctcacaagttatgcaacatatattatagatgctgaatctcaatttttgaaggtttacattgcatattatttacaagccatgacgacaagtatcaaatttatgtttgccacatattaaatttttaacatgcccatgtccaaatggttgtaactatgaagcagaaaacaatatacataccaataccatttgtaaatactagcatataactctgtacgtattcaaattacattatttctgttcttatcctgtataggttttaaatattgaaaaatataccatgcataatcaagggataggtaatgataattggtgggaataaattaaggatggcatgcatggatgggtccccaacataagcactcgagcatgcattgctaatactcagcctcgcgtgccaacactcccatgtccctaacacaaactacttagtaaattaaaatgatctaatctattatttacaattaattagtactaaactttgttatactcttccactaccacagttatactcttcacgtagttgttcatttatatgtatatttttcaagtagaagttaaaatcttatgaagatataatgctctcgaaaaaatgttgtaaaagaaaaagaaaaaagagagagagtagctgacagaaggaacatatagggaagagagtaaagagaaaaagcgaacttcaagaatcaacaataagaaaaagtaaattatttgcaaattcctctttttgtctcttaaaagatacaaaaaatgtttttttttttaaacacacagagaatgcaaactaacacaagataaaacaagaagaagaaacacagaattttgactgtcattatcataagaaacatagcaaccacaagactttcctttatatttggctatatacatttattcaaacaaacataatatgtttcaggctttgtattgctaattgggaacatttcccctcccccaactttttttttctcttttgaccaacttagcttatattaatttgatttcacttataactacatgttgcatacaatttttgcatattcttatctgctaataagtaaaactatgtgatagtcaagatagcatcaaacctacgggtccaaactaaggtttcaggtctaatattaggtatgggatccatctacactttttgttttttttactgagatagaatttacttattagcagatttcattttaggataaattccgataccaggtaaaatacaaacacaatttgaaaaggaatgattattgtttttaaagagattattcattaacacatgagacatttagactaaacaattactccacctctgttttagctagccatatctatataataggttctaataggtgatttaaggaggaagtgtgcatactcatattcttaagccatggaccaacaaagaaagagagaaaagcattgtagttagattttgcttagtcactttatgtcagtggtcttttatgattttgtcatttttatttcatttttggttcctctgtattcttggaggttaaaaaaaaaggaaaggcatgaatgatttcatcactatccaagccaagtacttataaaacacatataaacatttagactattactttaagacaccataattccataaaccccttttgaaactttctctcgtctctctctctctctttcttgttagcataaggccccaagaagacataagagtgttttcatgattctttatttgggttttgttatgaaaaaatttagcttctatagctttggaaatggtgagagcttgagaggattataaaaatcaagggtttttgtcttcttttgctcacttgctcattctttaatatcgagaaaacgttttgggctttgatg

SEQ ID NO: 9441 - DNA, 3000 bp, Unknown
  misc_feature (1)..( 3000): cDNA_ID_1809380_gDNA_ID_1972120_Annot_ID_178941 3000 nt of promoter + ATG
gacttaaaactaaacaagctcgttgttggaaagaaaaagaatttcccaacgctaaggagctttgtttcgccaattgtccccctcttgaataatttttatggattctgtcatttcgaagcagatttttttaaaaaacgttgataaatctaaatatgtatgttgcatattcgatttaaggttttttatgacatttatttcgattttagtggattcctttacattaatgttacgatattcttattttctataatttaaattcactgaatatcaaccaattacatttctaaataaaaatatatattttataggtgttagataatccaattacagttgccaccaaaaaatatggaatttaaaactaaattacaagtatatgatatttaatttggatggggtttgttaggaaaagataaaataatttgcatagttttagtttttgagtcaaccaaatggatcaatagattaattgagaaaaagaaaagaaaaaagaaatcaatcataatgttttcgaattttttggaaagcttatacgatggaatcggagacgatgacgccgccgacgacgacgaagacaacaacaacgacgagaaaaccccgaaagcctcaacggaaagacacgatttctcgagaaacgccgttcgtttgtcaccggaagaggaggctcaagcgcgtggggttaaagatgatttgacggaacttggtcataccctcacgcgtcaatttcgtggtgtggctaactttctcgctccgttacctgatggatcttcttcttcttcctccgatctatcgaaccatcccaggtttaaccaatctcggtcttcagatcctggattgaatcaatcgcgttcttcagatcgggacgaatcgtgtgttggaagtgatacgccggagactggaattaggtttaggagctgggatttagaagaaaaattggcagaaggcaatgatccggaggatgaggaagaagaagaagaggaaacagatgaagaagaagaagaagaagaagagatcgctgcggttgctcttacagacgaagtgctagcatttgcgaggaacatagcaatgcatccagaaacttggttggattttcctcttgatcctgacgaagatcttgatggtaacgtatacattgagtcaagtctttcgctattagtcttcattgatttgacttataggcatatcaaaagtttgattatttcaacttttatctaatgtagatttggaaatgagtgatgctcaaagaggtcatgctttagctattgagcgtcttgctccgaggttagctgcattgagaatagagctttgtccatgtcatatgagtgttggttacttctggaaagtctattttgttcttcttctttcaaggctcaataaacacgatgctcatcttttgtcttctccacaggttaaaaaaacctgaatctcaatctcttcttgagtcaaaatgattctttgttgttgctgttgtttattcaacaaaatccttttgcttttgcaggtgatggaagctagagcattgtggatgaaagagcttcagaatcagacacattcttcaaaagaaagtagagatatgattcttgaggaagaagatattacaccatcaacttctaattactacaaccatgctcctcctgagtttctttctccaagaatatatgcttttgaacctccttcgattatgtatcgcgattttgaacacgggtttgaaaacgctcagttcatcgataaagctgttattgaggaaaaaccaatccagaagaacgacaaaaatagtgcaagccttagccaaacatctaaagatgttgttgatgatgatgatgatgattggccagaagaagaagattctgctaattcttgggctccaatgtttacagtgaatgaggatgatgtttctttcagtgatcttgaaggagacgacgatataagtagcttagcactcaagtctaagattacatcaaagggcacagaccaaaaaggaacatgaaacatcatctggcttgttgctttgccctgcctcacgagatcgaatcaatagaattgaacataagtactgtgtgctgagtcaaatcgtggaagtcttttgggtgagtttgattgttttgtggatttatgatgtttgctctcaaagagaaggaagaaagaaagaaaaaggttttgattgaaacatgtacagaagatttactttgacactgcaatttcattgtaatgttctctctcgccaaatgtaatgaaatattgaaaagcactatttcattcgcgtggaacttaaaagaaattgatagagaatggcgcaagtgaattcaagtgtaacaaactgttagaatcattattggattggaaaatcatatgggattttattgcttatgttgaggatttgtatgtatgaaaatgggaacaaccaggaggagctatcatcaattaacaaaataactcctatgacttaactaaaaaacaaatctatgttgaaatgtataacatttgtcaaaatgctagtactttgttaataattaaggggtgttattggtttgtgatttatatagagttttagtgatttaaaaatattatatagaatctgatgttattcaattcaaattttcattttttttttttaatttggtattattagtttaagatttataaaaattaatctaaaatcttcgtaagtaagattgcttccctaatacagagaaagaaagaaaaaccaagtaagattggtaatacgatgtcgtttcgcagaataatgcaaagctgaacccaatttaataagctgcacttttctttctttctcgagtctcccgtcgttttttatgtcagaaccaattcgtcaggtcgtgaataagtgactttatcgacgaaccaccactcagctgcagcaaatgatcgtttagctccggcgaagcgtaaaattcttcagatctctctggaattaataatccgtctgtttgatcgatctgattcggcaaatccttgagaaaacaaggagggaagaagaagaagaac

SEQ ID NO: 9442 - DNA, 3000 bp, Unknown
  misc_feature (1)..( 3000): cDNA_ID_3041900_gDNA_ID_1972120_Annot_ID_178932 3000 nt of promoter + ATG
tgttccaattatatttgtccgttagtgcaaaaaggtcttacctttttcgccatcttacagtcttgtgaataattcaaattctaaaactttttgagattcttacagagacattttgtcactctttgcaacagaacagtgtgagaatgggtgaccaatatgtttcttagtggtgatgttctcttttgctttgttggtggaatcttaggactgtattgactggccatggctgctgataccacagcttcaagttactggttgaattggagggtcctcctctgtgcattaatcctcttagctccaatagtattagcagctgttctcatttggaaatatgaaggcaagagaagaagacaacgcgagagccagcgagaattaccagggacattgttccaagatgaagcttggaccacatgttttaaaagaatccaccctctttggttgcttgcctttagggtattctcgtttgttgcaatgttgactttactcatttccaatgttgtgcgcgatggagctggcatattctacttctatactcagtgagttttaatcattatacttccttctcacatttctgaatccttgaaatgaatgaaaaagatctaaactttttttctgaaacaggtggacatttactcttgtcacactctactttggggtacatctcttggaaattccgttgttgaggttactaccttagttttagatactaaatctgtgatactttttttcttcgtagtatgcttcggtgttatctgtttatggatgctgcatctataataaagaagctagtggaaacatggagagttatacaagtataggtgatacggaacaaggcacttatagaccaccaatcgctcttgatggggagggaaatacgtcaaaagcttccaatagaccttcagaagcacccgcccgaaaaacagcggggttttgggtttatatctttcagatccttttccaagtaagtgtcttattttcccctaagttatcttgttgagagtgaagactgtacaatgccatctcaaagcttcaaaaggacttacaaagttttctgttgggatagacttgtgcaggtgctgttgtgctaacagatattgtattttgggcgataatctacccgtttactaaaggttacaagctgagttttgtaagttctggctctaataccgtttgagttccattctttagaaagatttggatttctttgatatgatcacttttttttctggcagtctctatactaaaagtcgacaatgaatatatttattccttacatgtgttattttgactgcagctcgatgtttgtatgcattctctcaacgctgtttttctccttggtgacacaagcctcaattccttggtaagttttcaaaactgaagtctgcggatacacaatctcctgccttttttattagaatctaatggcaatcttctttcttccttatccagcgattcccactgttccggattgcttactttgtactttggagctgtattttcgtggcttaccaatggataatccatgccgtcaagaacttatggtacacacttgttctgttttcttatcttcatagaggcataagtttccatcattttgaccccagatattaactcattgtactgatcaagtactatgactttctgattgcgccaaatggcccactcaaaatcttcttaacaaacagagccgcagtgtctttacgagttttaagggatcttgttatacatgttttgcaggtggccataccaatttcttgatctttcgtcaccatacgcacccttatggtatgattataactcttcacacttactatgatatcaaagtttccaataaaaatcaaatttaacaataaaaaagagacaattgttgtgatcttttactaatgtttctgcaggtacttgggagtggctgtgatgcatataccatgctttgcggtcttcgctttggtcataaagctgaagaattacttgctgcagcagcgtcacaactcgtgatagttttggtctccccgaattcaagtttcatcttctatttatgagattctttgttcacgagagaataccacacatggaggaaacaatggttcatggtcatggtcaaagtcaaagtcaaagtcattcagaaagtttgagaaagtcaaaccctcttgttgagtaagagactatccagaagaaagaagagtaatctccaacactacaacacattaatttaggtcttgtttagtttgtttatgattaaacaagtctcctcaataatgaagtgtcataaataagttatacaatcccttgttgtaaagatgcaaccaaataagtaatgagaaattaataaatatttttcttttaaaaacaaaatttggttatatgtgacacaaatggaatggttgaagttgaaacgttcattttcaagttaggtggcatactctaaaattgaatgaacaattgaacatccaccagcttttttcagagatgcgtagctgcaaagtcttgctaatgtttgttaaataaatcctagtatgtagaaaaataatccaaattctaatgcaattatttgctaaatcctacaaaagtatatactataaagatttgagaaagaaataaacattaaattatgtgcatatgtaaaatgattgttggttataatactaaataataaagtttataacaatattttacaaatttggaagttgcaactataaatggtaaattcggtccttaagattagaagacaaagaagagtcgtgttggtgagctaactacccaacctgtgaagctacccccattctctctcaacggtaaagatccgccattttcaccgatctctgtttcttctcgtttggatctttggaaattttagagtttgttcgttctctctcgtatctcattttggaattgaatcgttagtggatttgatcgggaaatgagtgttttcgcgttcgattagtgtttatcagtctctggatctgtgattttgattttgttttctccagttttcgttttgaa

SEQ ID NO: 9443 - DNA, 3000 bp, Unknown
  misc_feature (1)..( 3000): cDNA_ID_1383941_gDNA_ID_1972120_Annot_ID_178930 3000 nt of promoter + ATG
catgcgacggtaacggagaaggtatcaacgagaacgtgtccgccgtgatctcagtcaatgttttggtgtgataatagaaaaaggagccgtttatttgcgagtgggatccacgcgcctggtcgttgggcaaatatggcgggtaagttttggcggggaaataaagaagaagaagccttatagagtagttaccgtgactttctcgaaacgtggaccagaccaaaccgtcgcacgccagatttgtcggaaggtaattatagtttacttacttggaaaacttttgcactaataaaattaaatcgtgtaaaaatttgttaacattcgtaaaataggaatattaatttatccaaatgaaaaagagggaatataatttttgaaaaagaaaaagcaaaaggttttctagtggttgcaaccacacagacgcaatcaatttattattatgtgtactatagttttcttttgtaacgttacacgatatccaattaatatttagttgaggatttgttatgcttatagcttttgactatgtccattgtccagtgcataacctttgcttttctttcaagttgttaacagcgattctctaggctgaaaaaaccctctaatttgcttactaatttcaatattgacggtctactagtatattagtatgtaagatccgttgaaaattatgtaacaaagaaattgaacctgaaccaccaaaattaaatgttttgtatgattggttgtgagattttcggctaaactgatcgattcagcttgacaagtctgaaaagtagaagccactcatgcaggttttgatatgtttcttgaagggtgttgacgtaaagaaaataaaccatggatgtttggtatatgtaagaagtatattttgtcttcattttaatggaagaattgatctttcctatattcataggagccacctttttggtacgagtttgagtttcttgttttatgagcccatgtgttgatcgtccaattcttgttgtatgaaaagaagttggtgtcggtcaattaaatctgagagactttacagaaatgtgtgtttcgtctagctccaggccggaactattcttgcatagtggaagaaacaaatcctcgtattattaagtctccttgttcccgttattaataagtttcatgtggtatatatcatctcaatattattagaacaatagtataatataactaagaaaatctttccatatgttttatcttgatttgttcagttgttcatattcatgaagattgtatactccactttttatccttgtgatggtagtgtccattttgcctctcaaatatttgaatctctgcttctcacgatttgaatgggtactgtaattttgatttgatgcatgaagatcaaaagctctatattttctcttgattcagtctaataatgctgcatgcaggcaaatactgatgctactcatgtggatagtaagatttttattaattatagcggtcttaactagtttttgaaatgtatcactttaatgtttttttacagttttggaataaaatccaaaattgaaagaacaactaatagcagcaaaccactaacgtgatttagtgatgctgcgtaagtaaattattctttggtaatctcattgtttgcttttagtaccctaaccatatctaaaaccacttggttgttcaagatgtggacgatcatgatgactcattcttgacatgtcttaacgattacttttgtccacaaccacaaaacaaaatccttatattgatattaaaaaataacattggcaacttcatttgaaatctcaattaggcaatgatgcaaaaccaaattgtatttgttaaagaaactttatttttgtataacatttgagagcagttactgtaattgcacaagagttgagacctggtaggtcgacttaagggccattcaagtcacacacagactcgcaagtcacaagaaccacaccctaatcttctaaatttgcggagagcctcatagtttaactttcaagttgcctctatacacaaaactttgtcgtgtattgatgattcaagtggcatttggttggccacataattcaaaaggtatataccggggaccagtcacttttgtgatatgtttgaaggcagatattcatcggggtttggcactctattccaaacaaccggtctgaggaaattatatgtcttatagaaaacgtagttagataagatgtaataggtttatgtcttttcacgtcatatttttagtattcgatttaacataacattttacaatgacaataaatattaatttttaaatttaataaatttataccagatgctattatatgtaaccaaatcacccaattcggtttggtttagactactgtcagttttcttgcaataatttctcgtaggaccgacaaaaaaaaatgaatttaagttttaaatttggttggttcaaaacttaatatcaatttttatggtttagaagaagaattatagctgccaaaagtattttgtccggtaattactaattactctttgtaatctcatttaacttgcccgtttaaataaacagacaaaattaaagaaccctaattaaagtttggcagaacctatgtcccagaaagtaagaaaaaaacaaagtaaactgagaagtcatagtcaaaagacaagttagttccaaccaaaataaaataaaatgtgatatcaagttgaaaaagtgacggatagagaatctatcctttggatcctctcctctatttttagcccttcacttggatctctcttggataactcattaaatgacactatccaatataaccacatgtgtatctgcgtatgtatatgcatgtgtatttatatttagaagcttcctagttttgtctaagaaaatatcttcttgttttgttcctttcagcgctataactcataattctcttccaaagttcttggatttgttccccaaatcaactggagatctaagaagaagaagaagaagagcgaagatcaaaggataaggaagaagagaggaaa

SEQ ID NO: 9444 - DNA, 3000 bp, Unknown
  misc_feature (1)..( 3000): cDNA_ID_2182561_gDNA_ID_1972120_Annot_ID_178924 3000 nt of promoter + ATG
agatatctgtttctgtaaagtcacgtaactttttaatgtattatatatcaaatgttaaaatgcgccaaaaaacaaaagacaaacgaatataaagtgacaacagaaataacagattacaaatgggaccacaattcacaagccttgataacaattactacagagtttctctgtagactaatggtgattagtggttttaacttttaagattagttaatgaaataattaacagagtttcataacggttgcaggcgtttgaagcggcttgggtagcagcttgcaaaatcgaagcatcagtgatgcttgtaccgcctgaatacacttaccttgttggaccgatctcattctctggtccttattgtcaagctaacattgtgttccaggtgagaattgatctcttttatatagaagtgtatcactttggtgaaaatattctaagctttgttgtgaattatgcagcttgatggtacgattatagctccaacggattcaaagacatggggaaaagggttaatgtggtggattgattttacaaagctgaaaggaattaaagtacaagggaaaggtgttattgatggaagaggctctggttggtggcaacaagattctcctttcattgatagtgataccaaactcatcgtccctttgaacaattctgctaaccaaaaccctcctatgccggtaagttcatcgtcttcttcttcactgtctcattcacaacacaatattcatctaagaccaaactctgttttgtttttacatatgacagatcagaagtgagcttgatgagagaatgccaagcattaaaccaacggtgagaaatagatattggcactgtgagattgtaagcattagtttgtttactgatttttgtttctgttaggcattgagattctctgggagttttggtgtggaagtgacgggtataacgatacaaaacagtcctcagtgtcacctcaaattcgacgactgcgtaggggttgtggtgcatgacatagccgtttcttcacctggtgacagtccaaacactgatggaattcacctccagaacaccaaagatgtcctcattcacagcactactctcgcttgcggtaatatgatctccaatcttaaatcctgaatctttaaaaaatctcaattcttaaatctagaaaccttgaattatgcaggagatgactgtatctcgatccaaacgggttgctcgaacgtgtttgtgcacaatgtgaactgtggaccgggtcacgggatcagcattggtagtctcggcaaagagggtacaaaagcctgcgtctcgaacataacagtacgagacgtagctatgcacaacacaatgacaggtgtccgaatcaagacatggcaaggaggagtaggatcagtgaaagggataatcttctcaaacattcagctcaaccaagtacaaattccaataacgataaaccaattctactgtgaccatagcaaatgcaagaaccaaacatcagcagtagcagtggaaggagtgacttacgagaggataaaaggaacttataccgtgaaaccggtgcatttcgcttgtagcgataacttcccgtgtgtagatgtgcagttatcgtcgatagagcttaaaccggttcaagaaaagtatcgaatgtatgatgcttattgctggcagacatttggtgagctcaacactcctactcttcctcccattgattgtttgaagattgggaagcccccgagaaacaaagttcagtccgatcacgatgtgtgttaacggatttttcgcaagtaaaaagatgtagattcatgtatatcatctttctttagcctataaaacctacttcatacgaatttacggtttagatattaaaaatgatgtctcttgctacttaaaatgcctcactttattaaccagcaccaccaaccaagtgatgatcaatacagcatttattattttgaatgggctagagttttttcatgcaactggttacacagaggttgttgtatctttgcttcgtgacctgagtagtgagtgttaaagatgagtcaatgttagttcataaattgaagagttgttacatcttgttccactaagcatgagatctttatttccatacttgttgatggatttatttcatattaaatgtataacggctgagatggtgaggccacagagaggtgagaagagtgtctgttacaaggaacaaaagcaaccaaaaaagtttatacttgttctctgactttcttcatatcaaaatttgcatagaatcatatatgatagtgtttactaaatggatgcaaaatgacagaatccaacaaaatcacatagcttggaggggatgatatgaagtcaaatgaaagatttgattgatggtcatgaattacaatatacaaatttgaggggttaatttgaaacaaaatgtataactttagggtactttttatatactatacaaaaataggagggtgctagtgaaactttcacattcagaaatcacaaagtagtagaagaagtttcttcatatttcaatcacaaaatcgtctttgtgctgctgattggaagcttctctctctctcggtttagatccctttcaattctccaaaggtaagctccaaaactttccagatcgtcttacattctttcggatattctggatctgcattcgaattccattaaaattcccttgatgaactgatccgaacaagtatctgagtttttttttgtgatctgagtttttcgttagatcgctcgccattgtcgtcgaatgatcgtgtatcttggggtgtagattttgctttgtttcctgatctcttattatgtggattcaaaggatcatgaaatgttggatttttcgattgtcgtgttagtagatgcatttgatgtaaacattgctaaaaggagcaattttagcgaacagtgtgaaaaaaatgttgtaagtttttgctaagaagaagagtgattcaattgtttaatggtgtgtggatctcttgacattttcaggatcaacagttaaaaggaaaatg

SEQ ID NO: 9445 - DNA, 3000 bp, Unknown; identical to SEQ ID NO: 5564
  misc_feature (1)..( 3000): cDNA_ID_3041922_gDNA_ID_1972120_Annot_ID_178920 3000 nt of promoter + ATG

SEQ ID NO: 9446 - DNA, 3000 bp, Unknown; identical to SEQ ID NO: 5562
  misc_feature (1)..( 3000): cDNA_ID_3077660_gDNA_ID_1972120_Annot_ID_178922 3000 nt of promoter + ATG

SEQ ID NO: 9447 - DNA, 3000 bp, Unknown; identical to SEQ ID NO: 5563
  misc_feature (1)..( 3000): cDNA_ID_3077668_gDNA_ID_1972120_Annot_ID_178921 3000 nt of promoter + ATG

SEQ ID NO: 9448 - DNA, 3000 bp, Unknown
  misc_feature (1)..( 3000): cDNA_ID_2182776_gDNA_ID_1972121_Annot_ID_178964 3000 nt of promoter + ATG
ataacaaattgtatcacttgaattattctaaaatcccataataaaatgttatagtgtggtagatttaaagtacaaacaattgtttcttgttatgtagttagaaactagattttagcctgaggtacaccatagaaccatatatatatatatatatttaaatgaaaaattaatttgtttagtagattaaaaatagattttttggtttgtattttctaaatgtacaactgttgagtgatgtctttttgttgttaaaaccaaacagaaggaattggggaaactaactagaaactacaactagaggtttggttaactaagtactttttagtatcttttgctttttccttaaatcatggagtaggaagcttgtctacaaaaggtgatgtcttgtagtaggtaaggtgtaggcgtgtgggtgtaacagagaatgtttgttgctttctctatgagtgtgtgtaagaagaaaaacagagctatgtgttcttgtaatgacgtttgaatgataacaagtttaaagaagaattttagctactcaatgttttcttttctcaaataaacatcaaatatctataaaaaaaaaacaagtcttatatatgtatattattaagtatacaattactatgtttgaattttatcatttaaaaatataggaacaataacatacatttcattaatttaaaatctagattatatctacatacatttcaacaataacatacatttcattgttttgttaattttgtgtttaagatgatataattgtattttgattgtcatatctaagatttcacccgttgtatactgtttcgtattaatatcgactcacacctgtcataccatctaatttgttcagtgaaattaaacattattttttatttttttttgttttaatgatactttattttaaaagatatataatttaaatccaaatgacttagaccatctccaatggttaagaaccaattgcatcttaaaaattattaaaattaaaattttggaacatgacacataactgtttttgtcactcataataaactcttagctaagaagcaaatcttagtttttaatctgttttgatttatttttgggtattatcactctgtatacatagaagattacaaaattaagtgtcagaaaaagctactgttgagccttttctctccatcatgaaaatactcttatacccctatatcatatttgctcttgacgttaaatatgttgttaccttttaataataatgttatcatctttccataattataaaatctttgaaatcaaatcgttggttcaatagctggtaatttgtttatatcgtcaactatattattaacaggttaaataggtttgtaccctaagttttttcatccatatatcaaaacctcatccatattttgctaacaatattatcctgataatacgttatctgctaactattttgatgcatgtattttttctacatgattattcagtcgcaagtcaacttttttgctcttcatgctaaatattttgttactttttaataataatgttatcgtcttcgcatatatatatatatgtctttgaaatctaaacattggttcaatacatgaaaatttgtttatatcgtcaaatatattattaacatattaagttggtttgtactccatgtcatttcatccattcatcaaactccatccatattttactaacgatattatctcgataatgcgttatctgctaactatcctgatttttatcatatctctttatagggatatatttgttatatagattttagttgaaaaaattaccaaaataaatggtcttcatgtatagattcttaattatttgatggtgcatgtatagatttttaactcaccctttattttttaaaatttaattctaagatattagtctaagatagacctaagatgcatcatttgaggtgttcttagattcttggttatttgtagactacacaataatattttgagttatcgtagttgtgcctatttcgataagtctcttgttcgattgttgttctgaaatggtttagatcacgatgttgaaactttgattatgttggtgtctcttttaaaaactgtttgtgtctttatatttgtcttttcttctgcaaataattgtgttgagaggtaaatttgttcttactttcggattggttggtttctcattatcaattttatggtgatcgtacatgaatgtagcattattattagggtcaaaccggtacgatccggttcgggtttagacagtcaaattatataacaaaccaaactgaaaaaaaagcacaaagaagagaaataaggtttaagatctacaaatgatgaagaacatttgagattctgactttttacgatccaaatttttaaaatttatgggttctgataaaaaatatttcaatggcaaaacatggtatggaaagatagattttgaaatgatatggaaaaacaaaaaacaagtgaagttggtgattttgttgttctatcctgaaaaagtctatccatctcttgttctcatcctttctgaggaagtcaaattaaaaactgtatgaaggaagcgaaaccgtatggagcggtagtgctttgggatgtcatgcatatagaattttatagagagagagagttaaagatacttcattcttgcctaatagacggacgtgtgtgtgtctctctctttgtcttagtttagctttttgaccagatttaacatttttgtggtcacaaagctcttgttgagaaaaatattatatcaagataacgaagtaacccaactcgtcgaagttcatactgtaattaccggcccaggcccataatattattgtaaaaagtaaaaacattggggttttcagttcaatatacttttgcctgcactcaatctcatagaaacataatactacgaggaccaaattgtaaattagagaaggaagccgaaaggtcagtggaaaagtactacttgtctttgtttaacttccacagaattgacatcattttatgattttcagac

SEQ ID NO: 9449 - DNA, 3000 bp, Unknown
  misc_feature (1)..( 3000): cDNA_ID_2110032_gDNA_ID_1972121_Annot_ID_178982 3000 nt of promoter + ATG
ttttagtatgatattgtcctctttgggtctacatgttcaagccctcaagaatttgttattgggttacttcccaaaatgcctcatactagttggagttggacttgacttatatattagaaactctttttcttaacttccgatgtgggacctttggtttatacccaacaatcaaaatacgaattagttacgaattataaagtataaaaacgtaattaaactcagatgaatgaaaatccccaaactcagctttcctcttacggaaataaacgaattttcatgtaactaccacattgctcgatgtttattttgatcgcgtacaagggaaaaaataaaaatttgaaaaatgggggatttgaagtatttttccaatcccttattttactcgtctaataaataagaaatgtttcgctttatcccttaaatgtttacataaatctattgatatttagtgatttgagtatcagcattcagcattattgataactaaagtgggaaaaatgctcataccaaattacaaatgtggtaaaataaagaatttgtgttcttgctctaccgaattaaagaaaataaaaattattattctttaaacaagagaattttgctgcataagaccaaggaaattgtgtccgcgtgtaagaattgttgatcttacgtggtttgtctccagtcgattttaaggttttgccttgatcctagtgtttcttgctctctccgattagttggtgaggtgtgttggtagttgtatttggtttttggtcgcgttggattcttgctttcctccctgtcggtttgctattggtttgtcgtcggtgtgaggtttctccggacttattggtgcttttggtatttacaggttctatagggatgctttgtgaaagtctctcatgcctttgttcaattctagtgcttagattgttttttctccattaattttgtatcttctttcgatttctgtctctatatttggttttaatcagttttgctatattttggagtttagtttccctcttttgggcaaatgtttcagggttattgtgagaaaaaacaaagaaacagtgattattttgacggagatcgagagagagttaggagaaatattaaaaacaatcggagaaagccgaaaagaacgacgagatattgttttctttttcctaaattattctttaagaaaaagggcgtgacggggacgatatcactgagcaatcaaaggggtgatttataaatctaagtgacggcgatttagttgtttgataagttctttgattgctgatttggaagattttcttttaaagttaatccacatggcaaaaatattattattagaagaagataaaatattcattaatttttatagattttctgatatttttagctaaaacaattctaaatttatataatatttacgagtttaaaaaaagcatttacatacataacttaattatcaaggaaaaatattaatagttagagatatcaatgttacaaagttatcagaacgcacaaaaatatacagaaagaaggtcaatatgataaatcaaattcagaaaacgtaataacaaaaaatatccaattaaaataactaaattaatatgaggttaggtagcaaacgtctaaattacaacacaagtaaatttttagccattatggattaatgactattgataaaaaaaaaagtaaaaaaaataagtagaatagaatgaaagtagtgcttggtacattattatgattttttatttagtgaatgttttcagaaaaatttatttaagagtaagattaatggagaatttaacacaacaatttttttttgacttttttttcaattagtttgctagttttttaatttaattaatgtagaatgacacatatcattatttttatgataatatgtcactcatatgagtgtttgacaattttcatatatataatttcaactaataataatttagattaaaaaaaaacaaggaattcaatgccaagaatatcatataaaatatataggaaaagtattaaatttggttgacttttcattttagtcacaaacttttattaatcaacccgatttagactcgtcataaaatattttgatgaaacgcattaacgaggttaactatgtgttacttattatcagttatctccataatcaatctgctgataaatcaacacaatttattttaaaaattttagtcaacaaaaatactgatttaaagtatctaaaggaaaagttaatgtcttttcaaccaaattatttgttaaaaaatacatattttctaaaataatatgttttgctaataaataaaaagcaatttaaaccgaccgaatgatatttacttttgtactaatttggtttctattttcatcataaaccaaattttaataaaaaaaaattttttaaaaaaaacctatgaaacaataacgccggattggaaatagtgtttttttttgggatttttttaaattaacaatttgctctaatttctttatttaaaaaacgcagaaaaaaataataagataaaaagaaaagtgagcacgtagttgtcatttgcagatattatcatttgccaattttcttgtaaattcacctctttccttcgtctatctatcctcccttccgcaacattgtaagaacaccaaatcccctctcatttccaattttttgtatatcttcttgtttcatatttagatcatccaatctctaagaatgttaaaggtcaaattttaaaatttttttgtcggtttttttttcctctccggtgtcggaatccgacaacgtaaggatgattcacataggtttttaatttttgatatgaaaagagattcttctcgtgattggcccatttgttttgttttcaacaatgttcacgttttgatcgcaaatttaatttgatttccatgataaaaattggaactttcttatgttgtgatcatttacaacaatttgtgcgtgatgggttgttctcaatgtaggattttgtttgatgatcgttgggttttgaaagaagagca

SEQ ID NO: 9450 - DNA, 3000 bp, Unknown; identical to SEQ ID NO: 9320
  misc_feature (1)..( 3000): cDNA_ID_2035097_gDNA_ID_1972121_Annot_ID_178988 3000 nt of promoter + ATG

SEQ ID NO: 9451 - DNA, 3000 bp, Unknown; identical to SEQ ID NO: 9306
  misc_feature (1)..( 3000): cDNA_ID_2035053_gDNA_ID_1972121_Annot_ID_178999 3000 nt of promoter + ATG

SEQ ID NO: 9452 - DNA, 3000 bp, Unknown; identical to SEQ ID NO: 9307
  misc_feature (1)..( 3000): cDNA_ID_1396277_gDNA_ID_1972121_Annot_ID_179001 3000 nt of promoter + ATG

SEQ ID NO: 9453 - DNA, 3000 bp, Unknown; identical to SEQ ID NO: 9308
  misc_feature (1)..( 3000): cDNA_ID_2035028_gDNA_ID_1972121_Annot_ID_179004 3000 nt of promoter + ATG

SEQ ID NO: 9454 - DNA, 3000 bp, Unknown
  misc_feature (1)..( 3000): cDNA_ID_3041184_gDNA_ID_1972121_Annot_ID_179012 3000 nt of promoter + ATG
gatcttgctgctgctggtatccaaaatttatcagatttggtaacatcaaactcctcaagaattctttcctttcttggtttctttaaaaaaaatcatcaagaatatgtttcttgattcattctttttttctacaactttcccactctttaaacattatttagcttcatgatttttctacgcagagtgatgatgattccaagaatcaaatgctaagaaagaaagagttgttgcttcaaaacatagaccatgcagtgaatctattcctcatctacgttttgacattatccatttttcctggattcttatacgaaaacacgggacaacacggactaggtgattggtatgcacttatcctagtagcgacatacaatttttgggatttgttcgggaggtacgcaccgctggtgaaatggctgaagcttgagaatagaaaggccctaacgattgcggtcttgacccgttatttcctcgttccggcattctatttcactgcaaaatatggtgataaaggatggatgattatgctcgtttctattttgggattaactactggacatctcactgtttgcattatgactatagcccctaacgggtacaaggtaatctatctactctccctatgctgttaaccaaattaatttgaatatatctagaaacttagattagttcatatttagaaaacaaaacacattatctttacaatttttttgtgttataccctttgcttttacgatttgaaaatataacacaagttttttttgacatataaatacaaacactataataaacaaacgacctctaccttcatatttaatctgattttgtattttgtgaagggtccggagaagaatgcattagggaatttgctggtggtttttattttaggaggagcagttgtaggaatttctttgggttggttatggcttattggcaagaaatatgctttctgagttctcatcattttgtgcaattaattccgatgaatctgactctttatggcaaaaaatgagaagcttggtgcctcgctcgaacctaactgtttattcatgaaaaaagaagaagaagagaatactaacacgtaaaactttcgaaagcttgaagtgatgaattcttatttcgatgcttcaccaaattataaaatttcactttttcaactccacaatttgctgtatctattttagttaatattttagacccatttgatcattttattaactattttctaaaatcttatatggtgttatttaaccatagatttttatagaaactaaatcctaacagtctacttttgtttgatcactgattataattttatgcattaaagtttagcattgttccatcagatatttgtaaaacaaaattaatagcaaaataaagtcattcatttaagctagtaacggacggttttcttcgagagaaaaccagtccggagtagaagagcttacatgggaaaacatagaacctcgtgctcttttcttcttagcaagacaatcagcagagacattgtttaagtatgtaataaaagataaagaaaaacgagaaaaactaggctttgaagcattaaaatcttttcactccgaagaaaaagcggactactcatcaggagtgttcaaaagttgtgtcgactccttactatctgtctataaaataatgtcgaaaatggataaaaatataagaaatcgtattgcccataagagagcctcaacagatatttgtaaattatatttaagagttttaaaatttggtcttattaaccaagtgttcatggccaagtgctttcgtcatgttggtccagactagagaacacttcttttaatcatgaaaacttaactcattgtttcctttatgtaaacattttaaagtggcaaaagttttttcttaggtatctacaaatattgagaactagtttcggttacgatccaaaaaagaagtaggtgttatttagttaagattttaaatattttgctaaaataagatttcaggcattttcgtgtaatttacaaatacaaaatgtagtgtgtaatttagacccatatttcctttcaaactaaccgatcaaaacattgatcacaaaatccttgtgtgcaactaattccccaaaaaagaagaggagaatactaacacgtaataatcaatttgaggtgaagtgtttatttatttattttgctaaatatttgaggtgaagtgttattttgataaatgcttcacttatcctttttcttttttacaacaaaattagttcatccatttaaattagaaacggatgattttttttaggagaaaaccagttcataataaaagattttatatgaaaaaaagataaaactttgtgctttttctttttcggcgaggcaattaataccaatattgtttaaacgtaaaataaaaagataaagaaaaacgataaaagttaggttttaaaatattaaaattttataattctagaaatgtccaaaaactaagtcaactacttcaaatgcttcacttatccaacttcaccgattctcatcgagtctatttcatacatagtttttattttcatttattacgtttagaccgatctcacagatatgtggatatttaatgattaaggattttaaagaaagttttgctttcatactatatcgtcaacaagttgtctaaaaataggaacataaaaaaagctttcacactttgaattctttaaattctataatcttttctttttctttttgagtcttactttatcctttcatatttgctgtcacaccttgaaaaggtctattattttactcgctcatctcctctttttaagaatcttgttttgaatcttcatgaaagctttgctcgttaaaaaatcaacaaactcgttgactctgcaaaaccctcatgtgctaagtttcaagtaagtatctctagctcctttatttgctccccagcaaaaaaaaaggaacatagcatcatcttgtgtttgatccaattcttgaatcttgaaaacaggtttatgttcttttgagctca

SEQ ID NO: 9455 - DNA, 3000 bp, Unknown; identical to SEQ ID NO: 9317
  misc_feature (1)..( 3000): cDNA_ID_2182840_gDNA_ID_1972121_Annot_ID_179003 3000 nt of promoter + ATG

SEQ ID NO: 9456 - DNA, 3000 bp, Unknown; identical to SEQ ID NO: 9318
  misc_feature (1)..( 3000): cDNA_ID_2035049_gDNA_ID_1972121_Annot_ID_179000 3000 nt of promoter + ATG

SEQ ID NO: 9457 - DNA, 3000 bp, Unknown; identical to SEQ ID NO: 9305
  misc_feature (1)..( 3000): cDNA_ID_3041196_gDNA_ID_1972121_Annot_ID_178990 3000 nt of promoter + ATG

SEQ ID NO: 9458 - DNA, 3000 bp, Unknown
  misc_feature (1)..( 3000): cDNA_ID_3088384_gDNA_ID_1972121_Annot_ID_178987 3000 nt of promoter + ATG
atgtaacaagaatgatacacaaaacattctttgaataagttcgctatgaagaagggaacttatccggtcctagatcatcagttcatacaaacctccatagagttcaacatcttaaacaagaatatcctgatctgaagaatgtggaggctttagtcccttggatacttgggaggctgtggaagaacagaaacgagctggtgcttaaagggagggaatttggaaccaatgaggtattagtaaggacacaagaagatgcagatgagtggattagaaggaaagaggctcagaatgtaaggaaagcaccaaccacaacaccgtcgggacagacgagaaacatgggaagctccaccacaatcttgggttaagtgcaactttgatggggcatggccaacagaaggattaaaatgtggcttagggtgggtgcttcgcgatcatacagggaaggtgttatggttaggtgcaagagctgtggtaaaagtaagaagcgtgctggaagtagaagtggaggctcttagatgggctgtgctgtcattatcccgattcaattataggaagatcatttttgaggtggattctcagcaacttgtgtctttggttacatgaaagttatgcttgtcaagtctcaatccaattatccaagacataaagtatctacttagcaagtttgaggattttatgcttgtgcatacaagccgagaaggaaatggagtggcagatagaatagctaaggaatctctttcttttgagaattatgatctaaagttgtattctattgtaccaatttgggttaaaagctctgttgagctagactgtgtatccataaatgggtgaatggaaagtttgttgttgagccaaaaaaaaaaaaaaaaaaatcatcagttcatcatattggtagtcttgtttgataagttctgctttttttaccttccagttttgccatttgatgttgcaatgagatttcttttgctaatgttttaaaataacaaagttgttgctgctagtgtttccaagttgtgtttgctgaaattagggtttgtaacttataagagaagcttgatcgctgctttcgactaaagggaattcaataacaacaagtttacttgaagaaaaatattaaaacctagaagaaaagagttacacctacaaataggataaaatccacataaatttctgttactaaatgtatcatagttttgtttcttctatgtatctacatatactcaaaaatttcaaagcattgtgacttaagggccagaagaaaacttgaagaaagattaaaacctattagcaaagagttaaagatccacataactttctgttgctgaatgtatcatagtttttggtttcttctgtgtcatatatacagactttctacagaactttttgagcacaaagcattgtgactttagagccacgagtaaaagacgaggcaaaatgtgtatcacgtccactaaccatataaactgtttcggctggaagaacacggttccactcgaatgactgatcttcgttcaatactctctctttctttctgtccacaaagaaatatccttcgtgaggcattcttatatgacccctccgaccactttcaaccaactcggttctcagtattttcacttgatccgtcgagttcacatccacctcaataaatctcttcagacctttacactcacttgaagctgccaccacatatactttaatcttcttcttcgggtcagtgatctctttgactgagtttgacgctggagattgctccatttgaggcacttgaaccgtcacagacgaatcttgaatcttactggtctcttggataacacgtctgggaacaatcacaattgtatccaagggtttaacactgttacactcgtatgactgatcttcgttcaatacttgattattgtgcgtaaagatgtacccttcttgagccagtttcataagacctctcagtgttttcacctcatccgtaactttcacttgcaccagaatattcgttgggacttcattcataccaggatatggcgacacatatactagcatctgccggactcttttttttccgttagtgatctttttgactaagtttgactgtggaaattgcttcgttggaggcacttgatcgttgttgttcttactcgcaaacttcacagacgaatcttgaatgttaacggtctctttgactgagtttgacggtggagattcctctgtttgatgcgcatcttgaatcttactgatgtcttgggttgtctcaggccgataactgtaaatctttctgatctcttcctctgtcaaaggccaatcttgctccgcaaagtactcttcaactgaaatccacggtgctggaggagattgctctgtttgcgggatttgatcgtcgttgttgtgaatagggttcacgtcaggagagacttcgagttggatttgagaatcgtggaagatctggcattggtcgaggttaagatcttctcgaagaataaaaatgccgtcgacgataagggtttgtttcgaaactgggacacgttgagacttctcgatcttctgtttgaccactaacaatgtatctgtgcgttccacttcaatctcgaacgatgaaccacccagaatctcgaccacaaacttcatgactctatcaatggtgtttcaagatcaatggagactaatgaagaagagagtcaagaaacagagagagcgagagagaaagtgattgttttgtaaagatagttcacgatagaatttggttttaatatcattcattcacatatcaaatgaaccgcatttgggcttgacccatttttattgggttacgtggctcttaagtcaatgaaagcctcacataaaatcatcagtatctatgctacagtatattcttacttatattatccaacggtaatgttataaaaagattgattaaaactatctagatccgacccattaaaccgtaaatctacaaatccgacccattaaagattcttgccggagacgaaaggtattccgattgaggag

SEQ ID NO: 9459 - DNA, 3000 bp, Unknown
  misc_feature (1)..( 3000): cDNA_ID_2182795_gDNA_ID_1972121_Annot_ID_178971 3000 nt of promoter + ATG
ttccaaatcgagtttcctgccatgtcgatttcacaaaacacgatcagttttgagattagcaatcacacagacaagaggacaaagatagaaaaaaagaagagggaagagaacataagagatgatcacatacctgtccaacaccggcaatcagaaatttacccgattttgcaaaagccaaagagttgacaaatccagtctgtaagatcaaacaaggcattgcaaggattattacttggtgaagtgaaatgcattaatcacagtcacaaacaacagattcatcagacaacactaaggaatataactagtgaacgaaaatttaccagtggaagctcgtacaaaggtcgaattgcattagtttcaacagcccacaaacgcacaaaaccattaccagctccagatgcagcaagatcactgcctctactagtagcaactgcattgacccaagaatttgctgaacagttattgttgactggttcatgatcaccgttttctgttaagcaaataaataagaattagatatttcagagcatcagtagctgcaacgaaacaaaagtgttttataactatatactgcaatgtcaagatccaactgcaacagagatgaaatggggaggatctaaattaggtttcacctaagattccattggtggtaatcccatcaggtatatcttgatgtgcattcttgaaaacgaacaccggtttcttttttaacatgccccaaagagcaacagttccattatccgaaccagacaggtactcattatcactgatgaaacagcagctctcaagagacgatgcaggagctcgatagatcatacgggtgctctcaggcacctataatcatataacaagacttacaaatacagaataataatagaaaccttatgatgatatcttccaacagtgtttacatggaggatagaactattaccttatgatacagcatggttctatctcttccaaccgtaagtgcacgctccttcctcagtgcatcaatggctagaatttcaccctggtgtccatgattttcagttataaatgctttatcttctacgttccacaccttcacagttctatcaaatgaaccagaatagagttctgaagttccgtatctgaaacatagacaagaaactgtgttccggtgacctggaaaggcctgtagacacataattgtaatacctgagcgcaagacttgatgaagaacaaataaaaaaaacactaaacaaaaaccaaatttattatcattacctggacatgctctcgggtacgaacatcccaaatatgaacatgacggtcaactcctccagtggccaaataacgaccatcagagctaacagctaaagcaagagattctctactgtgatttttgttacgaggctccctcaatttcatcccatgcgacttgagaatttcatcacttggccatatgtatttgtcagttttaccagaagatacatcccaatgcataatagtaccatcttttgaagctgaaaatcctctagaatcgtcatccgataaagctaccgacacaacagatcgtcggtgcttgacaataacactaaacccatcagtacttagtggctcctgaaccctgaatcattgaaaaactttaatcaatactactatcaaccaatcttcaaagatatcaaattgacctaagaaatgtacaaaatcactaagtttcttcacaattaaaccagctccctaaaacactaactacccacaaaccctaaattaccaacaatctcaaacctaaactatctaatttgaatacattgaggtactaaatttcttccttacctcgatgcaataagtcttcgaatcctaccactatcctcctgctgcttctgcatcaaactcttcttaatagtctcatcgtcatcttcatcatcatcatcatcattatccgcttcctcacgctctctcctcatcgcttccctccttctattcagcatctcctccgccaatctcttccgcttctctcccgccgtctcatcagcaaactcatcttcatcctccacttccccatcaactcttctcccatcttcatctccgccagtaaatccgttctcttccgcatcagagtccacagactcgatatcgtcgtcatcgtaactgacttttctccgtttcttcggctcttcctcaaaaaatggatccctttcattcgaaccctttttacctcctctcttaaagcttcctcctttcttcttctcgttgttgtacttcattcttctctctctcactccctcttagggtttaacgattttacactttgactcgtctaggtttagcctcagggtttagtggcgacggaagaagctggaaaacgattttgtttatttggtcggaaagtttacaactttaaaccttccactaggttttcttcaggaatcgggtctaccgggttgacccggactaaccaagcccatgacttacctggtctatggtttgagcccattaactatttcgttcttttaaagcagaaacttgggcctttaatttgtagagccgaagactaaccggaccgtcaatttaagtttggttcaatccgatttctgaatttttggttctgatttctgaagagtagtacgtaaaccgaattgggagattctcttatttcagtaacagtttaatacagtttttgtttagtgttttcaatttcggtattttttacaaactcgaatcggatgattccggtttaataaaatcaaatgagttcggtttagctgaatttaaaactgtttttaatcttatagtataccgaaccggaccatccatctaatttcaattgtctaccaaaaccgaccgaccagtctttgtcgaaagttgtctttcttcttccttgttcgattttcgcctcctttggcttttcattctctctctaacttctctatgttaaaattccgaaagctcgattcagaaatctagaagcttcctcgagggccctcgcgtagaaagtcgaactcaaattccctggagacaaagaagaggaagatg

SEQ ID NO: 9460 - DNA, 3000 bp, Unknown
  misc_feature (1)..( 3000): cDNA_ID_2182799_gDNA_ID_1972121_Annot_ID_178972 3000 nt of promoter + ATG
actccacaagagttctttctaatgtgaactctggaaagacttatgcatgcccagataacaaagttaaatgcatgtacaaaattcttcgtagcacaggcatgttaagatatttgcaatacctgatatagtactgcaatagtgggctttgcacatccaaacagaaacttgatatccagaacctgcaattcctcaagcctgaaatttagacaccacactcagtacatcatcattcagttttaaatatccccagaaaaatcatatcgtagtgattctagaggaatgagtatattgaggattaaacagtttatttacgaaagaatctgatgcctggaaacaaatgcacactagaattaaagagtacctgatattaaaagcttccttgagctgtcccttattatcaaatggaataacctaaaagaaaaaccaaggaaatagaacgcatcatcatacatgtataaacagatagattagtggaagttcagtaacatgatatatttaagtaaacaagcacatctgtcaaagtttttatagaaggtaacattataccttgaacaagccgtcatacagatggagtccaattaatctacaatctggatcaattataccaatctacaaagcaattgtcaaatcagaggtaagctacatgcccaccaaacccttaatgacaacgcatattttttgatgaaggaaagtaaatatataagcactctgaaatgcacagtcaagacgacgatattcaatacctgaccattgtctgttggccggcctatacgatcagaaacatcccccattgctctgaaaaaagtcaaaacatcatacagaatcagctgtaaagtagaaaatggtcatctgatatattgcttccaataataaccagtaagatgcaacaattacgccagcaccatacatgattttttccatgctttggatatacagcaatgtatcaattttgtgaaaggtgagaacctataatcaaactctcataaaaaatgcttaatcagaaataggttatagatcagattttgtaaagcaggaatatgctgtaaacagctatctaaaacaggcaagttggtaccatgcactaatctgtacataggtgacgagtgtaatacatttatttctaacaaaaaaatgataagataacggcgaacatgatcatgaactaaaagaaaaatagcacaactggttggttaacatcaactggatgcatggaaaaaaatttatcttttggaagctataccttgtaataagctcagaggactcaggatcccattgaagaacacagaatttgtatctctcagttgcaatgaacaaaaagtcttgcgcttcgccctacaaaagacggtggacaatactatcaacattttaactcattattaagaccatgacaaaagaacacaataagagatatatactcacatggggtcggaacaactccagagtagcgattcttccatatataggaacgtccaacataggctgcaatataggaacatccagcagattcttatattactaacaaaacaaagcatgacaacaaagtttttgaactttatactctaatgtacatggaacttaatccatataagcttgacagaatagagatgtatgtacctgaagtccttgtggggtaagcaaatggatctcgattcgagtacatttcctgagaacagatcaacactgctgtcaaactaatctactaatggatctgatagatgttacaatttaaggggacaatgctaaatcggataaatgagataactttcaaacaaatttacagtactgatagctaacgataattgaaaatcctccatatcaaaaaaggcacgatcttcaaatgtaatttagttcaggaagtaaaagccataccaaaaaaaacacaattctttgtcacagtttcaaaaaatccacctcatcaaagaacccagaggcattaaaatccttatagtcatctcccaaactgaaattgaactacaattttgtttgcaaagtgggtaaatttatgaaaattaactcgtgatgggaaattcattgaaaaccctaaacccaaatcaacagctgcaattcaaaaggggactaattgacaaacaaaaattgataacaaatagaggtagggggagagtttcgtacgcgacaatgagattgagctcttgaggacttgtgaagttgccaacgcacgagtgagtgacactggtcggtttgtgagccgtaacaacgtagttccatgagctcatcttcctcttctttgtctccagggaatttgagttcgactttctacgcgagggccctcgaggaagcttctagatttctgaatcgagctttcggaattttaacatagagaagttagagagagaatgaaaagccaaaggaggcgaaaatcgaacaaggaagaagaaagacaactttcgacaaagactggtcggtcggttttggtagacaattgaaattagatggatggtccggttcggtatactataagattaaaaacagttttaaattcagctaaaccgaactcatttgattttattaaaccggaatcatccgattcgagtttgtaaaaaataccgaaattgaaaacactaaacaaaaactgtattaaactgttactgaaataagagaatctcccaattcggtttacgtactactcttcagaaatcagaaccaaaaattcagaaatcggattgaaccaaacttaaattgacggtccggttagtcttcggctctacaaattaaaggcccaagtttctgctttaaaagaacgaaatagttaatgggctcaaaccatagaccaggtaagtcatgggcttggttagtccgggtcaacccggtagacccgattcctgaagaaaacctagtggaaggtttaaagttgtaaactttccgaccaaataaacaaaatcgttttccagcttcttccgtcgccactaaaccctgaggctaaacctagacgagtcaaagtgtaaaatcgttaaaccctaagagggagtgagagagagaaga

SEQ ID NO: 9461 - DNA, 1204 bp, Unknown
  misc_feature (1)..( 1204): cDNA_ID_2182627_gDNA_ID_1972122_Annot_ID_179023 3000 nt of promoter + ATG
aagcttgtcagtgttgtatccacggataatctcgcaatttttatcaaaagtttgatcatcacaaaattttggtaatcagtctcctttgattttacttgttgaaatgaaaacatgcaacaaacagtttatgagagtattgttgattcaagtaaatcagttttgaataaaactgtactcagattattgctgctaaagtatatgattcatgaaatctgaaattttgaattagttcagtgtttaggctcaatatcaaatattcgttttcgccatttgctcattcattgtgaagatcaaggagagaaacatttggcctgcttgaaacatcacatcaaaatttgaaaaccaacaaaattgaaaagattatgatgtccaagaccaagaccaaaatgaattttggtcaaacatgagtcaaacatgattttttttctttttctttttctttcatcaatgtgtttttagtcgttatctttaatattgctttttcctaactctccttctattggcgcatttattttttctgaatcctaattcattttttttttgttcttaaattaattccaatttccaagtcctcttcatctttattgctttttttattccctaactcttgttttattggcatagaaattttcttcggatcctcctcactgtctctctatactccactcttcatcaagcgttgggtcatcgccgtcttccctttccttccctctctaacgtaagctccagatttcttctattctctgttttctcattgaaatccctagtaatgattttctctattctctgggcatttcgtgcttcaatgcctttactcacttcttctttaagaaaatattttggatttctctatgttccttatcatgcatgcgacatgcgtgaatctcttagctgagttttgtaaatgctgtatcaatttcgtctcttttgctttctctagtttattttttccttaagttcttccctagggtttctcttgctctgaagatttccatactatcgactcagtttgctagaaattgagtctcttttgggctttaaactttgctgcatgaactatctgatgtgacagactcattttaactctaaaaagtttttcgatttcttagagattctatttagcttgtttggtgaatgcatcatcctcttggttgctatttttcatttgttatcattcttttctccaggtaaagcaggtaggatg

SEQ ID NO: 9462 - DNA, 3000 bp, Unknown
  misc_feature (1)..( 3000): cDNA_ID_3042012_gDNA_ID_1972122_Annot_ID_179041 3000 nt of promoter + ATG
tcttgcacaacaaagccctgtttaacaagtatatacatagtttcagacatgtttagaacaatgaaagcacaagaatcttggtaatagccgtgtttttacctgttgggcaaagtagaccaagaggaagcaggggcagcttcagaatccgaaaactcccacactttcaacgaacttgaatgctctgaatcaacactagtccaagttttcattccgaaactactcttatcaacctcactgttcttctgcatacacgcttgcagtgatgactgcttcagagctgttcgaccaccagttgagaaagatttgaaatttgtaacttccgttggaaacccagagttacccttcatcgattgagacttcaaagctcgatctagtttccgagtttccacagaggtagagactttctccggcgacacattctccttatcctctcccttttgagtggataaagaccctgtaattgtgtccacatttcccttattttcctccaacaaatcattcacttttctcgaaccagccatgttttttttccctttctggatggattgctttcaagtatcaagtttagaactttctgggagctaagtttatatctttatagattttgaagacatgaatctagaaacaggtgtttgacaatggtactgagttgaaagtaacgtttttataaagtcccacagtgtttccatttgaatttgaatagccattggggattgtgcgagcacagaaccaaagacacagatggacttttcttttcttgtcttaaacacaaaggttttttagatgtctgcgtttggtttttgccctttttctactttctacggacccaacggtcaatacacgatagtgggattttgattaatattttgtcgttttcctttgtcgggaaactgaaaggttgatgattggattgaggtttagcgggaactgtgtttcaaacactcaaacacttaaagtatcaacaacctgccgttttttatatttatcaacgtcatgccgttttatcttcgtgagtcatccaaaaccgataagccagagcctcaaaccatcgagtggctgttaaaccatactgttcaaattagtccaaccaaaaccatgagaggccacaacatcgtcgaagcccattattatcaccatggctaaagccagtagtactctgtttgctgtttcctgctccgcttcagctcgtttctctttcctccgacgctctgaatctcttaaaccctcagtttcaagagcgagattcgccgttccaatggctatggccgccgcgtcagctgccaccgctaaaaaactagcgcctgctgtgattgtgggtggcggaagagtcggaagggcgttacaggaaatgggtaatggcgaggatttgttggtgaagagaggagaagcagttccggttgattttgaaggacccattttggtttgtacaagaaatgatgatctcgatgctgttcttgaagctactcctcagtctagatggaaaggtagaaactttcataggccctaagaatcattagtgagccaaattgttagatgttttagggcgtttgatcatcgcagagcacaattcaaatgatcagattatcaaattttgattgtttcttcagtttatgacttggtatagtaaaaacgttgtgtgtaattaatcagatttggtcttcttccaaaatggaatgatggagccgtggtttgagagcaaaggtttgggtgatacagaccaagtgttggcctattttgctgtgtcaaagctcggcgagcctcccgtggatggaaagactgacactaacccagaaggtcttactgctgcttatggaaaatgggcttcagagatagctgcaagattgcaatctggtggcctctcttgcaaggttacaagaagcaaatctttgttttatgataacgcagaagctgcatggatatactaaatgtgttcttttgtcggtgtttctgtggttaggtacttgacaaagaagcttttcagaagcaaatgttggagaaactcatttggatttgtgcatttatgcttgttggagctcgtcatccaggtgcaagtgttggcacggtggagaaagaatacagagatgaagtaccgaaattccattcctcgtttcgttttagcattcaaaatcgttgtttagtgctaattacttatacattcaggtgtcgagactcatccaagaacttgcagcagctgctgccgcggaaaaaggactaacctttgaagagaacatggtggaaagactatgtgcttattcacgagctgtttctcatttcccaactgctgttaaagaagtacatatatcacttttatcatccttgatctctctctttcaatgcatgtgcatgtgcatcagtatctgtttcacaactagttttctgattattgcagtttaaatggaggaatggttggttttattcactctcagagaaggcgattgcggaagggcaaccggatccgtgtcccctccataccgaatggctgaaagagcttaaagtgatatagagccagtctttctaaattgtgagtatctggattaagtatcattcttacatattttaagtagatgatctgaaactagtgtcaactgtgtacacgcctgagaagtgaaaaaaagatgtaattttttaataaagaaagagaatcagttcacgctttgtaaaatgtccagacttttatatgtgtaaacttgtgcattttcaagaatcaaaacttttctgcttctagactcccatcaattagggaagactagaatcttcaataataaacaaattatgacagatacctatgtagactctttggaatcatcaatagttgacaaagtaagaggcaggatcgtccacgcttgtttgaattttcagcctttgcaggcaaggtggtccaagtaggcaactgtggtttcttcggttagttactatataacacataattctatattagctttagctttagcttcacataacataactcagttttctacaaagaaaaaaaaacagagcata

SEQ ID NO: 9463 - DNA, 3000 bp, Unknown
  misc_feature (1)..( 3000): cDNA_ID_4283152_gDNA_ID_1972122_Annot_ID_179040 3000 nt of promoter + ATG
ctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaaaatcaacattgacacatcgattattctttcttgtgacaatcttatataataaagtttgaatctttttaacagttgtccactttcagtttcctctgatggtgaatttgatttgagaggtactgaggtagtttgtgaaactcagatagaggaattgtttatgtagaaaagtaaggtatacagatgatgatcattggagggatgttcagagattgaactcgtccgtttattaatgatcaaacagtacaacaaagcttggaatcaatagaagccaagcaaatgcagaatgcttggtagcctgagaatggatacctgcaaacagataaagcaaaagacttttagatgataaagcctttaatcctaagcttataagtatgtttatgtttggctcattctggtttgagcaagtagtacctgaagtcgattacatatcttgctttgtcaactctccccatttgaagaattgtctgccttggagtctcctgcttataccaaattacacaatgtttaggattcttgagattggtttttgatcaaagctttaaagttgtggaaatgcaccgtgagtgttagctgaaagttcttcaccgagctctgtattctcagtcctgttcttcctctgtctctgaagtctaactcatgctgcttggagatctaaagaaaggggaagacacaatgaatttcatgctttacaaaatcaacaatgatgcccggtgagacttactttgttgtaatgtggtatccttgagcatagcttctgaattttttccttattctcaagccaatcaagcggtagtttactagcttgttgaacctataaggagatacatacatacgtgtattaacagttttatgttttcggaatgcaagattgatggagagaagtttaagattaggcatttacctgcttattgttgtttttctgcattggctgctgctttggtagcaaagttctcattcttctgtagctccctgtccaagttgttatggtgggtgtgaatctgcagaagccaacagatgcataagcaaacccaaaactaaggcagaggcaaattcatcaaaaaacacggcattcaaaatcctcaacgcttacattacaaccgaaagaagcggcttcaccattttacctacagaaccaactcgaactccctgcaatggaatcaaaagaccagaaacattcatactcgatttccaacctataagcagaaccaacaccgttacattgagcttgaatttctgaccttgtcccatatgtagtacttggaacccaagagattagccgtcatggaaccgacataactttcatccgaactgcacagcaatcccttaacattctgtgccaccctaaatatagatttcccattacgtcggctatggtaagcaactgctaacttccggtctttacgcccccgaccttcctgagatatcagaaacattgatatcactacatctcaattctcactcagcatcatggtaaatcgaatatctatatacttacatgtgtataaagtgaatatacagatccgtggctcaagccttcaggtgattgttctttcacaatcagacaagtgcatcttcccacatccaaaggtagtgtcttgcacaacaaagccctgtttaacaagtatatacatagtttcagacatgtttagaacaatgaaagcacaagaatcttggtaatagccgtgtttttacctgttgggcaaagtagaccaagaggaagcaggggcagcttcagaatccgaaaactcccacactttcaacgaacttgaatgctctgaatcaacactagtccaagttttcattccgaaactactcttatcaacctcactgttcttctgcatacacgcttgcagtgatgactgcttcagagctgttcgaccaccagttgagaaagatttgaaatttgtaacttccgttggaaacccagagttacccttcatcgattgagacttcaaagctcgatctagtttccgagtttccacagaggtagagactttctccggcgacacattctccttatcctctcccttttgagtggataaagaccctgtaattgtgtccacatttcccttattttcctccaacaaatcattcacttttctcgaaccagccatgttttttttccctttctggatggattgctttcaagtatcaagtttagaactttctgggagctaagtttatatctttatagattttgaagacatgaatctagaaacaggtgtttgacaatggtactgagttgaaagtaacgtttttataaagtcccacagtgtttccatttgaatttgaatagccattggggattgtgcgagcacagaaccaaagacacagatggacttttcttttcttgtcttaaacacaaaggttttttagatgtctgcgtttggtttttgccctttttctactttctacggacccaacggtcaatacacgatagtgggattttgattaatattttgtcgttttcctttgtcgggaaactgaaaggttgatgattggattgaggtttagcgggaactgtgtttcaaacactcaaacacttaaagtatcaacaacctgccgttttttatatttatcaacgtcatgccgttttatcttcgtgagtcatccaaaaccgataagccagagcctcaaaccatcgagtggctgttaaaccatactgttcaaattagtccaaccaaaaccatgagaggccacaacatcgtcgaagcccattattatcacc

SEQ ID NO: 9464 - DNA, 3000 bp, Unknown
  misc_feature (1)..( 3000): cDNA_ID_2109039_gDNA_ID_1972122_Annot_ID_179050 3000 nt of promoter + ATG
ctgacaagagcgatgtttatagtttcggggttgtcctggtagagctcataactggagaaaaaccgttgtcccgaattcgttctgaggaaggaagggggttggcaactcatttcctcgaggccatgaaagaaaacagagtgattgacatcattgatattcggatcaaagaagaaagcaagcttgaccaactgatggcagtggcgaaactcgctcgaaagtgtcttagccggaaagggattaaaagaccaaacatgagagaggcttcactcgagctggagaggatccgttcatcacctgaagatttagaggcccatattgaaaatgatgatgaagaggaccaagtcatggagatcagcagagaatgattctggaagcgtgtacaagaatatttcagcctttatgtaatgtatatggtgacaagaaaatcaataagatcactcggcagcaagtcatccatctttagccacaaagtgtatttgaaattcgaagttaacatgtacttttgaaaatgaagtgtggacttttggtgtgacttgaatgtattatttgatgactggaaaaacttacttgtctaggagtcaacgatgtgtcagaaaatgtttgacttcaagcattatggtttcagtttcagagtctcgacctgtgtaggtagtagaagttatatcccgctgctatcatcattccgctggtaagaattcccaaatatacagaaacgcatgagctctaataagagcgcctaatagaggcttgacatacaaccggaggtgacgatccgactcaaaacagtgcacatgtatactctcatctcatctgatgaaataaagttatctttcaattatgaatctctggttttatttcaccatgtaataatacacacaaattgcattatagaataaagaagaaaaagaatgttttagtacaagaacaataaatgtgggggtttcaaactttcaccgatagataaacagtctagaagaatttaagtttccctttggagagagcttgaacaagttgtaattgacacattgccttgtctttcccggtcaagccatagcaggacgagtgcctagcgcctaaagtgactgcaaagtaaagataaacagtacagaggaaagccaaaagagccaaagctgttaagagatattgatgcctctgaataagagtcgaccagctacccaactcgtcccactgcttctttagacattgttgtctccttgacggtgaagatacaagcccatcaagaaccatggctttataataccaattaacctgcaaaaattgacacacaagtcgttttaacacaattttacaagaaacataaacatgctatgaaaaggagatcatcacaatcagattgaatgtaacatttgggagatcacttttccatcataaaccatcataaatgtcaatgagaaacaagaattcgagacacatatcgctgttttgattggttgtggaaacgacattagtcataattataattacaaaagagcttggatcgtatacgaaagatgaaaatgaaagcaacaaattgccaacaataacgtcattctcaatcaatcatcaatcacaatacacaacaacaacaactcgcgatcgatgcacattggataatcgagggaaacagatccgaagtaggtgaaagattattagaaaacgaaccggtgagaatcggtttagagatctggagaagaaaaagctagattccagctccgtcgacaacccccgaaatcttcagcagtgttgttgcgatatggagagagagagagagatggatctcctccgtagattgatgatggctcgagctgggccgatttgccggatacgccgtacgcggcttattatgtccgttacataaaacgggaatttagggattttatatacaaaacaataaaaagataaaaaataggaaagaagatatataaagaggacaaaaaaatgatgatgcgttgtttgttagcttccactcctttgtgttttgaagatgatgggcatgttgttagaatccgatgatgagtgatgacatttacctaggactatgatctgactcttgcagcttccagagggcatttacgaatacgtattaagataaacttttttaatcattaacgagaagacaactcatgttctagtaatcacgataatgtttagtacttttgtatattgtatttgtatgacagtatgaggtgttcaatattttggtttgcttccaactaaactaaaagtctaaaatacattgttttagttgcactgaaatcctaatagactgagttgccgttgccgtgaatcactttagccggttagcatttagcatccaaaccaaaactatttacccccaatagcctagagttttttttttataacttttttctttttctttgtaaggagacttgcaaggttttagtagaggtctatcttaatcaaaagcccatgcatgataaacagaaggagaaattaaaataatttgggccattagtgggccaaacatgaaaacttggtattgatggtttactagttcctttgtaagttggtcaaaagtccgaaatcaggagcgagataataaagaaacaacgagttgttttacttttcaaggagaggatagctcaaggtttttgatcgatcgcaaggtattttgattctctctttctcaagcgattttcgttttccttcttttgttccagaggtcaaattcaatccctaaagctaggtttctcgggtgaagctttagatcgggagctatgatttcatctcgaatttggggataaatttcagcttattttaaccaatttcaattgattccaaataattctgtttatctctgagcaaaattgattaattttcgattcggtctttaaaaagctgcttttcttaccgtctccatccgaaattagttttttttgtttgtttgatgatttgtgttttgatgatttgtgtttgcgttttggttgatactagcagctgaatattgaatccaacctttaatctgagaggagaaagaag

SEQ ID NO: 9465 - DNA, 3000 bp, Unknown
  misc_feature (1)..( 3000): cDNA_ID_3042002_gDNA_ID_1972122_Annot_ID_179048 3000 nt of promoter + ATG
agtagcagccaagttgtaagaaacaaaatctgcagtggtaataaatgttgccagacgaggataccggaagggcagccgcaagtaattggagtcaacatagagatccctgaaaacaaaaacacaacagaaggaggatgcaaagttgcatttttgacgagcaacaaatattcgagtttgaatgttacagagccagaagagtttcatagtgatggatacgcggtggttgagcttggatggtactttgatacttcggattctcgtgttttaagccccataggttgtatgaatgtgtcagatgcatcacaagatggcgggtatggttccgagacgatttgcgtttgctcgtacggctacttctctggattcagctataggagttgctattgtaactccatgggttacgcagggaatccattccttccaggtggatgtgtaggtaagagatgcgtgtttttctttctgtatccattaatgaattcaatcaagtcttctatcactgattatgaatcaaattcgtgtagacatagatgaatgtaaactagaaataggacgcaaaaggtgcaaagaccaaagttgtgtgaataagcccggttggtttacgtgtgagccaaagaaaccagggcagatcaagccagtgttccaaggtaaaagtcaatttgattttatcttgaatgttgtgttgaagatattattgttttgttctgtaatgtacatattgtttcttttggtggtgcaggtgttcttataggttcggcactgttgcttttcgcctttggaattttcgggttgtacaagttcatcaagaagcagaggaggagcagtcgaatgagagtgttcttcaggcgtaatggagggatgctgttaaaacaacagttagctagaaaagaaggcaatgtagagatgtcaaagatatttagctcgaacgagttggagaaagctactgataactttaacacgaatagggttcttgggcaaggaggtcaaggtactgtttacaaaggtatgctcgttgatggtagaatcgtcgcagtgaaaaggtcgaaagccatggatgaagacaaggtagaagagtttatcaatgaagttgttgttctagcgcagatcaaccatagaaacattgttaaactcttgggatgttgccttgagacggaagttccagtcctggtttatgagtttgttccgaacggtgacttatgcaagcgtcttcgagatgaatgtgatgattacatcatgacatgggaagtgcgccttcacattgcaatagagattgcaggagcactttcgtacctacactcggctgcatcttttcctatataccacagagatatcaagactaccaacatactactggatgagaaatatcaggttaaggtgtctgatttcggaacttcaagatcggtgaccatagatcaaactcacttgacaactcaagttgcaggtacttttgggtacgtggatccagagtactttcaatcaagtaagtttacggataaaagtgatgtgtacagttttggagttgtcctcgtggagctcattaccggaaaaaacccgtcctcccgtgtccagtctgaagaaaacaggggatttgcagctcattttgttgcagccgtgaaagagaacagatttcttgacatagttgatgaacggatcaaagatgaatgcaacctggaccaagtgatggcagtggcaaaactcgctaaaagatgtttaaaccgaaaagggaagaagaggccaaacatgagagaagtttcagttgagctggagaggattcgttcatcatcttataagtcagagattcataatgatgatgatgatgatgatgatgatgatgatgaggatgatcaagccatggaactcaacattgaagagacttgggatgttggtatgactgctccagcctctatgtttaataacggatcccctgcgtctgatgttgagcctctggttcctctacgaacatggtagtataccctcatctgatgaaaaaatgttatgtttcgattatgaatttctagcttttcaccatgtaacaataataagtaacgtttctagtctgtacatgtgattatatgtgtttcataagtctgtacccacagtcatctctatgtattcgacgttcaaaagaaagaatgttttagtcataaacagtatcaggtttaagctttcaccgataacactctccaaggatttcagtttcccttaggaggtaccttggacatgtgttctaattgacacattgcctttctctttggagattcaacgccagcaaacttggacggctttaaactccgatatcctctgcttgaaaaccttctttcctacgctaccacttcagtgggcaagatttgttcaatgtttaacagaataaaaagtcaaaaccaagaatgtcaacatcatctatccattatccatgtgatcggctgattgccactaccttggattacattttatttgactggtcatagattcgttgtttaggtcaacttctgttttgtatcctgaatcctgaacgaacatgccaacatggtgacgatggtcaaatgagtataatgtggtggtctactttcatatggtcatcagaaaaaaggttaaatttttataatccaacgtgaactcattaaacttaaattagaatccttcaggcattgacattgaccaaacttaatttgttttataattccttatgccaacatggtgacgaactgacgatggtcaaatgagtataatgtcattggtctactttcacatggtcatgagcaaaatattggatttgtatattcaacgttcaatcattaacttaaattataatccctcaggcattgacattgaccatagtcttagtagtgtttactaatttttaggtgctttgtaacttgcttcacgcttctttctaaacctctattgacttttaccttaacatcagatcgggcaggtccttaacatgtagaaaagctgattgagattgatcagatcaaggaccaaagtaaaaatacaagaatt

SEQ ID NO: 9466 - DNA, 3000 bp, Unknown
  misc_feature (1)..( 3000): cDNA_ID_2182682_gDNA_ID_1972122_Annot_ID_179046 3000 nt of promoter + ATG
gaattatgaagacaaagactagcatcttccaatttattgtagcatctgtccttactctgctcatcaatgactcatcagcagcaacacctccacctccaattagcaattcttcaacgtcttgtaacaaaacctgtggaggaatctcgatcccgttcccattcggaattggcgggaaagattgttatctcaacggttggtacgaggttatctgcaacacaaccacttccgattctaacacaactgttcctttactctctatgatcaatcgggaagtggtgaatatctctctcccagacagtaacgaaccatacggacttgttcaaatcaaaggtcctgtgacatcgttgggttgttctagtaatactagtgaaggaccccaaaactcgctcccggttttgaatgtcacaggtaagggcagcccatatttcctgaccgacgagaaccgtcttgtggcggttggttgtggtataaaggcattgatgacagatacagaatcagagatcttgggttgtgaatcgagctgcgaacacagaaagagtggtgaagaagtaacaaatttgatctgtactggttacagatgctgccaggcgaggctaccggtggggcgtcctcaggctataaccgtaaatatagagaactctagtggaggagaagaaacgtgcaaagttgcgttcttgacggacaagaggtattcgccgtctaatgttacagagccagaacagtttcataacaatggatatgtggtgctagagttaggatggtactttgccacttcgaactctcgctttaagagcctcttgggttgtacaaatatgagccgaaaaggttctgggttctcggatgataattgcagttgcgagtatgattacttctccgggatgagttataggaattgttattgcgactatggctacacagggaacccataccttcgaggtggctgcgtaggtaagtcataagtgattgttttcttcttttgttttctcattagatcatcaataattatgtttcaaaattgtgtagatactgattcatgcgaaggaaatcacaactgtggggaagatgctcattgtgttaacatgcctggaccaatgtccatgtgcaggcctaaccccaagataaccaaacctaccaaacccccggtgcttcaaggtgagtggcaacttttaactattagactgataaagtagaggataatgtataccttatgtttatttgggttgttgtaggcattcttataggtttgtcaggattagtattttttgttgggctattctggctatttaaactcataaagaagcgaaggaacatcaaccgcagcaagaagtttttcaaacggaacggaggcttgctgttgaaacaacaattaactacaaaggacggaaatgtagaaatgtctaagattttcagttcaaaggagttaagaaaagccactgataacttcagcatagatagagtgcttgggcaaggcggtcaaggcactgtgtacaaaggaatgttggtagatgggagcatcgttgcggttaaaagatccaaagttgtggatgaagacaaaatggaagagtttatcaatgagattgttcttctgtcacaaatcaatcaccgcaacattgtgaaactcttgggatgttgcttggagacagaagttccaatcttggtgtacgaatatattcccaatggagatctgttcaagcggcttcatgatgaatctgatgattacaccatgacttgggaagtgcggcttcgcatagccatagagatagcaggagctcttacatacatgcactcagctgcaagttttccaatattccatagagatattaagactaccaatatcctactggacgagaaataccgagccaaagtgtctgactttggaacttcaagatcagtaaccttagatcaaactcacttgacaacattagttgcaggaacttttggttacatggatccagagtacttcttgtcaagccaatacactcacaagagcgatgtttatagtttcggggtcgtcttggtggagctcataaccggagaaaaaccattgtcccgtgtccggtctgaagaaggtagaggcttggcaactcatttcctcgaggccatgaaagagaacagagtgattgacataattgatattcggatcaaagacgaaagcaaactggagcaagtaatggcggtagcaaaactcgccagaaaatgtcttaaccggaaagggaagaaccggccaaacatgaaagaggtttcaaatgagctagagaggatccgttcatcacccgaagatttagatgtccgtaccgaaaacgaagacgaagaagaggatcaaccaatggcaatcaacaacaaaagatgattcttgaaccgcgttcatcagattttctgagaacatctgtatatatacaaaaaaaaaactaatgctcattttgtttgctaggaggagtaattataatgcgtgttagtaagtgtaaaaacctctgtaccactattttttttctcttcaaaatctagggtttccaatgaagaaaacaaaacggacaaagtaaagatttggggatcgtgattcgtaacgatttcggaagcttccttggtcacttcggctgatgaaagagagatttgtgggccagataacactttacgcgtccaagttttgatttcttcagaaagtgggactcaaagagttcatgtcagattgtcagctaccagctaccaacgtcacattacttgcacacttgtacattagaagactaattctgccaaatgttcatacgtcattggtcataatccaagagagtcaaacatgaaattcgttgactcttaataagtactatattttggtcaacattgttttgcatctcttttcacgcatcatccatcttatctcatttctgacattttcgtctatgcagagtcttgatttttgttttctcccttcattaaacaacattactagaatcaaaagatcagatagagctggcaagttgagagaacaagaacaagatcagt

SEQ ID NO: 9467 - DNA, 3000 bp, Unknown
  misc_feature (1)..( 3000): cDNA_ID_2182678_gDNA_ID_1972122_Annot_ID_179045 3000 nt of promoter + ATG
aggagtgctgcttttcgtccttggaatcttggggttgtacaaattcattaagaagcgaacgaggatcatccgcaacaaaaactttttcaaacgtaatggtggcttgctgttgaaacaacaactaattacaaagaacggaaatgttgatatgtcaaggatatttagctcaaaagagttgaagaaagctactgataacttcagcatgaacagggtgcttgggcaagggggtcaaggaactgtgtacaagggaatgttggcggaagggagaatcgttgcggttaaaagatcgaaagttgtgggtgaaggcaagatggaagagttcatcaatgaagtcgtacttctctcacaaattaaccataggaacattgtgaaactcttgggatgttgtctagagactgaagttcctgtcttggtttacgaatatattcctaatggagatctgttcaagcgtcttcatgaaaaatctgaatccaatgattacacgatgacttgggaagtacgtcttcgtatagctatagagatagcgggagctctttcatacatgcactcagctgcatcgattccaatataccacagagatatcaagactaccaatatactattagatgaaaaatatagagccaaagtatctgatttcggaacttcaagatccataaccattgctcaaactcatctaacaacgttagttgcaggcacttttgggtatatggatccggagtactttttatcaagccaatatactgacaagagcgatgtttacagtttcggggtggtcttggtggagctcataaccggagaaaaaccactgtcaaggaagaggattggcaactgatttccttgaggccatgaaagagaacagagtgattgacacaattgatattcggatcaaaggagaaagcaagctgtgccaagtgatggcagtcgcaaaactcgctcgaaagtgtcttagcaggaaagggagaaagcggccaaacatgagagaggtttcatttgagctggagaggatccgttcttcatcacctgaagatttagaggtccatgttagaaatgttgatgcagaggaacaaatcatggaaatcaacagagaacgattttgagggtatgtacatgagtgacaagatccattctttatgttaaactagaagttgcccacaaatatgcctttaattgctttcaaaatacgaattaaatacgatgataacttgtagttaaagtctcaacttgatatgtttatagataataaaattttagtgtattaaaatctttcaacaaagtttaaatctaagaccaatgaaagaaggaaacaaagttgaagaaacacgagaaactatgtagatcaaagatttgtcctccattccatgcatgaactttaaggctgataccatacggcatatcttcactatgatcgagtatattactctggatttctctcctacacctgtggccatcttcttgagcatagaaaccaaaaattcagctatcttcatggttgatggttcagttttccagttattgctttcttgcgttcatccaagtagatttggttgttgtctgttcgtataggtcattttcaacaatcacatttaggccatacattcccaacgtcctctagcttcttctagcactttttctcttctctttttatcctaagctcaatctctgcaaacataaatacaaacctatagatgacgtgaagagaaaacctctctgagtttgacttgtcacattctgaattgtcaaagcttttgagtttcactgatcaatgtaaagaggctatgttaacacacaatttagattttttttctaagacataatttagaaatttcttctgtcacgaatcatattccatctatattatattctctaaaacacgcctgcataagagacatcaagagagaaggaagactgtatataccttttcggcctcatactccgttctccaagaatagctcttaacaattcctttttaccatatactgttttgaatttcaaaacagaagacgatgagcttcacaaatccgaaaaatgcagcccttgcaaaattttggatgcaaaatatattcaacggaaaatatgtttttatgttatagatagactcaaacatgagtactggatgttaaagccctctaagaacatggataaagtgtaagaattaaaaggcaggtaaaagtataaacatacaataccatcggcgaacagtggcggagatggaataagattatgggagaagtaccatcaacacgatgatggcgtgaccggaggtacctttagccacgaagggaagtttcgtggtagggtaaatagacttttttttgccgtttcgtttattgaaaatcatcaatgagtaagtaaagagggtttggcaaataaatttgccgtttttgtttaataaaaattaatgagtaattaaaaagttttttaaggaagaaaatgtaagataataaatgaggaataatatgtggacacatgtagaatgtataaaatgtcaaatgtccaaattttagagcaagttaagaagaaaccttgtcatattatgtaagataagatgtatctttaaaattatataaccttagtgacaagaaaatcaataagatcccatcgacagccatcaaatcaaactagatcatttaaatctgactcagtctgttctcacttcttacaaaaaacagagcactctgttcttacttctcacaaaagaccctttcagtggtgaggttgctcttcttttgggttttttcccacctaaatctggagtttgacttagctggagtagcgtaaacagcactagaggtcaagtttctcaaatgttgattcattattagaaaatagattcccttaggtgtagagttaacattgaataagagtattttaatgctactttgtaacatgcttcacgtttctttctaaacatatcttgaccttttcatcagatcagacacgtacatacctttttcccctagatgaacagatcaatcagatcaaggaaaaataaacagaatt

SEQ ID NO: 9468 - DNA, 3000 bp, Unknown
  misc_feature (1)..( 3000): cDNA_ID_2990057_gDNA_ID_1972122_Annot_ID_179042 3000 nt of promoter + ATG
caaaatcgttgtttagtgctaattacttatacattcaggtgtcgagactcatccaagaacttgcagcagctgctgccgcggaaaaaggactaacctttgaagagaacatggtggaaagactatgtgcttattcacgagctgtttctcatttcccaactgctgttaaagaagtacatatatcacttttatcatccttgatctctctctttcaatgcatgtgcatgtgcatcagtatctgtttcacaactagttttctgattattgcagtttaaatggaggaatggttggttttattcactctcagagaaggcgattgcggaagggcaaccggatccgtgtcccctccataccgaatggctgaaagagcttaaagtgatatagagccagtctttctaaattgtgagtatctggattaagtatcattcttacatattttaagtagatgatctgaaactagtgtcaactgtgtacacgcctgagaagtgaaaaaaagatgtaattttttaataaagaaagagaatcagttcacgctttgtaaaatgtccagacttttatatgtgtaaacttgtgcattttcaagaatcaaaacttttctgcttctagactcccatcaattagggaagactagaatcttcaataataaacaaattatgacagatacctatgtagactctttggaatcatcaatagttgacaaagtaagaggcaggatcgtccacgcttgtttgaattttcagcctttgcaggcaaggtggtccaagtaggcaactgtggtttcttcggttagttactatataacacataattctatattagctttagctttagcttcacataacataactcagttttctacaaagaaaaaaaaacagagcataatgagcagagagaagttttccatatataacttgctctctcttctggttctgctgatccatggtttgattgcagcatctgctcaagatctcactgtcttcagttcttgtcaaagccattgcgggggaatagcgattccttatccctttggaattggtaaagattgctatctcaacaacaatgagtggtatgaagttatctgtaaccgaacctcaggaaaccctctgccagttcttaagagtatcaacagagaactggtgaatatctctctcccggacgactcaagcgatgtctttgggctaacccgaatcaagaatccggtaacttctttaggctgttccaatatggaagaaatcagcttggctttgaatgtgaccgggagcccattcttcctcaccggccgtaatactttagtagcagttggctgtaacaacaatgcctcgatgactgatgataagctgcagattggaggatgcgagtctacctgcgacgtggggtttggtcagagaggacggaacagaagctgcaacggctatagatgttgccaagcgaagatactctctgaccgtctgcaacagattggcatcaagatagagagtcttgatggtaacacaacgaaataagctgggtgcagagttgctttcttgacagacgaggcatattctcctttaaatataaccgaaccagctttgttttacgataagggatatggaacggtggagttaggttggttcatagataggttacacaatatgtccgttgtactggggtttgctattcaattaccgagggtacaagcggttggagttacagtaactatgaagcttgcatatgtagatatggtaagtatttagagcgaagctatagaagctgcaggtgtaacagtggctacagaggcaatccatatctctcgagtggatgtacaggtaaactaacattttctggtataactttgcgttagtttctgtaagctccatgaatcattgatgcattcttcgcctaagtagatattgatgagtgtgaagaagccaaagctgaaggaagcaaccattgtgggaaagggtatgattgtgagaatatcccaggaaactttaggtgtaaatccaacaaaaacaaaagactagccatcattcttggtaagctaccgatcatctgcgatatgtcatcatggatagcaataaaacggatttggctttaaatgtgtttcttttgtgttgggtaggtattagtctaggctttggcttgttggtagccattggagcatggtggttgtataagtttatcagaaagcaaagggagataaagcggaagaagttctctaagcttaatggaggactattgatgcaacaacaattggtttctaacgaaggcaacattgagaatacaagagtattcagctcgaaagaattggagagagccacagaaaacaagagtattgcaacatagaagatccttggaacgtttgtactgattcttcctccaacatcaccaccacatcttcatttggtcgaaacattgtgaccatcagagaccactagatgtaaccgtatcatttgaaattttggtgttattcgatttgtttagttgtatgtattttgttttatccggtttggagaatgttatattgaataataagaaccacaaacatatcaacgaaagtaatcgctcttgactgaatatttatgagattggactatgactagaatagtagtctcattgcatttgtagtactagttgttcgcaacagctcagattcataaggaccaccagccaatcaatagaacaaaaatgaaaagtgaaattatcgcccaccgtggggctcgaacccacgaccacaaggttaagagccttgcgctctaccaactgagctagacgggctttgtgcttagcttaactgttaattgttagatagtctataactgtaggtaccaagtcaaattttaaaatatctcaagtcaatgatctgcactctgcagaaactaaataattgagatgaaaggatccatacatggagttgacttttgatgataaaagcttcacgcgtctatccaaacttctttgaacgtggacttttgtcacatagaagataagagaagatcaatcagattaaaaaaatgcagaagt

SEQ ID NO: 9469 - DNA, 3000 bp, Unknown
  misc_feature (1)..( 3000): cDNA_ID_1582349_gDNA_ID_1972122_Annot_ID_179027 3000 nt of promoter + ATG
aacatgaagatggcattaagactggcaagtcaagtaaaaaggagaaagcagataatggtttagcaaaaacatctgcaaagaagccacttgcagaaactatgatggtaaagcccagtggaaaaaagttagtccattcagatgctaagaaaaagaattcagaaggtgcaagcatggatacgcctattccccaatcatcaaagagcaaggtaatcagttatttgaaccatgatttcgcttatctgtatataatatactagaacttccttaaacttataatggggtaactgtgcagaagaaggattctcgtgcaacgacgcctgcaaccaaaaagtctgaacaagctcctaagagccatcccaagatgaaacggatagcaggagaggaagtggtgattattttgttgctttctctgtccatgatatgaggcattgacttctcacctgtattcatatggtatagattcctcttttcaggagtccaatacaaacgagcttggtgaagaactcgttggtaagagagttaatgtctggtggccactcgacaagaagtaagtttattgttaaacttactaacttcatttttgatactatatgatgaatgatagcaatcttacgatttgtatttgcacaggttttatgaaggtgtcataaaatcttattgtagagttaagaagatgcatcaagtgagttaacttctctatttggtattttaaaattctctatttattgcataactggtttatatagaattttcccactgatggtctcgcaggtaacatattctgatggcgatgttgaagagcttaatctgaaaaaagaacgttttaagataatcgaggataaatcttcagccagtgaggtgaaaatttcttacattctatcattcaccattctttatatttaccaaaatttcaatgtatctggtttccctaataaaatctaagcaggataaggaagatgatctgcttgagtctactcctttatctgccttgtaagtgaaacttccatagttctatgataacccacaatttataattttaatttagctttagtcttgagttttttgctgttatgtgcagtatacaaagggagaaatccaagaagaggaaaattgtgtctaagaatgtggaaccgagtagttctccagaagtcaggtatgaaagtatataagaattctagttttagttgtttgaaagtttgatccgtgagtgaattagttcacaattatggatgtagatcctctatgcaaacaatgaagaagaaagactctgtaacagactccattaagcaaacaaaaagaaccaaaggtgcactgaaggctgtaagcaatgaaccagaaagcactacagggaaaaatcttaaatccttgaaaaagctgaatggtgaacctgataaaacaagaggcagaactggcaaaaagcagaaggtgactcaagctatgcaccggaaaatcgaaaaagattgtgatgagcaggaagacctcgaaaccaaagatgaagaagacagtctgaaattggggaaagaatcagatgcagagcctgatcgtatggaagatcaccaagaattgcctgaaaatcacaatgtagaaaccaaaactgatggagaagagcaggaggcagcgaaagagccaacggcagagtctaaaactaatggagaggagccaaatgcagaacccgaaactgatggaaaagagcataaatcattgaaggagccaaatgcagagcccaaatctgatggagaagagcaggaggcagcaaaagagccaaatgctgagctcaaaactgatggagaaaatcaggaggcagcaaaagagctaactgcagaacgcaaaactgatgaggaagagcacaaggtagctgatgaggtagagcaaaagtcacagaaagagacaaatgtagaaccggaagctgagggagaagagcaaaagtcagtggaagagccaaatgcagaacccaagaccaaggtagaagagaaagagtcagcaaaagagcaaactgcagacacaaaattgattgagaaggaggatatgtctaagacaaagggagaagagattgataaagaaacatattcaagcatccctgagactggtaaagtaggaaacgaagctgaagaagatgatcagagagtgattaaggaactggaagaagagtctgacaaggcagaagtcagtactacggtgcttgaggttgatccatgaatgaaggattgttaggtaaatgttaatccaggaaaaaaagattggttcttgtggtttaggtaacttatgtattaagtgaagctgcttgtttagagactaatggtgtgttttatgagtagattcttctgacctatgtctcgttatggaactagtttgatcttatgtcaccttgctagcagcagatattgatatttatatatttaagagacatgcgcatgagaatgagggtatggaaaagtccatatcagatgacacaaacaatgatcgtatgtgtagtcacttgtgcatttccagttttggacataaaattctgatattgcatagaaatgtttttaaataacactaatccaaacctaaataaaatatctctatacatcatctagaaatgtatggcttgatcaagaattgtagataataataccctgagttaaatgattgtaggtattatttcagttttcaaaattgtccaaatttatgagctatattaaagataatattttcaataaggtgtgtagttctaaatgtttcttcttcttccaccaacccctctttctatatgtatgttcttttttctaaaataattgtttgttcttttttagatatatcaaattaaatataaaaaatattgacaaaacttatttaccattgttaggtgaacttggcaagtgtgtaaatataaagataacattccttttcgttctttatatatacgaaacgtaccacaaatttctaactaaagcattcatagtctctcgaaagcctcttttcagaaccgaagctctttactttcgtccaccgggaaat

SEQ ID NO: 9470 - DNA, 3000 bp, Unknown
  misc_feature (1)..( 3000): cDNA_ID_3042024_gDNA_ID_1972122_Annot_ID_179030 3000 nt of promoter + ATG
aaattaaaatgtagcatgtaatcgattcacacaaatacgtctggtctaagagttcatcgcaacattctactatgcatgaaccgataaccaaaatacatctatacaacaccaaaatacaaaactaagaacacgtcacggtaacaaaacctcgttgtgtcaattaatctctggaagcagaacaaacaacattggtactcaaatacgttaattagcttatttcagaatggctcttatttatcactctctctctcgttcttcttcttcgccttcgttgttgttgttgtctctgcatctacgcaacagtcttggtatctgaagcagcctatgagatgatcattcgtgagtccagctgcttgcatgaaggagtaaataactgttggactaacgctgcgaaagcctctgcgtacaagatctttgcttataaactcagctttcgatgtcttcacagggacttggcgctgatacctgaattggctctgtgtaggcttgttgttcacaaagttccacatgtacttcttcaatgatccacattcagctataatctggatgaagttaagaattaacaggcagacagattataatatttagacaagttctaagttttcagtaattatgatcagtaagtgtgagcttatgttctgttaccttgcgcacatggcgtgagttatcgaggattgatcgtatcttgacctctgatagtaaggaaatggcagcagtacctggcgctgttaactttttgtcattcaattcagctacagcgactggatcgaagtccataaaaacttccctgtttcaaataagaagcaaattaggcaatcagagatcagagctactggcttagcatcagaagtttatattgcgaattcaaaattcatattactaaagaacttggtttggttacctgagtatatgtcttctggagagaatgtcggtccatgagagttcggctagagcaccagagaggcataataactcaaaaagcttcctacacaagttaaccaagcggtaagagactcttataactacaaagtgtatctcagatagaaggaaaatagttgaggatgccacatacttgtcgtcatgtacaggaactccccattcttcgtcatggaaagcaacatagcacgggtctttacaacgtagaaaaacgcaacattattagtcaatttacagcagagaaagatatgaagcatgagagaacaacaaagaataatggaaagtgcctcttggcatggaaacatttatgctcattagtatagagaatccagaaaacgctgtttggcttacactaaaagcataaacgaagtggatctatcagctaatcaaaacatccttcatctaaatttcatggacactgagaagttaaaatatttataagagaacttcaggacaagctacttcataagttatgcaacatagcaaatgatctacacaatgctcactgaataaaatacatagcaattgaaacattttgttggccattgaattacttaatattcacatacagaagaacataattagatcaaacaaaaaacactagctccttgtctcaattcagtcccatttgattcaactagataagaactttatcatctcacacaatcaggctaaactcaatctcacattcacattttcactcatttcatttatttgaatgcatctaaagtcaaaagctctctcactatgcaatgtgtgataggtgaaagtttgatgcttaccagctttaggtgtgatccaagcacaccttttacgaccatcagcgaagcaatcaccagaaaccttctcttcttctttcccaacactcagcttccttgtagaagagacagacccacttcgcctcacaaccttcttacagctcgaagaagacgccacgctcaaaggcgatgactcacacgaagacgaagcatcagaggaatacgaagcagtcattgaagcactattctttctcaaaatcgaagagcaaagagacgagcattgcttcagagtcgtccttggtgaagccggagtagttggtttcttcgctttctcatcttttgagtcgatgatggtcttctccatcatcggcttctccagtttcatccccggtggtttcctctgcagcttgttcccggtaggaccaagaactgatcggaactctcgctcatcggaatttacggaccggaatctaggaggaaccgacattgacccgattctcacaaaaaactgctttttgatttcacagatctatcactggatcacacaacaacaacaaaattgctatttccaacagtctcgaaacttatttcaagagattatatatcggaaggcctagactttacagctacattagcaccaaaaatgaaacttttttgtcaccgctaaatatctcatttttaggaatcttctagtaaaactaaaccaagttgcttgctgtgttcacgagaaaagcaaggttagaaacaatgagcaacaaaataaaatctttgaacaatgaagaaaaaaaaagcttttgacttcagaaaaacccagaaaaaaaaaagaaagaaagaagctttttctgatcgacgacgaaacgaatcaaatcgagagagagagacgaggagaaaaggtcattcaccagtcacgacttaacacgtcatcgtttggttcttctgctttttctgttcttttgttcctcgacccgacaatgaaacgggtccttattgctcgacccgacaagttaaatggtttaattgcttactgtaatcagttggttaatgcttctgagttctgagattaggaatgtttctttgctcgtgcgtatcaaccaatgtaaagacaaaagttttaattaatcgaacagagaataatttctggaattgccataaccaaaataaataaattaaatgctaagttttcttctatggtcggaaaattgccacaaaagggacccacttatcctaagttcctacagagatctgttttctttcacaacatttaaaaatccaaacttttctttctttggctcaaaaaaaccttcca

SEQ ID NO: 9471 - DNA, 3000 bp, Unknown
  misc_feature (1)..( 3000): cDNA_ID_2182647_gDNA_ID_1972122_Annot_ID_179031 3000 nt of promoter + ATG
acgctcttggattcgtgttgatacttctggtaatactcaggtcatggaggttgacaagttcactatgatgcgtaggtgtgacttacccgcccgtgatttaaggctgcttgatcccttattcgtgtatccctctactatcctaggccgagagaaggctattgttgtcaacttagagcagatccgttgtattattactgcagacgaagttctgcttctgaattcccttgacaactacgtgctgcgctatgttgttgagttgcagcagagactaaagactagtagtgtaggtgagatgtggcagcaggaaaattcccagttgagtaggaggaggagcaggagttttgacaatgcttttgagaattcatcccctgattatttacctttcgagtttagagctcttgaaatagcccttgaagctgcttgtacgtttctcgattcccaggttagtaacactttagcttcgattttgtttccccctcagaaaatatagactaatattgggcttggatttgactactacacgctaagttgatttaattttatccttctctataggcttcagagttggagattgaggcatacccgttattagatgagcttacctcaaagatcagtacactaaacttggagcgtgtgcgtagactaaagagcaggcttgtagcactgacaagaagagttcagaaggttcgggatgagatcgagcagctaatggatgatgatggagatatggcagaaatgtatctaacagagaagaagaggagaatggaaggatctatgtacggtgaccagtccttattgggttacaggtcaaatgatggtctatctgtttctgcaccggtgtctcctgtttcttctccacctgattcccgaagacttgataaaagcttgagcattgcgaggagtcggcatgacagtgcaaggagttctgaaggtgcagagaatatagaagagctagagatgttgctggaagcttactttgtcgtcattgatagtactctaaacaagttgacatcggtactttaatggctcctctcatttttacttttgatctttcttcgctagacagctttaatcatctgtgttcctctctttactttacagttaaaggagtacattgatgacactgaagatttcattaacattcaactggtaatacctcaaaattccatcttccacagctgatattaatccagattgagaatgcacaagagtcatgctgaaaacctcttcaatatctgcaggataatgtgcggaatcagctgatccagttcgagttgcttctgacgactgcaacgtttgttgtagccatatttggggtcgttgctgggatctttgggatgaactttgagatagacttcttcaatcagccaggtgcattcagatgggtactcataattactggagtatgtggctttgtgatattttcggcattcgtctggttcttcaagtacagaagactcatgcctctataagaagagagacatgaatgtgctccccagaaagtagacatcaacttatattgttatgttgcttacagatattaatgatttgtttcctttacacaatggaatcttgggaatttttatcataggcattgtcaatccaaatgtgatagaatctttgatctttttattaaaaaacggataaccaaacatggtgcatgaaaatgagaatgattttgaatctaaatcacaaaaaagactcagattttgactaagttttaacttgtgtgggaaaatgagtacgagataacagtgtgcaaatgactcaatccttcagacagactacttgttagctgatgaagacgatgagaggcgtgcttttcgagctttatcggccttgtccatgtaatcttggtgagattgatgctttgaccctaaaagaaaccaaagaacttcaaccaattagcccaaacagagtcaacactataggatgtaaccaaaagcagatgtaagagatatacagattcaggtcctatgggaatgttagaatgaaacaatgtgatccatttccatatatactgagaaaccatttactcactatgtcatgtttctcattttgcaagaaaaccaaaatcagaatctaattgcaatcaaaatcctccaatttcatcttctaccaattaccctttcaatccccaagaagggatttggttatacaattattaaacgatgagagagagatcggaccttgagtcatcaaataccaaggaactccgaagatgatggtgacgattccgatcccgaccaagacgtgcttcttttcaccactgtaaacgtaatgttccattttagctctgaatcctccgcctccggccatacttgcaggaccaccgttggtcttcgtctcatttcccatttctcagatctctcttttttacttttcctttccgatcaacagcacacaaggtttatccatcagaggttttagtaccatgtataagtgggccttattatggcccatcaacataagatttcctttttattgaataacattttaaaccccatattttgttacatattagtgtagaagcgtgataactttctgacattacagtttcaccaaaaaatacgcggtaaattcgctactcatcgaaagccaataaagagagtgaattagatagaagagaagagagctataataactcttcgcgcctcgtcaaaatacgcggtaaatacgctccgcatcaaaagttagttagtgtatgattatggtaaccaactttcacaacggtccaatctaaaggagtattcaatcattcatccgtcatctatggtactaagtaggaaccctcaatttcttcattctcaagtttcttcaagccctagattttccttaatcattcatacactttcccacatttattacaaatcactttaagtatttgttgccgatccttaattagctcttttccagtttttatttcatataattgagatctgttgtgatgttgttaggttaatttttgcatgaagcttatgattgtttctcagaataatg

SEQ ID NO: 9472 - DNA, 3000 bp, Unknown
  misc_feature (1)..( 3000): cDNA_ID_2182651_gDNA_ID_1972122_Annot_ID_179033 3000 nt of promoter + ATG
ggaatcaattgagccaacgggtgccagattagatctagaagagatttcagatgaaccaggccctttacgtagatatgaccaagaactcgtatcagaggataaagcttttgaggtcaacctcattaccgcaaatgtaaacaagtcgacggtatcatcagctgagagggttgttgaaaccaaaagatcttgaaataagatcatagagtgacatcgtaagctcccagcacatgaatctagtacttgaacaagagactgtacatccaaaaactgttcgtcaaataccaaattagtatgtgtaataataatccaacaggtttggagacacaaacctgaacttcaactgcagtatcccttgctaaagtaagcatttgaacagttccacgctctctcaaagtttcacggaaagttggtagctgaagtttcttcccaacaaaaaattctgccaggaacagaaaacctttgcataagaacgaacttgagtattttaccatgaagataacaaaatatgcggtggttttgcacaaatccaaaggaaggcattcgacacagcaacttcaggattttaccacagcagcagtcttccgagagagaccatatttgaaatgctgacaattattgacataaaatgtattgaagcgggaaacagaataaaaagggaaaacagtggaaagttatatatgctagattttgtgatagtcacttactgcttaaataatctgtgatgaacgggtacaatagtgatcgggtaagccctcctgttggttctttttcgattaatgccctaattgacccgtgaaacatcacaaagagtgagtgcacttctttaagcaccctccttaatgcatcgatcctccatatcgctcctgtctccttatttttctccacaacctgccaatgtatagatcagatcttgtttatttacattgctaagacaccataggatgcatcattcatagaaaacattgtgctataacaaaagaaaagtaagacaatgccttaccataaccatccagatatcaggttcagcctcatagaaaacatgggaatgtctttctgcttcgatcacttcacaagccgcctccggagagaaaagtctgcattaatagtcacaccaagcctcaaaacatgaagaagatctacacagactatcgattaacgaccctgacttaatttatcgaacaagtcacaaatgcaaccaaatctagatcaccagcaattgtaaaaacacatctcacagtgttcaaaaagaagaagaatctatagcagctgacctagtaaaagtaataagcccttcactgagcccgatcactgataactgcgtcgagaagtctaaatcggcaggataaaagaacaaaattttctctaactcttgtccttcagtttgacctctcctcaaatcaaacatgcaaagtcgaaggctttcatcaccagagctcatggacgccatttctggtagcttctacgagctcattaataccctaacaatacaatgcaagaaccgcgtcagaatcaagcatgttacaattggttgttgtttccaatgtggatgtactctacttcaaaatccaaagtaatttcagggtttcaagagcacattggtgattcaaccacggcacacaaataccaagtaaggttcctaataagaagaccgaagaacccatacatcgagaagagaaaattactgtagaaggctaggaaacggaaaaaaaattaagtgaaaattgactaccttgaggacgaattcaaagagcaatgtcgaaggagtgatcaatctcctggtactgcgagatagttcaccgatcggagatagattcaagaacagaagagtcaacttcaatttctaaacgcaaactcgaatttgagcgattgagctgaaatcagtagaagaattacgcgacattttgtgacaaggatcaaggaagaggagcaggtggacagctgctaaccgccacgaaataaaccgggtcgggttatcaaataatcgggtcaatatctgaaacgggtaaaccgaatatttctagatgctccaccggttaagtcagacatatccgtctgaattatacgttgtgtgaatgcgaatctcaaataatttgttcaatcattcagttagtatcttactttattactcggttaattattaaccataaataaaaataatgggagatagtgataatgacacaacgttaaaagatctaagtagttaagtagtttagatttgataatataatgggaagttagagataaccggtaaattagctatagtcggtcggttagcattccggttaacccatcaatggctcgtattcacactagtcgcgcgactaactaatagagaaaaagcttttgcgtgtttgttgttgtctccatcgctcgtttgtttcttcttcagccatatcggaaaaaacgatatccgacgagccattcggtgtttgttccgagaagctccgatcgatctgtgttagggtttttctttttccgccttatgaatctctctatcgcggtttcattagattcagtttaactcgagtgatgaaaccaatctccgtgctagaggtaaaattctgttaggttttctcttttttgtttttatgcttcgtaccgatcgatatgattcctggttcgttttgtttccaaatctgcagctctttgatcccgtggctggtaggatattacggcgtttgtagctctggtatggcttttgttgttcgtttggttctgattttcgaaaattttcgaatttttaatcggaatctgattctagttcatcgttttattgttacagtcgtcgtggatagagttagaacgacgaaatcagccttggtttcctaactggtatttgttctttagcctatgttttcaatttttctcttccggttttttggtggtttgtgaaactacttaatcttcttgattacctaattaatcatatcattgtttacatcatttattttgatatttgtagttatttggcatttcagtatctgaatttttgcaacaatg

SEQ ID NO: 9473 - DNA, 3000 bp, Unknown
  misc_feature (1)..( 3000): cDNA_ID_2182643_gDNA_ID_1972122_Annot_ID_179029 3000 nt of promoter + ATG
atgatgagagtgacaagaggcctatggttatcacaagaagtgagtcttcttctagactgcgttcaacgatatttgcatcaagatttgctgctaatgcattgaaagggcacagacttaggagctcagagagttcaaagaccttgataaatctgcaaaagcctccggaacctgattttgatgctgaataatccaattcttgatgagaggccaacatcagaacagagactacataactgatttatacacataaatgctctatatatagaacttgtttcagaaactgtaaagttatctacacgagagccaatgatccttcaaagacctgcattgcatttttaacagttccaatgtcgatatctgctagttttccagtcttcgaagcaataattacacagttactcttctcttctgcatacggtacaaagagcttccctttctcttctgaagagaacaacccaatactggaagaaaaagaagcacacacatgttagttcttgaaaacattgaatcagtactctttatattactcaggtattcaccatggtttgtctcgcgcattagctagttgaatcgcagctgtgtttgttgcgatgactccagcagaatcgtttatcagagcagccaactaagtaagctcaagaaaaggaatcaaagtaagatcagtgaattcaactttgttcataacaaatacagacagataagcatgcatacctgtcctggtgttgtgatgaacactatagatgtatcatcacccacaaaatcttcaacgttttctctttctttctcatgtggaatcacaaagaccggcttgaatcccctggcattgttcacaatcatatctcagagaatttcaaactaagcaaaaaattcacattttgaaggtgtgtaataattaccttacaccctttataatcttagcccatttttcaagtgaaagtaaactatcagcatctccttttgattgcattgatgccttagaatctgattcaataccatgaatcactataaacttccccgtcactgctccagcattcctatactttgcagccacaacctctttcactttccgtgaaatcgataccctaagtggcaacagaggagtccttggaacactcctaaacggtcttcctaaccaatcttccatctgagtatacctgaaaccatcaacagtcaatttagacaggcgataaaaaaacctgcagtttcttcggtttcaaggaactcacatgctataacctaattctgaaaggttggtattttctgctgtaaaggtctcggacagcatcagaccagctcctgcagagttaacattcgggtaaatgtaactaaccctgtctcgagccgttgtcatgaacaagaacgctgcgtggcctaaccctgctagcttcgtggacagaaccatgtcatagtaccttccctgaaacatgacttaaaagaaaagttaactaagcagtctgataaaggaaagatagaaaaaacgttgaaatatttgaaagttacaaactttgaggagtccgatcatgtctgtgtattcagctggttcaggccaatgatcatccggatcatacacattggcccatctcacgtttttgtttagctcgtatgtttgttttcctctttcagtcgttaatatatctacctgaacaccaggataccttacaaaacaacagaaacgtacggacaatgttctgcatttcagtttaaggttttaaaaaaatgtcgaatcggagacagagtcttatacttttattacctgtctttgattagctgaatagtcgggaaaaagagtagattctcgtaaacgccaccggagataacgcagcaacatcgtctaacatctcctctgattttcaacggtaaagaagcaagctcgacggtgtaaccctttggaaacttcaagaagccgtaagggttatcaggattatccggtggtcttggatcctcgtcttgttttccgtcggcaaacaaggacccgtattcgttatccgggtcttcaccgctatcaaacgggtcgagccacggattattcttcttcttgagattgaccgatacatcggaagatctcgacgtaagacgagtttgaaagttgaggaagacgagtggtttggaggtagaaaacggcggcgttttaaagaatggggaaatgggtttgggtaacagaggaagtgaagaagccattggaaggtttttttgagccaaagaaagaaaagtttggatttttaaatgttgtgaaagaaaacagatctctgtaggaacttaggataagtgggtcccttttgtggcaattttccgaccatagaagaaaacttagcatttaatttatttattttggttatggcaattccagaaattattctctgttcgattaattaaaacttttgtctttacattggttgatacgcacgagcaaagaaacattcctaatctcagaactcagaagcattaaccaactgattacagtaagcaattaaaccatttaacttgtcgggtcgagcaataaggacccgtttcattgtcgggtcgaggaacaaaagaacagaaaaagcagaagaaccaaacgatgacgtgttaagtcgtgactggtgaatgaccttttctcctcgtctctctctctcgatttgattcgtttcgtcgtcgatcagaaaaagcttctttctttcttttttttttctgggtttttctgaagtcaaaagctttttttttcttcattgttcaaagattttattttgttgctcattgtttctaaccttgcttttctcgtgaacacagcaagcaacttggtttagttttactagaagattcctaaaaatgagatatttagcggtgacaaaaaagtttcatttttggtgctaatgtagctgtaaagtctaggccttccgatatataatctcttgaaataagtttcgagactgttggaaatagcaattttgttgttgttgtgtgatccagtgatagatctgtgaaatcaaaaagcagttttttgtgagaatcgggtcaatg

SEQ ID NO: 9474 - DNA, 3000 bp, Unknown
  misc_feature (1)..( 3000): cDNA_ID_2182635_gDNA_ID_1972122_Annot_ID_179026 3000 nt of promoter + ATG
gatttctcaccaggctggatcagatagcttgttaacgttgcgtactttcatcaagatgaaagagttcttcttcactggttccttgctcaagtattctggttttttgtttggattagataatcctcggttgctcactggatccaaaaattaaaattgaaaaaaaaaataaaaaaaatgaaaaaatttaaaactgttttttggtgtctttttggttaggctgcttttaggctatgtggaattacaaaataggtgttaagagcgtatatgatgcacaagaatttagtcactaaaaaggttattccatgatcttattaggtgaagaagaattgtagaaatgaaatcatgtatttaacatttggtttagtgagtttgattgttatggtgaaatgattctgcagttttcttattatcgatgataccatttcgtggaattgcgttttatatttcgcaaaactattgacaataacaaacaaatttcagttgtttacaccctttgtttgtcaaccacaacttttccaatgattccactaatccacgttgctgccaatgtctaatatcgtatcaattatcaaaattgtgggagagaagggaaccaccgaaataataatgtccttacacaacgtcgtctagcccaattaataggcccatttaagcccaaataatacagaattgtggccctggtccgctacgatccgttaaaatctgaaattagggttttagtttaactctccatataaattgttccaaatttcattcgtatcctttccgctgctgccgtcttcgtctctgaggtcagtgtttcagctccttgaacgatatatacgatcttatcgatttcgcattattctatcttaggctatgtatatgactgtcgaacttagttttaccgccgccgatttggcttcgttatattttccctagtagaattaattgtttaggtgtttgctaagctcatttgcatgacttatattggcagataataaggacttgtgtatttttccatcgttaaaaggcatttcaaagagacaatatgtcagggtaagcttctccttcgttgttaactgcatttgtgaatcttgcgttatcagtaatacatgtagctaatttctctgattatccatccctttttcatatactccacgataattctctcttctattttgaggtggccttatctatttaattaaatagcatctgttgttacattgttgatttctgttttgtgggacttagtcaagcttcggaataatcagaaagttgctgtacgagtatcattttgtttgtttagcttgtctgattcttctaatcgcgtctagttggttcttgacaagtttcaaatcagaattgttccatgctttagatgtttcgatgtttattgtggacaatccaagtatatgatatcatgtgttgtgtcctgacttttcagtgatgaggctgcccctgttgttgttcctccccccgttgctgagccagcggccatcccagaggacatggacttaatgactgcattggagttgactcttaggaaagctcgtgcttatggtggtgttgttcgtggtctccatgagtgtgctaagcttattgagaagcgtgtggctcaactcgttgtcttggctgaagactgcaaccagcctgattatgtcaagcttgtgaaggctctctgtgctgatcacgaagtcaggttgctaacagttccaagtgccaagacccttggcgaatgggctggtgtaagtctatgttttcctctttaatactgactcttcatatataccttattgtcgctcagtttatcctcctaaatgaatgtttggttatcaatggcaaattgaatctttgatgttgttgcagctctgcaagattgattctgagggtaatgccaggaaggttgttggatgctcatgtcttgttgtcaaggtatataaagtcatggatgaatcatctaatttttaggattcattgatgatggtccatagttcttttacttaacacgtttctgtgatttcttgtcaggacttcggcgaggagacaactgccctcagtatcgtcaataagcatattgcttctcaataaaatgccatgaagcatatctaaactcggatttcatatgttttccacccccaatgctgttttctcttggttttgatatattatctaatatttagcggacagctcttgagatttgtttggaacatgatcaagttttgttgttatctagactttactcttccaaggccaaatttgcttgagatttatttggctcattactcttcatcataattttttttttcctattaacctatatggtttctacttaactaatatagttgagagagtgaaagcatttaaaatctgtttaccgtatcaaataacaggatatttaactcagcctcgaaaacacttatatttcatattattcatcttgttccgtctgtatacatttttttttttgttaaaggctttggtccgtctgtatacatatgaattgtgttctatcgtcgtcaattttttaaaaaaaaacttttttcgttttacacgaatacaaaaatcattgaaaatttcattcatttcttttgaagtgaaaagctcggggagaaggcgggaagtggaaaagccaaggctctggtattgcaacaattgattataatttgtagagatacttaattatgatttgaaaaaacaggggattacttaataatcgaatgacaaagcacacacatgattgattttagttttgtgttttttgtcaagacttgcataatcgagtttaaagagtagcgtttttttgtttgtttatgagttaatttcgcatgtacgggttacatagagcagttcttgcatgttctacaccgcctttaaaaggcgcaaagttgtcatttttatttccttttcatttgcttccaaccatttagatttgaggactctctgtcttttcttatttcggagaatgttctttttctagggttttgaaattctaagagattttctgaagaagaaaacaaa

SEQ ID NO: 9475 - DNA, 3000 bp, Unknown
  misc_feature (1)..( 3000): cDNA_ID_2182712_gDNA_ID_1972123_Annot_ID_179064 3000 nt of promoter + ATG
ttgtgtacatatgacattcttggcagtaggaatggctaacaatatatttgattgtttcaaaatgttctgtaatgatcccttttttctggtgtgtagaatagagtgataaacaatgcaagagcttctagtatcacttaatctgttcatatgtacaagactccattaaactatctgcaaaatataaaaaggttgtgttactatcatagtcttagtgataaataaaatcttaacgaaatatagacaagaatccgttgtagtctagctggtcaggatactcggctctcacccgagagacccgggttcgagtcccggcaacggagtttttttctcatcgtactgagtaattttccacgtggcaggatttagttttactccattattttaccttttggcccctaaaattaaaaagcttgacgtaaaaagcgtgacgcttgcgaaagccgaggcgtgtggtgagtttgtttcccatgtggccttgagggttcgctcacgcctttgtctaaaaggcaagcaaattaagcgacatctattcatggttttgttcggacttgtaaatttatattctttctttctttttttcacctttttgtttgtaaaagcagaatgtgaggtaaacttatcatgtaatttacttttacatacacactagagagtgaacacgtaatgattagctcaaggtttatgagcatgggaaaaaatacaatattagacaccctcaaaatgagatctcgatttcactcttctgtctaagataatttaaacttccataaaaaactacttgtctttagtagatacatataaaaagtagtggtatacggtttctgtttttttttttttacaaagaatttgaaaaaaatggaattgacttgtggatgtgggggtgagtgtagatcgacaaaggcagaacataaacgcatgtaaaaggaaaggtgctttttgtgtgtggacaaggagcataaaaaatgtttaaaagaaagagcattccaatttcaagatttcaagaatcctaaagacataaggataagacactcagtcactcacacttagcttcgccgtttaggtccttatcattgttcaccattgcatgcgtatttttgtttatttttcttttaattgtttttgttcatagacatgtatatagattattatcgacgtaatataagtgcatagttagaaaccgcattaaaacttcaaaatgaaaacagtttagtttaaatcgctagagtacaaattaaaggttgaaataatccttaattatatgtttattgaagtcgttggttcagtttttttttgtgggaagttgagaagtacaaaaaagttaaccaaagagaagtcaaaagttcacgtgggctagctggttactacgtacgtcagccgaactaaaagacacttcgtcggacaacgaagcttcaaccacatgcttagataagtatagtactacggacaaaatcacattccatcaccaaataataatagaggaatattttgctataaaatgtctttcgtgacttcgccaagtgcgttcgcatattgtatcggtttggatattcagagatatatctttctctctgtatacatatataatcttttgttcttttgtaaacgatatagtatgtatgtagagcgtcatgattaaatagtggttaaaaagtggcagaatgaaactccatagataatacaatttgattcctaattttgattagcaagaggactcctcaactatacataccgttatcacttaagacatgaatgcgccaaactatttaaagccacccatgattttacacctactatatacgcactccttcgtgactatgacaagtcggcgaggttattcatgaaatattgaagtgatccacgttctgaaagttatgtgtaacaaacgtacgtagatgactagatgatatagtttgtatacgagttgaacactatgtgttaatgatttactacataggtgtttacaacagaacatatatccatacgaaattttttgagatcgaaggtcacgaaaattatcataaacacatagtgttcaactctaagtataaatgaatcaaaatctaagaataaactagtaaataaaatattttatttaattatcagaattcaaaattttgagatagggagtgaaacacttaagtatatataaccgcaatcgcacgccaaaagttagtgggaaagattggattctttgagtaaagattaggacaaaattaaaccccacatttaagaaatgaaattggaaaacaaaagtgtatttgctaatatcaagaatcaacacaatgagtatgtttgaagatacaaatgaccccacatgcgtgcatgtgttcatcttaaacaaaagaaaagactcattaatctcttaatctcgagattttcaaatctccatcatctctttcctttttctatatcactatcgattaaatgagtttctaaagtaaccaatactgaaattatccaattaataattcactttctaatttcttacaagaccacaattttgcctttatttagtttataatatttaatgtttgggggtatatggtccccttcttccatgtatattctctcgtataaagaagctggtaacttctgcttagctgttcttgtctagctgtgctcttggggttggtttcttttcttcttttcattattttttgtttgaatttggtgttggagataagattatttgagattctgggtttctagtggttttgctcaagggatctgttgttgggtttaggttaatttctggtgttagttctgttactgaatgtggagaaaggaagcagctttaagtgtttgttagaatgtctgagtgaaattgatctgtttttattattatctcgatctgggttttgagggatgaatccaaagtttctttctatctgagaaactctgtacattagggttttgattttagttggagggagtttttttttagggttttggaggctcaaatttccctagtttctttgttgaattctggtgagagaaaga

SEQ ID NO: 9476 - DNA, 3000 bp, Unknown
  misc_feature (1)..( 3000): cDNA_ID_3042055_gDNA_ID_1972123_Annot_ID_179073 3000 nt of promoter + ATG
gcagagaaatattacttgaatgtgcaacatgatcctcataattaagagcttctacttgtatggtatttcgatgagaatctctccattgttctctacttcaaatatcaaattagctatctaggtaaaaagtgccgttagatcgaaatccttcatagtaggtgatgatcaatcttgtattttgcgtatatatatacttcacataagaaataaatatattaatttatatatttatttctgtccaaaaatcatagaaagttataagaaaaccaaaaaagaatagaaaagaaacaatgtttggacaaatggatacaaaccaattgaaaaatcgtaaccaaccaaaaatacaggttgtacccccagcaaaggcagacctgtctttgttttctcataatttatagggaatttaataaaaaaaaccctcaactttggccagatccatttttaaaccctgaactatatttttagtaaaacaaaccctgaactaaaacctgttaataaacttaaccccacagtaattaaatattaatgggatattaatttccaaaaatcgaccaaagaacaatgacagaatccgtgatccaactgaagatcgtccacctcaaaaagttctttatacacgtgaaaaagttcaaatggtaaaatagaaaacaatgaattatgtttcacaagatcttccttttcaaattatttaatttaatctttgcatatttagacttgtagcaactatcaacaagtcggacacaacaaacgttcatgcaagcgtaaagcagtgccaaaaccacccaagaaacctcaaagacgaccaaggaaaaaacagaaaacaatggatgaagagaaccctatcactcagccaatacaatcttctcttcaaagttaatgcttgacaagtctttactttagaatatcttgtccctctgaaacgattgttttttttgtgacaaatattgttgtgttgcaacagcttcgatagttatgttggttggatttatttaagtatgactctttggattattttaagttgttgtgtctttctttcagcttctaaaatccaaactaattaagcaattcaaaatcatttagaacgtttttttgtaataaattcaaaatagttttaaagaacatcatgtggtttttgcgctaaatacaaatgtctcgttgtttttttttttagaaattaatatcccattaataattaattactgtggagttaagtttattaacaggttttagttcagggtttgttttactaaaaacatagtttagggtttaaaatggatctggccaaagttaagggtttttttcattaaattccctaatttatattcaaaactttcaaaacaagttaaaggaaataaaaccaattaaggttaaccaaaaaaaacaacagatttcacgcatctcacgcgcatagtgacattgtacatacttgtcatgcatcgtctcttccacatggatacaaaagataggcatacaacaacaccatcatcatgaaaatatgtacatgcacatacatacatacatacaacgtcttaggactagagagcaaagagggtagggaaaatttgatgctatgtttgggtaggccactgtcacagagcttaaagagaagtgctttctttccctaagttagcaaattaccccattttgtcaaaattccgtttcttctgacaacaacacttacgttttacgaatataaatagttgtagcatgatttatttttgttaccaatagataaacatatttattcttatcgattgccattaggactagggattctgataataattgatatgtcttaaaatttgcagagacaacaactttgcgtgttggttttctcatctgtttgtgtttagccttagtctgaaatctgaatgcatttaagtttttcaaaactaatcactttcaatcctttttaattgtcaacatctacttgtccttttaatctaatccaagaatattgaatacagaaacatgtttacacaaagaaaattaggtggtaatgatatgaattagagaagtgtaatcaagattccatctcatattaaacctatttaaaagagttgtaagaaaaaataataaaacaagtaattatttacttataactatgcatcaaatattacgaaacttttaaaatgaattgttaatctaattcaatcaatattataattatctatttaactaataatatttatatggtggcaaccaaagaatatatatgggtccaactggtaatttagatgaattgtaaaatttttcggaatagttgcaaactataaaaaagagttgtacgagaaagttgtataataaaattgagaataaaactttttataacgtttttgataaagattttataaatgataactgtcaaagttgtacaaactctaccgctttgataatgagttatcaaagacataaacttttatcctagttaatcattttaacttttagaatttaagctttgaattaaaattcaagcttagctttgtataagaaaaagtttaaatatttttactttgccttaacagtaaaaagcttttaaccaaaaacattgaattcaacctactctcccaaaaatttcacctttaattttttttgaaaacaatatttaccagtttagtgcatcttgttgggttgttccttgtcctttctctctcagaaagatctttacttttactttttcagtattttcctctctcttctctctcttctctctcttctctctacttagctgcctcgcttttgctccttttacctctttccatctttcaatctcctttgagagagagagcaaatgaaaaaaacccaaaaaactcttttctccaaccattaccatctcatgaacactctcacaggaggctctctcttctcagagagcctacccatctaatatttcttcatctgagtctcttttacttctctcaaagtatcgatctttattcttctttttgtaaaccctctctctctctctgatttctactgacctgtttggaagatatgatg

SEQ ID NO: 9477 - DNA, 3000 bp, Unknown
  misc_feature (1)..( 3000): cDNA_ID_3057627_gDNA_ID_1972123_Annot_ID_179076 3000 nt of promoter + ATG
aaacaaaaagagatcaagtagcctgaagatcattatggaggaagcagaatcaaacatgttgtaccagaagtgaaacatataacaacagcatcatcagaagcccaagcatacgttgctaaggaaggcaccagtgtacgctgtttaagcatctcggttgtcaaaactggccagtaacaaaaaaaaaattgagtcacaattccatctccttaatcttgagttttaaggtttataaaacaaatcatacactggttaagttcatttgcaaaatctgttgaagtagactccatcaacacacgccatttcaaggaaggtatatctccattttgaacatcaatgcaccacgagacacatgtctcatcagtaaccaaaagcacaggttctactagcagcattgccatttttgcttctttcaagctctgccctttcacacaaataaatcattaagaacaccaaataatgtgtcaggaactttattttacacataacacaatatactaaaaaggatgtaataagcagacactggacttgaaaaagagagactgacccatctgtaattcaaaggagcaactactcctccaaccaatgcaacagctaataaccactccaagaacaaatcactgaaaccacaaataacaacaaaccaaactttcaacggttcagattcaaaaaacccaaattttaagtcctcactcactccattcattcaaatttgaaaaattcagaactttcgtagaaaaatgtacctgttaaaagcagcaatagagacgacatcaccgtttcggaggccgagacgaatcagtccggcggcaaggctcagtacgccgtcaacgaactccctgccggtgcgcttccggtttccgtagactgtgacgacggcgttccgtttgacggaggctagccgagtcaaacactggcagatgtgaggccgagagtgattagccattccggagaagggcaaattatgaaattcacagtgtcatccaagtttactggaagaagaagagggagacagagagattcgattttgtgttctttccattgatgacgtggcagtacatgtcatcgcatcgacgacctctccttatcttacgttatctgtaaagagagagtatcatcgtttttgcgtttggtgactatataggccaggcccaattaaaaatgggctttactatcagattagtaactgaccaaggttgagttgaaacttgaaacattggagataaaaaattgtttccaagatcgaagtgaaaacaaaagatacagtactcaaattcctctactaacacttttgagatgaagatcagctagcattgagaatttgcctgaaatgatttatgagagaacgcaaggttttggaaacgagggaaagtgaagggtaatgcatttttgagatacgtgcgaagcagttcacagcgaattcgtttgggggagacgtaaacgactcacatggtagatgctgaagcggcgactcaacttcttcttcggggatcatcatcgttggtggagtcaaaaagtcatgaattttgtttaatttatcttgatgcaaatatcattgtttttctgtttctggaaatttatgtttttaattgatgaaaaaaaaacaactttcaaggattcttctttgctttcaagaaatagaaccttggataccactcaactataaatctataactgctactgtagtttacttgttatttttcctttttcacgctatttaaaacaaatcttattatagctatattataaatcgatgacaaaaatactcccgagaagtatatggtaaattcaaactggaaaaataaaaatgggaggttttatatttcttaatttgtgttagatccccgtgaatttagggccaatctccgacaaggaaactcacgagaattatttataccaaattcagacaaagcacaagagtcgagagacactgttcctagccaacgtggaataaagaaatactacatgtttagtcgaatgtagtggcaacattcgaagtagcttaaaacggagtcgtttcgtcttgtttggattctcgtataaagccttccttcacgggaaggtcttgtaaagttgttgtaactctctttaagcctaagagaaaacttcaacaagaaaatggccgcacacaaaaccagtgagtatccaccgttgatttcaatgctgatcatgttcatcatcgtcctagaatcaacgattatcaatgcaagagaattacgaccgtccgatcacggtctcgagtactactacgaaccaggcgagtcatcagaaatgacgtcattctttggaccaccttcttcaaatgatctaacgtcgatatcatcaccgtctagctcgatattgccgagtgcggtgaagtctccaatgaagacgctatcaaaagatcaggatgatgatcgcgtgatgaatcacgtgctggttgtgggcagcttggtgtgtggactctccggcgtggctttgatggtcgcttctgctctcatttattttctcggttacccgaaaacgcaaaattcctctgttaattgtgatcacattcataataataccaagtagaatcgttcctttttttttgggttttctctataattttctcaattgtatcaagaacaataaagatgttatcatgtattattgtaagaaaacagatactaataatcttttggttggttattgattatgtttggtgtgttcggttcaggaaaatgatttgaactggttcggtttgggaacattttgtcaattcggttcggttattgctaataatgaattaatttttaaagcttacaagaaaaatctaattaattaattaagaagtctgagagcgtcagttggaggagtccaaaagaggagaagaaggaagcttggcctttgaggagattcaaaggatcgtgttgcttactgtatttaaaaaccctagagttcatcatcatcttcctctcattattgattgctctaatcaggttccgacgagactaataatcctttctcagatcgataacaatg

SEQ ID NO: 9478 - DNA, 3000 bp, Unknown
  misc_feature (1)..( 3000): cDNA_ID_2182765_gDNA_ID_1972123_Annot_ID_179082 3000 nt of promoter + ATG
gatattaagctactcaatattaccaaatcccaaatacaagcgattcatggactgactcggaccggtttaatccaaaccggtcgagaatcgagtgttagttaataccgagaatttcgatttcccgtagaatcgaatcgaaccccgctttatcttctcggactatcagaggcgttgaacgagttgactctttgactcacgagtcacacaacatgacgagatcgatgaagctcaagaaacgatcgcgcttgaagaaaggtaaatagaagctgcccagaatctgtgcgcctttctccaatttttgaacttttctgatgaaaaaaaccgaatacttcttctgcagaggtaaaatcaacgatagagaaagataatggtaggagacataaaatcactaagtactggattcaacgttacgatctcttctcaagatatgaccaaggtatcgaaatggatgaagaaggatggtactctgtgactcctgaagaaatcgcaatcaaacaagctcagagatatcgtggcaaagtggtgattgattgcttctcaggcgttggtggtaacactattcaatttgctaaagtgtaaacctttttctatctctctcaatatcaagaagattgtgatgtttttctaaaggactcttttttatatagatgttcttctgttgttgctattgacattgatccggtgaaagttgaattggcgatgaacaatgccatggtttatggagttgctaatcgtgttgattttgtcattggtgatttcatacaattagctccttctctcaaagtaatcttctttttcttctctctatcagtttttatatttctgcaagtgtgaagatttattttgacccttttgttgttgttgttgttgcgcttgtctactagggagatgtagtgtttctttcaccaccatggggaggaccaatgtatagagattttgagagttacaatttggatatgcttcaaccaagagacgggtaacaaaagattactttacctattgatgtgttcaatatagttgtggatcttgtaatgagtttttgttttggtgtaggtactcattgtttcagattgctcagtccattacacctaacatcattatgtttctaccgcgaaatgttgatttagcacaagtggaagaactagcttggctctcgtcgcctccgttaaatcttgaggtaagacgcactgtcaagaagaatactaggagagctaatttattggaaactattgtcttgacaaatttgttatgctgtgctttcagatagaagaaaactttgttggaggcagaatgaaagctgtaacagcttattttagttgcaatgcagtttagtttagaaatgggaaccattacattaaaaggaagtatcttttagcatcagcattagaggaactgataattgaatactcttattattcactatctgttcttacaatattataatttcttgaaaagatttcttatactaattccaacaaagatacaaaactgtcattcgaattttgaattgtcttctatcttacttttagtttgtaactaaaaaatagaacattagaaaaggagtaaccagataatgaatgacaagttgaggagtagtcgtatgatgagtcctccatagtaaaggaggaactgtgggttctgcaagaggagcaaagggttaggttccttttgggaattttaagggtacatagagtcaatacttctcaaactcaagcaccttgagctcctagaggatttgatatcccacttatgaacttccagcctcaagggtccttccaaaactggttctgcagcgctatcaaaatcctaggtatgacatccattccattgtacatcccatgtcgttcatttcttgcattttcccgatgggatgtgaaagggtatcctatcgcttgacttgcttatttatttatgatgttttttgtggctatgcatctcggcgtagtcacacctagtggagtttaaatcctgcactgtttatatttatttgcatagaaaagcctaaaaacaaaaggttgcatgatttttcttttcacagttttacttccacatattgcattctagccttctaggagtgttcttatgagttgcatttacactttgcatgttttaggaggagatgatctactctaagagaacaatgttcactttaggtgaatctaacaaagcttagctgtgcgaatgctacctggagtgataggaaaagtctctaatccattaagtcacgtggctcaaggactcacagaactaggaggtttctagggatatacttcttagcggttttagtgttttgtcattcatgtctcagcgtaggatttgatttggttaggaacttaggagttgtcctagcatacgcaacattttaatctacataacaggttcttgatctaatcgatcattagcactcagaaccactcttgttatgatttgcaggttgacagagccagctagatcttcaacagcactagtcatgagactcatgactcatataacaagcttcccaattaccggaggtttcccttttgtcaagatccaaagcagaagattcgtttctcctctcatgtgttttgaaacttgcttcttcctttgtcaaaacgattagaacgcttgtgtatataatttcatctgaatactaattttcatgaatattttttcaaatacaaagactattatcatttaaccgaattctgtagtgtgtagataaatgtatctaaaaatctactcctcttaaaaaagttacctataaaaagaaaaatcgtgtatgaaagattttgctataattgttaatcctctgtcgttgataaacccttttaaaataatatttcctgaaaaagtcaacaaagacagagagatatatatctttcgacgaaattgaaaatttcaggtatccttgatctccgatcgaaagggcactaatttcttactggcgtgtctcaagtctcgacgacccatttctccatcttccttgacctcatctgggttggtttttattggtgaatg

SEQ ID NO: 9479 - DNA, 3000 bp, Unknown
  misc_feature (1)..( 3000): cDNA_ID_3610938_gDNA_ID_1972123_Annot_ID_179081 3000 nt of promoter + ATG
ggtacaacatgtttgattctgcttcctccataatgatcttcaggctacttgatctctttttgtttcgattttatcgccttcttgggataggtacaacgggaagacccaagggtgtgacgataagccacttggctttcataacacagtctctagctaagattgctattgctggctacggtgaggatgatgtacgctttttacctccacttatctgtttgtcctcaatgaaatctatagagctgaatacttccgtaagtaaatagtctcttaaatttctctgcaggtgtatttgcacacgtctccattagttcatatcggcggtctgtcatcagctatggccatgctaatggttggagcttgccatgttctgctgcccaagtttgatgccaaaacagctcttcaagttatggaacaaaaccatataacttgcttcatcaccgtcccagctatgatggctgatcttattcgtgtcaacaggtaaaagtccttgcttgaagtaaatttcggtctgtaaaccgttggttggctgaaatacttttactcaaaggacaacgaaaaatggagctgaaaaccgcggtgtgagaaagatactaaacggaggtggatctttatcaagcgaactccttaaagaagctgtgaacatcttcccatgtgcgaggatactttcagcatatggtgagtcactctcatcaagcttctaaatcaaccgtttttgttaatgttttgactttgagatgttggttttaaagggatgacagaggcgtgctcttcgctgaccttcatgactctccatgatccaacacaagagtcttttaaggtgacttatcctttgcttaaccaaccaaagcaaggcacatgtgttggcaagcctgcccctcatatcgaactgatggttaaactcgacgaagattcatcgagggtcgggaaaattctaacgcgcggaccacacactatgcttagatattggggtcatcaagtagctcaagaaaatgttgaaacatcagaatccagaagcaatgaagcttggcttgacacaggtgatatcggggcctttgatgagtttggtaacttatggcttataggccggtccaatggccgaatcaagactggaggcgagaatgtttaccccgaagaggttaccttccaacacaagaaactgctcgatattaccctcaagtttttttatggattgaatttacgcaggtggaagctgttctagtagagcatccagggattgtttctgctgtggtgataggcgtcattgatactcgtcttggagagatggtcgttgcttgtgttcgtttacaggagaaatggatatggtctgatgttgaaaaccgtaaaggaagtttccaactgtcaagtgagacactcaaacatcattgcagaacacagaacctaaccgggtaaaatatctttgataatctagttacttaacgagtaaattgttgtatatatacttatcagtttgatgaaattcatgaaacttttgttggacaggtttaagataccgaagaggtttgtccgatgggagaagcagtttccgttgacaacaactgggaaagtgaaaagagatgaagttcgaagacaagttttgtctcatttccaaatcatgactagctctctctgatcattacaattttaaaccgttaaaacattctttatttgtttgatgatacaaatttttagttagttttagtttgatcattaaacccattattgccctttaatacagagacaactaaaccatacagatcaaaatcaacaatattttcgagccgatcatttttctctgtgatcaactaaaccaaacccattcttgtatcaagacttcaagccgatcattttcgaagctctctctcaaagaagtttccgattagtatctaactatctatggatttaatcttctatcatatcgttttcaagctttattttaactggatctctttggtaaaaaattgcgtgtttctcttggttgttgtaattgtaaattaattttaatataaatatggttgcacagaacaaaaaaagaacaataataaagtggattcaaacctaaatgtatattatttgatttttccaacgtgaaaagaatgcatgaccgtacaataatcaggaaccactaattttacctaccaaaactatatgtatatgttattactttactgatgggatgggatgggaccataaataattcatattacatttatgatcatcagcagagattgagactctcaaagcatcaccgtggtgataaatggaggtgtcttccctaattttttaatatttgattaaagacacacatgaagaaagataacaaaaatgtctataacaagacattaagggtttgaatggttacggcggacaaaacctccgatcataccactttttatttactattcatcaattataatccacagtggtctggaccaaaaaagataaaagaaaaccgcagcggcttatctgcggaccgcttttacatacaaataaacttggtccacaacggtttattgtctgcttcaaaaatgaagtagactaaaccgtagacaaattagaccgctttgtccgttacatccattcaaagagtaaagacatctttaaagacactcttgattgatcaagacttttgacctagaatctaaaaacgaagaagaagccaaataagatcgaaagagaggtaatttagacaccattaattgttcgcaatgtttataggaaacacttcattcttttatagagagagaaaattatagaaaaactaagcaagtacttgtaagtgtatatttaatctctaagtttaatctcttaattagatttgttttcaagcttagtttaatctctaagtttggtaagcgttcttcaagtggtacctaccactgtccagagcaattaaattcactggccatagctctttactacttacttgctctattccgtattcttatttaatgaccctctttgcttctgcttccttcttatcattcactcacgacactaacc

SEQ ID NO: 9480 - DNA, 3000 bp, Unknown
  misc_feature (1)..( 3000): cDNA_ID_3042051_gDNA_ID_1972123_Annot_ID_179075 3000 nt of promoter + ATG
gtgcggtgaagtctccaatgaagacgctatcaaaagatcaggatgatgatcgcgtgatgaatcacgtgctggttgtgggcagcttggtgtgtggactctccggcgtggctttgatggtcgcttctgctctcatttattttctcggttacccgaaaacgcaaaattcctctgttaattgtgatcacattcataataataccaagtagaatcgttcctttttttttgggttttctctataattttctcaattgtatcaagaacaataaagatgttatcatgtattattgtaagaaaacagatactaataatcttttggttggttattgattatgtttggtgtgttcggttcaggaaaatgatttgaactggttcggtttgggaacattttgtcaattcggttcggttattgctaataatgaattaatttttaaagcttacaagaaaaatctaattaattaattaagaagtctgagagcgtcagttggaggagtccaaaagaggagaagaaggaagcttggcctttgaggagattcaaaggatcgtgttgcttactgtatttaaaaaccctagagttcatcatcatcttcctctcattattgattgctctaatcaggttccgacgagactaataatcctttctcagatcgataacaatgtctcactctgctgtttctcaggtcagatcctccacacatttccttatttttttagtcaacgattggattttatatcttcttgattatagtgattatagctggagagtttcgaatcctctgttttgtttaggggtttgatttgggtcttaatgttccatttgtctgttttcggagaaaacgagggaatttttaaaaactttattgatttgaggttttattgatctttaatctgggtttaggcttgtctttaattcgattaacgatcttttcttagtgatcctgtatttgagtttcatttgttatcagaaaggagttttaatctgatggagtttaaatttcttctatacaggctggtgctgtctcagtttcaattgaaaaccaacgttctcttagaagatccgtcttcaaggtgatgcatctaatctctcatataagtataaagattcgagcttgagctgtgttcatactcagagtcatggattctgattgtcttctacatgatgtctattgttttgtttgcttgagtttgatcttaaaccatcgcttgctttgtgttgtactctatttccattctgcagcagaacaatagcataagcttcaacagcaagtcatggtcatcttctttagcattgaaccagaagacaacaagcataagagatgggaaacggtacccgagcacgacaatatgtatgtcggttcaacaaacaagtagttccaaggttactgtctctcctatagagttggaagaccctaaggatcctcctttgaacttgtacaaacccaaggagtcttacaccgctaagattgtctctgtggagcgagtagttggcccgaaagcccctggagaaacttgtcatatcgtcatcgatcatgatggtaaccttccttactgggaaggacagagttacggtgtgattcctccagtaagtcatgtccctcgtgctgttacgttgtcttcaaattgttaccaccattcttaatctcttaaatctattaatgaactggaacttttgcgtgtagggtgagaacccgaagaaaccgggagcgccacacaatgtgcgcctttactcaattgcatcaacaaggtacggagatttctttgacggtaaaacagcgagtttgtgtgtacgtagagctgtttattacgaccctgagactggaaaagaagatccttcaaagaacggagtctgcagcaacttcctatgtgattcaaagcccggtgacaagattcaaatcaccggtatgtaaactaattacccaaccaactgatctcatacttaaagaccccttggactaagttttcttttaactcaatatacatttcaaaaccaggtccatctgggaaggtaatgctattacccgagagtgatccaaacgcgacacacataatgatagccacgggaacaggagtggctccatacagaggctacttacgtcgaatgttcatggaaaacgtcccaaacaagacatttagcggcttagcttggctcttcttaggcgtggccaacaccgatagccttctctatgacgaagagtttaccaagtacctaaaagaccatccagacaactttaggttcgacaaggcattgagcagagaggagaagaacaagaaaggtggaaagatgtacgtgcaggacaagattgaagaatatagtgatgagatcttcaagcttttggacaatggagctcatatttacttctgtgggcttaaaggaatgatgcctgggattcaagatacacttaagagagttgcagaagagagaggtgagagctgggacttgaagctttctcagctcaggaagaacaagcagtggcacgttgaagtctattgagctctttatttgtatttgctgtttttgatttttgatttaagaatcgtaataaatttgaatttggtgtttttctacttttcaaacatgatatgatgataatatctgaaatttgttggttttgagaagagaatattctcagagaataatcaatatatcatttatgtagtgacatgagccatcaagaaaacgacgaaaaggtatatactattaaagttgagaataatcttatcttacatgtgctgccataaacccaaccaaaggttatagaatattgcataaaatattcgaatcgcctaacgtcattttaatgaaaattttagagagtttataaatcaataaatcataataatcatcggtttaccaaaacataagtattttgaattttcggcttttgttcggttatgtagctgaacaattcgaattagtgtcatagattcataccgaaccgagattactctcttgtctgatgtctctagaattcaaacaaatacgaaccggtttcgctatcgatg

SEQ ID NO: 9481 - DNA, 3000 bp, Unknown
  misc_feature (1)..( 3000): cDNA_ID_2182736_gDNA_ID_1972123_Annot_ID_179071 3000 nt of promoter + ATG
gtatatttttgcagacgtgcatactaaaagtcgatctaaagtgttgcattggttgccaaaaaaaagcaagcatgaaattgcagagtatctctggtaaaaaatacttcaaagcttttaattgcgtggctcatatgtctttaaacatgatgatttaaatactttgtttccaatggaaataggtgtagaggaagtggagtataacatcgaaaaagggctcatgacagtcagaggtgacgtagaacccatggctctggttcgtaaacttaataaacatgacagaaaaacagagcttttctcagtcaagtaccagcttgatgatgatgatctaaacagtgattcagaagactactcttcttctgactctactaattcatcttatgatcctaaacccatggaacgtcaattccaagagaagatgatgcagcagaagaagaagaagtctgggatactaaaaatgctttctcttttatggtgtttcagcagtaaatcaaaagttgttcagcctttaccgatgcgaaaccgaaactggcatgtcccatcaaagtttgagaatgttcctcctggctttggcttcaattctactacatcgtcgcagttgcggcctccgcatccaatgatgccctatccaccaatgatgcaaccaccaatgatgcagcaacaacgaccactaatgatgcagcaacaagcacaagttccaatgccacctaatgttaacatgttccagtcagcaccccaaccgtttaagatgcaccctaagttgcattacggggagcagaaacaggttgtcacctaagctacttgttctgttgattatgtctctgatacatatactaagcaaaagaattgtttttaagtttcgtatcttttgccaattgccgatagtgaacatttctcaagtctggcaaacttttaaaacaaaagaacaagggtacattttgaattcatttatgtgtgattctctgcatctcccaaacctggttccataaacatttggataagatgagctttgtttgtgtcacggaacaagaatctcattcataacccaacagagaaaacataaataacaactcaaatctgtgcctattgctagtactagaatctattgtttttgatacagagatttctcttggagaatacttgtcttgagatttgtctgttgtgcttgtgcatcatgttttcctccgatttaatggttgttttcatgttcgccctccaaatctttcaagtatcccatgaacaaaagaaacccgaaaaggaagaatccacctgaagagctccctccaccgcctccgccaccaccaccaccaccatcatcccgaggtgggaacccgtttccaccgtcatcaagctttggggatttaacttttcctgatatttaagttaaggctaaaaaaataaattctgaagatacaaacaagaatagaccagtccgtttctgttaaagcacattctcaagaataagaaccatagcaagccacaatttgagttcaaaataactgtttcatattagctagaatcgtatggttttttaagcccctcttgtttgttagaaacgcaaaatagttgttcaacatagagaaggggatgaaacaatttaccatgagtaggagcttgtgtgattgttggtgattgccgtgtaacggtctgtgtttgtccttgactgcattttgaattctgcagaaaacaaatcagaataagtaaacagctagcgtttcagagacacttaggaagagaataccggaaaataaactattatcggccataagagcaaaaggatcttgttcataaaacaagcaaaatggcttatgatgtgtaattaagttatgtgagcaaaatggtgtgtgatgaagttatcccaacagctaaagatttaaaacacttaaacttaaaggctgcaaagtcatgaatggaacctaccagcgcagagttacatgcaaagactggtcttttattcttagagacgacaactggttgcactgcatcctggagagaagggaatttactttggctccaaggctggcgttgcatagaaacgcttgtaggataacgcctttgagagtttcctattacagacagcaagtagaagaagagctttagaattccattgttcattcaataaaagcaagctcgaacgatgggactaaagcaagaatcaatgctacaacaacactcactaaagctctgagatatcaataacaacaacaagtctagtttcttcaatttgtcaagagcaatccaaactcaatttcaaagaattttccaaagaagcaattgtaaacttaagagccaacaagtgttgagatttagaagagacataccattactcgtaaaagatttctcacgaggagcgaggtacaccgatgtttgtgtaccaatacacaatgatggattcattaccggcataactacaaacagcaacaaaacaataatctttaacctatttcacaagggagaaaaataaaaaaaaaaatcaatttctcataaatcgaatagagaaaaaaattatggattcatcaattttgaaattcgattaatgataaaaacccatagagatttggatcaaagcaggtagattttttgtcgaggaaaaatttgggattttggttgctcctcgaagcttctcgatcatagaggacgaaacgcaaataaatagtttataagaagaacaaaaaagatgaggaacgtgaatcgcacctgaagactaaaacgcaaaaagacggaaaaaacaaagatctttcttagggtttatgtaaaattctcgcacaaatcaattttaaagcgttggcttctattgcaagaatctaaatagcccagaaaataaaataaaaggacaaaatatttctcctttgtttgtcggttttttattttccaacaaaatgatatttgttttatttattattactaaggctgatcggaaaaaattaaaaaccctaatttgagcagatctttccaattgaaagcgaaccgtgaattttgagtctctttaccggcggcgaaaaa

SEQ ID NO: 9482 - DNA, 3000 bp, Unknown
  misc_feature (1)..( 3000): cDNA_ID_3042066_gDNA_ID_1972123_Annot_ID_179065 3000 nt of promoter + ATG
ctgtactgctaatgtatcaaagttgtgtttggtttctattttccttttcatacattgtgttttatcagtcttgtggataaaaaaaatcgttactgctgttccttgaaaatttggttttgagctctttattttcttctaatgactaatcaccagtgtcttgcttttggttcctacaaaactcaattcagtatctgtagttttggcaatgccttgcttctaataatgagaactcttgactcttgttgtagaaatcagtctctactaagccttctctttgagaaagaatgttattacttgcaatctctcatacttatttttaaaatggctatctgcagtttcccttgctctctagaagtggagtcatggaaagaaggattgcagaagcatcaaaagaaggcgatgataaatgtctcattgaaatctctgatcttcctggtggagacaaaacgtttgaactagtcgctaagttctgctatggtgtgaagcttgaactcactgcttctaacgttgtatatctcagatgcgctgctgagcatctcgaaatgactgaagaacatggggaaggaaatcttatttctcaaactgaaacatttttcaatcaagtagtcctcaaaagctggaaagattcaataaaagcgcttcatagctgcgatgaggtcctcgagtatgctgatgaattgaacattaccaagaaatgcattgagtcactagccatgagagcatcgacagacccaaacttgtttggatggccagttgtggagcatggtgggcccatgcagagtccaggtggcagtgttttatggaatgggataagcaccggggctagacctaaacatactagttcagactggtggtacgaggatgcatcgatgctaagttttcccctttttaagagacttatcacggtgatggagtcccgcggcattagagaagacatcatcgctggctccctaacctattacacacgaaaacacttgcctggcttaaaaagacgacgtggtggacctgaatctagtggtcgtttcagcacacctttgggctcagggaatgtactgtccgaggaagagcagaagaacttgcttgaagagatccaggagcttcttcgtatgcaaaaaggtttagttccaaccaagtttttcgttgacatgcttcgaatcgccaagattttaaaagcaagtccggattgcatagccaatttggagaagaggatagggatgcagcttgaccaggctgcgttggaagatcttgtaatgcctagcttttctcatactatggagaccctatacgatgttgactctgtgcaaaggatcttggaccattttcttgggacagatcagattatgcctggtggggttggctctccttgttcttcagtagatgacgggaatttaatcggatccccacagtcaataacaccaatgacagcggttgcaaagctgattgatgggtatcttgctgaagttgctcctgatgtcaatcttaagcttccaaagttccaagctttagctgcttctattcctgaatacgccagactcttagatgacggactctatcgtgcaatagacatttatctaaaggtaacactcaaaagaaccctatcaatctcctatgtaacaggtttcttttcacacagacagattaagttttctctcttttgatgattctcagcatcatccatggttggcggaaacagaaagagagaatctgtgccggttgttagattgtcagaaactctctttagaagcttgtacacatgcggcgcagaacgagagattaccgctaagaataatcgtccaagtgctcttctttgagcagctacagctcagaacctctgtagctggatgcttcctggtctcagacaacctcgatggcggatcaagacagttaagaagcggaggatatgtaggaggaccaaacgaaggaggcggaggaggaggaggatgggcaaccgcggtaagagagaatcaagtcctgaaagttggaatggacagtatgagaatgcgagtttgtgagttagagaaagaatgttccaacatgagacaagagattgagaaactcggtaagacgacaaaaggtggtggttctgcaagcaatggagtcggtagcaagacttgggaaaacgtttctaagaaactcgggttcggttttaagctgaagtcgcatcaaatgtgcagtgctcaggaaggttctgtgtctaagtctaacaacgagaatgtgaagatagagaagctaaaggatgttaaagagcgtcgtgggaagcataagaaagcttcgagcattagttctgagaggtgaaaatggtaaatttccacggttcaaatgtccagttactgtgtgtttggacattgtttagctaaaaaaaacaaaagagagcttccattgttaaatgtgtgcattgtaggcttgtaatcatgtttctttttttcaattgtttatgtaactttgactaccaactattttgtcatttttatatttttattttaaacctctaagaatattggaaagattcaaaaattactgataacgaatatattaattaactatgtaataatcaatcttcatgaccacaaggattattaagataaggtttactttttttatactatacttattggggagtttcagatttgataagtttatgtctagcctttaattaatgatttagagttaatcaaaaataaaatctggaagactttgaactgaccaaaaagactctcatgctaagtaattgaaggacatttcagccgccagcttgacccaattaaaaagcccattttagtttttcttccctttgttttctcttattttaattttacctcagtttataatattttattctctgaaatctgaaaaatcatctcttctgaaaattttgttttccgttaattcgtcgagtctctcgatctccgttctcatcagatttcaaactctccgatctcggattccgacgagatattagtctcattgtcgaaagagatctgttccgatacggcgtgagaa

SEQ ID NO: 9483 - DNA, 3000 bp, Unknown
  misc_feature (1)..( 3000): cDNA_ID_2182724_gDNA_ID_1972123_Annot_ID_179068 3000 nt of promoter + ATG
tatagatgatgatacgaatgatcttgacttcataagttatagaatgttcacaacggtctttacattcaaaattctattgtgatttttttatttattgcttatggcaattcttcggattcattaccgataaaattttagattataaagtcaattggtaaatatggtactaatctggtacgggacgaagttggaatcttaccataaatattagacatgctccacgctggactacaattcttcttcttcatcgactaatcataccaaaatttcattgatatcggattctagtcaatcgtcggatcatcgattttttgaggaaaacttccaaatttctctatgattttttaggctatgaattaaggatttcatttgatttgtgaaaacttgaaagttgtagattacgaattaactccatcagtataaatttaggatgaagttccatggtggttatgatattgtgtgatcaaacatttgacgagagatttacagctttcttcgacgaagaaaccatggactttttttctcatgaattgatctacctaaatggcgaagaagggtttcaaggatgtcggttctcgagttgggaaaagttatttttctatttctatttttcttatttttggtgaaaatttaatttaagtcgttatatagagttttgggcctttaattttgccaataaacgttaaccttttttttttcttagactaatacatgtcttttattgatataatgaaatcaacatttgaatatgtactatatcaacatttaaactccttttgcttccatcctatatatactccttgaggattttcaagctttagaatctctttgtgaccaacaatctcattgcctctgatcacctttttcgtagacttgtacatccacttcgcaagaggctgaagacgaatctctctattaaaaaggttgttccgtagacggagtcttggaacataatactagtaatgatttttaggaaagaacttatgagttggaagcacttgattctctgataatcaagataaaactcaaaatgaattaccagattgcgcttgaagttgttgtttgtgatatatggcctcaaaaaatccacaactagctcaatttctgaagaagaaaacttgacacccctatgcggcactggactttataatattttaggttttggatatttaagtttaagatttaattttattagcatacaaagtaattaaatttaataataattaatactgtaaaagtaaatttcatgaattaaactattttttgaggatcaaagctattgcgttccatccaacctacaagatttagattttgtgttcgtagagaggaaggtaacattttttgtgagatcatcttcaataacaaacaaacataataattagaaacgaagctttacaaaattttaaaaactgaaataaaaatatataaattgagataacttacttgtttcaagaggtgaaataaacataggcaaagatgtaggatcttttgatgttgctttccaaacaacaactacacgaacaggaaatgaaaaattagacgatgatgaataacacgaagcacaaagattagtatacaaatataattacgtgaacattattgaagaaaaaataattgtcttatttttgagttatggagggcacataaattacatgttggtaactatttgttatatgttgattagcacaatagctaggaaaaccaaaacatgtagtcgattaaactaaccttgcgtaaacaactcatcatcaattggcaaagatctatgagattttattttccatggaccataacagaaaaaggagaaaagaaaaccgatgacgatgcatcatagaaaggtccaagattgaagtaaaaaaagaactataaaccataattattacatatcatgcataaaaatcaagccgtgatgtttgagtttcaagggagaaatcctatatttatagaaattttcaacataaggttttagggttttagatatgacggcataaattatacggacataatttttttaatagaaaaatataagtccaataggcgaataagagaattaggattgatagacgaattaggggtgattagagttgattagggttaataggcgaattaagattgatacgcaaattagagttgttatttgtaaaacagaaaagattacattacattttttacacattttttttacatattaaaatatggaaatctcattaatgtaaaatataatcttattaattaataattaataattaaagggggcaaaaacgttcgttaatattctgagagcaaacgtgagcactttgatatataagataaagtttatttatttcccaaatgttacgaaaaattaattccgtcatctttttgttaacaaaagtttatcgatatgcttaaaatgatccaatcatcgaaatttaagtatttttttataaagtcaaattaaattttaaaattttaataatatttcaaaattatatactttttcatcttaaatttaaaaatttgtgatttgtttgacattttttcccaataaaatatagtttcaatttttctattttgctaagatagcaatgtctgtttataatacaaatttggatgtataataaatattttgtctcacaactaacacgttgaaaatcgaccactacttggtacgaaaatagcaaaataaattaatttggggcttttcttaaagaaaattattttatatttttctttaattttgtgtttgtgtcgtccttctatctctaagaagcactacccctcccgcaattgaaggttctcttcgtcgctcacatccaatctctatcgatctcagattccaatttctgcgaatattttcttcccagagagattacagattctagggtttcgaatagttctttccaatctagtcttcttccttttgtttctcgggcgaaatttcccttagggtttcgaagatccgaatctgtggacggagacaattcgacgtcttcttgagctgcaaagatgttctggcga

SEQ ID NO: 9484 - DNA, 3000 bp, Unknown
  misc_feature (1)..( 3000): cDNA_ID_2182720_gDNA_ID_1972123_Annot_ID_179066 3000 nt of promoter + ATG
tatgtaataattatggtttatagttctttttttacttcaatcttggacctttctatgatgcatcgtcatcggttttcttttctcctttttctgttatggtccatggaaaataaaatctcatagatctttgccaattgatgatgagttgtttacgcaaggttagtttaatcgactacatgttttggttttcctagctattgtgctaatcaacatataacaaatagttaccaacatgtaatttatgtgccctccataactcaaaaataagacaattattttttcttcaataatgttcacgtaattatatttgtatactaatctttgtgcttcgtgttattcatcatcgtctaatttttcatttcctgttcgtgtagttgttgtttggaaagcaacatcaaaagatcctacatctttgcctatgtttatttcacctcttgaaacaagtaagttatctcaatttatatatttttatttcagtttttaaaattttgtaaagcttcgtttctaattattatgtttgtttgttattgaagatgatctcacaaaaaatgttaccttcctctctacgaacacaaaatctaaatcttgtaggttggatggaacgcaatagctttgatcctcaaaaaatagtttaattcatgaaatttacttttacagtattaattattattaaatttaattactttgtatgctaataaaattaaatcttaaacttaaatatccaaaacctaaaatattataaagtccagtgccgcataggggtgtcaagttttcttcttcagaaattgagctagttgtggattttttgaggccatatatcacaaacaacaacttcaagcgcaatctggtaattcattttgagttttatcttgattatcagagaatcaagtgcttccaactcataagttctttcctaaaaatcattactagtattatgttccaagactccgtctacggaacaacctttttaatagagagattcgtcttcagcctcttgcgaagtggatgtacaagtctacgaaaaaggtgatcagaggcaatgagattgttggtcacaaagagattctaaagcttgaaaatcctcaaggagtatatataggatggaagcaaaaggagtttaaatgttgatatagtacatattcaaatgttgatttcattatatcaataaaagacatgtattagtctaagaaaaaaaaaaggttaacgtttattggcaaaattaaaggcccaaaactctatataacgacttaaattaaattttcaccaaaaataagaaaaatagaaatagaaaaataacttttcccaactcgagaaccgacatccttgaaacccttcttcgccatttaggtagatcaattcatgagaaaaaaagtccatggtttcttcgtcgaagaaagctgtaaatctctcgtcaaatgtttgatcacacaatatcataaccaccatggaacttcatcctaaatttatactgatggagttaattcgtaatctacaactttcaagttttcacaaatcaaatgaaatccttaattcatagcctaaaaaatcatagagaaatttggaagttttcctcaaaaaatcgatgatccgacgattgactagaatccgatatcaatgaaattttggtatgattagtcgatgaagaagaagaattgtagtccagcgtggagcatgtctaatatttatggtaagattccaacttcgtcccgtaccagattagtaccatatttaccaattgactttataatctaaaattttatcggtaatgaatccgaagaattgccataagcaataaataaaaaaatcacaatagaattttgaatgtaaagaccgttgtgaacattctataacttatgaagtcaagatcattcgtatcatcatctataacataaaaaatgaaaaggagtatatgttttgttggacaatactatgaaagaaattaatgggtttcaactttcaagtaagttgatcaataacccatttatatgcaaaaagagtttttctttggtgcaatatgcgatgggtttattttttatttttggctcaacatcaacttttcattaaccaattcaaaagtataagtgattcgaccacaacatattttaaccaaatacaatgaatcagtttagtatcaccctgaaacactaagatggattcaacgctatccaactgaaatttactgtatttttccaaccacaacgagatgaattacaccacgactctaagtgaaatcatctcttaaaccacctaaattcacccaatgacacaaaaacaattactaacacaaagaaaatcaaatcctatcctaagatccaatccaaatccaagctattagtccctcatgatccgagtgtagaacgtgtcctaatagcatctacgccagaagcgcaacttcaaaaaggttttgactcctcggctttcactatttcggtcctaagtctaaaacggatatagtaatccgaatgaaactcaacaggataccgggctgagacaaaagtttttgaaaccggggctttattggagagctttccttcttcttcaacaatccaaatggttttcttttctcccctacttctaatatgaccggagaatgcgatggatttatttatattagtcttacgcaattcatattattatatttggagatggaaataatatgactggagaatgtaattagtttagagaacaatgagaaaaaaattaaatcaagaagaaagtttatttgataaggtattattactggtcattgacttgtaatttgtaaaaattcacaatactctgtatacgaaacgagatgactttggttaaaacacaaatactgaaccgacaaataaataaattaccggtttaataaaccgttcaaataccggttcaatctgatagttatacgatgaaccgagcttgagtcgttaaaccttgtttctaacatcagaagctcgaatcctccgatttgatctctctgttcgtttcttccaaaccctagaaaaatccttagcaatg

SEQ ID NO: 9485 - DNA, 3000 bp, Unknown
  misc_feature (1)..( 3000): cDNA_ID_2182999_gDNA_ID_1972132_Annot_ID_179091 3000 nt of promoter + ATG
gttatttgatttagtcacttaatcgtcagtaatttcataagttcaatttgttttctaatcgttatgtaaatttagcattttatttttttcgtttttagactagatttacaaaacgatatgaaaactaaccggactttggatcccgtcatttgacctagtcatttgatcgttagcgatttcacaagttcaatttgttttctaatcgttatgtgaatttagcatttttttgtttttgactagatttataaaacaatatgaaaactaaccggactttggattccgtcatttgatcgttagcgatttcacaagttcaatttggtttctaatcgttatgtaaatttagcattttctgatttgtttttagattagatttacaaaacgcttgtcacttgatctagtcattttgttacaagttcaatttgtttttttttttgcgtattttagattagatttacaaaatgatatgaaatctaaccggactttggatctcgttatttgacgtagtcatttgatcgttagcaatttcataatttcattttgttttctaatcgttatgtatatttaatattttttatttattttagttttagatttacaaaactataagaaaactaactgggatttgggtagcgtcatttgatagttcaatttgttttatcatacgtaaatttagtactttagttttttatcagaaaaaaattgctttgaattttcaaattatttttataaaaaaaattcctacaaattttatacaagtttttgtgttttgtttttgttcttatgtcaatttttcttcgtttgtggaataattcattacaccaattacgtattgaggaaagaaataactggcaaatgtctaatccttccaagagtgttcgtagttttgtgttataacattagttctctgttcatcatacacgacatgtttttctgctactttgtttaaccaaccctaaacctcaattttcacagaatcctgtaataatctatttcgataacccgaggtctgctccattcgatccaacccagatgttgttcttcatttcataattggattaagaaagctctcactcttgttttttgagtgcatgatcatcactgcttgtggctccttttgtcaatttgttcacactatctttggcctcagcgagaaatgcagcgtctggtttgtgtttatctgcaggttctttcatggccatacagatgtagaacacgatcactgtgttcactgataccaccgcaagaaatccgctcaagagaattagagaatgaggagacaatgtcgttgaacctgttaaagatcaagctcaaaacactgatagtgagtattgaggtcagcttatcacattaacgagctgagcaagtaatacataaaacttatgtgggacagacaacgccaaaggaacaacgagcattggatgaatgtgaagatcatcaaaaagctatattgatatgacaattctaagagagtacagtttcaaaaagttgtacaatagagaaaatttctaaaactaccaccatagccaagtaaaaggaactattaaactgctttcatgagaaaagttctacataaaagagtgtacgtagaagccaaagatttcaagaatttgtgtagtttatgatctccagcgaagaagatgaagttgttttgcttcaaggcatcattgacttcactcattaggagtggaaaccctagtaagaatatatatgatttttatgagtttgtgaagatctctctagctataatgataaggatctttctggcttttcatcttcttcatctttgacccttccttcaagttgtcctagcgcatcttctttcaatttctcaaaccttcctcgacaaatcataacgacatgggccaaaaggtatcggaaacccaatctctacttcagtctttcccttttggaaagagagagactgaagaagaggttgagttttcgaaaccttttaaccaaagttgttatgatttgtcaagaaagatttagggaattgacagttgttgccttctaaatcaaagaaagtgcgccaaggacagcttcgaggaagagtcaaagatcaagaagatgaagagccagagagatacttatcatgatcaccagagagatctttacaaactcatagaaaacatccatattctcattaggcttttcactcctaagaagcgatgaagctaaagctaagatgcgaaatttagctcaattgttttacaatccaactataaagctaaatagtagataacaaaatatgaaaagttgcacatttgtgaacttcatacacaacaatattggaatgaatccaactcgaaattgcatcagcataactagaagataaaactcaaccaaaagaaaattggagaggatcgcaataaaacaaggagattaattaccaggaagcaaattgtggttgaatccgtataatatggcaacaggaagaatccacatgaacattgacgcaataaggaacttgtgcataactccagccatggcaaaaccaccgaattgaagtttacagaaatcgagagcccattgattttagatgaaatcaggaatcgagagacacagatcttgctcagggttaagggatggattgagtccggcgttggatctagcgagtgcactctcggtcttagactcggcgggttaaataagattgcttgtaagagcggtataagccgattcgtgggacggtacaaacattaatcttgacggtatttttttactaagattattttgacggtttttgtttaattttaacggttttttttgtactacaattaattttgacggtttgattatttgatatgtttcaatttatgacttattaaatagatagacatggaataaaggtaaggaatatatattgtttacaagttatgcaagattggaatatctcatcatgtaacaagattatcctaaaaacaccgacttataagaaattaactcttgcattatccttaaagtaagagggaacaaaaaaaacacataaagaagaaaatg

SEQ ID NO: 9486 - DNA, 3000 bp, Unknown
  misc_feature (1)..( 3000): cDNA_ID_2183028_gDNA_ID_1972132_Annot_ID_179104 3000 nt of promoter + ATG
gggattacaagagacggaaacaagagcagtgagaaaccaaatcagcgtgaatcttccgcagatggggaaagatacgattgataaagtcatcttctttcttcttcccacgtgcctgatgtttacagcgtcagtcgtctcggcggagaagttgaaagaaaccaccggaccggcggcgacgacgacgacgacgaggaagttcagaaattacagagtttgtttggtcacttcttccaccaattcccgtattttattattttttatttccagcgtggacttttctttttctttcgacccattaattcgatatttttatggtttcattcaggtaaatttattacatgtaaacttaggtgttactgacgctgttacaactcatattttactgttcagttatattatcctttttgtcgtttcaactttcaattgtaacaaaattataaatcataggaatttgtttccttaatttaagtattaggttatgagtttaagactaaaaaccatgtgaacaaatttataacaaacgaatagaaacaaatatcattcgcaaaccacatttatgtttccttgctctttctctattttacacacattcttccaatacaataattaaatatggttttacatacagaaaaatataaaatgtaatgttgtttgcattataagttctagagggacaaaaacacacttcttctttttttaccacaagcaatttcacttattacgtaacattaagcaagagagacttgagagcaacggcgatatatcataagacttacgaagaggaagaggaaggtacagttgaagggttgaaaggtttctgttctgcgcagctgagctcatcgtttggtcccgcgtcttctcttccaatacccatgaggtcaaggaagtataagtagtgtgagattatgttgttcattggatcaatggaaccttgaccacatgtgtactctccgtagaggacgttcatggtgctgccaaaagtcgggccacgcttggacaaagtgtcgttctttgtaggtttccagtttccgacaaagatgtcgtgagctgagggctgagctctcttgattggagtcatccatctccagattgcagcttggaatgcaagtgtcgcgttttgctcaatgtactcagggtggttcaagagatcagctttcagggcttccccagctgctccgtagttgaagttccttcaaataacacacaggtaaaaataccttcagtatggacgaatgcaaattgtttgacacagtttttatctagagcttcaaagtagaagagaaatgtgtaccagtaaatgggtaaggcaccgcgtccgtagtattcagctccagggctgcaggggtacttgaatttccaggactcgtcacagtaggattgcattgggctcatttccctgttgtagcacagaccccaagctaaaggccctcctgttgcaactccatagccacctataagacatcacagtaacactcatatgcagcttcttacaacatagaaaccaccaactgcaacttagggcatatccattttcatgattctgaatgtcgagtttgatcagattaatataatggtatagctatggaggtaagcttaaagcatccttttttctattcatagttagatggtcaactatgtagaaagaggactaaaatgaaggaaaacttacaggacgttttgctggctacatgaccgagaaaggcagccatttctttctgtcccatgagctttcctccagtggtaccaaaaccaagaggctcaaagagggcagcagcagtaatgaaagactggtagtcccagaaaccaacagcatgagcaatgggagtgttccttttggaaaagagttgctcaaactgataaacctgaaagtaatctgatatcgtctggttacagcagtatttagaccaccagctgcattcccatccttgcgtgcacaccttatttcccctcactttcttcactttaatcgttttgtcctctccattggcaaccaaggccagaaatgatacagccagcagaaccaaaatcacgattgaaccactcctgattgtcaccatagcttacaactatggaacaaataccagctacaagctgcaaacatcaacaaaaaaacaaatttagaaacatccattaatcccaagtaagcatctgaacattactataaagaaaacagaacacaaattactaacaatacagatctaccttatacaataggcacttaatgccaaaaagctgattagaaacaacaaaggaagaattaaaccaaaaacatggaactctctaagttcttaagtgaaaaaactaagaaaaattgttagattgaccaatattataccaacttggagagattgatgtataagatatgcgaagacttcaaatgtgagatcacgaattcaataaccaagcaacgaaacaaaattctctagtcaagatttagctaaatcgttaccaaaattaggcataagtacttgtggaaaaaatgcttacccgcaatgcagatcagctatagatccagagagagatcgagaaaactagcttgtgaattcaaccgacaaaaattaccctttttgcttcgttgccgagaaaataaggaagagattcttgggaaagagaggaggaagaagaaacactaaactaaagcgggtgacggatcagcagtctctatcaaccgttggattagagaacaatcaacggtgaagattgcgtttggtgtaatgtatgtgtcggttagacaagacagcctggttcgtgttgtgggccctactttactgaagtggagccttccaccgacagccgcacaccagcagaacctgatttaaaccaatcggtctacttcgatttttttcatgggttttcggttcatgttatggcccattgggcttttaagtaaggcctttctataaatgtcaattttgccagagtttcctgtctcgtccttgtctttcctctagccactcttcgccactctctttctctctcccttgttttccaacagtaaca

SEQ ID NO: 9487 - DNA, 3000 bp, Unknown
  misc_feature (1)..( 3000): cDNA_ID_2183052_gDNA_ID_1972132_Annot_ID_179111 3000 nt of promoter + ATG
atgtatgctgctactactctatcatctgccaaatcaatctctgcagaatccctaaatcttcgttccgattccaattcaggtctactccgaatttgtgggaattttctactgatggaacttagctttctaactggtcgagttgttgattagatgcttttttttttttttttttttttgaatcagaggcagcgcatggtgcttctgagtctgagactcgagtctctttaaggaagaagaggataaagcaggatgatttggagcctgtaaagaaatgttccgccagagaaaccaaggcccgcaaggtaatatataatagggtttttggaaatttcaagtcttgcgtcgagtatgataatttttgagatttataggcaatttgttgatccctttgcttgagaaaagttactgctttttatgttcttaactaatcagattttaaagatgtgtattatatgatcctcttggtcttttgtttatgtaatgcaggacatgtgtggattacctgatatagaagactctccttataagaagactaatggaactgcttcatctagtaagtctcactatctatagttattagtgactgagccaaaacttgttctcactactcttcaactaacaccatgattacttgtatgaaattgttttgcagggacgagaaaactaaactcatacataaaatcaacagaagctagcccttctgcatcgtcgatcaaaacagcaggttttctttcacgagactctactctactactcttagtggcattttgggtacatttattctttacggaaaacgcgatgtccctaagatgtttatttagggctaggcataccacctgaaaactgggaaaaggtgctcgagggtattcgaaaaatgaaaccttcagaagaagcaccagttaatgctgtagaatgtgatagaaccggaagctttttacctccaaaggtagaaatatcttacactaaatggaattgaggtattgctgagtttgtgcctattggttttatgtggaagtatacaatgagatagtttcattgctttctcaaatattacttcccatttgcttttcattattacatggtagtactctatgcatatattgggaaccaagttccaagtggtttaccgtgaattagtaacaaatgctagcttatgattagaaaattttcatattctgaattcttgcttccttgaaaggtcgatggaaggtttcccttcttgtttttccttttgatcttatctctccctatttctaggaaaggcgattttatgtgctcataggaacacttctttcaagtcagactaaagagcacataactggtggtgagatttgaattacttatctctccctatgttgcaagaacgcttaatttcagcattctagtatctctgatttcatctggatctccaagtttcctgatattatattcaaacacttataatatgcagcggcagtagaacgacttcatcaaaatggccttctcactcctgaagccattgacaaagccgatgaatcaaccattaaggaattgatctatccggtacattatccctttttaatcttacttcatgttgttaagggctctttgactctgctatgcccccagctgccatatttttcatgagaagtatttaagaaattaaaaggaaaggagtgagaaactataaatagaaattgttgttatcgttttaatttcgataagaaacttactgtttcccctttacttttaggttggattctatactagaaaggctactaatgtgaagaaagttgcaaaaatatgtctaatggaatatgacggtgacattccaaggactttggaagaactactttcacttccaggagttggtcctaagattgctcatctggtataagttgcccatattattccgctttgtaagagagatacatgttttcaaagttcttaaaaggtttctttgatgtactgcgataggttttgcatgtagcctggaatgatgttcaagggatatgtgtagacacacatgtgcatcgtatttgcaatagacttggttgggtgtctaaacctggaacgaaacaggtgcttctctaacaccaggtttatgttgaagtatatatggctatgagattgatttcttaacacttggtaaaatttggttcttctttagtttgcttatctgctcttggtcacctatctctactttgttcttgaccagaaaacctcgtcccctgaggaaactagagtagctctgcaacaatggcttccaaaaggagaatgggtggctataaactttctgttggtgcgtcatcctgggatatcctaacttatagatgcatgaccatacatagaacaatctacttacactccacttaatcttcgtcctcacatttttgttgtctgaaatctcatcaggtaggttttggacaaacgatatgcacaccgctaagaccacactgtggaacttgtagtattactgagatttgcccttctgccttcaaggagaccccgagcacatcatccaaattgaagaaatctatcaaaagcaagaagctttagttgctttggctctggattctccttctagatcattgttaaacccattttttgattagtcctcggttaaagttaaattgtatccaagatattgtatagctttatggggaatgcaagagcatcccacttgtgtgtaaaactaaaacttatagaatggaaacttacccttatgaaagacactgggcaagtacacttttaactgaatattatgaaaaaacttaaaagatgattcaagaaccttttaaagtgtttccactaaaagcaagtgatttggattttggagtcatccaccttgtaatctatctaatttgttatcaaacattaaaatttttgaattccccttatatagaattaacagaaatttctttctttggtcaaactaaaattaactgatattctatgtaaagactaaaaagattatcaacaaattgaattttgcaagacggaagaatccttactgatgtg

SEQ ID NO: 9488 - DNA, 3000 bp, Unknown
  misc_feature (1)..( 3000): cDNA_ID_2183040_gDNA_ID_1972132_Annot_ID_179108 3000 nt of promoter + ATG
tttatttagctttttctttttttgacattcattagatgaaatggcatcctatccaggggtctagatgcgccattgatcttagtccaggttctggaaatgccagtgtctcctgtcaccgtttggttagattctgttggaatgtgagttttttttagcttgaatccttttgttttgaaaccattttctattactatatattgaatcttagcttcagtgcagagaagacgctcacagtcctgtggactgtaaaactgctgcaaaatggttagcaatacacgtttctgatatccaaaacccggaacgtcggtatatttcccatttatgaaatgattcagtctttttggattatgattttaggctactagaaaatgcggtgccttgtcccaagtgtaagctaaggatcccacgaaatcaagataattcactgaagatgaaatgcttaccttgtaactatgttttctgttggtaatatacttgttcttctagctactattagctcttatgatcttgtggttaattagtatgatcttactagtatgctctttcatgaaatgtcctctgcaggttctgccatgtcgactggattgaagacatggaaggaactggtggtgatttacacttttgtaccttcgatgctgtcttggtactttatcagctgatgatatttattgaaaagtttcttttttattgatctttcatgtaccttaattttctgatgtttttgtagagtgatcaacgtgggaaaatgtcagaatctgattcaaatagatacgaagattgttatgaaaattgggacagtaatgaattggtatatatgcatttatttatgaacttcaaatccattatttacctatgaaaaatgcattgatttcttttgagtttgtttttgggcagttgatgcaaaaggaacaagcaaacctgccaaaactagatactattgtaagataaatctatattgtcttttgtttcaatctctgtagattaaagttgaatcatcttttttttaataatctattttccagattcaggaactaagtaacacacagttagaaaacgtatcgcagcttaagttcatcctagaagctggacttcaggttagcaaaagtcaaactagtgtgagaaatatcttatgttttgagttttggtttccgacataacttaggtgatgactgatgcatatatacatgatacagatcatagaatgtagaagggtcctggaatggacttatgtttatggatattaccttagagaggatgaggtcgggaagcaaaatttattgaaggatacgcaaggtatgtaacttttgtatatgtatatgcataaaacacagagaggttaattttaaggtaacatatttttgttaatcagagaggttgaagaagtttgtggaaaatctcaaacactgtttggagactaatctgcagccgtttcgttacgaggaggaaccgtcaaaggatttcaatgccttccgcatcaagttaaccgaactaactaggtttgatattccattgtttcttgtaattttaacaagatccaacaattaaaccctaaaaccaatcaacttttttatttatttatttctttctttcataatagcctaacgcggaaccactatgagaatgtggtaaaagatgtagagaatggcttagctagtgttgtctctgagggggaagcaagtggttcaggccgtaatcaataatcatgatgattaaatcgagtctaattgttgagttccaatttactaccgataaattggtttaattgcaaattgcagtttaggctggaatattggatatatattaattttataaaaaaaaacgagaatgttctctttttttaatgtttgaaattactgttgtaaaaatgtttgaattgactaattataaaagaaaatattgggtgtgagttatgtactctgttttctaggtttcaaacattaatatattatacataatataagaaaagtagatcatttttataatcttgctaggtttgagccaaaaacgttgtaattcatgcataattaatatatatcaatggtacacattcgttgcatttagattgattcttgttccctatattatatgttactcgaaattgtgaatttgataagaattttgtgttgctcgtttgtttgtgtgattcatctacttagaagtctattgaagctgatggtgccaatatgacatcggtccggaattgcaaaccctattaaatactcaactcgaggaagtcttcatttttttgagatgtttaatttggggtttaccattctttcaacattttgacaaatcaaatccgtcacatctaaaactatctcattaactagaagataaaacaccaaaatgcaacacgtaactcttttaatcatttaaaaacaatatactatagttgaattctacatgaaatcattttcagttcaattttggcttcatggtgcttaaacattgattttcctagatttactttacgttgaagaactaattatttttgtttttaatatcacgtgggtgacttctcaaagaaaatgtcaaaaatctttgtaagaaataaacaaaatttctttttttaagaaaaatatcatagactttacttttatagaatttccattgttcttaaaatcgattactttgttctttttttgggtccaaactttaaattgattacactaatagtattaaacttttttttgttggttactaaaaatcaattgaaaccgatagtggcaaaagtccatatatctttctctcatctactcgatttctgaatcgcgaacgcagcgagcgatccggaatcgagagagagagctaccaatttttccaacttgttcggttccttataaagctgtttactttcccttgcgaattctctctctctctactataaagcaatacccttttctttcttttttggtaacccccaaaccctactttgtccagcgagaaaggaagaggggtttcgtctgattccgctaaatctctagtctttatctaaagatc

SEQ ID NO: 9489 - DNA, 3000 bp, Unknown
  misc_feature (1)..( 3000): cDNA_ID_3042093_gDNA_ID_1972132_Annot_ID_179103 3000 nt of promoter + ATG
ccacaggaattaagtttgcctgaattaagtttgcctgaatcaagtttgccacaggaattagaagtaaactgttaggacttcggaaatctactaaagaacctagagaatacattccaaatatatcctcatttcaagctaaacagcttaattaaaccattgtgtcaatgttgctcctcgcttgattgaagctccttgtaagttgtaaccttgtaaaggcactcacagctaaatctgtcaattcattgcagaagcagggtcggtcaaatggtatgcaggtagattaactgcttgaatagagattacaaacctatatattataaacgtggcttgcttcaatgcttaaacaaaggtattgggttcaagtctagctaatccacattcaacaagacaacaatagataattacgaacgatcacacagtatgttgtttgttgaaatccatgtctactcagcttaatggaaataaataactgttagctccaatcacgaaaaataaaacgaaaaccatgagacacatcctagaagctagtcatgctaaaagcatctttgctttgctaagcttaacaacaacaaaaaaaaattcctaccaacacattctgtgtgaacacgatctactacattctgtgtagatgactaccctatctatcaccagtcaaacacgatcctgtacctgtctttctcactagtgatgatagaaagccagtcatcttaccttccatttttgcacaattgtggaaacaaacagcttctgctcactctgtttgatttagcttgtaagttcttcttttactaagcttttcaatttgccctcttttcgtggatcttttctttttgcttgaatatgatgcacaaatgcagctactatgtcatggagtttcgggggaggcctgcttgctgaagaaacattatgaccagcatccttcaaagctcgagcaacatccttttgggctttctggaagtgcacattacagagggcaggaacagtcgatgcaagagttggttttggacaagttattgctttcgactgagctctgcatgaacaatgtgaccacatagagttagaataaagctgattatataattatcacatgctcattgcactccgcaatgcaaaaatttaagttctttccaatcagggatatcaaagcacagatgacacagacatctcacatctgctccatttttatcaccaatttaccataatagctagaccaccatcacagtaagaacttcataatgatataatcatgcagacaatcctaactcctatcatcttcgcccattacgatacaaacaatgcaaagtactttcaattcctcaccacgaaacaaaaccaaaaccagtatcaaggaactgaaatttcacagaatcataaaaacagattagcatttattgaagcacctattatttcctaatgcgagagaatatgatgcgaatcaaaaggaaaaaactatgaaactcgaaattgtgaacgaaccttttattgacgtaagtacaagacgtataaagcttctgctttttatccatgaggatatgaagctgacagtaattggtgagtgccatggccttagatttgcatccactaccacaagcaacacaattaccagccttaacgccatcgttgttgttattatcattatctccgctaccttcaatttcatccccagtttgtccttcaaccttacgtctcttgttttggtgataattctcatctttgaaaggactaacaccatagttccagctataatatctatgttgtgccttgagatcctccattagagcccagtaatggtctctgtagcatctagagagctgcttcaggttgtgcgatctgcgtcggagaagctccgggcgagtgaggtgattggaatttcccaggatctgatcctccaccgccatcgaaatcggtgaattcgatgacgtcgacgggttattagggtttcgaaattgggattcctccaatacaccggatttcgagggggttgaagcaatgatcggagatggatgcctaggaggtttggaagaagaagggttttgcttggaagctgacgccattgttactgttggaaaacaagggagagagaaagagagtggcgaagagtggctagaggaaagacaaggacgagacaggaaactctggcaaaattgacatttatagaaaggccttacttaaaagcccaatgggccataacatgaaccgaaaacccatgaaaaaaatcgaagtagaccgattggtttaaatcaggttctgctggtgtgcggctgtcggtggaaggctccacttcagtaaagtagggcccacaacacgaaccaggctgtcttgtctaaccgacacatacattacaccaaacgcaatcttcaccgttgattgttctctaatccaacggttgatagagactgctgatccgtcacccgctttagtttagtgtttcttcttcctcctctctttcccaagaatctcttccttattttctcggcaacgaagcaaaaagggtaatttttgtcggttgaattcacaagctagttttctcgatctctctctggatctatagctgatctgcattgcgggtaagcattttttccacaagtacttatgcctaattttggtaacgatttagctaaatcttgactagagaattttgtttcgttgcttggttattgaattcgtgatctcacatttgaagtcttcgcatatcttatacatcaatctctccaagttggtataatattggtcaatctaacaatttttcttagttttttcacttaagaacttagagagttccatgtttttggtttaattcttcctttgttgtttctaatcagctttttggcattaagtgcctattgtataaggtagatctgtattgttagtaatttgtgttctgttttctttatagtaatgttcagatgcttacttgggattaatggatgtttctaaatttgtttttttgttgatgtttgcagcttgtagctggtatttgttccatagttgtaagctatg

SEQ ID NO: 9490 - DNA, 3000 bp, Unknown
  misc_feature (1)..( 3000): cDNA_ID_3042107_gDNA_ID_1972132_Annot_ID_179095 3000 nt of promoter + ATG
ataaatattaattttgatgaaaaggaatttgtaaagaagcggttctcgtaatttttcttcggaagttgtcaaagaaccggcagatcctcgctgctcttgcattcgctcactacggtaacactctatcatctccatctctgttttgaattcgagattcgaactcaaagatttcgttttggaggattgcaatcttttcaatcaaaaaaaaaaagtaaaaagattgtaaaattgatcgttgattgggtgcggatgatctttggtcttcttgagcttaacttgggttgacatcagtttactgttttaagagatgaaaacccacaaggcatataacttttctagggtttagggtaattatattttaggatcaatcttctcgaaaaggaagaaaaattgaagcttgctatgtctctttaccttgagatatgagaatcacaggtcaaattatgttcttgatagattcagttgttgagttcatgtgtggtgttggaagaagtcaaaactctagttctagatataagcttgaaatttggacatgattttgtagatgtaagcttgaaaatggtttaggagagatgttactagatgcttccttatgccttctctgagactttaacattttgttgacacttttgttcttttttatctacatcttttgaatcatttgtttaaagcttttgcttaactcaaaagtaatttgtctcagcttttgcttaatggtgcctttttcctctggcaaacagatctcagactacagttaccaagatggtgtacgaaataactgagcaaaaaagtaattatttcttcacaattatcgctgtatagctttttcttgtgctgtttctgatgtacaactcttttggcaacggattttcgttagttctaagcattttgtcggtcctgtcgttcacttgtctttctcttgtcttataaacattactgaacagatcaaggtagatactgggtcagatttctttatatacgtgttatatctcttctttaggaattaaatcagtaatagaaatcacaaacttcatttttctttgtcttatggcttccatttcctgaatgtttgcagaagttgggttgggcctcattggttttggtttatcctttacgtttctcggagtcatcttgtactttgacagaggtttgctcgctctaggaaacgtgaggatatccttgttatttctaaacattaaatctacacaagggtccaacatttgagtctcatttggcttttgtgttcagttattctggttgataggtgttggccttttacttggttggcagtcgacttggagagtatttacaaatgttaataacttgagggtacgcattggactaattctaatctctgttaattgtttctcttgatgaacctttcatatggacatatcaatatgttcttgcaggggactatctgtttcgtccttggactctttctaatatttgtacgttggcccattatcggcattatcttggagatatacggtgtcattgtcctattcgggtgagtgcatttgtttctgttgctcatagtttcttatcgagtttttcacacattgtgcttttagatttgacatattaaagcagactgaaaaatgagtaaactagtggttctggcacagcacactaggatcttttgcctacagaatgatgatgtttgactaataacaatccatatctgatgaactcatttcctttcaccagtcacttattaattttattcagcttcttgcttaaagttttagcctgttacagtgtctaaccaacatcacatgtactaactttgcagcggattttggtcaacagtaaaggcatttctttcccagattccttttgtcggatggataatacagtatcctctcatggtaagtaatccacaacaacacttgccttttcctctaatgctcctttcttatgctttttgtacattcagagcttcctgtcagggccttgttcttgaacaacatcccgtgctcctgcctcaatttattcagtcccttgtggtagcttaagttagcctttctcggaaatggatagacccaatggacgtttcctgatatttagtttgcacatgatatagggatgaacataaaatgatttagagcgatggactgaattttgttttggaatgatctgtttatttttgcaggttcttgagcaacttgtaagaggtgctcgttgaaaaagatcaatctcaatctcatggctcttcagccgcttaacgacatcaaagcctttctttcttttttgggacatgacagagactttgctctgttttttgtttttttggtaaacctcacctttgctctgttttacatgtctaattttgctgtatatgccaaaatacattttcccttaaattgatttatcttctcgttaagcaagtattttcaactataactccaatcttgtgccaaatttaatcaaattcagatgataagtttttttttttaaacctccaatcttgtcccaactcaattttcattatgtaacgtgcggataataattaagtagttttgtaacgaatcaacgacatatttaacataaattaaattttaacagaataaaaagtgttcacgttattaaattttgtttttatttgcgtacggacataagttcctaaatgtgtcagccaaagatcaaattgttttcaggatcagacagagatcatcgagtgcggatttttctcggagagatgtctcttcgtgctttcttgctcggcgaggcattgacctaaacccgcttaataatctccgacgaagatccaggacacactcggcgttaagaggggaaagaaccaaaaatcaaacaatcatgtggatttcgaggttgaagagagttaggagaacgattatggttctgggcgttgccaatttcgtcgtgattgtttccggctgcgttcttactctcgtttctgacgcagattgcgacagccccggacaactatttcccctcttcgccgtttgtttcgctgccggcgtcaaactcgccgcc

SEQ ID NO: 9491 - DNA, 3000 bp, Unknown
  misc_feature (1)..( 3000): cDNA_ID_2991053_gDNA_ID_1972132_Annot_ID_179099 3000 nt of promoter + ATG
ctatatagttttcagtcattcaatcattcattgctcaactaaagatccgttttttggtgaaatgaaaatctaaccacgagggtattttcggtatttctcactgtgaagtatctagtttcttacaagttaattaacgactatgtatataaaataagttgacattgtgagctttgatatttagggtcgttgctaaattagcttggttggtacttgtgcaagacgtgatcctcgtattttcggaatgacgaaaataccatttgatccctaaccacgtgcttgaaaatacagcaaaaatgtggctcggttacccttaatttgggatattatttaaatcttcgaggattcctatatctcaagttgcatttatttatttagaggatggattttttcgttgatgaccaatagtttctctgctgagatggcgaaatatcattggttgtgatgaagattattcaaatagaaagcgatgtagatctagttggtggatctgatctgtccacttttatattattttttccttggtcctgatgattcgtgctttgcttcgttgttatctaatcataatatcttccaccaagcctggatgtgacttcccacacctaaccggtcaccggcctgaaccggaattcaactatccatattatccaaaaatccctctttatttacttacattatatggtttctaatattttggatgtgaatgtgaattatttttaaaaataattttcacgtaatgtcattataatatagtttactttgtaaatcagatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcaggtacaatttatttgtttccatgtgggattcctttttttttttcttcatgtgttattactataaacatgctactttagtcaaattatatgaaatttcaaaatttctagaaaaggacaaaaaaatgtaaaatatttgttttaggatagacataaaaaaaaaaattaactagtaaaggtaaatgcagcaaaactctttagtggccatacatttttgttggtggccaattcttaccgaatatttttatcactggttttgcagtatagtcttccttcagacacttcaatgaactacatggataacttcatgcagcttccagaagattctgtaccctgcaaaatccgggccaaacgcggctgcgccacccatcctagaagcatcgctgagcgggtcagttataaacactttttaatttatttagcgatggataattaattcactaaatttagcaacaaatttgatcgtccctaatcatgtagaccctattctttttgccatcctcctatcttaacctatacaatatgtttatattataggagaggagaacgagaataagtgggaagctaaagaagctacaagatcttgtccccaacatggataaggttactttatatcaaatatatatagtatatatggtaacatcattttgaaaaagtgttcattacctcacacacttgttgctgattttcttagcaaacaagctattcagacatgctggatttagctgtacaacacatcaaaggccttcagcatcaacttcaggttcccttatcttactttttctgtttaggtcagctgaatccatttccagagttctctctagttcatgatccatattgatacataaacacattttcatatacaaacgcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttatgttttgagtgtcgcctattttgtaaggattatgctatgaattctgaaactaattcgagttatgatcataagcaaagcaagctagcatccattatatatatgactttctaatttgatctctcttttctttatacttcttcataaatagttcctgaattgaatattgaaattaaaggtacgctaatttttcttatttttaaaattgaagaaatggaccaaataccaaagttacttgaaccaatgaaaacattaataagcagaattcacgtaccaaagaccaaagtgaatctcgttgatcatataatgaattatgatatatttagtagtagttagaaacatgcaaatagatataggttgatatgaaaattggcataaaatgtatgaaccggaatactattagtagcattaactttcctattattaacaaaactagcgtgtatgcacgttacagagaaagatttattctttattagagatgaaatttctttagttatacatacactttggttttgtaagttaaaaaaatataactccctcctacgttaccaagaagtccaccaacgtggtggattttaaaataactaaccaaaaacacaaatcagggaaaagtcgtaaattaaaactgataatttggaggaaaatatagaaaaagaaaaaggtaacgacattaaagaaggtgcacttaatgcgcagtatgtcctcttgtgccagcttgttgcaccgtcttccgtctcctcctctttccctctctctctctctccaaaccagtcctacttctctctctagaaacctagggaagaagaagaagacggtgaagcgagcg

SEQ ID NO: 9492 - DNA, 3000 bp, Unknown
  misc_feature (1)..( 3000): cDNA_ID_3014269_gDNA_ID_1972132_Annot_ID_179101 3000 nt of promoter + ATG
ttgatacacttgtctaagttatacactaattcttgttctttttatattttctgaaaattttggcagaaatcttcgaatgttgacgctaccaaaggtggtgctgaagaggaaactcttgatattagtgctatgggtgctgttatctttgtcatatcagcgtccacattcctcgttttgctcttcttcttcatgtcatcgtggtttatcttgatcctgaccatatttttcgtcattggtggtatgcaggtaatgttagctaatcttgagcatatccttagtttcatggttcaatagctagaactatgatcaatgtttggtaacaggttgatagtaaactttctttagcattgtttccttcccttgtaaaaatacataacatgatgaactctttatgtgaaatgaaacagaggcctgctaagctaagcattattatgtcaatatcacaattattaatttattttctatctcagggaatgcataatattaacgttacactcataacaaggtactctcagaaacccaattaagtttttgaaccgtgaaagagctctattccagctagttaaaagcatcatgtgatgttttctctttattcatgtttatatttctgcaggagatgcagtaaatgtggccagaagaatttaaaactacctctgcttgggaatacctcgattctctcactcgtggttctgttattctgctttgtggttgctatcctctggtttatgaatcgcaaaacttcgcacgcatgggccgggcaagatatttttgtaagtccattttagcctggtaattttacagttgtctaaagccaaattatccctatgcattttggttcttctttgatttttttccgtatgtctaaacacaacttctggcttgacgcactcaacatttactttcacttcttgctcaaatccaactcaaggttctgttttgttttcgacatttatcggttgacttctgtaggacttagcttaggatgcttttggttcaaaattgtccttagttggctttctaaggttgacgtgtcatgtgacagggtatttgcatgatgattaatgtcttgcaagtagctcggctacctaatatcagggtaaattttctgtatgtattttcctactaaaattcttttgtgatccctttgtatgtgttctaatgggtgtctcacacttaggttgctaccattcttctctgttgtgcatttttctatgacatcttttgggtattcatatcaccactaatcttcaagcaaagtgtaatgattgcggtgagttttcgttattttccttcatttaacaaattgtgtgtcttacaccttaatatttaattctgtttctgcaaggagaagaatatttagtgttgtttcttcaaaaatccatcaaatcatatgattcttataaacttaagcctcatcaaaccagagcatgtttaccattagtgtgttttacttttactccggagcatgatttgtgtcggataattgctcaaaaccccaaagattgagtttgagttcacttgttgtataaaatgtttgcacatagcgagaacgaagaaggtcgatgataggttaactaacctcaatcacgttctagttgattactatattcttctgtttgtgtaaatttatggcataggttgcacgtgggagcaaagacactggagaatctattcccatgcttttgagaattccacggctttctgatccatggggtggttacaacatgatcggttttggagacattcttttcccgggccttctcatatgctttattttcaggtaaccctcttatgcatgatgcattggctcaataacgattatggttcacgacaccaattgtgaacacatcatctgttacaaacgctgtccgtattcaatatgccccatctcaatatgttttttgaccgctttttaactcttttacgtctcagatttgacaaggaaaataacaagggggtctcgaatggatattttccgtggttgatgtttggctacggacttggcctcttcttaacatacttgggattgtatgttatgaatggacacggtcaacctgcattgctatatcttgtcccttgcacgctcggtatcttgttcatctcatgaaaaactctgaattttgatgattagtcccctatatatgcattccattgaaacccaaccaaatgcaagatttcttacatattgagcggcttgcaggaatcacggtcattctagggttggtgaggaaagaactcagagacttgtggaactacgggactcaacagccttcagctgcagacgtaaatccatctccagaagcataaattgcttcaacatacataactcaaaactctggagactgaagaacaagaagaagaaacatcaaaaaagaaacaatttttcttttgcacataaaaaattataagaaatatacacttttgtgcatacacatgtagtctcgagcccaccaaaacgtatataatgtaatgtatatgtatacatacacacaatcaacaacttctgattctgaaatgaacaagtttttgtatactgtacaaatacgaatttgaatttttttttcccctcaaaaaaatataaaaccagctttaataaggatttgaaaagtttccaagttcatatatagataaaccgaaagaatttggatcaaactataatttttaggaactggaactgacacttatcattaagacaacaagagacagattcgattaaaagagaatcttcaggcaaaacggcgtcgtgtcttgtttacacataaacagaggttattaaaaagtttgggaagagcagatctggaagaagaaagaagaagaagaactctctactggttaattttagccggcgggtaaacggatatttttggaggaagagcagctcttctctcaaaaccatccctctttctctaaaaccctaattctcgacatccttcaaaacctaacaatttcaatttcaattaacccaacaactttcttactctcttcctttgaatgatttca

SEQ ID NO: 9493 - DNA, 3000 bp, Unknown
  misc_feature (1)..( 3000): cDNA_ID_3042101_gDNA_ID_1972132_Annot_ID_179100 3000 nt of promoter + ATG
gagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttatgttttgagtgtcgcctattttgtaaggattatgctatgaattctgaaactaattcgagttatgatcataagcaaagcaagctagcatccattatatatatgactttctaatttgatctctcttttctttatacttcttcataaatagttcctgaattgaatattgaaattaaaggtacgctaatttttcttatttttaaaattgaagaaatggaccaaataccaaagttacttgaaccaatgaaaacattaataagcagaattcacgtaccaaagaccaaagtgaatctcgttgatcatataatgaattatgatatatttagtagtagttagaaacatgcaaatagatataggttgatatgaaaattggcataaaatgtatgaaccggaatactattagtagcattaactttcctattattaacaaaactagcgtgtatgcacgttacagagaaagatttattctttattagagatgaaatttctttagttatacatacactttggttttgtaagttaaaaaaatataactccctcctacgttaccaagaagtccaccaacgtggtggattttaaaataactaaccaaaaacacaaatcagggaaaagtcgtaaattaaaactgataatttggaggaaaatatagaaaaagaaaaaggtaacgacattaaagaaggtgcacttaatgcgcagtatgtcctcttgtgccagcttgttgcaccgtcttccgtctcctcctctttccctctctctctctctccaaaccagtcctacttctctctctagaaacctagggaagaagaagaagacggtgaagcgagcgatgtcttcggacgacgaaggaagagaggagtatctcttcaagattgttgttatcggcgactctgccgtcggtaaatctaatcttctatctcgttacgcacgtaacgagttcagcgctaactccaaggcgacgatcggagtcgagtttcagacgcagagcatggagattgaaggtaaagaggtcaaggctcagatttgggacactgctggtcaggagcgtttccgtgccgtcacttccgcttattaccgtggcgctgtcggtgccctcgtcgtttacgacattacccgccgcaccactttcgaaagcgttggacgttggctcgatgagcttaagagtaagtctcgatgtgaattatgcgattgactatcgatttaggggatcctcatgatctaattaggtcgtacggattgacttagaattgggaaattttgaatctagttttggtagattatagaatttgtgacctagctagaacataacagaggattattcaagaaccgcttaggaaagtatctcataatgaacatctttagattggtctgagatctaaaattgattcatttgctcttttcttggttgtttcagtccattcggatacgacggtggcgagaatgctggtggggaacaagtgtgatctagaaaacataagagcagtgagcgtggaggaaggaaaggctctagccgaagaggaaggactcttctttgtggaaacatcggctcttgattcgactaatgttaaaacagctttcgagatggtgatacttgatatctacaataacgtgagccgtaagcaactcaactcagatacttataaagacgaactcaccgtgaatcgggtaagtcttgttaaggatgataactctgcctccaaacaaagctctggtttctcttgttgttcttccacttgatgatataccacaccaaaataatccttttttatttctcacaactgtaactttattatataaatttttgtttttttctttgactcatggaagaaaagaaattcatgaactgtaatttatttggtcacattaattttccttttataattttggcaaacattcaaaagatctattcattctacttgggttatttcctattttaaagaaactaaatttgattggttggttttgtgatttttgtcattatttgggaaaagcgagggaaaataaatccaaataggggaagaaaaaaagagatggcttttcaccgagttttctctgcttttgtaacaacgaacatgaaccaagaataatcttttctttccctttttttgtttgtcccacaattcttcaaattttcttctctctatctaattctcacggtggcgatgtctttacctccgtttacttgccgccttctcgcggcggcggcggctctctatctgataggtctgctgtgcgtcggagctgacacgaaagatgttaccgctcccaaaattcctggttgctccaatgaatttcaaatggtaacaggtttccccaattcgagttcctaatcattaattttatggaatttcactttttaatttcgtgcgaagatttggttaaaccggaatcgtttttgcctttgtctaacggaccctacgtatatatctcattgattgatttgaatcttcattggaattgcattcaaccacaaatgcagcttttgttaaatttcaataggtttaggttaaatccgttattgaaatcgattgatgatgaggatggggtagtttgttcattgattttgataaaaattgattgatatgatataaagcattgttccttttccccacaatatctatgtgatcaatattgaggtttctctgtttctgtttattaccagttgtctataaatagattcatgtacaacaaaacttctctacattatcagatcgctcatgcaactactgattattgaacattgtccaggtcaaagttgagaattgggtcaacggagaaaacggtgagacttttaccgcc

SEQ ID NO: 9494 - DNA, 3000 bp, Unknown
  misc_feature (1)..( 3000): cDNA_ID_2990271_gDNA_ID_1972132_Annot_ID_179094 3000 nt of promoter + ATG
ctctaattctcttgagcggatttcttgcggtggtatcagtgaacacagtgatcgtgttctacatctgtatggccatgaaagaacctgcagataaacacaaaccagacgctgcatttctcgctgaggccaaagatagtgtgaacaaattgacaaaaggagccacaagcagtgatgatcatgcactcaaaaaacaagagtgagagctttcttaatccaattatgaaatgaagaacaacatctgggttggatcgaatggagcagacctcgggttatcgaaatagattattacaggattctgtgaaaattgaggtttagggttggttaaacaaagtagcagaaaaacatgtcgtgtatgatgaacagagaactaatgttataacacaaaactacgaacactcttggaaggattagacatttgccagttatttctttcctcaatacgtaattggtgtaatgaattattccacaaacgaagaaaaattgacataagaacaaaaacaaaacacaaaaacttgtataaaatttgtaggaattttttttataaaaataatttgaaaattcaaagcaatttttttctgataaaaaactaaagtactaaatttacgtatgataaaacaaattgaactatcaaatgacgctacccaaatcccagttagttttcttatagttttgtaaatctaaaactaaaataaataaaaaatattaaatatacataacgattagaaaacaaaatgaaattatgaaattgctaacgatcaaatgactacgtcaaataacgagatccaaagtccggttagatttcatatcattttgtaaatctaatctaaaatacgcaaaaaaaaaaacaaattgaacttgtaacaaaatgactagatcaagtgacaagcgttttgtaaatctaatctaaaaacaaatcagaaaatgctaaatttacataacgattagaaaccaaattgaacttgtgaaatcgctaacgatcaaatgacggaatccaaagtccggttagttttcatattgttttataaatctagtcaaaaacaaaaaaatgctaaattcacataacgattagaaaacaaattgaacttgtgaaatcgctaacgatcaaatgactaggtcaaatgacgggatccaaagtccggttagttttcatatcgttttgtaaatctagtctaaaaacgaaaaaaataaaatgctaaatttacataacgattagaaaacaaattgaacttatgaaattactgacgattaagtgactaaatcaaataacagaatccaaagcccggttagttttcgtaccgtattgtaaaaatctagtctaacaaaacaaaacaaaatagaccaaaaaaaaaaaattgtagaaaagacttagaaattcacctgaaatcgttcttgaattgatgtaacgcgtaactcttttccttatttgatacctctcgaagtcgtcttatctgagtcatcatctcacgaatctttaccgtagtcctcctttgttgttctccatactcaaccaaattccaaaaatagcccttgtatgatgacatcatccaaaagagccgttgtgtgacatcatcacaaataatctccgacgaagccattaattgatcgtagtcagtttccgtcgtcttgtctcggtcatctcacgaatctccaccgtagtcctttgttctccatactcaatccaaaatagcccttgtgtatgatgatatcatccaaaagagccgttgtatgacatcatcacaaataatctctgaagaaaccataaatctatcgatcgttgtcaatttccgtcgtgttctgtcatatctcggccacaacgtcatcaccgtaactttgaatcccttacgtataactataattccagattcaccttctttaaacatctccttgccctctctaatgatcgacttaattaaacatgatcggagaaaaaaactgaagagatacgaataattcccaaagcgatcgagaaagagattcatgacggcttcgatcgacatatataatttggtcgagaagaaactcaagtttttaaaagaagaaggagcaatttagggttttgctcttcgaagaatgagaagtttgattcttaagaagagatgagtggggttaataaggaaaggttatcatcggaaaaaaaggaaattaaggtgattgatcacgtggctataatgaattaatctgattgcccaattaaaaaaaaaggaaatttataaatattaatttttaaaaaatatatatataaatattaattttgatgaaaaggaatttgtaaagaagcggttctcgtaatttttcttcggaagttgtcaaagaaccggcagatcctcgctgctcttgcattcgctcactacggtaacactctatcatctccatctctgttttgaattcgagattcgaactcaaagatttcgttttggaggattgcaatcttttcaatcaaaaaaaaaaagtaaaaagattgtaaaattgatcgttgattgggtgcggatgatctttggtcttcttgagcttaacttgggttgacatcagtttactgttttaagagatgaaaacccacaaggcatataacttttctagggtttagggtaattatattttaggatcaatcttctcgaaaaggaagaaaaattgaagcttgctatgtctctttaccttgagatatgagaatcacaggtcaaattatgttcttgatagattcagttgttgagttcatgtgtggtgttggaagaagtcaaaactctagttctagatataagcttgaaatttggacatgattttgtagatgtaagcttgaaaatggtttaggagagatgttactagatgcttccttatgccttctctgagactttaacattttgttgacacttttgttcttttttatctacatcttttgaatcatttgtttaaagcttttgcttaactcaaaagtaatttgtctcagcttttgcttaatggtgcctttttcctctggcaaacagatctcagactacagttaccaag

SEQ ID NO: 9495 - DNA, 3000 bp, Unknown
  misc_feature (1)..( 3000): cDNA_ID_2990259_gDNA_ID_1972133_Annot_ID_179123 3000 nt of promoter + ATG
ttagatcaagcataccttgatacagcaagacttgagtcctctccaatgcgtactccaccatgaactttacgctcttcatcacgtctgcccgcaacacatcttctacttcatcactacattcctcaaaacgaaccgtttcactcactcccaaaacacgttttgcttctctctggttcaagaggtccaccacgaggtctgttctgtatggaatcgcccgtgccgtgttgtagagcgtcgcgagtcctgtcatgttacttagtagcgtcaacagttcggtcctcgcgtctgctgcttcacgccatttctgggacttcacgagagctacagatatctcctgcgctttttgcagttcaactctctgttttgcgttgaccagacccgagtagtagacgttgaccgcatgggtttgaacctgggtcaccgggtcggtcagcccgtttccaatggctagcccctttagattcactttcccattgggtttctctttaaggatatagtatccaatggctggaacgtacttcccggcgtagctctctccagtgaagtaaaccggtcggttttcgaagcttgggttttgttcaaggaactccacgagagcggcgtaaagatgctcagcgacctgtctctgatttgtgggtatgtcttgttgtgaggctgcgatgctgaatccgactcctattgggttatccacaaaaagtagtccgaatagacggttccatgcgccggggttgcgctcgaggtctgtggcgcgtgaaactacacgccagggaccgagctcgtaaaagttgccaatcattgaagagcagcctggcccaccttggagccaaacgaggagcggagtgtcaggaagaggtgtggttggctcttgggcttcgtagaaggcatagaacatggacgagccgggtgcgggtttaaccgggaggtagccagatttagtggggagagcttcatcgggaaatagcggtggctgaggagactcaacggagacggcgaggaggagagtggaaagcaatatgaagagtgtagtggcttgctccattatttccactaattggtgacgcctttacataaagatccctttgtattatttcatttatttcattatttgactgcaaaacattacgtttatgttttgtcttgtataacatgtgaatttttaaatgtgtaacaataacatttttgtcaagacgtgcttgcttactaacctaattgcattaacatgtgagttttttaatttaaaggtttttgtttgtagatgattttccataatgtatattattttaaatttattgttgccaaaagaaataaaatctaaaagttttattgggccgaaaagagaaaaaggtcagataggcccataaaaagttggacaatacaaagcgtttacaatttgtcaattgcaaatttcgtgagatgcttcttctactcgtcatctctgtttggtaaagtgatcacaaggtgttcgatataatacctgaaagagtttccgaaggtgtgaagatgatgatcttggatgtttgctcagaggttataaagatccagaagctacgacgggctgtctcttacgccggattctactgcttcactgctgccctcacattcttctatacaaacaacacgtaatgtctttcgtccgatctcagtttgcttcttttggttgttctttcttttcaatatcggaattcgcagatgatttcaatttctgggttcttctcttggtttctgcttcaggtttaatttgatttaatgttactgattcgaatgttgtgtagaacaagagcaggatattccaggggagatcagttttatgcatcttaccctgctggcaccgaacttttgaccgacacagctaaggtttgtccttgatgacaattttgagttgtcgtttacagtttatatagttgattagttctgtgtggaactgatgattggggtttattggagtaaagctgtacaaagcggcgcttgggaattgctatgaatctgaagattggggtcctgttgaattctgcataatggctaagcattttgatcgccagggaaaatctccatacgtttaccactccgtaagtttcttcaatctctttatgataatctctgtggtgcggatattttagtgttgtaaaggtcagtttccataagtctagaatcttgatggtactgactttgtggtgccattgatagaaatgtttgtcgaatcatgtggggttagaaccaagaattgagctcattttattgtgaatgcagcaatacatggctcaccttctatctcaaggccaactcgatggaagtggctagtggcgccagctctctttgtttcagctttgtgcctaatcttgttatagcaaattcgaatcctggtatcttggaacatttgtatggtgtttgtataagtccggaaccgtaccattggcttacatggattattcagatttgtactctgaaaattaagagcatgtaattcccgcagaggcacaatgtaataaacatatagcatagcaaagcaacaatccggggaaaaactttggttaccaccttgaaagaaatggggaaaactgacagagcaagaagctttccatcatcagcagagacgtttgataaaagaaaggtcaagatttcattccacgaaaaatctgccgaaaataaacatctcattctggatgtggtatatgaaatgggattgtacatggagtttgaaaaacttggcaaagagaatcatggaaggaactaaccatttgagctgcaaggtcatacaacacttccaagaatttatttagacaaacacaaatgcgactggttttttttaatgagtgaggcccattaaagaaatagtatgatattataggcccaaacaatcccaaaacccttggcctttttctgtcgcgctaaaccctacgatctagaaccttccgtcttatgtgtctctgccccaaattaaaaactcagaaaccctagaaaattccgattcatcaactgagagagaagaagaattgagaaatg

SEQ ID NO: 9496 - DNA, 3000 bp, Unknown
  misc_feature (1)..( 3000): cDNA_ID_2182978_gDNA_ID_1972133_Annot_ID_179125 3000 nt of promoter + ATG
ttatagcatgatcatgaataagcaaagtcaactaagctatcgtctacattggctattgaagttgctgcctaaacgtaaacgaaaagcatccacagattacggaaaagcacaaaatgagaagatgcaacacttgggttatccatgtgattgatgcccatttgtaaaaattcaaagacaggttcataaaggtagattcaatgataaacgacaacaaagtccaaccacatcttcaagataaactaatttataaatgacttctcctcataacacaaacaccaacatgaaccctcgtggttaagttggcaagcttagccttttcaatcctcgtgcaaagttcccaaaacatcctcgtcccggaagagatggtacctgcgtccatcacacaaacacaaaagttactcactttgagtcaaattcttcttcatttgtaatttcttattcgtttctaaaatcaacccaccaatcaatatgtaaatctggtgttcaaattggcattattaaacattgatcaaaatgtttttaaatcctctgttacaaaattttcaatatcttcacagtcttacaagtaattcccttagttccatccattaatctaattaatggataatgattcctgaacatgattagctaaacataaaggttcaattagatcagatcagaattttatcagaatattagggcaataataagaaagaagcgggtttaacttactcgttctcgccgagcttgacctgtgtaccaccgtactctggaagaagaacagtgtcgccttccttcacagagaccggaatcaatttcccgtccttatcccttgatccaggtccaacagctatcaccttgcctgagttcagctgcaatcacccaaaaatatgtttatttttcagatctaagaggcgaaaatcagaagaatcaaatcgtgaaatcaaagctcttttaccttggaggatttctcaggtaggagaatgccgctttcggttttagcgggctggatgactctctgcaccaagatgcggttgaacgttgggatcagacgcttcatcatttctcaattcttcttctctctcagttgatgaatcggaattttctagggtttctgagtttttaatttggggcagagacacataagacggaaggttctagatcgtagggtttagcgcgacagaaaaaggccaagggttttgggattgtttgggcctataatatcatactatttctttaatgggcctcactcattaaaaaaaaccagtcgcatttgtgtttgtctaaataaattcttggaagtgttgtatgaccttgcagctcaaatggttagttccttccatgattctctttgccaagtttttcaaactccatgtacaatcccatttcatataccacatccagaatgagatgtttattttcggcagatttttcgtggaatgaaatcttgacctttcttttatcaaacgtctctgctgatgatggaaagcttcttgctctgtcagttttccccatttctttcaaggtggtaaccaaagtttttccccggattgttgctttgctatgctatatgtttattacattgtgcctctgcgggaattacatgctcttaattttcagagtacaaatctgaataatccatgtaagccaatggtacggttccggacttatacaaacaccatacaaatgttccaagataccaggattcgaatttgctataacaagattaggcacaaagctgaaacaaagagagctggcgccactagccacttccatcgagttggccttgagatagaaggtgagccatgtattgctgcattcacaataaaatgagctcaattcttggttctaaccccacatgattcgacaaacatttctatcaatggcaccacaaagtcagtaccatcaagattctagacttatggaaactgacctttacaacactaaaatatccgcaccacagagattatcataaagagattgaagaaacttacggagtggtaaacgtatggagattttccctggcgatcaaaatgcttagccattatgcagaattcaacaggaccccaatcttcagattcatagcaattcccaagcgccgctttgtacagctttactccaataaaccccaatcatcagttccacacagaactaatcaactatataaactgtaaacgacaactcaaaattgtcatcaaggacaaaccttagctgtgtcggtcaaaagttcggtgccagcagggtaagatgcataaaactgatctcccctggaatatcctgctcttgttctacacaacattcgaatcagtaacattaaatcaaattaaacctgaagcagaaaccaagagaagaacccagaaattgaaatcatctgcgaattccgatattgaaaagaaagaacaaccaaaagaagcaaactgagatcggacgaaagacattacgtgttgtttgtatagaagaatgtgagggcagcagtgaagcagtagaatccggcgtaagagacagcccgtcgtagcttctggatctttataacctctgagcaaacatccaagatcatcatcttcacaccttcggaaactctttcaggtattatatcgaacaccttgtgatcactttaccaaacagagatgacgagtagaagaagcatctcacgaaatttgcaattgacaaattgtaaacgctttgtattgtccaactttttatgggcctatctgacctttttctcttttcggcccaataaaacttttagattttatttcttttggcaacaataaatttaaaataatatacattatggaaaatcatctacaaacaaaaacctttaaattaaaaaactcacatgttaatgcaattaggttagtaagcaagcacgtcttgacaaaaatgttattgttacacatttaaaaattcacatgttatacaagacaaaacataaacgtaatgttttgcagtcaaataatgaaataaatgaaataatacaaagggatctttatgtaaaggcgtcaccaattagtggaaata

SEQ ID NO: 9497 - DNA, 3000 bp, Unknown
  misc_feature (1)..( 3000): cDNA_ID_3042123_gDNA_ID_1972133_Annot_ID_179130 3000 nt of promoter + ATG
agatttcctaatttctgatcatctaagccgtaagagctgcacaacattaacaagaaaacagatttatattagtatacagtattacccaactgaataagttacaggggttttcatattagccaacataaagagaaacagattgctgaattctataaacatgacttttaacttaaatggtagatatgacattccagtgcgtacatacctgcctatctgcttgttgatccagttcaacaaaagatcagcagtgcgccattcattgactacgcttatctcatttttctcttgtttaggtccccagctgccaccaacgaaccttttaggaggagcccaaaagagcattggataatgattgatagagaacttgtcacaaagctttacattcatctgtgctgccagaaaagtcacaataacaattagaaagaaaaaaaactatacacaacctcataagatacagttttcaagccccacgctctgactcacacgatccacatgaagtaagagaaaaaagagaaaggaaggtcaagatacacgttcatctatataaataaaaaagatggtgcaagtacctttatcgcacaatcaactctggtcatcaaaacgacaccaggatatactgcgtctgctccattgaatagccttgcaactttttcataatgtggctgcagcagagtcacccattggatataaacaacattgacaagagtaagcattgaataataagacattgaatggcgttgttaccttgtagtttctacatgcagggcaccttgagccaaacaaaaattatgggtcaatgtcagtatacaagcctttcgcatttatatataaagttaagttatttccggataaatctcagagaattggataacgtaaagtcaggttcgaatatgaagaacacttgcaaacaaattccgtgtaagatccagtgcttaaaagcctaaagtttgaatttttttcagattttttacgagagagagagagaatgagaaaactgaccagtgagcgaagaactctaaaacggcatatttggcgggggaatcttggaaaactgaatcaaagttggtagcgttcaattcgatagcgttgtctttctgatcggcgacgttactgccgatgtcccggagaatcgagcgcgatcccggtgaaaacgacgccgcagcttcaaggctcagcagacccaacaacaagaacaagtgtatcaaagacattaaatcgaataaagcatacaaattttgaagcttgatccggatgagagggaagatctaagagcaaaaagagcttccctccttccgttgagaaacaaaggtctctggtgtttattacgacgtcgtaacgcctttgaccggcgtcgatactttgttctcctccgacaactttcatactgggctttattataacgttataggcccattactaatctccatttgatgtttgtgtttgtttccttttgacccgcccaaaaagaaagaatttgaatgtagataagataacgctatctctagtcaatactcaatagtcaaataaaagttggccattttgtttggaaatcggaggaacagttaatgttatccaatagaaaaacttatggagtggttttatttgagatgtttttgtttttctttgtttatagataaatttcggattggatataaaacaccatccgttggtagtattaattttacaaaaaaaattaatcatatatttattttctttgtattctctcatctatgaagataacatgagaaagttataagaaaatatatatatgagataacatgagaaagtctaaaaatggattaattagaacagagagtcaacaagttcatgtctcctcctcactctaaccacaagtcaacaccatttgtcttagtcatgaggagacacacatacacacctcacattaagaaaatttaacacatagcttccttatactattgccacttctcttgcactattcggtatcaattgtttttaagtgcccttcttggtactggggaaaaaattgacaccaaaaagtatcgatcatgtgcacatcctcaacctctaataataatgtcacttaaataagaatgcagtaacacagtccacgtgcatgaattcatttttctgatatagtttgcattcgtctgacatatttggtttcctgatttagatgaatattaaaattcagaaccattttagtatagtgttctcatttctcaactcctgcctcgatctctatagacgttcatgtatgcttttttttgttttcgtttatcaactctcaaaaggatgagatattaacaaccattcttaatttttggcaagtataacaaactgagagagaatgtttaaaagtccaattttaagattccaatatgcttaaaaaattcttacgcagcatctactatccgccgttagttttagacccttttattatgcgggaatttcccaattgtaccttttttgtttttaaaatcaccaataagggggtgatttcaattttcaactaattatttgggtgtaatgttgaatacgaaaaaaagttgagcaataagtaataaaacatgaaatacaagggtcaaattatgcaaaagaaaacaaaaataagaggtgcttcaatctttttattaaagagtccccttttattgactgtcctctctctctctctcttctttctctttgtcatgaaccagtaatcttgtttctcttcatcttccattgacgtttccttctatcctcgttgccttcatttttcactcgcacgctaatcttcgcctactttgttagattttcggttttgggtttttgtcttttggtcgatttcccctgttcccagaatctccgattaagctgcttccttaatctcttgtctgaatataaactttttccggcgtgtaatttagataggtggttaaaattacgagtagtgagaggagtgttgttgctgttttgtttattcggtaaaacgaaatcggaagttctttgttgtcgtttgattccttttgagaaagagag

SEQ ID NO: 9498 - DNA, 3000 bp, Unknown
  misc_feature (1)..( 3000): cDNA_ID_3042125_gDNA_ID_1972133_Annot_ID_179128 3000 nt of promoter + ATG
aactttatacagttagttgatagtccttaatggatgctttggaacgaacagaagagttgttgcatttgactaatagcattactttcataaataaatcttggatgttacttcaactgtttgttttgaaagtcacaacttatctaataacagtaaaattagtacaaaagaagctcaaaacatgaataaatacatctttcaatacctaacttccgtgtagcctcatgcaaaatttatttcaaaatatgagacatttaacatcataattgaatctttttggtttctaataactcctgcatatgccttgatgacttgatagaatgatagagttaaaatagttaaaccttgtcggcaaagggttcacggacgtaaggaagatcacgttcaagatactcaaatatcaaacgaccttgagagcttaaaggctcgccatcatcactagacgaatcttcttgatgctcctttcttaaggagagtttgtccattctagcggagatctgctcttttgaataacagagtcctctttcagattcactactgcttccttcactacttgaatccctaaaatcgctttcgctctcctcaccttgccgcctgcacattaataaacagaacaccccaaatttcttagagaaagacaagacttgagctttatagactaaaaccactacaagttatgaacacgtaagcttgaacagttcttaccttgcttgaagagatgaagttaaagcatcaacatcagcgtatacttgaataccagaaagcgagggcacgtagtattgaaagacacgatctttattgttattcaaagtgagaggaactccaatgccataagcactccactctgcaaacgattcccatacatctccaagaagaaaataaggaacttgagactcaacatcactgcctcctctttccctaactattgtctacacataaatttcacaccaattagctgaaagtttttgtctttttagaaaaaggtattgactagacatgtagaagcaaaccttagataaatagtgagccggaacagatggtgtcaccgaatccaaaaaccgttccacattacttgacgatgcctcagaaacatggtgtttcaacaatgcagagccgttctcacgatccttagtgtgactcgatctgcagccataagagacgtcaatttgagctctctgaagctgagtgaagttaaatccagctcccaacatctctctttctcaaaaggaatcaaacgacaacaaagaacttccgatttcgttttaccgaataaacaaaacagcaacaacactcctctcactactcgtaattttaaccacctatctaaattacacgccggaaaaagtttatattcagacaagagattaaggaagcagcttaatcggagattctgggaacaggggaaatcgaccaaaagacaaaaacccaaaaccgaaaatctaacaaagtaggcgaagattagcgtgcgagtgaaaaatgaaggcaacgaggatagaaggaaacgtcaatggaagatgaagagaaacaagattactggttcatgacaaagagaaagaagagagagagagagaggacagtcaataaaaggggactctttaataaaaagattgaagcacctcttatttttgttttcttttgcataatttgacccttgtatttcatgttttattacttattgctcaactttttttcgtattcaacattacacccaaataattagttgaaaattgaaatcacccccttattggtgattttaaaaacaaaaaaggtacaattgggaaattcccgcataataaaagggtctaaaactaacggcggatagtagatgctgcgtaagaattttttaagcatattggaatcttaaaattggacttttaaacattctctctcagtttgttatacttgccaaaaattaagaatggttgttaatatctcatccttttgagagttgataaacgaaaacaaaaaaaagcatacatgaacgtctatagagatcgaggcaggagttgagaaatgagaacactatactaaaatggttctgaattttaatattcatctaaatcaggaaaccaaatatgtcagacgaatgcaaactatatcagaaaaatgaattcatgcacgtggactgtgttactgcattcttatttaagtgacattattattagaggttgaggatgtgcacatgatcgatactttttggtgtcaattttttccccagtaccaagaagggcacttaaaaacaattgataccgaatagtgcaagagaagtggcaatagtataaggaagctatgtgttaaattttcttaatgtgaggtgtgtatgtgtgtctcctcatgactaagacaaatggtgttgacttgtggttagagtgaggaggagacatgaacttgttgactctctgttctaattaatccatttttagactttctcatgttatctcatatatatattttcttataactttctcatgttatcttcatagatgagagaatacaaagaaaataaatatatgattaattttttttgtaaaattaatactaccaacggatggtgttttatatccaatccgaaatttatctataaacaaagaaaaacaaaaacatctcaaataaaaccactccataagtttttctattggataacattaactgttcctccgatttccaaacaaaatggccaacttttatttgactattgagtattgactagagatagcgttatcttatctacattcaaattctttctttttgggcgggtcaaaaggaaacaaacacaaacatcaaatggagattagtaatgggcctataacgttataataaagcccagtatgaaagttgtcggaggagaacaaagtatcgacgccggtcaaaggcgttacgacgtcgtaataaacaccagagacctttgtttctcaacggaaggagggaagctctttttgctcttagatcttccctctcatccggatcaagcttcaaaatttgtatgctttattcgatttaatg

SEQ ID NO: 9499 - DNA, 3000 bp, Unknown
  misc_feature (1)..( 3000): cDNA_ID_2034266_gDNA_ID_1972133_Annot_ID_179124 3000 nt of promoter + ATG
aaaacggctaaggctgctttagcgcgttaccttatcgtaatattgatggggtcaccatcgatcacgtttccttacaatttcacttttgtttcttctcaatttcagctttacacgtcttttacaaatttgtcgacacggccaaataaaaaaacatcaaacatgaagctccgatgaaaaagatggatcggtgttaaattggagatatcattaaatgtcaatcccattaacgtactatcctcataatttatcaaccaataattatatgtacattgacctctcctttgtttacatccaaaaaacgtacgaatcaatccatatgattaattaaggaatcatggggtactctcatacttaacattaatttaagaaataatggtgaagtgatgtctattttttttgtttgttctaacaatggtgaggtcaaacgatggacatagattatacacagtagcccaatgggcttaatagttacctaactctgaacccaattttttctcggcccaactaaaaggattatcgtccgccctaactctcctaatttcgcactataaagttgcgagtttcacaggttttagcaggagccgtcattagggttccaatgaattttgtttcaatttttcgatgttctgaatatcattctctcaacaattaggcgaaagattgattttcatatgattagtagttttctttctgttttccgcgaatgtttttccgagaaaattgaatcgggaaagaggcaaaaaacaggggagagattttgataaatagctctgaaatacctgtaggttttctacggggtgcccttgctcttctttccctaataccaaaatggcttcatagtacgggtttctttgtgctttctctgtgttttgtgtattttttatactcaaatcactttgaatctcattcacaatcccgcctccaatcgccattacatgtttttaaaaattctttagtttatgcttcaaatctccttattcttaccaaaacagtttatctgaatcaatccttaagtgtatactgtatgctaacttttttgagaaagtttaagacttcaggaacaggcaaatgataaactaagtagcaaaagttaccaattcgtactaaaatgaacttgtgaacatgacgtaacaaatctaaatccagagtacaattagaatctgaattgaatcttacagaactaagtacaagtacacaatatttagattgaatggtataagctcgacgaagttgtctgcttcacatctttaccaccgaacaatcctttccccaaaacccaaccttcaatcatatcccttgaattcacagctttatctgtcggaacaaaatgaccagctcctgtaaccgccacgtggcacaaattcccccatctctgaacataaccagcgaccacaccgtcttcatccttccacacacgcctctccgccgtcgagaacattcccaatcctgaccagttcatagtcttcatccactcctccgtcgaaacgacgccgtctcttagatcaagcataccttgatacagcaagacttgagtcctctccaatgcgtactccaccatgaactttacgctcttcatcacgtctgcccgcaacacatcttctacttcatcactacattcctcaaaacgaaccgtttcactcactcccaaaacacgttttgcttctctctggttcaagaggtccaccacgaggtctgttctgtatggaatcgcccgtgccgtgttgtagagcgtcgcgagtcctgtcatgttacttagtagcgtcaacagttcggtcctcgcgtctgctgcttcacgccatttctgggacttcacgagagctacagatatctcctgcgctttttgcagttcaactctctgttttgcgttgaccagacccgagtagtagacgttgaccgcatgggtttgaacctgggtcaccgggtcggtcagcccgtttccaatggctagcccctttagattcactttcccattgggtttctctttaaggatatagtatccaatggctggaacgtacttcccggcgtagctctctccagtgaagtaaaccggtcggttttcgaagcttgggttttgttcaaggaactccacgagagcggcgtaaagatgctcagcgacctgtctctgatttgtgggtatgtcttgttgtgaggctgcgatgctgaatccgactcctattgggttatccacaaaaagtagtccgaatagacggttccatgcgccggggttgcgctcgaggtctgtggcgcgtgaaactacacgccagggaccgagctcgtaaaagttgccaatcattgaagagcagcctggcccaccttggagccaaacgaggagcggagtgtcaggaagaggtgtggttggctcttgggcttcgtagaaggcatagaacatggacgagccgggtgcgggtttaaccgggaggtagccagatttagtggggagagcttcatcgggaaatagcggtggctgaggagactcaacggagacggcgaggaggagagtggaaagcaatatgaagagtgtagtggcttgctccattatttccactaattggtgacgcctttacataaagatccctttgtattatttcatttatttcattatttgactgcaaaacattacgtttatgttttgtcttgtataacatgtgaatttttaaatgtgtaacaataacatttttgtcaagacgtgcttgcttactaacctaattgcattaacatgtgagttttttaatttaaaggtttttgtttgtagatgattttccataatgtatattattttaaatttattgttgccaaaagaaataaaatctaaaagttttattgggccgaaaagagaaaaaggtcagataggcccataaaaagttggacaatacaaagcgtttacaatttgtcaattgcaaatttcgtgagatgcttcttctactcgtcatctctgtttggtaaagtgatcacaaggtgttcgatataatacctgaaagagtttccgaaggtgtgaagatg

SEQ ID NO: 9500 - DNA, 3000 bp, Unknown
  misc_feature (1)..( 3000): cDNA_ID_4262218_gDNA_ID_1972138_Annot_ID_179179 3000 nt of promoter + ATG
acctacaaactttggctcttgggctggcttgttgacttggcttaggtgcaagactgacagctctccttctattctccggaaagtttctgtacaaactttggtttacaacgtttggcgcgagagaaacaataggtttttcaatcttcgctccattccatcttctcagatattcattgtgattgatagattgataagaaacacgatatcacagcaagaagacatcgtcatcttttccaaagcttaatatcgtcatcttttccaaagcttaatgcgtttatggattcgttgactgcagtttgtttctgcattaaatcgatttgttgccacgtattttttacttcttttttttgccgtggtaacaaaagcttgggtttacttgttgtataactcttttcattaatatgatatttacagtttgacaaaaaaaaacaaaaaaaatcagaataattggaaatccaatcatattatcacagttttcatttaccaaaaaagagtataatgtcatgactcacgtaataatattactatagtaataacgaaacctctacaaggacaaaactggaaacaaaaaaaggagataactgcgcacgaagaacgggtctcaagctttccgacaagacatgcgcaccacaaatttatttagtctccgtatataaatcctccatttccaaaaccttcccaatcttcttcttcttcttctttctccttcaaacaaatcatgagacctgcgcaagataatcaaggctcgttccttggccggattagtatccgtcgcaaccaattcgtcgacgtcaacaacgaacaagaacaagaagatctcgagcttttccaaaaacacatcgccgatcgtttcaccgagcttctttctcctcctcaaccaccaccgtcagatgaaattaacacggtagcttccgtagccgcgacggagcagattatgtccgtgacttggcttcgtaagctgatggatgttttcctctgttgcgaagctgaattcaaagcgattttgttaatgggtcgtgacccgacccagatttctaagccgccttttgaccggttagttcctgaaatgttagaccggtcgattaaagcgcttgacatttgtaccgccgttgttaacggtatcgattccgttagacattaccagcgtttagctgagattgctgtgacggctttggagcaacgtccgttaggtgacggtaacgtgaggagagctaaacgcgcgttggcgaatctcgtcgtcgcgttgagtctcgaggataaagagaatgttagcggcggaggtggtggcggcggcggagggaataagacgacggagagatcgtggtcgtttggtcgtcgaagcggtggatcatcggcggcgagtaaaggaggagcaacgattggtcagctcaaatcgtcgtcgtgggcggttgggagaaattggtcggcggcgaagcagatccacgcaatgacagcgaatcttacgccgccacgtggtaacgaagcggcgggattgcctcaaccaatgtttataatgagtacggtgatggttttcgtaatgtgggtgctaacggcggcggttccgtgtcaggagagatcaggattagcgaatcatttaccagtgccgccgaaacatttgaattgggctcagagtttgatcggaatccatgagaaaatcggagatgagtggaagaagaaagagaagaaaggatctgctggattgatggaggagatgacgaggatggagaagctaggtcactcgttgatggaattcgcagatggatttcattatccggcggagaaagatgctgctgaatctgcggcggtgcaagtggcggagatggcggagatatgcaggagaatggaggaggagcttgtgccgttacagcaacagatcagagaagtttttcataggatcgtgaggagtcgtgcggagattctcgaggtgttggagcaagccgggaaagtttcggcgccagttgtgtaaaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaactaatgtctgcaggtcttcttatctctctcactcaccaccatcttcttcctcgattgtcaaaaccctagatcgaaatcttatctctctaatctgttgttacagttcgtagagtcatg

SEQ ID NO: 9501 - DNA, 3000 bp, Unknown
  misc_feature (1)..( 3000): cDNA_ID_3042186_gDNA_ID_1972138_Annot_ID_179188 3000 nt of promoter + ATG
tatatctggtatcgatgaagtctatatcagagagggagcttttagaagaatgtctaatcttcggttcctcacagtatacaaaagtaaagatgatgggaatgatataatggatataccaaagaggatggagtttccacgtcgacttaggatactaaaatgggaagcatacccaaacaagtgttttcctcccaaattccatccggaatatcttgtggaacttgttatgaagaatagcaagctcgagtacctctggcaaggaacccaggttggtgttgtactttttaatatatgaattttgtatcctactttctcatcaagttatatgatgccctttctctctgttaatctgtgtctttcttgcatattcagccgctaaagaatctcaaggagatgaatttaaaagggtcctccaatttgaaggcactcccaaatctttcaaatgctacaaagatggagatattgaaactgagtgattgcaagagtttggtggagattccatcctctttttcgcatcttcaaagattagagaagttgcggctgagggggtgcataagtctggaagtcattccagctgacatgaacttggaatttctttacgacttagatatgagaggatgctcaagattgagaaatattccagttatgtcaacgagactctactttctaaatatatcggaaacagctgttgaagatgtgtctgcatcaattacgtcttggcatcatgttacgcatctctcgataaacagcagcgcaaagttaaggggtttaacacatctcccaaggcctgtcgaatttctagacctaagctactctggtatcgaaaggattccaaattgcatcaaagatcgttatttgcttaaaagcctaactatatctggatgcagaagactcacatcattgccagagctccctgcttcgctcaagttcctagtcgcagacgattgtgaatcactggagaccgtattttgccctttcaagacatcaaaatgttggcccttcaacattttcgaattcaccaactgtttcaaattggaccaagaagcaagaagagcaattatccaacggccattttttcacgggacaacgctcttacctggaagagaagtgccagcagagttcgatcaccgaggaagaggaaataccttgaccattcctctcgaaaggaaaaggtcttaccgtggcgttgggttttgcgtcgtgatttcccctaaccaccaaatcacagaaaaatttcattccggactacttatcaaatctcgaacaaaacatttactgataattcactatcactttgaaagattagaccaccaatctccagcgttgagcagagagttgtttttcgaattacgcagcgtaaacgataacttcagattattgaatgtggtgccagattgattgaagaagagagcattgaagataactatgagtctggatcagaccaagcctccgaagaagatagcatcgaagagaactatggatctggatcagaccaccaagcttccgaagaagatagcatcgaagggagctatgaatctggatcagaacaagcgtccgaagaagacagcatccaagaagagaactatgaagagagcatccaagaaagctatgaagctggatcagaccaagtgtctgaagaagagagctatgaatctggatcagaacaagcctctgaagacgaaaatgagtttgaacacagcgaagaagcctctgaagactacaaatggagtaatactaatctgtgactcccaaagtcgaaggagagagcaagtgccatacccagacaaacgcacgagcaatctccttcgcaatcatggtgaattcttcctctgaaacattgaattattttcttgctattaactcgaacagaaatgaataatgatatgatgattttctcgtgcttgcagattatctcagagaagaatcgccgcgagatctccaaataccacctcttcaaaggtacaactctttttattttgtttgcgaatcgtcttaactttgatctgtatacgtgtaatcagatacagtacgtagatattctgaatctcttgtacttagcccatcgttttaactttagctgtttctgaattcgatgccttacttactttgaacatagttagcaagaacaatgtgattcactaggattacttagaaatgttacttttatttcgagaaagttttgtatgctaaaagaggacttgaatttgccacaacatcccttgatcgagtgttccgaatcctgcaggtgattaagcttatgtagagctttttgtcaaaggagtatgtcaaagagacttttacttgggtacattactactggttccttaacaatgaaggcattaacttcctcaagactcacctcaatctcccacctgagattgttcctgcggtcctgccaccttaaaaagcagccttctttttttttccacgactgagaccttaattaaaagcagccgaataagcgaccaattttctgtaaaaagcacttactagattttactttgttaggctttcccttttgtgtatttttgtatgtctctttaaaaagataaggcattcacggtaaaacaaaacaaaaaaatcaacgaaaaataattacggaaacacaaatatttaatgaaaataaaaaaccagtttaaacacttttatgggtcgatttttatttttaaaaataaaatcctttaaaaaaaaaactaaaaaaggagaaaaaaatcgctttgattttaaaaacaagtgatcgaattcaggagagggatcagatgataaaagaaggagagtgctcaatagtcgtaacaggctgagcgaaacactcttctcgcattaagcgagtttaataaccactcctcatttcccctttaacttgcctgaaggatcatatttattcattgccccacctttaatcttttttatagccaactaatcatatccctcccgtctcttctaaccgatgtgggacaaatatctcttcttcagtttttcaaaaccctaattagcctaccgaaa

SEQ ID NO: 9502 - DNA, 3000 bp, Unknown
  misc_feature (1)..( 3000): cDNA_ID_2036317_gDNA_ID_1972138_Annot_ID_179194 3000 nt of promoter + ATG
ttgagcaggcggtggataggactgagggtatccgactggaggagggacaggttgatcaaaacgagacatctgctgagctggtggcacacccattggctgcgatccaaacactccatctcttttgtccatctcaagtttgtgttgtgtctgcaagcagaaaattggattttgggttatatatatataccataagagaagatagtttcagaagctcagataagtttctaattctcgctttctagtacctgcatacatgcgcagaccctgcaagaaaatcaagaccgcaaaatattagcaattcgtgaacatgaatagattagagggagaatctaaaaatcacaagaagtaaatacagacgtgcagtagaccatatcagcacagcaagagagtatctgagaagcctcggaaagttcatcactaccaacaatgcaagcaactatagagaatatgcaagcaacttggctgaggcagaacataaatcccttcaaacacacaagatgagatttgttagtttcacacatgtgtaaaaccaataaaagtagaagaaaaagagagtatgagagtacaattatgcaattgtcgcattgtgttgtctggatgttgaattcatcctgcagaagaaagcgggtagaggccacagagtttccgaagcaaaggaagacctgaaaatttcaattgcaaatgctaattcataagaatcatgaagagatctattgaattattgcaagcaggttttaaatgccaaaatatcaagaacatcacactcatcggtaaataatgtgatctcctaagtcaaataagttgagcaacggaattctaatatagagcagaggaaactaggaaagatgacggaatcacattatataagatttgaacagatgtcccagaaagacacagtgacacaactacgagaaaaagaaaatatccaaatcataaactgtttcatgttccactttccatttcaataagtttacacaaacaaaacgagtgtcattcactgatgttaaaactaatgttacattcaccaaaaaaatcagaaataatcgaagtctcacctcagtggcaaggcaaagttgaggacatttgctttctccacaccttccactacagggcatatatccagcacagcaagtatacctgtgacgcgcaatatcttagcaaagaaaaaaatcagactaatattctcaaaatagtttagaaattacataccttgacatgtcattgtaaagtgctcttctccgaagcatgtatgacacacaaggtccactacattcaaaatgtataacaaatcaaatatgtaaccaaaaccatgaatacagactcaaaattgaatcaagcaaaaataagcctaaaaacaatctcagatacaacgaaaccctaaaagcaaatagatcaacaacaacttaccacagacacgagatgcagcaatctgcaaaaagtaagttcataattcccgaaaaaaacaaaaatcagttcttcaatagaaaaaacaatgaagttaagagacataaaaacaaaaacaaaagagactgagatttacagggagtgtcggcggtgacggtgcccatgagatcggagtgccataaattccggtaatcttgcctaagtttcatcttatccaacttatcttgcgacgccgccattgctttggaaactcaaaaaagaagaagttcagattcgaaaaaccctaaatcagtgactatacagagcaaaagcaataaatcaaaatcggttacaaaatctataagaacctgatgatctgcttcacgcgtaaacctttaattgatgaaagcagaaacttctcgtcaccctcacttcaacgaagatatttttttttatcaaatcagtttcttagaaaaaatgagaagtttgactattatttaggaccagtttgacccacaactttttctttaattgtcgggaccaacaaatttaatatcctcgggttctgattggttaaaatatgaccttggggaatgccggaattatataataaattttaaatttatataattagtaagatcaaaaataaaaatcacattaatgcacaaataaaaagattttcaaaatgttgaacgcattaatcaaatgagggtttggtaacaatttcgatggtttctagaaaataactattcctctacggatttaatgagagtttgaagtcgaagaaagagtttttctatctctgcattctaaattttttgcaaatgttggtaatattacaaaatattttgccgacaaaaaaaaaaaattacaaaataagtttttaccgtcaccaattaccgcatgtaaattttactttttcaaagtcagatccgttacattgacaccaaatttcaatttctcctttttcaaacaaaagtccactgtcgtcaatggctctacgaatcacacgctaaattcgatttgtttctatttcaatagcaaatgagtataaaaggtttgtcaattcttacctttagcttatgtcatgcaaaataccctagtgggtttagactttaagatataaaaacaccagagagaaaattactacaataaattatttacaaacatagacaaaaatgtgtaaattaaatgtatatggagaaattcataacataaataaaatacgagggtacatttgttaaacccactaattgtctgctatataaacatagcccaccagaccaaataaactggacctgtcatgccttggttctgaaacaagaactgtgaagaaaaagagagaaacaaaaaaaaaaatcacacttttttgggtaaaaggtccaaatttacattaagaaaaaacagttttctttttgccaattttggattctggtggttttcaaaaaaacaaagatcacgagtgtcacttgtgttttctctgtaaccgtttcatttgctcaattcaattgcagagacagtaaaaaaagacagaacataaccccaaaagattcacttgtttatctctcttcttcttcattgagaatcttgagtttgtgttaccaaaataaaaagggc

SEQ ID NO: 9503 - DNA, 3000 bp, Unknown
  misc_feature (1)..( 3000): cDNA_ID_3042178_gDNA_ID_1972138_Annot_ID_179198 3000 nt of promoter + ATG
cttgcgaaaaaatcgattcgcgaagactgcaaaaacttataccatcctgcattccagcaatggaagtcatgattcaggtgtaatcattacaccagatggttactggcatagttactttgtcttaattagtcatcttaacactcctgtcattattcttcttttgctatctcagctagaaggttctggtaactggcccatggatgatttagcagttgagaaaacaaaatctgccttcctcctgaaaattgcagagaggtgggtgaagctattgtttgtaacacttcaaactattaagtcacagtgtttttatctgagtactgacaaatgaaaatactgacagccttcagaacgtcaagggaataccatgcacagctactgaggataatgtcgatgttttcattggtggttacgcatttcgcttgagaatattgcatgaaagaggcctgagtttggtgaagagagaaagtgagttttcttcttgtacacactatcctctatttcttaataaaaagcttatgtgatgctgacttcctcgatttctactgagttgcagttggagtggacccggtgaagcatgtttcctctaccgataaaatgctttttattcgtagtcaacatgcaagtatgattaatggtttgcaaggtcgatttcctgtatacgcaccagttgccaggtaaaagtcaataaaatttatgtgttttacttttgtttgctttgaagtttcataacccagaccttgtctgctacttgaaggcttgcaaaaagatgggtttctgcgcatctcttttctggttgcctggcagaagaggccattgaacttttggttgcttatctcttcctcacacctctcccactcggtgttccttcctcccggattaatggattcttaaggtacatttccgcgcttccatacttatgaattttatggaaaacaaccaggcaatgctgttggcaacaatcaaaacatcacatctttccgctggaccgtgtaacaggttcttgcgattactagcagactatgaatggatgttctacccgttgattgttgacataaacaatgactttggtagaaatgacgagaaagagatcaatgtgagtcccaactttaataatgggtctagtgttgggttagatttgttagaacggccgtatgtcattgtaaaacatttctggtatttttaggataacttcatgtcaagtagaaaaggctacgaagaggacaaacaaaacataagttcagctatgttcttggctgctccttacgacaaggcatcagaggcatggacatcaacttcaccaaatttattggttagtaattagaatacgcttttgaaaagcatatcttccgctactctgttctttttcttcttaactctctttatttcctttgttaaaggaacaaaaaaggttggtggcttatgctcgaagcagtgcaaacgtgttgagcaagatggtattgcaagaacataatgattctgttcaatgggaggtgagtgtgatgtattgaaaacaaaatgtattgaaccggtattatgagaacattacatcgactaattttatgagtatatatgttgcagtgccttttcaggacacccttgaacaactatgacgcagttattcttctccatagagacaaattaccttatccacgtcgtcttctgtttccatctgaacttaaccaaggttccaaacatagctctctctgtctctatttattatgtctatatcgttagttccaccatttaacttctttcccatttattgaacagggaagcatgtagcacggggaaaagcgagtagattgttcaacccatttatgtcgcctggagatttgaagagaagccatgaagagcttaagaataagctaatggtggacttcgagccgaccaagtgcttgttgagtgggttgcaggcaagtgttgtctcaaaaacataaacaatcatatttattcaatttcttattaaaagaaaggaacctatcacgcgattcttatctttatgcggttgtttgcaggaagagtttgggacgttgaagccatggtatgatcatataggaggcgacgcaattggtttaacatggaacaaacacaattcaaaggtaaacaaaaatcttcttagtgtcttacttaaaagaaacactaaaggaaaaatcgtaataacaaatgtaatgtttgattgcagaaacgagaacgagatgaagaagaagaagaagaagaagaaagtaatccaatggagatgttaaaggcggtaggcgaaatgggtaaagggttagtgagggatatctatttgctcaagcctccacgctttgtctaaatatcaacttgtcttagtttctttaaaatgtgtttgtcaattttgtttactcatcatcatactcaaactgtctaaagcgactaaacacattaccagttttgcttcattcattgagtttaatgtgtaccaaagcttaatgactattcgttgtcctactattttgttttttaaaacaaacaaagctcaagacctttcggggaaggttatgtgacaagcaaagacatatatacaaaacggagtagtatttgtggagattggagaagaacaatgaaaatgaatttacttgtgctttgtaaccgttgtgtaataacggctattacaagaaaagtttatagataagataagttacatgatctcaaatgtttcgatgggttttgtttgatttgcaaatagcttcctgagcatatcacgacagtattcatgtctacattttctttgtggcctaattattaaatttaagttaccgtcgaaacttgaacttgaaactttatttttgccaacacggcaatgagttctcttggaacatctcacatcatcatcatcatcatcatcatcatcatcatcgatatctgtaataaaataaaacaaaataatgaaaaagattctctcacattatcttatttctccacttgattcccagaagacaaaaaaaaaaaaaatcagaaaaaaagaagaagagagaaacc

SEQ ID NO: 9504 - DNA, 3000 bp, Unknown
  misc_feature (1)..( 3000): cDNA_ID_3034573_gDNA_ID_1972138_Annot_ID_179199 3000 nt of promoter + ATG
atgcaacgcagactcgtaaggttaaaaaaagagtatatctacaggaaaagcttggaaggtgatgagcgtaaggtctatgagcagaagcggctgataagagaagcccttcaaggtctagtgatgattttttttttcagtatctgttgaaacaatcattgattcgatgtgtatttttcgtttttctgattttggtttatatggtttaacagaaggaaagccgattcctactgagctccgaaacgtcgaagccaagcttcgacaagaaattgatcttgaagaccaaaacacagctggtaagaatttggaagctagatttttccaattggtttgaacctgtgatatgaatggtttgtggcatcagctaatggttatcatctaatcatgttgttactagttccgcggagtcatatcgatgatgaatatgcaaatgctacggaagcagatccaaagattttgttgacaacttctaggaatccaagtgctccgctcatccgattcactaaggtattgttttgtttagtttccgtcgttgaatagatgctgacgttataatgttcctgattccttttcattgatggtgtggtttctgttgcaggaattgaagtttgtgtttcctaactctcagagaataaatcgtggtagtcaggtatgtgtgttgttctggcttctgcacttaaagtcatttggaaatatctaattctctttttttctgtaatctggttttgttttgcaattgatcattgcttgtggtttcttcatcgatgttgttaaattgattgccaatggtattagctcccttttgtttcctgggtataactattgcatgtgcatagacttgtatcagattattgttgaatttatgcgcaacactggtcatatcaatgaattgcatattagatcaagctttataatttaaaatgtagttgagtctgtccaattctgcagaatctagatttcaaataaaagcaagactaatataaacgatcatttaagctggagttgtactgacacttatattcaacacaaaacctctctatgtaagtgtaacacggaaactatgttgcattcgaatcgtaatctaagtttctttcccactctgttaatttgcaggtcatttctgagatcattgaaactgctcgttcccatgattttactgatgttatattggttcatgagcaccgtggtgtgcctgatggtctcattatctctcatctcccatttggaccaactgcatactttggattacttaatgtggtaagtaactctttgaggatctgatttttatatccaaatctttcttctttcaactcctagtttagcctttttacttaatccaaagtcccttctgtttaggtaacaagacatgatatttcagacaagaaatccattggaaaaatgcctgagcaatatcctcatctcatttttaacaactttactactcaggtatatctctagagccaaaattcacttcgttcttactgtaatttggtattggaaaccatcaagcttcgtcgtgtctcatagaatgatcgctctggtttattcatttctaatgtaaacatattttcaaatttgatttccctttgttttgcagatgggtcaaagagttggaaacatcttaaaacatatcttccctgctccaaaactggatgcaaaacgtatagttactttttctaatcaatccgattatatatcattcaggtaaaattttctcacaatgatcagattttacgaattttaattggtgacatcaattgtagtatgcaaagcctaaggtcttaaggcttatgttagcatttggtaatctgatccacatagaaacagcatgtaagaacactgtaaatacaacagatggagatttttataaattcttgtgggtatatatatataggaatcatgtctatgataaaggagagggaggtccaaaatcaatcgagcttaaagaaatcggtcctcgatttgagttgcggctctaccaggtacgcattctgcttaaccgaatcaaaactgttttcctcgagtaaaataatggtttgataaagaatcattctagttccttagtaacaatgttgtttctgtgtaatgcaattatttttgcaggtgaaattaggaactgtggaacaaaatgaagcagagatcgaatgggttataagaccgtacatgaacacctctaaaaagcgcaagttcatcggtgaatgatgactaaacggaacagctttgaaccctttatctaaattctgttttacttatcattctgttggaagagctgttcagtttttgtgtccttagagaaaattgcgatgattttgttttaacgtttagcttataaaaacaaaactttcttgtcttcaattagtatttatcttcaaccatatactgttgcgtgagtcataataaaaaattttgtagtagtatttttatccacgaattcaaacaaaaattatctgagcagcatcgaagtgctaaaaggtattggaaaatggataaacacaaaattgtcaaaattctaaactataatttttattttttaattataaatatctttcatcgtgttgttatatatatatcagtcccaggtttcgtctcatagtttcagttgtgtctctttcatctgatcatcggatctatcggtaatttacttcttcgtcttcctcagatcgatttgatctctgtgaaagtcgcgaaatcgaattttaatttcgtttaatcatttgcttgcttcccagttttatttttgttttttgttaatattatatcgaattttctcggccatatttttcattttaaattctatccattagttttataaaagtccataacttactgctctgtgttttctcttttgattcttctctgtttatagtgagtagagagagttatcatctagggtttatagattggagattttagccgcaacaaggaggaagtgtttttaatttaattttattgttaagagttattgttgctttagggatttttagaatttgggtgttcttttaa

SEQ ID NO: 9505 - DNA, 3000 bp, Unknown
  misc_feature (1)..( 3000): cDNA_ID_2036309_gDNA_ID_1972138_Annot_ID_179197 3000 nt of promoter + ATG
gcattgtttattcacaaaagaatcgatacagaatggggctcgtgtcacatatatacgtatttgggtttagttaacttatcaaactttaacatatgtcgatacttccattctcttatcgatctccttgcattgatcttttttcttcattgtttccaaagtttcacatttaagcatatagctagacatgtttcctaaagcagatgaagttcatgaaaggatgctcaaaatgttgaccactaattaaccttgtacctttgatttcttgatgcatgctagacaaatctcataaagttaaattcaccgaaaacaaggataatccacaatttagcgcattgacagtactaaattttgtatggctataacaccgcaaactttctaccattatataaggaatacctggctactaattatatttttacaatgagaatagccaaatgtataaaagagtgtattaaggaataccaaactactgtcatgactatcgtctactttctatcctagaatcagtgagccagaaagaccaaaaaattacatttcgctataatatcaagaagtaatcagaaaacttctaaacttttaggcataagataggaaaacatcaaaagttaaagggtctaaataaatcagacctagctagttagagggaatttctgcgagtcgtgattccaaacagcttaaactataccctgttcgattaacaattaacaagtgtattttacaatcagtcatgtagcaatatagaatatttcataactaatttaaatcaatactatttagtacagtttttattatctcgctgtgtaaaaataaagaataattaaaatttgatatacaatgttcctaactaattttctatacaaatacataaatattcacatttttacaatgatcatcagccaaatgtacaaatgagtgtggattattttatgcatgaacacattcatgcatgcacacgtacgtatatgtataccacctacatagaaaatggctatatttatagaaaaagaagagatggcttatgtggcaaattagtgccaaaacacaacttttgtgaattgtgacctcaagaggatttggtcgttctttactgcaaattgtttgtttatgttcattgttctaggagagtcttctattagaaggggcacatattaagttgagtgtgtgtttaacaaatgttttacatatatatatatatatatatatatgtatatatatatataaatctttttctttataacttacacgcacattaacaaatttgaaactaagttatgacatgatagccgtatatcaaaaactaatttatactatttattatgaattcttaaccaacaaatcactattagttggttttataaacttggttaggctttcaattctaaaaacaaacatcatataaatagaaaagataaaagcaaactgattcttgctatttaagaacaaaacaaaactatttacttattagttaaatgaattttataatctaccttcgtgaaaatacccatttctgatattcagttataataatgattaatccctcaaccaatagggagttggcatttcgaaagaattttatatcataaagcttgtacaaacagataaagaatcaaggatgatttgattattatgacttaaatgcatattttattaaatcaatgaataagagtaagagcactcttggaaaagtggtcaaaatgctacctgtttaattctttgtaggtgtagtagtctaatgcctaaaaaaaaataatttgtacaaaaatctgaatacaaaaatataaaccaaatattcttttaataattttatttcgtttattgatttgtttagctaatctattgattttgcttattaatttgtggggtatcttaccaacttcctccacaaagacaaactagcttcaaaagacaaggtagtcttttatcttccgttgtcgacttgacaagtactttataaataaataacaaaccgtcaaattggcgaatcaatcttgagaattagtgtcgacataaattttattattgtacattatacaatttagacgataaatagtccaaatccattgtcctcgagcagggacgactctaaaatatgggaggtccaactgtccaagccaaagaaaatgtcttttggatatttgtagatagtttaaaacaatgagagaacatttaaaaaaattggggacaatgttttggatatttttatatagttttaaaacaatgagagaacatttttaaaatattttttaaattgaagacatatatttacaaaaataaaaaatttagtgattttagacccatatttcaactcgtagaggatgaactgatgcatgattagaaatttagaatcctgaccttaagtcacttgtgtttttttgctcaaaaaaaaaaatctgattatttatttttaagcccaaaacttagataatcctttacctttttgctttgaaaaagttctgattaaaactttgtgggcaattttcttgaacttcatcactatttgggctttttaacaaactcacttatggccagttttatagaaccggcgtcgtatgatacaagcccttgcacgacagcgtatctatgaaaaataacaaaaactgaaagaacaaaataaataaattaattcggacaaaggtttaaacttaaacccaaccctggtttcttcttcttcctcagtgccgccgtaaacaagcttcgccgtcgattttctcctcctctgaagaagaagataatttaatttctaaagtaagtttgcttctgattccgttaatagtctctatttcgaagattgtagtctcttaggagaaaatcttagtaagattgtaattttgctctgcttcacatgatgggcttaaacgatgatgaagcccacataggccattctgcaatttgagacgaaatccttgctttcaaaatatatatacattaaacctttcattattttgctcttcttctccttcttcttaaaccctagtcatcgagaatccagtaccagtaacc

SEQ ID NO: 9506 - DNA, 3000 bp, Unknown
  misc_feature (1)..( 3000): cDNA_ID_2036242_gDNA_ID_1972138_Annot_ID_179189 3000 nt of promoter + ATG
caatcaactttattcaatacaaccaattccacattagaaccaatttttttttttttttttggtgttcagactaattctgaaaacccctaaattttaagctactactaattttaaaacaaatctgagctctaataatttttatattaaatatgaataaatcatactatgttaaataatgattggtcatgaggactgacttggaccacgcggcctttttcttttcctttcccacaggaataaaattattttaattaccttttataatggatcgtctctttctaacaatttatacaaacatattttattatccgtatatgtcagaccgtacactttgcctgtatcgacacacgatgtatgttggtgcggactttactcatacatctaaaatatttgtaacacaaagtttccaacagtgaaaaacgaattaggaaaaaaatgcaagaagttcacaaacaatcattttgtttatattttaatgttttagagaatcagttttgtttgtaataacttacaaaaaaatgtttttataaaaataatagaatggaaatgtttataaatagatggaatgctaatttatctatttattatctaatactaacaattgttatataaaaaaaaccataatactattactaacaattgtttgtttccactgagatctgtcgcaaacaacacaagtcatacagtattaataatgatcaaatatgtttgttgtagatgtgttcaaacttcaaacacagtcatcattttttatttataattctgagtctgaatatgatgtatattttagaagtaagataagaagagacagtaaaagatctttaaaagaaagaaaaagagttgatacaagaacatgaaatagtacaaagacagctaatacaagaactgaagcagcgaatctattgtctccctcccccttctcttctagcaggcaaactaacgtgccttccattcacctcattctttctttctttcttcactttttcaattcgtcctaatatataaatatttgtttagatatttttttaactaaattctttttattttaactttattgaaataagattaattgtttcatgtctataaacaagatataaatttgtttagctgaactatatatacaacttaataaataaattatagccaaattaaaagagtttggacgtttttctttattaaaaaatgaacaatgaataagacttttgggtcattcattaatatttataagtttcaactattactatgatgagtacaaaaaaaacaaaaaaaaaacaaaaaaactattactatgatgagtatttagttttttcttgtcttaaaagatctctatatgtatggttgataataggtttaatggaatcgattatcttaactctgtctacgcaaagtgacaaattactttttctttaaaccatattcttatcgcccaccaaacatcatgtaaatttttaaatattgacctgaccacataattttttaatctgtaatgttggttgttattttcacctgtcctttagaaaaagaaaaagcttcatttcttgtctctttttttgttcactttattattgttctttcttcaaaatcaaattctagctttttgatatttaaaatcactcgttgacatataaataaatatatatactgtacggctaaaccgtatgtaactggactaattgggccattcgttagaaaaaccctatctggttacatgtacaaaactggaccataaaatatgggccatttgcacacaaaaaacatatgggccaatgcttcattacactcggcctatgaggctatgacccaagtgtatatgacctttgttagtaacttggcatcaattcaaattgtttgtggtgcccaattagttcttattattacaagatgaccaaatgtagccaatcctttatacaatagtaaaaactctaactaaaacacatattacaaacattttgttatagaaaaccataagaatttatatccttaaatgagtttctaatcagtgtaaaaaaaacacttgatttgttatgacttaattatcagctgtcactctatagtataatacatccctttctttgatttattcattgatagttagtgatcaagaacttttaaagtcaaattataaccaatcattatcaaacataaaatatgattaaatctaacaaaaaatgattatatgatggaataaaacaaaataaattgatgatggtgaaagaatgattgtctccacacagtatatagaagcaccaaaataaaagtcgtcatcacaatgtcgtgcgtggctatgatgcatttgggctttggcccacactacaaacaaaaatccgttgaaatttgtacaagaaaaacagtttactttttgcctctccaaaaatatctttatttattaataacaaactaatttagtattattatttttaatccaatttaaaccaaattttattgagacaattttagttgtattttttcattttttttctaaattcaatagaagcaaaagtaaaagctctatggaactgctgacacctaattaaatactcaaagtttaatatgataatgattaattcgagaaataacgagcatctttgttagtaccgaagctctataaataaatattatccacagcgataacgataatattccatcgataaaaatcacaaaagtagctgccaaaaaaatgaaaaatcacgaaaactataatatatacacattttatataaaaagaaaaaaatatgcactaaattctaagcgttgtgcatttatcactcctggcactgtcgatgcctacaatcacgagactcataacaacaaccaccttcaaaatctcgggttctcgggtccggttcaattccggtttttgacccgaacctgtttccgtcttcttctcaacggttatgcttctgaagtgatatcaccactctctctcgtctgaacctgaattttcaacccgacccgactccaacttcgttttcggatccgaaaggatctccaccggtcatg

SEQ ID NO: 9507 - DNA, 3000 bp, Unknown
  misc_feature (1)..( 3000): cDNA_ID_3042189_gDNA_ID_1972138_Annot_ID_179187 3000 nt of promoter + ATG
tctaacaacagagaaatagtgatccacaagttattgcaacaatttggtagacaagccgttcataaagaagaaccttggaaacacaagattttaatacatgctccagagatttgtgatgtccttgaatatgccacagtaagttctttctcttgtgtttattaatttatcatttaaacttaggcatgtggtgaagaaaagcaaatcctacctattgtgctaacaatttcctattaattggtatacatattggtcttagggtactaaagctatgtccggcatatcatttgatatatctggtgtcgatgaagttgttataagcggtaaatcttttaaaagaatacctaatcttcgattcctcaaagtctttaaaagtagagatgatggcaatgatagagtgcacatacctgaggagacagagtttccgcgtcgtctaaggttactacattgggaggcatacccatgcaagagtcttcctcctacatttcaacctcaatatcttgtcgagctctatatgccaagtagccagcttgaaaagctatgggaaggaacacaggttggtgtctgtactttaaatatatgtatgaataatgttcatgtttgatcttcatgctctttctctctgttttgtgtcgatttattcagcgccttacacatctcaagaagatgaatttgtttgcgtctcgacatttgaaggaacttccggatctttcaaatgctacaaatctggagagaatggatctgagttattgcgaaagtttggtagagatcccatcctctttttcgcatcttcataaactagagtggttggagatgaataactgcataaacctacaagtcattccagctcacatgaacttagcatcccttgaaaccgtcaatatgagaggatgctcaagattgagaaatattccagttatgtcaacaaacatcactcaactgtatgtatcacggacagcagttgaaggaatgcctccatcaattaggttttgctctcgtctcgaacgtctcagtataagcagcagtggaaagctcaagggaataacacatctccccatcagtttaaaacagctagacctcattgattctgatattgaaacgattccagagtgcatcaaatctcttcatctgctatatatccttaatctatctggctgcaggagactagcatcattgccagaactccctagctcacttagatttcttatggcagacgattgtgaatcattggagaccgtattttgccctttgaatacgccaaaagcagagctcaatttcaccaactgcttcaaattaggccagcaagcacaaagagcaattgtacaacgatcattacttcttggaacaacgctcttaccgggaagagaattaccagcggaattcgatcaccaaggcaaaggaaatacattgaccattcgtccaggcacaggctttgtggtttgcattgtgatttcccccaacttggcatcgcaaatcacagagtacaggcttcctcaactattgtgtcgtcgtcgcataggtcaaggcgacttagaccccattgaaaaggtgttcaacgtacgaactctactcaactttcaaacggaacatctatttgtgtttatcattcaccctcacttgccatttatcgatccctctgaagtgagcagagagatagtgttcgaattcagtagcaaattcaaccactttgatgttattgattgtggagccaagttcttgaccgacgggagcatcaaagggagttatgattctggattggaacaagtgtttgaagacaacaccaaacacggtgaccatgcagattgttggaattggctattccactgttttgatctaccccattttgtgaaaaacgtcagaagctttgtctcagtatgaagaaaatagaatccagaactgatgaagtgttcattctccaattcatgtcagcccgagactctgtcaccaaagattttctatactaattttatatccatcttatggtgtcgtcgtctcatagatcaaaatggtttatccattaaaaaagcttgtgttttggttggcttacctcatcgattacttatatactgtagttcaatcagaacatatccgtgtgttgtaattcagtcttgtttagtcgtgtgaagcgagatcctgttttggatcatcatcgttttcttgcttcgataattgcgaggaaaaccgggaaacttggtttggggaaaatgatgatgacgtggccatcggcttcattcaatgcgttgggtccttctaggtctaattaaattgggcctataggaaaaaaagtgtaatccatctcttttattttctgggtggctaaatatatgggcttagaatgggcctacagacaaacaaagtgtaatcaatcttctttttttgtgtttttattccgtgtaaatcagtaatttcaaatgaatctgtttcttaaccgctcgtgattttgtatcgctaatcgtgttgtgtgtgtttagattttacaatactcagcgactcagggtccacaacattttcgtctttttgaagcagtctgtaattttgttcttcttaagaggttatacacaagaaggtttgtagaaaaggttacagtgcacatcagcacataaagctgcaaatatggatatcgtttgtattattcttcagaggctgctcatagagtacattattattttctttgacttaataacgcgttcagatacaggagggaccccttttttgttcattttctcctcttgtataagtttccaaaagttacacaatggcttcgaaatatttgatacagacttatcttccacttctcagtaccccttgtccatgcattattatttcgttgacttcataacgcgttcgtcataagtcatacagaaagagaggaccacctttttgttgttttgattttatatagtttccaaaagacgcattaatttcaaatatctgatttttttttatttttttacttatcttccaattctcattacccatttttccatctctctggctctgagc

SEQ ID NO: 9508 - DNA, 3000 bp, Unknown
  misc_feature (1)..( 3000): cDNA_ID_2036273_gDNA_ID_1972138_Annot_ID_179182 3000 nt of promoter + ATG
aaatgctcgttaacttcacaaatatagtcatttctatttatcacattccgagaaattatgattacttgaatgcattaatgttaaaaatataatgtttgttgcaatgctaaggttttttttttttcattctaaattttgttcttatttttttctctaaaaaatgagtagaagtaaatatagccgagaaaaagattgcgatatatagaagcaaaagtcacctttctatgtgatcaaattcacatcgatgtttggtaattgatttgctttaatccaacggtcccacttttacatcgacttcatctactatacatacatgcatgggtcttccaatacatgtgtgtagcgttatatacataaacatatatagtgacttgtataaaaactaaatgtaaataaaacataacaaaagtaatggaacagtgatttagtgatgtgtggtaactggcgagtgctttggacatttttgtataaccgaaggtttaactaatcaagattaaaaaaaaaaagaaaattaatcaagattataagaaagcacaaaaaattatcaagattataagagcaaccccatcggttcaaataaaagatatcttagctatatcttagctaataaactgattaaatttaataaaagcagctaagattagttaagatttatatcttaaccaagatattttcttaagtttaagaagtggacaggtgttgtgtatttattgggtacacaaataaacaaaagtaaggaaaaaaaaaccattggaacataaataatttaaattttttcccttaagaactttttgcttcttaaccaatggagcataaataaattaagatattctctaacttatcttaactttgaaaaagcaaaattttaattttaaaaaaggttaagatccaagattaaaagctttaacatcttaaccattggggatgctctaaaggaccatgcatccagtatcttatgtgttggaacaggtgtatccgtatatgtatgtaactatgtattatgtatcgtaatttgtacgtaagcttggtgccctggtctacagttccctagttaagattctattttgacaacaaaattgatgattccaatcatccatatttgttatagggagaaattgagcatgctatatacggtgatatatatgatatttatttaatatattgaataacaaacacagaactagtgttataggtgcaggtatgtaaatataatgtgataaacattttttatatagattggaaagaatacgagattgttgttgctctgttagaacgaacaaacagaactagtgttataggtgcaggtaaggtaaatataatgtgataaacattttttatatagattggaacaaataaacatttttctgttagaacgaacaaaggcctgtcaaaaagaacaaacctgatgtgacatattacatatatgattataattgattattgtatatatagtattgcatgactatctttacaagatttcaatacgaaaataaattaaaaggagaaaatttataaacgaagcgatttcattctcggtaaggttttccgatatgtctcctaactaaatcaaagccttgtaattgaaacttgtaatgattgttattctatatatctttgaagaaagcttcggtattggacgtacttaatataattggattttatttaaattacaaaaatcactgtataattcggctacatgacttaatcaattatttcacgttgaaaacaatactatatcaacttcaaatacactccttgtgtatggattccacaagttcttttctatctatagaaatatagaatccacaagttctatctacttttattagaattttttattgttcgttgttgttaacataattataagcaataaattcaaaaaaaaaaaaatctaaaagacacaaaatttccatctttgatagggcttcggaatcattaattactttttacaaacaaaaaagaagaagatagggcttcggaaattattagaaagatggaaggatattgtattaaatttggcttcatattttcctttggtttgcggccatcaagtactagtactactcagtacccacaggccacaggaaaaaaagtagtactgctttattaagtgtgttacgataaatggaaagcgttttagtatgtgattacaaattgttgtatgtgatcattaattagttattggtccgacttctaagtttaaatattttcagaattcagttagtttaattatacatgttagacgaaatgactctttttgagccaatatataatgtatctgaatttttcattttgaaaaatctttttataaaataataggtcaacctcgaattattataataaaataaataatttgcgttactatgaaaattaatttactgaatacagtatatagagagagatagaaatagaggaaaacagtggataatacatgattagttgatactcatgtgcagcgagtctatatatattatatactcatgattagttgatacatatgtgacgattagttctacgaatcaatctctagttttcgtcttaaaatcatttggttttatagaatataagaaacaaagaaaacaggaactttcgcgggagacagaagggtacgtgaagagaaaaacacataaaagtgataagggcttaacgtaataatactacaacaaaacctctctacgtacaacgagtaataacacatgaaaatagaaagtcgatgagacatcgttttaaggttagatcgatgaagaaatatctcaggccccacccctgggacccgacccgacccgacccgacccgacctttgtctcctctccttttaaaaactctccattgcttctttgtcttctctcttctataacataactcaagaaattaaagaagatagatagagagagagagagagagtaaaaacctaaagggtgatatacttatataaaaattaatttaagattgtgattaagtggttcactatatttaagttactttgaggagctactaatc

SEQ ID NO: 9509 - DNA, 3000 bp, Unknown
  misc_feature (1)..( 3000): cDNA_ID_2036263_gDNA_ID_1972138_Annot_ID_179184 3000 nt of promoter + ATG
ccgacaaagtggacagctggtcaagtgggaggagcatgcggtgcagcagcacatatgaccacacctgcgagtaccaaccacaagcattttagcaagttgcaaatgcagaatcaaccaaaaatggcggaagaatgcttacgggacaaacacagcgttgtactcctgctctaggcatatcacacagagatcaggaacagcgtcttctttcttggtagaatctgaaatgctctcacgtgtcccgtttgaacctggtcagaagagattgtagtcagagccagtgcaacctatatgtagaataaagagattcaccaatggataccttcactctctagctcagctctctttgctgctgcgtcaagcactctgcaaaaacagctgactacttaattttgtgtgtacatagtttcgagagaaacaagccgatctagtactcatgcttgagaacggttattcacttttagacagacaaatctgtgacataccttttttgtaactgtctccgccgtcttctctctagaacagagtcaatgacatgcttcgtaattaggaacacaccaagaacagtaaaacccatggaggcatatttgtacaacctgtaaattatactcttctcaatcagtttggctcattgccgtttttctacaagagtataggagaagaaccgagagaggagagagacacgaccttgaccattttcccaaattagaaatgagctgatcgagtgatttagaagagacgtagaaagggcccctgtcaggtttttgaatcctgaattctccaatatcgtccttgacagcctgttatacatggcagcaacacaaattagatttaaactcatcggtaagcctctatacatagatcaatcccacttcctacaaatattgctattaaaggaactttgagaaaatttcaagaggcaaataccagactgatgaaggagttagtgtgctatgtatctctatcaacagttacaacttaagcaaaagagaggacccgaaaacactgagaatacgacatacctcaccaacaattgttagcggtattccagttggaagaacacgctcaatgcgcttaactccaagcatctgaaacaaaacaatggccgcttaagcaaatagagaagccaacaaacaaagaaccggaaagaaaagtaaaaaccttaagtccttgaagataatcaagtgttcctcgtacaagcgagcgtcctgactcttcaaaaacttcactaccaacagtcaaggcaaaacccgtcgcaccacgagctcccattacatggacacggcttgtcccatcgtcctatcccaaacagttttggaaatggtattaagaaaacatccaatcacagttgtttcaaacactatgctactagactagacttaccagaaaccaaggaacctctttgctcattgatagcatcaacgcactatcttgtacccaagaacccgtctcattatgtttcaggaaatgttgttccgcctgaaaagatcatgcaattactagagtttcacataaaacctaatcgattaaaccagaaaacaaactaagttccatgcgctaatcatcagtctacaacataccgtttcttcaacaataacaccgcgtatgccactatgctcgcatttgataggtgtctcagagccgactcttcctgataccgcaacaatgaaaggcagaatcttgctatctaattctagcaattgagctacacatacagaacaatcagaaaacatgatcaaaacttcatcctgagagtagatgaagcaatcaggggagaagaagattacctaactccttgagctgattaaccctagtgactgtttcgagtacttcagcatccctgcactcaaaaggataagaaaggatttgattgattgataatctctttgggaagatgaaatataaaagagatcagacaaacctgccactactccggccgagaagataaagagcagcggcgctgaggcagcaagtaactccaccccaaggaatcatcagactctgaagtcactcttacttgtttgcagaagaacaacaatacctttgaagttattgatgagcagagagatagaggtaggttttgaatctggatgcagcgaattgaatgaaatagagatgggagtgaaacgaatctggatttagaacacagagagatggaagaagatcatgcgaaattagctaatgagagttatgagtatgaatcgaggaagagtttgaagaattagaaactagaagcagtgaaagaagaggagaatttcgaaaggggaaattaaaagattcagagggttggaattgaatgatcctttgcttcgatctctctcaatattctcatgcgcagggtttggggaagacgacgatatagtccccaagcaacgaagctgatgacgtggccacttcccaatccaatgggcctactctttttttttgtttaagcccagctaagacgcatgagtctttttttgtttttttgttcttaataaaaagttaaaaactgtcccattccccacggtaagagagtcgttaatcttttgtttcattatgcaattaggtttgtacataatttaaatttacaatcgttaaagctgtctattagtcgctgcctagtcagtttgaagtatgaggcggttcttgactcgaactttctgcatattatcacggattaaagaggttttgaagagtgaatagatttattataaacgacaggatttataagtgagagagctttcgaagcaatttgtaatctctttcgctttctttaagagccattcgaacaacttggagcaaagccttgactcattcaaatgtgagagggcccattgagtcttgactcttgagtataagaacaaaaaatcttctctttttattatagccacaaaaaattaatcttattatctctttatttgatattgcctctctgataatttttatatacagcatttccaaagacacattaacgttaaatatcttcttttagttatcttcaacatttccagctcgttcatc

SEQ ID NO: 9510 - DNA, 3000 bp, Unknown
  misc_feature (1)..( 3000): cDNA_ID_2036267_gDNA_ID_1972138_Annot_ID_179183 3000 nt of promoter + ATG
aatgacataccatgaacattccagccggtaccctataccgaattccaaatatagaagaaattgttagcaggactagtaggatttgtttatctacagcgaatgccttaatttacattataattgaagatagaagataagaaatacgaacttactttggcgtgctcaagaacatgacaaatctcccgggcatctattaagatttggcgttcccaaggctcttgtttttgaatagctcttttacccatttgttgtagtaatctgtgcatcactatttttgtatccccattgctaaaaatcttcatctttatgagagatctgttttcaaggattttcagcccgtatttgacatccaagtcactctcagcgaacatggttttcacaagatcaccatcttccttgttgaagaagattgcaatgtggagaaatagtgtttgcgcattctcatctaaactttcatagccaactcttagtacgtcttcgatatcttgatcaagaatagtttccagcctggtcacaacatcttcccattcgtcttccttcttcccccgtaaagatgaacccacgacacaaagacccaacggaagcttaccacaaagctttgttacactttctgaaagctcttcaaaaccatgacgtggagaggtctgtttaaaagcataactacacaagatcttgagagcatcttcatcagatggaaaccccacatggtaggtattgttaataccatgttgctgcaaaagctctttgttttctgtggtaactacaatcctacttcctggaccgaaccatgtagtttcattagccaaagcctccaactgctttaacttgttcacatcatcaagaatgatgagcactctctggtcgcttagattttcttttattgcacctaaatggcatattctcattccactttggttcaaaacctttgaaagaaactgttcttgtaaatgcagcttaaaaccatactcatcaaaaccactatgatagcttcccctaaggttgtccacaaaacaactaagttgaaaccttttagagagtaaaccatataaagctctggcaatagtagtcttaccaatcccagcaggaccagcgattgcaactatcttaacttcaacattatctaaatctagcaaagattttatttctctcaaatgagcttcaattcccaccataccatcaaaatccctagatggtgtagcattcagtttatctaaaacatctctggcaatcttttcgatcattatagcttcattgtccctaacaaaagagaaagaaaggaaaagcacagtttccatcaaatagatacagagataacattgcatgttcccaacaatttatgacattttaatacttaattcaacaaaaacatttcccttaatcatttaaattccaataatcgtaatacctcctacatcataaaacagcactaattgtttaagttttctctggtgattacaacttaatataatataacctataaacaaacaataaatcagagattaaaataaagaccaaccatcttaagaagtcttctccagcaatattgctgacttggttcaaagctttgctccatttttgcctttcctcctcggtcttacgtgcacaagtttcattgaaagcgatcccgaatttcccgatctgtttccgcacatcggatggatctactccgtagaagatggtcatcactatctgtcccatagctttcttgcactccaagatctccaccaattcatccaaacaccagcttgatgaagcatatttcttggagagaatcacgatcgagatccttgattcttttatagcttctactagtgaaggcccgatcgttgcgcttctcacaatcttttgatcatcaaacatagtgatcccgttgcggttaaactgtagtcgtatgtgactgagaagtgttttacggacgtcaggcccgtggaagctcgcgaagacattgaacttgtagttctgagacgaaaaagaagaaggagaagccatgatgaacgagctggaaatgttgaagataactaaaagaagatatttaacgttaatgtgtctttggaaatgctgtatataaaaattatcagagaggcaatatcaaataaagagataataagattaattttttgtggctataataaaaagagaagattttttgttcttatactcaagagtcaagactcaatgggccctctcacatttgaatgagtcaaggctttgctccaagttgttcgaatggctcttaaagaaagcgaaagagattacaaattgcttcgaaagctctctcacttataaatcctgtcgtttataataaatctattcactcttcaaaacctctttaatccgtgataatatgcagaaagttcgagtcaagaaccgcctcatacttcaaactgactaggcagcgactaatagacagctttaacgattgtaaatttaaattatgtacaaacctaattgcataatgaaacaaaagattaacgactctcttaccgtggggaatgggacagtttttaactttttattaagaacaaaaaaacaaaaaaagactcatgcgtcttagctgggcttaaacaaaaaaaaagagtaggcccattggattgggaagtggccacgtcatcagcttcgttgcttggggactatatcgtcgtcttccccaaaccctgcgcatgagaatattgagagagatcgaagcaaaggatcattcaattccaaccctctgaatcttttaatttcccctttcgaaattctcctcttctttcactgcttctagtttctaattcttcaaactcttcctcgattcatactcataactctcattagctaatttcgcatgatcttcttccatctctctgtgttctaaatccagattcgtttcactcccatctctatttcattcaattcgctgcatccagattcaaaacctacctctatctctctgctcatcaataacttcaaaggtattgttgttcttctgcaaacaagtaagagtgacttcagagtctgatg

SEQ ID NO: 9511 - DNA, 2838 bp, Unknown
  misc_feature (1)..( 2838): cDNA_ID_3049893_gDNA_ID_1972139_Annot_ID_179206 3000 nt of promoter + ATG
aagctttagccctttgaacactcccttttttttcttagttatataggtaacccacttatgatcacagttaattccatgtagatcgtattaaagtagtctattgactaaatcactaaaatatcaattaatgaattaatgttgtatgatttgttatcgtttatacgaaagtaaagaaaaacaagaaaacatgacttggattaagtaactctatgttctgtcttaatacaggagagcagggaattcaagacgaccaccaggaagagcataagtacggttaaagcttgggtaagaagcagaaagagagagagaagtataattgttggcaaattaatataggtcttgtattgctgctagattctcttttcctttcatttgggatcgaatcttttaaatatgcgcaaaatatttgtgaccctacaattctgttttttttttttttaaatgtttgttttgttcctatagtgaagaaatattgagctagttaggggaggttttaaaaaaatgaagacactgattattaaaaggatttcaagaaagaaaagaagtatacgtacatgcaatgcaatcctgttttctcacgcattgcacgacttatattgggattatttctaatttgatccatcatcaaataacgtttagatgctttatttccttactcacattgtttattgggtacttgcactaaatgatcattaacatttattaagttaggtaaataattgtgtactccttttatgtgcaaaaacacaaaatgggtactattttattactaacatgctttcttatcaaatagcagtaccctatgttgttctaaataacatgctaattcaattcagatttggcagacaaaataacatggtattttagagagagcgcgcacaagtgtgtttttttaaaacaaatgaaaacatcataattacgtacctgattgacccttgtgtatatattcacgattagaaattgtagattaccaaaacactcgcacaaaatggttctatatatagacaatatatgattcttatcacatgttttgaatgaaaaaaaaagaattaagatggattttttttttgtaaagaacaattgtactttgaaagagtcttatccaatcattaaaaaaaatgtcgaatccattatttattgatgtattctgaaagcatatattcttccaaaggggcaaataaaagagatgtcgacaaagattggatacataagatattaataatttataaatgcaatggcatatatatatgatataatttgagctctaaatgccgaaatttgaaaaggagaatgtgtgtaatggttcttacaaataaaggagaccacaatgcttctttgtgttatgcttttttcccatcttttattcttttgttcttttgtggggttaactctaccactactcattttctcgctcttttttcacttattttccatatatttctaatttctaaattaattttactaatcttgaaatacaaaaaactattagacttagcttactaatttactacaccaccaacatacacactacgcaacatatgctaatatgtattaaaatgaaaagaacaaaaaatgagaaccggtattacaatttatcgtagtgtatgactagttatgagatgagaaggttcttgaaaaaagaattactaaccaaataatgtagattaattatttgcaaataaagaaaagcaagaatatatagcaaaatcatgagtttacggttcggctctataaaatcttctacaaccatccacgataaacttgatacatgaaatgtcttcttccattaaaacatgagttccacatataaaatggtttacaagtaactctcgaacatatgtgcatggtaaagcaaatatataataccattattttttctgtcttaattaagcaaaattaaacatatatataatatatgatccctacatgttcacttttaaagttcacaatttcaagagtttgaatatctttaatttgaattattaccaaacgcattagacagactaaacagagacataataatcaatcaacttctttttgtcttttttttttttttttttttgggcttccagtcttcataatcaaaagtaactgaagaccagtcttaaagctggaacatttgaactaaacatatacgactgctcctatcgctctagaaattttaattaacaattattcatagttacttaattacaaagacaacaataaaggtgaacgaataaattaaaggaaaattatgaaaatagtttaatttgtatgaaacttttcatccgcataccaaatgtcatatactcttatcttacatttttctcttgggacatatttttggagcgaacactttcgcatgtacgataaggttcagtggtctgagcttcgactacgttaaaatgatgattagggtttactaatttggaattaggagttacatttaaggttaaaagtttatgagtttcaagtttcaacgaagctttaaagtttaaacgatggttaaagttttatgattatggtgggctatgttatagttctttcaatttcgttgggccaaatgggctaaacgattaacgaccctatgaatgggcctgaaaaaatgaaagccacgtgtcagacccccacaatggactttgactcggtgcggctgccggagagaataattaattatcaactccgatgaaaagaaaacaaatacaaagttccaacaaaaatcgaaattcacaatttctcttcttctaaatccatggagtgatgatgatgatagatagattgaatccaaacacaaaccggatccgagattaaaaacaatccggattgtttatatttactttagatcggagaaagatg

SEQ ID NO: 9512 - DNA, 3000 bp, Unknown
  misc_feature (1)..( 3000): cDNA_ID_3042222_gDNA_ID_1972139_Annot_ID_179220 3000 nt of promoter + ATG
tgtcaggatcattaaagtgtagaactaagtcaactgattgattaatagaaaaaatcgatacaatctcacttcctttaagaaaataaaaataaaatatgctttagagaaaataaaatctcgcttatttatgagatatcatatcatttttaggtaaaaaagattagatgtccttttgagacacatcataccatatatatgaccgacaacacacataaaaccgcgtgaacaaaaaatatcatccatcaaccccttacgatgcaaatgtactgtaaaagatggttcattaatttaacatcgtattttaacgttacaattgtatggaacatggaaggttcacaatacgtggaacaaaacaataatgttacgtacggtgtaagaaaaacaaaaaaaacatagcactaaaatagttttcttttaattttcctcttcaaacttctcacgtggaggctactagtggcgaacgtcattcaaatttacccacacccaccatatattatctactcactcccttatatatacacacttccacaaataattcactacacccaaaaaagcttctaacaaagagaaagtgtctgtatgttgtgcccactctctacatttatcaatcacttcatgtgtgttaccttgattgcaaaaaagtgagaatatattctcacaacattaaatccaccccgaaatcgaagtgagtatatcacgagtgtagtaatatcttagagatggttttggaggatagaaaggacggttcttctttgccgggacgatccggtagtttctctaaatcgtcaccgtcggagttggatgttgttgatccctacaagcggataagttcgccgggatctatattggatgctgagaaggtagagaaaaagcctggaggatggagagccgtctcgttcattttaggtattttaattttatttttaggcttcgtgtacataatttagtttacctaatccttgacctttcctcagttattggctaatatttttttgttaatttccttaattggatatatagttctagaaaccagttaatatattatcattgggagatgtaacgggccgttgcaagatcacgttctgcctaaatcattgcacataatagtcagaacaaaagaaatgagcgcataatcttttcagctcgatcaaaaattatattatatattactctcgtaaccgtcggtccaacatgtttgacactcgtctagctgacgactttataactgaaatggaataaaaatttgtcatcataagtgctcttttagccaaaatgttaactttcattttaaattattttatacttttaaatttttataatattttatttctctctatttaatggaatatgattaattttgttagtgatgataattactagataaaatggagtataattgatattcttcaatagagggattatttgtcgatttatttgctgataatattttgtaataaaatgggttgaataggaaatgagacgctggagagactgggatcgataggattgttggcaaacttcatggtttatctaaccaaagtgtttcacttagaacaagtcgacgctgcaaatgtcatcaacatttggtcaggtttcaccaatctcactcctctcgtcggagcgtatatctcagacacttatgttggccgcttcaagaccatcgctttcgcctcattcgccactctcctcgtacgtataatatttttttatttaacttattgaaaattttatataatctttttaaaaaactaaaataaaaataaataatctaatgtgtctacaaatacacaacatttacgtacgtagtagtatttactttatatgttcctaacacctcaaatccgcaactattcgcggcctactgccagcatgggtcagtgctttagcgtccactgttcgaatagttgcatccaacaaaaaacataacaactctaaatagaaagttctatattactactcaatttacgtgtttttttgtgtgtgtggcgacgatacatgatacttggcacataatttcaccccgcacgtggacatgataagaaaatacgtatagacaaattaaattaagtatatatatatgtaaatgacaaagtattaacactttatatattattttatacctattatgttactctctttttttctatatcaaaagctattaaattacttttgtatcgtacgaaaacgcatgaacttattgagggaccacgctatcgaggacgataaggtcggtcaataatgtgaatcataagaacaaaagcattagttagtacacttattcttgtcggtatttaccttgaaaatttatataacatccaaaaaaaatggtaagaaaatacttatctcacgtaaacatcttttgttcattgatgaaacattttccaataaaggagttacgtattagaacgtgttctgtttaagagataaagagatgtgcgtagaaaaggaagagatacgcaagtggtcaatatagattattgacaatgagattgtccaataattgagtgtttgagtttcttgatgatttagctagctagttgggttttagatttggtcagtatcacagtgacgttacgtatataataatagttacttttctagtgtctgtttcattcacaattatagaattatgatcgcatccaacttgttaatttctcttgcacttttttgtctttttcgtaattagttaaacgttgaacttaaactgttacaaatgctcatattactatattagggttacaacagaaataaatgatattaggttctacgtcactgtcactttcacctaatcaaggtaacatcacttttcaatcatatgaagtcaaacctaattaagactattgtaaactttattaattgtttgtatttgttcgcataacttcaatctatatatcccacactactgtttgctttcttcaatattaattaacaatcattcagtttcaagttatatattatagaatatctaataatgaagaatcggtttcaaaattaataatg

SEQ ID NO: 9513 - DNA, 3000 bp, Unknown
  misc_feature (1)..( 3000): cDNA_ID_2183305_gDNA_ID_1972139_Annot_ID_179218 3000 nt of promoter + ATG
gcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacacagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtacttaatatatgatttttgtttttattttttgcttatcactttcaaggtggttttaagacaacactgattacatgattttgtattaacctatagtctaactgaaatggcataaaattaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcgcgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaactctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttcgaagaaatcgatgaaatgatttaatagactatccttagggacaacaagaagattgtcgatgttgtttgaataattactatgacaatgtatgtatcataatatgtaagaactagaatatttaataaaattttacctttcattatgtagaagtgttagatatagttcacagttttgtcttattttataactttgtcatcatactctctgcctggaatcagaaaaccatctctaacaagtatatttaaaatcataaaagtaatctagttagatggattgcatttggaactatatcatatacactatgttatgacttgatagaaatataaacagtatagttttaattgatcatttctatggaggatcacgttattaggcatagtttcatcctttatcgattacggacggtaaatgagtacaacccaactaatatgttgtaaagaaaagctactactgctattactgttaatattaatattagacttcttgggtacataaaaaaaaaaaaaatatatatatatatatatatcatattagacttctagaacaccaagtccaaaacatatttggcatgaagcaaaaatatctactgctttattttgtgtctacctctttgccacatgctgtatattccatcattcatttaacctacaattgaattccgttttaacgtttattcactcaattaatatattggggtttgacaaaaataaataactagtatataggtttgtatgcttttttactgttagctaataaatagaaaatccaaaagaagctttcatacaaaatcaactaaattaaaatgaaaagttataagggaatcatatattgtgaaagatttggaatccttttttcacggctgtaaaagggtcaaacacttctgctgccaccattgttgtctctcttgcgagtctaaaaagtaactcacactaacgaaaaaaaaaaagatagaagagagatagctgtggatatcacgttgaacttaaaatttaggttgcataatcagtggatggataaataaatagaaataaattatatcctaaacttaaaacaaacaatataataaaacgttttatacaattccagatttattcaatatattggatatgactcatgcgatagatatagcgtaagacagctatttagaattccaattataactttatagttttcacgaactgattctagacaacttgatttttaatttggactttaagattactaaagtaggtttacatgcaactttccgcttacttcatatgatagttttgcgctacaacttagagccaatagaaaatgtagtgttaaaattggttacgaattacggctacttggtccaccagagaatatttgacgttatatataaaagccaactcttccgctctccttgtgctcaaactaagagcttctactcaaaaccatttgcttctttctgcttagagagagagagagacacactcaatg

SEQ ID NO: 9514 - DNA, 3000 bp, Unknown
  misc_feature (1)..( 3000): cDNA_ID_2183347_gDNA_ID_1972139_Annot_ID_179232 3000 nt of promoter + ATG
ggagaccgtttcatacttccaaactttcgatggtgttatggcagaatctgacaaggtaaaacaaaacactatttctcgatttaaccgtttaaaccacaaatttctctaattcttgttttattttcaatctccttctggtgtttcaatcggttagaattaatctcatgatcatatgattctgttatatatttacatatagttaccatataattcttatgtctgaaattaatacagttttactgcatctgataaaagtcaacttgcttgttcggaaatggtctcgagtatcgaaagttcattattttttttgggacggttatttaatgctcaaggataccaagattttccggtatttagaaaacttcggatgaaaacatttataattaagatccgctctaattaatataggtcggatcgatccattttttttctttttttctttattggcattcgatcatgttcacttttataatactatttactttgtgtgtattgagaactatttatcgtagaagtttagaagataggtccaaacagtttttagataaaaagtgaatataaatgtgtcttggatattacaggaagaggagcttgatgcaacaaaagcaaaggtggagaaagttcgggaagaaaatgagaaattaaagctcttactctctacgattcttaataattacaactctcttcaaatgcaagtctctaaagttctcggacaacaacaaggagcttcgtctatggagctagaccacattgatcgtcaagatgaaaataacgactatgatgtggatatatcacttaggcttggaagatcagagcaaaagatctctaaaaaggaggaaaataaggtggacaagatttctactaagaacgtagaggagtcaaaagataaaagatctgcactgggttttggatttcagattcaaagctatgaagcctcgaaactagatgatctttgtaggcaggttaagcttgcaaacgctgaaaataaatgtgtatcttcgaggaaagatgtcaaatcagttagaaatgaaaaccatcaagatgttttggaggagcatgaacaaacaggtttgaagaaaactagggtttgtgttaaagcatcatgtgaagacccatcagtacgtaccatcaaaaccatacattacatatatgtgtttatttaccatttcacatctaatttaattatttgatcatatacacgttacatgaatatatatagataaacgacggttgccagtggaggaaatatggtcaaaagactgcgaaaaccaatcctctcccacgagcctattaccgttgctccatgtcgtcaaattgtcccgttagaaaacaggtataatacattctataatttctcaatccaaatatctgtttattaacaattggttttgagtaaaaacttttaaaacgaatgtctataggtgcaaagatgtggagaagaagaaacctccgcttttatgacaacgtacgaaggaaaccatgaccatcctctccccatggaagcaagccacatggcagctggaacttccgcggctgcctccttattacaatctggctcctcctcttcctcctcctccacctcagcgagtctaagctatttcttcccttttcaccacttctctatctccaccactaactcgcacccgactgtaacattggacctcacacgaccaaactatcccaatcagttaccagacgactaccctctatcgtcctcctctttcagtctcaacttttcctctccagatcctccacctccatcatcgcatgaccacaccttgaactttagtggcttgcgaacacaagctccgttgagtacagattcattattggcccgttatcgaacgagactttccggacagcaataagccagtaactgtatcggtatagctagacacaagtctagaaagtaactgatttccgttttctttgtcattcatttgtttttcagcctctgaaagagagatctggttttggcatgatatgcaaaatgcttatatacttgtagatatccaaatgtttaaattagtggattacctatcatatcatggattatatatgtatatgaaggttttgtaaattaatggtctacacaaatttgatacaccaaatatttttttatgcttataaaaattttaaatacaatgttaattttttttgttggtgaattaagtaagtatgactatgatgacacaatgatatctaaaatggaaggtggttttcatgcagattgacaaaatctccctctttcacttttgcaaaattgtttgatttttacaaaataaactttagttagcatcacataaaatagtgggttatttgacaaattatcaacacaacgtattattatttgaaatcacatacgtattgtttactaatttgattattattattttttgctacagacatttactaatttgatggtcaaaattgtagtcaccattaaaattatttacataaaagaattgattattttacttccctcaattatcaaatataaatttgtgatgaatttgaccgaaatgaagatgtctgaattgtttgagccacctaaatgtttagatggtcgattcttaaaaaggaaagaaaacaaaatgaccaaaagaaagaaaacgtatgaaactatgatccatcagatattacttttaaatcaatcttgggctcaggcccgttactaccgttttctatcttagaattcggcccatccacgtcagcgactccggttataacgctgttaaactcttttgacacacgaccacttattataacgtcacgtgtcaatgcacttcatcaggacgcgcgtaaccgccagaaaagcgaaaccaaaggtccatctccgacacgttgcttatccgaccacactcaccactgttctaaattctctcttttttttttccttaaccaaaaaagctctctttttttcttctgggtttcatcgtttccaatctaaaatcatcgtagatttgtttgaaattcttcaaattgagccggtatcaagac

SEQ ID NO: 9515 - DNA, 3000 bp, Unknown
  misc_feature (1)..( 3000): cDNA_ID_2183328_gDNA_ID_1972139_Annot_ID_179227 3000 nt of promoter + ATG
atataaactagaattatttttgtccaaatttttcgtaaataaattttgtaaacagcgattatgactctggcaatttcttaaaaaagaattggataagtactgataaatttgtattctctcaactaaaatctctttttaatagaaataaaagctaaatcccaggaatcccattttagtaccagtcgtggtataaatattaacacttactgattgccgagagacgaaagaggaaaatcccaacaataaagagcaaacgatcttacagctcataatatttcgttaattatcaaattgctaataggtaatttcgcggaatcttcctttgtaatttcctccaactttctctgctttgcttataattgcgtctttgcttcctcctttacctttacgcggcacatagattattctctccaagtgtgttaatttctcttcttcgtaatctaattttgttttgttactgttgatttgtgtctttctgtttcgtggactctttttgactcccatcaattttaggattcttcttcgtgtgtggattttgatttcttcttcttctctggtgggttttggaactgttaggcttttgggtattttgttgaattccttagggttttgtagtaagattttgataattattgaatcgtttagaacaagagtcaactttttaaagtcattttatagaatctgagtctactagtcgttgaataaatattcttaaagaaatgatttttataatcttcttctcgtcgactttatttattatttagaatcttgtatttgtttttataacccataatctagaatttgatgatttttcaggtataaagttttgtaatttacttttcaggagaaaaaaatgggtcaagctttgggttgtattcaagttgatcagtcgaatgtagcaatcaaagagacttttgggaaattcgacgaagttcttgagccgggttgtcactgtttgccatggtgtttgggaagtcaagtcgctggtcacctttctttacgtgttcaacagctcgatgttcgctgcgagacaaagactaaggtctcttgacacttcctcttgaatcaataccttactcgttctgtgtcattgaaggttgtaatggttttgggttactttgttgtttaggataatgtgtttgtcacggttgttgcttccattcaataccgtgccttagcggagagtgctcaagatgctttttacaagctcagcaacacgaggaatcagattcaagcttatgtctttgatggtttgtttcaatatccttcctttttggcttcttgatgttattgtgtttgccttaactaatcgatccaccatttttgcatagtgatccgagcaagtgtacctaagctggatctagactctacctttgagcaaaagaatgacattgcaaaaaccgttgagactgagctcgaaaaggtaaactactttccagccatctccttgagcaataattttgaaatttgtgcaaaaaattattatacataggttaagactctaactgctgttgtgtatataataggctatgtcgcattacgggtatgagattgttcagacactgattgtggatatcgagcctgatgtgcacgtcaagagggcaatgaatgagatcaatgctggtacgtttaaatcttgctatagaagttttcgacttttgtttgttgagaatctcacaatgttctgttctgtttctggtgtaaacacagcttctagaatgagagaggcagcgagtgagaaagctgaggcagagaagattctgcagatcaagcgtgctgagggagaagctgaatcgaaatacctttcaggtatgggtatagcccgtcagagacaagccattgtggacggtctgagaaacagcgtcctcgccttctccgagtctgttccaggaacatcttccaaagacgtgatggatatggttcttgtgactcagtactttgacacattgaaggaaattggtgcttcttcgaagtcaaactcggtgttcataccgcacggtccaggcgctgttagggacattgcttcacagatcagggatggtcttcttcagggtaactctgctgctgagtagagaaatgtctcaaagtacaaaaaggctttttcagagttttagagttgtgttactacttgctactcagtttatcttttagcggttggctctatatgggttcttaaatttcttatcgtttctctcttctaggcttgtggacttgatccattttcttgttttatgggtttgtggatagagtttgggcttgaaaaatatttgtgttattttgggttttaatgtcgttaactcgttattaatgtttaaacagtggttaaagaatttgttaacgagaatcctgattttactgaataacaaccagattgttaacatttaataaacatttcaatttaataaaaagaagcaaacaataaaataacgttataagaataaaaggaaaacaattaacttgataaaacaaaaagtagctactttttaaatctctacgataccaaaccactgagatctgtgcttcactatttttcagaaataaacgatttcacgatcttaacgttccaaactcatcgatcagccgtcagatggtaaatcagacaaaaaatagaaaacacaaaatctgagctactaaatttccttgtatcttgtatttagtaagattgtataataattaatatattaatatcgttgctcaaaaaaaaaaaaaaaaaaataaataatatattaatattttagtctaccgacgtggcagagaacgcggaaggatctaagctgacgtggcgttatagtttgataataacaagtccacgcattattcgaaataaaaaaagatcttttcctttcaccaaaccaaaagttatcatatctctctgccaaatactattttctcaaaaaataaaaataattccaacgactcttattaacctcttcttcagtaacattcgctgctacaaaatatcttcttcttctttcttctgctctctctctctctctcgcc

SEQ ID NO: 9516 - DNA, 3000 bp, Unknown
  misc_feature (1)..( 3000): cDNA_ID_2183321_gDNA_ID_1972139_Annot_ID_179225 3000 nt of promoter + ATG
agaaaacaggatgatgatttatgttaaattagaagaaactatttattattaaatattttacatcatgaaaggagataacacctcgagtaattacaattagttttgagttaaacttcttttaactattcttaaaatcgaaatattagaaattgacattatcattttaaacaatttcccatgaaagccaactttagatattactcattatacaaaatcatgatctaatgtttttagacaatgactccaatgagtgctgacttaattagaccgtccaataattcaggtgcaattaaataaatggaaaattttaacattatgttactttctaacatatatatcattggttatacagtttgcagacccctgcaaggttggccccaactttagaactgataatataagaaataaaaaagcattaaaaagaaaaaaaatcttcccagcttcaagtcaggtccatgaaatggagaagtcagcagtcaaacatatcacagctcatatacagacgagattataaaagggaaatagaaaaagaagatataatttcacgggcagtctaaagaactttggttatgaatatttcgtataatttaatgtcaatttgttgtatgctttatgaaaagagagaaagagttctaaaaaattgaaaatgaaataaataatgtagagaaaagagagggtcggtcactgccacaattaagcggaagtggagaatggttggtatttgttgtgtccttcaaacctcaagaagcttcaatctcaagatccttttgttttattttctgcagattactttgtaaaatggtttattaggtatttttatatttgcaacagtctttttaacataaacagatgatatctaattctatcgatcttgctaggaaaaacaaaaagagaattttcttctcgagtctttaacactttagtgcagaaatttatgtggtacgcttagtcaaattcaataattgtttgtaaatgaatccacagagttgaatattggaaaattaatatattgcggctatatatttcaagataattaatgtttcggattttttttcggtacatgctttctaattcaccggaatattttatttctcattgacaattgtgtttttaactaaaattaacaccaaaaaaaaaacagtgttttaactaaaggatgtggtttgttgtttatgttaaccacaacaataaattctgaagagaaaaagtttgcaatagagactgaaccaggtttacaataaaattccttaatggaagggaaataaatcaagaaaacaaaacaaatattgcatggataagaaaaacacgacacttgtctatgcaacttgtttctttagttgcatgagatcactttaatgttaaagtcctcccaaacagtattggattcttcgttataaaaagacctcagggtgattagagccttgtccttgtgaatttgaatcatatactccaacatgtatacacgtacacacaaatacgtattcatatatggcactggaataatcaatatattcaattctgagaatagtagaatagcactggcctaaaaaaaaagcattagttaaatttcagcatattcttgtatccatgccatgataatggttactttgttgttttattgtctattatttctattatatatgaactttcaatttgaattttagatatattggcagtacaaatacaaaaattactttaaccactatagctcctccgagcattcgtcactgatcagtgagtgtgtgtttatatatgcgatattaaattaaataagtttttcttcacactgtgtgtgtgtgtgtgtttgtgtgcgtggtaacaataaagttctgcgtagacgacacgtatccaatattaatggagttccgaaagaaagatcttctggcaaaaccatcatatatagagacaacagtttattttatcttttaaacaaaaatacgatcacattttttttacctaaattgctaataaaaagtacatagaaaatggtttacaaatatcagccattaacatatatagttcaatattacccgacaaacaaaaacatagtttatttatgattctatctcaaaagaatttaagacgtcaaaagaggtaattagtaacatcattttattggagatattttgcaatgaaaactgccatgaatagaaagaggaggaatcagtaggtctagattaagtgaatgttctacttcatttttgttttagtcaaaaagatagtttcactaaatttattttaaagccattaagtggagggcttgattccttccatcacctttatcttgccctcaactttttttttttggatttacttgcatccttctccattaaacaaaccaaacccaaatatagtgtgtattttatttaataattatgaccagataaatgtggtagactaaaagtttattttacgtgaaacaatctatgtcattctttaactatctagaagaatttagtgttcattaacatgtaaatgtgaacgaataatataatgtgagtaatcgatatgcaatcaatccttaaactttgttaccactataccttgtagagaataatagaacaaaatcaattctcatatgttaattggtattggaaaccccatttcaaaatcaacttgcatattaagtaaagggaaaacaaacatgattgattagtctttattccaccactatattactagctttataaattcttggaattaatatcatctttagtgccctaaaaacaaagaaataaagctagttttctctagaggagaagaaaacaatgttatttcctaagaagagcataaagaaaactacaacatgaagtcattttctaataataaagagggcccaaattcttctttcttctcacccaattggacccttcctcaatcccttctcctctcctctctttaaattccgctaatacccttctcactttcactcttatatttcataaaaacctttttttatatctcctctacctcaaagtttgagagaaagaaagagagaga

SEQ ID NO: 9517 - DNA, 3000 bp, Unknown
  misc_feature (1)..( 3000): cDNA_ID_3042231_gDNA_ID_1972139_Annot_ID_179208 3000 nt of promoter + ATG
ttgaaccgcgggtctaatatggtagcgatggctagaaccaggtagtttttatcccagaaatcgtcaaatttctttctcatgtttacaactagagagctaatgaaatcatccgggttcttgctccactcaattaaccggaggtgtatgtcgcatacctctgggaagtacatattggcgggtaaacaactgctctttgtgaatgcatttatcacttcaacaaagactttcaagaactcaacaattgttcctaatctctcccattccaaatcagatggacataacacggaatcaggatcatgttcattcatgagcgaaaacgcgctcttttgctctaaagcattctccagcatggtgcatgttgagtcccatctcattgggtcatcgatgcataggttcctttcacttacagctcccgtttcaactatccactggttgaatctatcttgaatagattctgagcttttaacatatctaatactctctcgaataatgtttattgtgtcacaacaagcttccagggaatcttgaaccatctcgttaatgacattaactccacagctcacatcaaacaattggccgtaacagtaaaggaacttattctgcgataaccggtctctgattttactagctacgttctcactaaacggaggagcatgactcgacgccatagaaaacaacttccggtcaatatcccactccatcaaacacgtcattataacttcagcaagcatctcaccactatgagatggatcaaccataaagaagttcaaaactctctttttcaattcccatccttcatcaatataatgcgctgccaaacacaagaattcatcagaatcacccgaaccactccacacatcaacactaatactaatcttcccaggtaacttatccaacgcttcgaaaatcttatgcttctctttcgcataaatctccatacaatcagattcaactctttcaaaagcaacaagctcaaacaaaggctgtaaatttccaataaacattctgaatccaacatcttcaaccatactcaacggataaccatgtaagataatcatcctggctaaatcgaatcgacaccgcctctgatccaaacccatactcacaacattaacatcttcatgttcttctttctcatgttcatatctaacattcactacactaagcacttcttcatcctttatccgctcattagctaactctttcttcttccccttaacgaaatactgagcaacaccgttgttgttaccattagttctcctcctacatctaatcaaatggttcctcaaatgcgaagtcccgctcgcgcttgagccgctaagtcgcttcttacaatgcctgcagattgcaatgtatgtctcaccttttctaactctatcgaaatcattccacactactgatttcaatctaccagattttacaatcactgcatctgacaaatccatctcattgtttatcatcagtttcttctgtctcctacacatgtaaacaaatagcagaattttcaccagataattcgaattcaaacaacgaaaccaagttacacaaaacctaaaatctcatagtttccatttgcataaagcttttaagaaaccatcgaattgtcaagaaaaaaggttagaatctgagctctaaagcacatgtacctcttcattcaagtcgcagcggtaagcttctcactggtggtttaacggcggcgaagtctctcagtgtcggtggtcgcggcggtagggttttaagaagaggaagaaaaaaaagctgaaagcttttctgttagcgagagatatttttttgaaacggcgaacaaaaagtaaatttacgaaatgagaccttggattcatgtaactttagaaatatagcccaaagttagtttatcatcaaaattgtccttttttttaaatctaatattaaattatattcaaagaaaaataaacttttatacatgtaaatgcaaaagacttttcttaaaaattaaaagagatattatcgatggtgttatcttgtcaaagcaaaccacgtttggatcccgcctttgtatttctcacaactccctctccttgttgtccttaactggtttctaatgtttttgtctatcaaattgtactttttcgattgcttatgttcatataaacacacttctctccacgtcgcaaggtttgagcctgaacgtctgcgatatgttgttcatcttgtcgaacatagagccgctttggaagctcgcagtcactgctttgaaacccctctccgcgttgtttaagtaactagagttgtatgactcagctgcttttgaattgtggagccgatattgaggctcagaatgaagttggacatacttctctaagaattgctcttcaaaaatgaaaatctcgatctttcaagtaaatttgtttatcttttaaactttgttgtgagtctttgtaaatgaaaaataacatgtttatgtcctcttgattgcagcttcttcttgaaagaggtgtcaatctgaatgcttttaatttttatttgcataaagcttttaagaaaccatctttataaatatagcccaaaggtatgttattatcaaaatggtgttggtgaacatgttgatgttgttacctcctcggatgtgtctctcgacatggatttaatcaaattttttttttaaattgtttttttaataaacttatggtacataaattaacagttgtatagtcttatcaaaatcacaaaaaaaaaaacgatgtagtaaaaatattaatagtaaaatctatcaagaattaataaaatattttgaaaacatacaaaattccaagagaaattatagcgggttgcaaaaatggatcaccacaaacaataatagcaaacgagaacaaaactcaaaacaatttaggtctctgaaacagtatatatactcatggccatctttccatcaaatcatccagaaaaaaaaaacgaaaaaaaacaaaaaaaaataataaaacaaaaaaaactttttatttttaaataaaaataaaataaaaa

SEQ ID NO: 9518 - DNA, 3000 bp, Unknown
  misc_feature (1)..( 3000): cDNA_ID_2183293_gDNA_ID_1972139_Annot_ID_179214 3000 nt of promoter + ATG
ccttgacggagtaaacataagtttcgaagaagaaactgatacaagtgacccaggatccgacccgatagattcagaagatccaaaagtcagcaatttctgacccggtgacccgagatttgacccgtcggaggagaccgacgagttaaaactagaagccggtgatgaaaaccgatcagcaaacaaaaccttatcaggattctcaacaacctccacagaccacaagatccatttcttcgtcgctgagatgtgcggctcacgatcacacgtcacagagttcctccacggcggagctcctccgttcccacgtaaatatttctcgttccacgacatgagtttaaccgttgactcttctttgattggttcccagtcgctttcatgctccgcttgacgaaacggcggcgtttggatgactttcgcgccggtcattcccagaagaaacgacgactcgctcgccgttaaatacttgccgtagcagctcttgagacgtatgaattttggtttacgtggaaccatctccaccgtccatagcgattgccgtgaggttccgtcagagctttgacggacggttttttcatcctcgacggcgtagatgtatgtatcgtgacagctccgtaatctaacggccgttccattattgaataactccattcttcttcttcttcgttaaggacacggtgagattttgttatgattgtctaactatttatacaatattttctagtctactatttgttctccaagtattacaatttcattaaactgaaatgttgcgcgtagattttgttaggtgacatatgtgttttcttagttatttcaattcaattatattgttactctaataaatggatgattttgtcaaaattaatttccaggctgtatatcattagtctcctccctgacttggtccagatgtcacagcaagatacattttttttgtcttttttatgaagctagttgtaatttgtgatatttctatatcaaaaaaagtcaacccttttttgttcttttaaaaatttagtagatcaatgactatattttggggtaaaaggtagatttatagattttgttttgtaagtttcatataataatggaatccaaaaaaaagattataaaattaatggcaataatttcagtgcttgctaatattattttttttaatagtataaaatctcttataattaagtagaacacgcttttaacttaagagttaagagtatcaatataagcaaacttaaaaataaataaaaggttaagaagaaaaaagtatagaaaatactatgacttttatcaattactgtctattaaataaatctaaaatctgatatattatactatttcataatcttcttgtttatttattcatttatttttgggtgtgcaaacaagcttcaaaacttggatagtgcatatacgcggtagcactagacatgggcctatattgctgttcaacaaaatcaatcatagatttctatgggtcgaaatgaaggcccaataatacgattttttcaaacggtacaagcccaaagcataatttgaagtttcaaaagtctcatgattaaatggagaaacttaatcacagagacattattaaagagtgagacaccaaaaaaggtcagctttattgggtcgcatcgcatcgcattaattggcccttttttttgaatcatgactggaggaaaggctccaaatcaacggctgtatcattgttccttagatttttgttgcaatctttatgtttgaaggacaaaactcatatgtgaacaaattaagctataatttgtttttcattaatgtatacgaccaatgagcaggacctgcagatcaagccaagagatgtgagtatcctaatgaatatgtttgtttgtttcttcatcctgatatgcaacaagatgtaagtatgtaagttatgtaacattcagatgtagcatcaaagattactttcttaatttaatttttggatctccatgcagtattcaatccaaaactgtttgtttgtaagtttatgaaaaaaaaactagaggtaaaacaagtcactttttaaaaacaatatagaaaataaacagttttgatgtcaaaacaagattctgtaatttgatggaaaattagcacaaaacattattcgatggttcaaacgtgattttacggtttaacattaaaatgtgattccgcaggattttcatatcgaaaaataaagtgcgtataacgagttctagtaggtcaatgagcttactcaaactatcccataggcaacttcatgacccataatgtgttaaacataaaaaaaaaaattcaaccacccatcgacccaaacagatgaagaaaaacttggtttaaatattctattactcaaaagctctttatcattttactccactaaaacagattaaggccactcaaaacacccttcaaacgagttgagtttaatttgattatagagttgttgatctttggctcttctgcttcttcaccaaccatttctgcataaaattgttaaaagtagaagttccttagattttctagtaataattcaaagactgatataagcatccatttccattattgacaaaataaagctttcactttaatctgaactatttttttccatttgtctacaatgtctgtcgtcactttttgacttttctttttgcttctatattcccatttgctctttactcacattcatatactttctcaatttccttaatttcaaggagtgcaaaaatattgttcttactctcattcatatactcttttttaaatcagaaaaaataattgtttttaggtcgagtatcactcactgcctagggagagtcgaaaaccaatttttttttaaaaaatcagtaacaaagagttattatagaataaaatcgaaactcttcagtttcaagttcctaaaccttcacgtgcctcttcttcttcatcttcctcacaacactgtccacatcgaaaaagttcagtcaacagatttagaatcagatctcttcctttctcttttacatg

SEQ ID NO: 9519 - DNA, 3000 bp, Unknown
  misc_feature (1)..( 3000): cDNA_ID_2183297_gDNA_ID_1972139_Annot_ID_179216 3000 nt of promoter + ATG
cttgatttgacaatctctgcatttaatgaagtatggatcttgagattcgtcccattcaacttcaaatccaaatctagtgaagaaatcttgaagaaaaccaagaagatctccttgacagccttgttcagataacgacccgtgggttgattcacaaccgtggaggatccgacccggattctttaggagtttacagtcccaaggacaacgagaacagttggggagagtaaaaggagagcaaggacggagaagagagagacgagagcaagaagagtcagagactctgaaaggtgaaccggttaagtcgatgaaccggtttggtgaggaggagaaccggagagaagaacagttgtttgtgttccggttagtgtttgtaatgggagagagggttagagaagaggagattgatgagtaatggaggatagagaaagtgaggtttttgattgtgatggtggcgcgtgaagatgagcattggatctggaagtttgggtggccacatcccggagaagctgagaaagggtacggtggtgaggagttgaacggtgggcaatgaaatgaagaagaacatgaagtagatgcagaggaaggtttagtactaaaaatggtgagaacaaagatgagtagagagaaacatctccacggtggttgagacatgtaaaagagaaaggaagagatctgattctaaatctgttgactgaactttttcgatgtggacagtgttgtgaggaagatgaagaagaagaggcacgtgaaggtttaggaacttgaaactgaagagtttcgattttattctataataactctttgttactgattttttaaaaaaaaattggttttcgactctccctaggcagtgagtgatactcgacctaaaaacaattattttttctgatttaaaaaagagtatatgaatgagagtaagaacaatatttttgcactccttgaaattaaggaaattgagaaagtatatgaatgtgagtaaagagcaaatgggaatatagaagcaaaaagaaaagtcaaaaagtgacgacagacattgtagacaaatggaaaaaaatagttcagattaaagtgaaagctttattttgtcaataatggaaatggatgcttatatcagtctttgaattattactagaaaatctaaggaacttctacttttaacaattttatgcagaaatggttggtgaagaagcagaagagccaaagatcaacaactctataatcaaattaaactcaactcgtttgaagggtgttttgagtggccttaatctgttttagtggagtaaaatgataaagagcttttgagtaatagaatatttaaaccaagtttttcttcatctgtttgggtcgatgggtggttgaatttttttttttatgtttaacacattatgggtcatgaagttgcctatgggatagtttgagtaagctcattgacctactagaactcgttatacgcactttatttttcgatatgaaaatcctgcggaatcacattttaatgttaaaccgtaaaatcacgtttgaaccatcgaataatgttttgtgctaattttccatcaaattacagaatcttgttttgacatcaaaactgtttattttctatattgtttttaaaaagtgacttgttttacctctagtttttttttcataaacttacaaacaaacagttttggattgaatactgcatggagatccaaaaattaaattaagaaagtaatctttgatgctacatctgaatgttacataacttacatacttacatcttgttgcatatcaggatgaagaaacaaacaaacatattcattaggatactcacatctcttggcttgatctgcaggtcctgctcattggtcgtatacattaatgaaaaacaaattatagcttaatttgttcacatatgagttttgtccttcaaacataaagattgcaacaaaaatctaaggaacaatgatacagccgttgatttggagcctttcctccagtcatgattcaaaaaaaagggccaattaatgcgatgcgatgcgacccaataaagctgaccttttttggtgtctcactctttaataatgtctctgtgattaagtttctccatttaatcatgagacttttgaaacttcaaattatgctttgggcttgtaccgtttgaaaaaatcgtattattgggccttcatttcgacccatagaaatctatgattgattttgttgaacagcaatataggcccatgtctagtgctaccgcgtatatgcactatccaagttttgaagcttgtttgcacacccaaaaataaatgaataaataaacaagaagattatgaaatagtataatatatcagattttagatttatttaatagacagtaattgataaaagtcatagtattttctatacttttttcttcttaaccttttatttatttttaagtttgcttatattgatactcttaactcttaagttaaaagcgtgttctacttaattataagagattttatactattaaaaaaaataatattagcaagcactgaaattattgccattaattttataatcttttttttggattccattattatatgaaacttacaaaacaaaatctataaatctaccttttaccccaaaatatagtcattgatctactaaatttttaaaagaacaaaaaagggttgactttttttgatatagaaatatcacaaattacaactagcttcataaaaaagacaaaaaaaatgtatcttgctgtgacatctggaccaagtcagggaggagactaatgatatacagcctggaaattaattttgacaaaatcatccatttattagagtaacaatataattgaattgaaataactaagaaaacacatatgtcacctaacaaaatctacgcgcaacatttcagtttaatgaaattgtaatacttggagaacaaatagtagactagaaaatattgtataaatagttagacaatcataacaaaatctcaccgtgtccttaacgaagaagaagaaga

SEQ ID NO: 9520 - DNA, 3000 bp, Unknown
  misc_feature (1)..( 3000): cDNA_ID_4255143_gDNA_ID_1972139_Annot_ID_179217 3000 nt of promoter + ATG
caatcaaagaagagtcaacggttaaactcatgtcgtggaacgagaaatatttacgtgggaacggaggagctccgccgtggaggaactctgtgacgtgtgatcgtgagccgcacatctcagcgacgaagaaatggatcttgtggtctgtggaggttgttgagaatcctgataaggttttgtttgctgatcggttttcatcaccggcttctagttttaactcgtcggtctcctccgacgggtcaaatctcgggtcaccgggtcagaaattgctgacttttggatcttctgaatctatcgggtcggatcctgggtcacttgtatcagtttcttcttcgaaacttatgtttactccgtcaaggtcgggtacattgtccccaaaaccaacagaggtacgcttcaattctaattcatataattttgtcacgcattatcacaacatactatactatataattaaaatattgattttgggggtattttgttttgtaacagaggaaatgttcgaagaagataatagtagaaaatgtatcggcgatggaaatattccgggatgcgaaatcggtgcgtttacgaagctatgcacatcatgggaaatatttgattgctgatgacgatgaagagggtgtgataatgggcaaaaacgggtcatctaaagaggctcgatggagagttgaaatggtaccaggatccgaaaaggcgatccggttaaagagctgccatggtggatacttgacggcgtccaatgagcggtttttgttgggagcgaccgggcataaggtggtgcagtctaggaagattcgtgccgatgagccggcgggagagtgggagccggtgaaagaaggttcaagggtgaagttaaggagcagaaacggcgggaattatttaagagccaatgggggagtgccaccttggaggaattcggttacgcatgatttaccaaaccggagtgctacgcagagttcggtggtttgggacgttgatgtggtcgatattcatgggaccggttgattcattactttaaaacttgtcttgaggctttgacattttgtttgcagcatgaataattttcatattttgataattggttggatgtaattggaaatgcgtttggaatttgtgaaaaaaaaatcagtaaacatagagttgcaacacttggtgtagagggtacttgttctgatttaattttgagagtaatcttagaagagtgtgacttttagacttttagtcctatgtcggaatgagctgtagggtcaatgggcttcaggttattgagatgactagtaagggtcctttgaggtttcttaatgatgatactctacgttttaagtgctcaggtttgttacaaattggtgatgatagcagagaagagagtgtagaggctgtacgaatgtattatatgtttccaaattccacccttaagaatatgtacgttagagtgttcgaatttctctatttgatatagcgtattgtttgtttgagaacgaacaaatgaagtcttatgagtttttcgtatagtttccgttttttgttgttctttcattttcttgttctttcgggtattttgatgtattttgattgttcaaggtttgatatgtagaaatacaaaaaatgatgtcccaaacaaacaaaatgaacatgcaaaattatgtagatgcttcaaaaagatcattaagaatagaagcccccaacctaaacaagatgggtttcaattttttcaagtagagcaagaagcgccaagcctggtgcaaaatatgccattgtacaaatatgtatataaagcatatttaaagcaaaataatgcatgtacaaattacgttaaccaaggaaattaacaatagaaacacaaagagtgtactaattgaaactatctacaaataactaatcgacgtctttttatttgaacgtctttttaattgttatgattagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcgcttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattccacattaattcgtcttgtgcaaaaaaagacacttcttaagcttcaacaagaaagaaatagtattcgcatagtattagaag

SEQ ID NO: 9521 - DNA, 3000 bp, Unknown
  misc_feature (1)..( 3000): cDNA_ID_2183284_gDNA_ID_1972139_Annot_ID_179211 3000 nt of promoter + ATG
ttatttaaaaccttttaatatagatcgatcctttgtttattttcagagttcaaaattttactctgaatttaatcaaagagaatgtattatatttgaatatagacaaatcataaattcaatgatgctaaatcataaattaggtttatgtggacacatcatcttcttctttttttggatcaaagggtgacatatcttttggtaagacgtaaatacttaatgtgtctttcttgatgatgttaatttctgtaaaacctcgtaccgtacacattgatgaaaatagtgagatcttgaaaatagagaggtcgaaaccaccacactacactagaccgtcttggagttactatagctacatctttgactttcattgttctttgcacgcaacttatccaaatcaacacatgttatcaggaaacgcggattctgtatttctcatgtgttacaaaagcgaaaagaatatatattttgaaaagttcatattataccaatttgacatcaaacaatttaataaatttgtgaataatttaagaatattcaatatattatgctgctgcagttgaaacctatacacaatatgaatttttaaagggggaaataaaagacaatctttaaagttgtaactcttaattagttgagcaatttttttttatccgggtatgattttgggatatccctatatatcggtttgtttgaatttgaaattatttttctttgtttaaacatggataaactgtaattacgatatattttttttgttttttcttaaactacaactaagatctatttggttttaatgttttataaattgagtctttgttttctttctagaaaaaagttatgaatcagtcgtagttaaaagaaaaatgtatagacaaacacacaaaaactataagatgaagaaatttcaaagatgtttactttccggaaaatttgacgctacaaaaagtgagaaagaaggtgagtcgtcgtcactctgagttggtagcaaagacgcggaagtttggaagtatctagggtttattaagtcatacataaagtaaatcataaataaagttaactcgtaattgagattttgtttaattactttttccacaactctcggtaaactgtattgttctcttctaataagtcttgggaatcagagccagattgttttttttccataatataatagtataatctctgtggaaactataaaaagtagcagtacaccatagactatgaaatttcaaattcattcatcctgttaagggctcaactagttaagtaataataattacactccaaatctgtaagtactaaattttgtaacaactcctaaattacacatacgattttatgtatggattacacatctattaatacgaaccatgaaaacatttcacaagaaagttttgattttaatttatatatcaaattggtatacgatgtatatcgtattttgttgttgtttgtttacgtcatgtatatctcatacttaccaaattaaatattgtttcggtcaatcataatggaaagtgtaaaaactattatttgaatctgaagatattcttatttcaaatatttgtcgtttttgctcgacgacgaactgacgtacatgttttgatcttacagaaaagaaaatggcgaccatcgaaattccgaaaagattccctaggttacggtccaaactcaagttaggacgtggaacatttgagatttgtaatgatttaccggccttgactgttaatagatatacatagacattgaaagggataacatgaacttctgacttaatttcacaataagttaaaccatgactgacattttggtgcttataatagtcaactcaaagacatatccatagatatgatacatttaacctgttagtcaagatttacaattgaaatagaattatttgtaagtttttaggaatgtacttatatattgatattgtcaaatgttaaagtatgtgcaaatatatcttgacccagtcgtaattataattaatgaaacacgaaccgggtacgtttgtgtgtgtgtgtatccaatatcacaatgtatagaccatataaactaaaattattgcatatcatagacttcgctctcacatcggatagagactgtttataaggtatctaatacaattaagaaggcaaaatcgctaaatacacaacaatttgtggtgaaatatataataaaatattttacataattttggtggcaagaaaataaataactgatccgttagttatgatattatccatgaagggttttgaatatattttatgtggtgaggttgaagtatgaaaccccataaaaaataggggagattgaagatagaaggtaatggctgaacctcattataaagtgttgattggaatttggaacacaacttagaacatacagtatatagttattgctgatatattccacacgtcttggttttggaagatatatgaagtctagactacaatatgatttttggaaaatttaaaattttatagaacatgaagtcaaaatagactatgattttttcaactacataagcaagagaacaaaaaaaaggagggatttaaattccaactcatgtctagagaaaaaaaaatcaactacttggtaccattgtgtcccactatttactattttagcaacggtacagatcaggcaatcaggacacactttcctggactctcttgtagtcttgtccctttgaatctcctaccgacccccaaaaaaaaaaaaaagtcttatttaattatttaataatcatttattttgtgtatatgtttattattattagcatatgcatcccgaatttgaccgtcatgcatgccgtaatctaagaaaaggataatcaaatttgagcacgttcatttcgaatatatatatagacgccaaacatagagactaaacctcatcaaaccacagctgttcaattcctatcccacacaaaaaaaaaaaaaacacgcacacaaaaacaagagctgtgagtttgatcaatctcttcaaaaagtgtaacac

SEQ ID NO: 9522 - DNA, 3000 bp, Unknown
  misc_feature (1)..( 3000): cDNA_ID_2183269_gDNA_ID_1972139_Annot_ID_179207 3000 nt of promoter + ATG
acagaatcaaaccatatacgattcgatactagtgattcaattaagtaagcaaaatggtaaaagattacctcaagaaatgctcttgtaatggaaagtgaacctaataacaatatcccatctactgcaaaagacacctgcaaatcataaaaacagaggaaacatcaaaagtggaaacttgaggataaagaaacaaaatttcccacaaaactgaagaaacacttaaaagctttaatggagaagaagaagagactcacgagtcgaggagacatggcagctggcaaaatccgtcgcgatgcttttttagttcgtttcgagactttcttgaacatgcttctcaagaatctgatcaaaagatcgacactgctttctctttcgtcttcttcatcatcatcgtcgctaaatccgtcgtcatcgggaacaacatcgtaattgtcaccaccgccgaagaatctatcgtctgattcgtatcgcctacgcgactaaggataaagagattgagtaaattcggattcggattcggattacacaattctatgagtaggagataatcagaacgtacgtgggagctagacgaagcgagtgagcgatttaggcggcggaatcggcggcggaggaatatagagttagaagagaagggagttacagagacaaatctgtgtgaggcattgatgagagttagcgatggtgatgatgaagatgatgataaggttgttgtagctgcggccatttgtgagcagagagagtaacaccagatgattattcagtgattgtaattaaaacggacctttttgataattaaatacatttgggatacttttgtaagtatacataaacaaaaggtactgtttcgtagtttttactttggtcgtgaccgagttttacttttagacttaaaagacttttttgataattaaataaaacctcggctattttagaaaagctacataaatatagggtaccatttatacttttatttgagagagaaaatcaatttatttcggctaagtctcgattgcttatatgtttctcagattatcgacctctcggttctttgcataaaagcatacatagggtcgtaagtagtgacgactaggtaaagaaaaagtttgctaaaagtgatatatgtaaaaataatttttttgttaaaagtgatatatgtgcaaaatatgattttagacttgatattgaagagtttacaaagcgggtggtgggagaagccacttggatccttggatgtagccgagggataggaaacggttagcttctttgtcgtcaatgtcttgtgtgaatggtactctcttggctttgtgtgatcctggtcctgaacacttgtactctccgtagaacacggttctgtcatttttgatataatcagcataaaggacatggaccgattgggtgatattcatacgattttttatgtaatgtgaaaagtgggacttacttgtcatgtgcgggagtcttgttttcttgccatccggtggggttgacaacgctggtcatctcggtgtaggcataaacaaccttagggtggctcatccatgctcttcccaaataaattcctccaccggttccagtcaccttgcagtgcacgaaagagtatccactcttctcttctgcgctctttcctgcatgcgctgctatcactctaataccgtctccaaccacgtgcaattgtgttcccttttgaactcaaacatgcattagagatctcgcactttatgtattaagaaataagtatgagatgttacgtaccaagtacatagaggttccacttccgaagatgaaatcgaatgttccttcaacgtaacaatccttgaagaaatggtttcctgtatcgtcacagattgtgtcttggaaaccgtagaatttgcagttgtagaaagcagcaaaatttccggagattctcatggataaagcttgtgctcccttagttttaccatctggtgccggcgcagtgttctacatatgcaaaaaaataaatcactcggccatgaaatagtcgactagtcacatagatgtatgatatatagtaggatcacttaccttaacgacgatgttaacggccatgaaatagtcggataagataatgagagaggcgctatcaacggttccatacttggcggcggtaccgtcataggtgataacaggcatggcattgggttgtcccatcaatgtaatgaagggtttgttcctgtcgatagtgaccttctctttgtattcaccaggagccatctttatgatcacccgctttgtgttccctgcaggaacgctctttattgcgtccgttagtgttttgaattcaccaccctttggattcacctgcaataatttttacatgtttttcaaaaaaattgtatcaaaatctattggtacaaaggatgagtttaagacaataagtgtgaatagtacgttgatgatacgtggagcagcctcagcagctacaagagcaggatctaagcctttacgttgagccaatggaccaacgttggcattgaaccactgcgccacttggggtttgccctctgggattggtgtcacatcatctgcgaacaccatcggtgtaacaaagaccatcaacaggcctaataaaatggacacatttgtgtatcccattttttattttatttttatttaaaaataaaaagttttttttgttttattatttttttttgttttttttcgttttttttttctggatgatttgatggaaagatggccatgagtatatatactgtttcagagacctaaattgttttgagttttgttctcgtttgctattattgtttgtggtgatccatttttgcaacccgctataatttctcttggaattttgtatgttttcaaaatattttattaattcttgatagattttactattaatatttttactacatcgtttttttttttgtgattttgataagactatacaactgttaatttatgtaccataagtttattaaaaaaacaatttaaaaaaaaaatttgattaaatccatg

SEQ ID NO: 9523 - DNA, 3000 bp, Unknown
  misc_feature (1)..( 3000): cDNA_ID_3042267_gDNA_ID_1972140_Annot_ID_179249 3000 nt of promoter + ATG
aaacttcaaagagtttgagagattcctcaaacgaatgcatggtatagcttccgtttcatattctcctagtggaatttagtgtcttctcaaggttttataacctggggttactttcacttgcaggtgaagccgttccggatcttggtttggctccagggacacaagagaccaaccccgagtgaatatatatagtcctccaccatgctactaaaaacacttattagcgcctggttacatataataagaacgtcttggcttgggtttaccaattcagcatagctaagttggagggaatcaaaaccaagattgtaaactgagcttgtaagttgtaagatgaatagtgtatagaacaatataagtggtatgtccattgatatttcagaagaaattgctagcaacattacaggctgtgttacacacaaaaagagctataacaacaaagaaattcttaaatctctcaataatgaatttcatctactttgcttctctgattctatatcctattttctacatttacacctataacaagattttcatgtttcttgaccacacaacaaagcttgagattcctgatttttgaagatcatatgttcactgttgtcatttacaggaaaatggcaatctatgaattgatcccattttcttctcattcctttgaaggaccacccggaaggggatccttccatgcctgatcctgcagagctttctccttcttctgtatcatggaatgttccataagacggcgatggagacatggggatgttcagagaagctgctttcattatagccgctctgtattcttcgtcatgatcctcaacaattgatttctggcgtacaattttctgctccaccggaatctgcataacttggtcctcttccaccattaactaaaaaatttcaccacaaagaaagtgcgtttgtcagaactcaccatctccaaaagctgaagcagtcacaaaaagcaaaacacatttcaaggtactcacatcgagagctctctgtgattccctttcaatccagatgatggcatgatccgctgttgcattacaggagagaacaatctgctcaaatctcccatcaactgggacagctgttctcacaacaggtggatatcttcctaatctgtataccaagggcatggttttcactttgaaacccgtgtcttcgagttgacgaaaacgattttgaagcacatgagtaaacataaagtataaatacctcaagggcttgcgcacgacgatatggtataacctaccaggagcatatagacgccttgcatctttgagcttcctctcctcgaatgtgaatgtatctttcaaacatgtgagacacaacaagcatggcaagctgaaggtttaagatttatacaagagcatgagatgtttttcatcgtctaaacttaggcttataacataataactgcttttgaatttcatactgtttcattaccagataattgacttgaagacattctccagagctgtggtagtccgaggtaagaaatcatcctggtttatccagagcagcacgtaaaatggatcagaagagtcacctaaacgagtcaatagaggctgatatatacaatcatcatacctgtagaacaacagagttgatgacatctgcatatgtcactgctagatggagagacatacatcttggaggagcaatagcaaagcatctaatcctctttctctcaatgttccccaacctaacccggttctgaatcacgaataagacaagcaaagaaacaacccctgctcctaacgaatgtccaacaaacgtcaaggaatagctcgggtttgcctcgagtaattcccttagaaccacatgctcctcttcaaaaacccacatggccgcctttaacaacccgttatgtacataacctccatcaaacttagtctgcccaagtttgttatcaagaagaacagcataatcacactccttagctaaattcagccctctaatagccaagaccacatcaccattctcatgatccaagtagatcatgtaaggcgtcacacgaccctcagtctggtcatagtctttcttcagaataacatgatttggatcaatcccataaccatcaggaggtgcccacatagggtcatgaagattctcctcatagacggctaagatcaagcggcagatcctagggataggctcaaactcatcagatgtagctaatccccaattctcactctcgtgacctgctgagtataaacatttcttccacaaccaatgggtacaacccaagcagtacacacattcaagtacaggaacacaacacagtatcgacatgagaacctatgaagcaagcaagcatcctctgttgaattttctggcgatgggatcggagtactccaccagaacccactgacacgagattagtcagtgtggatcaagaggctctaagaataaagacagaataatcataagctggtcggatcaagcttgtgttccaagatttgtgtccgaaaccaccaccaactactctaaaataaaaaaagaagaatttttaacaatcaagtgatttcttttggcgctgaagaagacacgaattagagagagagaagacaagtggaatttgttatctacgaaatgttcaagtcaaccatagttcgtaaagacgaaacaatgaaagaaacttgtgggcaagaagaatctactcaccagtcaccatagatgctcgaaagattccattagcatcctcgagactagcggagaaagacgtgcaatgtagaaatttcgtcttcggaagctgtcgggtcgggtcgggtcgggtcgggtcggatctgtgctgagtgtagaagaaacttttgttttctataggacagcgtattaggatttaggaccaacaaatttgggcttttagctataggcccattaaatttgtcagcactgcatctgagcggtgtccacagactctatcgtatacccaagggtactggataattacctcgttgcattttttatttgtttggtcagcatatttttagttga

SEQ ID NO: 9524 - DNA, 3000 bp, Unknown
  misc_feature (1)..( 3000): cDNA_ID_2990282_gDNA_ID_1972140_Annot_ID_179262 3000 nt of promoter + ATG
ttattataaataggatattaaggaatatataggatatgtaatgtgttatggcctgcttaaatgctcttgtaagattctaattttgtttccagctcttaaagtacaatttatctcgttcatgaaactaatgggacgagctgcataaaatcaggtgggcatgtccattgatccaaaacttcttctcgccaacttccctctcataatggggaccttaggactcttattagttggcaagactatattagtggtgatcataggcaaattgtttggcatttcaatcatatctgccgtgagggtcggtcttcttctggctccaggtggagaattcgcgtttgttgcttttggagaagctgtcaatcaggttattatatatatgatgatttctgttttttgcttttttacgatgggtttagtaactgcagtgtttcttggagagtatatgggttgtttttgatgcttcccatctattattttttggaaagttaggctcacatcatgatgcaagcagttctattagtttacaattagtcatttaaatgaaaactagaaaacgatattgtcatgttttatggatatgacagctgaggtttcagttctactttattcccatgtttcctctaaggcttgattggtatttcttccagggtataatgactccgcagctatcttcattactgtttctcgtcgtgggaatatcaatggctcttactccttggttagctgctggcggccaattaattgcgtctcgatttgagttacaagatgttcgaagtttattaccagttgaaagcgaggtactccttcacaacactttaaaataagtcatttatcaccattcctagtttcaattgtaaatttaaaacaataaagccatgattgacctcaatatccttccgaagctcatgcattcttggggtaaaaatgactgatcctttactttctgaatttacttgcagacggatgatttacagggtcacatcattatttgcggatttggacgaattgggcaggttggtatcgttatctataaactttgttgcgaaaacaaactcctctagaagtttagatagtttgatttagagaatagtttggtgatatatgattaaattcgtctttgaccgctgctttctaaatgttaaacgcagataatcgctcagcttctttctgaaagacttatcccatttgttgccctcgatgtcagcaggtaatgtaacatgcttgccttgtcttgctcaatgtatctaaccagctctttatttgtctcatttcgcaccaaaaatctcttattttacagtgatagagtagcaattggtcgttccctagatcttccagtttattttggagacgctggtagtagagaggtaagagtagaaagctgatgaaacaagtcaaaagtataaccacacatcatccaaaattattgacgttgttttacctatacgtgcaggtactccacaaaatcggggcagatagagcatgtgctgcggctattgctttagacacacctggagcaaattacaggtgtgtctgggctcttagcaaatatttccccaatgtcaaaacctttgtccgtgcacatgacgttgatcatggtctcaatcttgaaaaagccggcgctaccgctgtaataacttccacaacttttctattctccttctgtcattgcacaacattttcaaagtaaactgattaaaatctcgatacaaaaactcgttaggttgttcctgagacgctggaaccaagtcttcagttagcagctgctgttcttgcacaggtacaagagataattcttgtagtcattaagtcaccaacaatgttatttggggtatttgttaaacttgtcggcttctttttcaggccaaattacctacatcagaaatagcaacaacgatcaacgagttcagatctcgtcacttgtctgaactagctgaggtatatatttggtctatttaaaaaactacaattcttcttactctccggtttaatggatcctatgatggtacagctatgtgaggcaagtggaagctctctaggttacgggttctcaagaagtacgagcaaaccaaaaccaccatcaccatctgaaacatctgacgataaccagattattgaaggcacactcgctatctaaccttttttctcgcttctggtaagaccacacaatttcaacttcttttgcttaaaactgtacagaaaccaaaatccttattttgaagaatcttagcggagaaaaagtaacaaactctcaaaattttgatgggatgatgatgtgttgaaatttctctagtttctttcctctgggggaaaaacaaaggcaaataatatttgtattcaacatattgggtctaatatgtgaatctatccctcatttatccgacactatttgtctgtactttctacctttgcttcacccttcaacaatcttggcaatcgcaataacatgacttgctctgataccacttgtagtacatttagctttgattgttggagctctcgagttaaatcacaagggtatatatatctagtgtggtactttagaccgcaaatagagaatagaccgtaagtcaacgaacttacatgtattgtttatatattgatcagtgttaattacatgattaatctgagtttaagacgactaatcaaattaaaaagctactaaaaatatgaagcggtccgattggatttattaaaaaagaaaagaaaacgaaagactggtataataaaaccggaaaattcaggtgaaatcaacaaaccggtttcttttgtgatttgaatgaacttaaacccttgttgatatcaaaagaagaaaccctagtctctccgactctccgtagacgacgaagttatcttcttcaattcatcgtctcttctctgctctgctttgctctagatcacaaattaaaagacttcattagtcttcctgtctccaccattaccttcttcctttttaactcagccacgacgagcagactattgttctgttttccttgtataaaaatg

SEQ ID NO: 9525 - DNA, 3000 bp, Unknown
  misc_feature (1)..( 3000): cDNA_ID_2183253_gDNA_ID_1972140_Annot_ID_179271 3000 nt of promoter + ATG
tcttcttcttccttaaacacacatctctctacacttcattttctcacctttctcttctgatttcacttgtacacgattaagcaaagattcaatttccaacattgacgtttctctcgagtgggtgaagtagaagaaagttatgtttaaaccctaaaatatttttttcctgagaagtcgatctctaatggctcttgtacccaagattcgcaatcgcaccatctcggacaaaccagtctcttcgtcttgtactagaacatcgagtttcagacaaagacttctcgccagttgcaaacgatttctcaggttcaaattgttggttcgtgcttcttcagtgtcattaaaaaagaaagcagcaaggtgttcacaatctcaacaagttgttaaacataatgatgataggattgaggaacattcttctagtaatcggggttttaaagatggcaacaatttcttagtatcatcaacagaaacgaagaagcttgttgcggtactgattctaattaatatattgtatcaatgtttgtggatgcaatgcaagattgttctgtttcattgatttagtaagagagctcttgtattgatttctgttgaagttttgtggtgaacctttccaaccactcaacgaggaggaagtagctctagtcaatagtgccttgtctaagagaaacaggttttttttctttctttcagaattagcttatcatgtgatttgacttgattgagaatttaaccacttgtgttgctttgctatctcagaaagaagattttggtttcgcataaaaactccaatattgacatctctggagaaactttacaatgcctaaggccgaatcaatggcttaacgatgatgtaggttaagtcaagagttccttatgtgttttgtttgcaggaatcgtgttttattttcttctttgttttatatttataggtcactaatctctatctggagttgctgaaagagagacaaactagagatccgcaaaagtacttcaagtgtcatttcttcaataccttcttttacgttaaggtttgctttctcttttacttgttaaaaatagatttcaaaggtctatgtttcctcatgccatgacttactttacacattttcagctcgtaagcggctccggttacaattacaaagctgtcagtagatggactaccaagagaaagcttggatatgatcttattgactgtgacatagtgaggtttcctctttttgtcagaagtatatgtatagtccaatttgattgatgatgaacttgtgcagatatttgttccaatccacatagatatacattggaccctgggagtgattaacaatagggaacgcaagttcgtgtatcttgattcattatttactggagttggtcatacaattttgaatgctatggtataacttcttcatcatagaactctctgtccatttgcattttggagattatggaaccagtgttattgttttaggcaaagtacttggtggatgaagtaaaacaaaagagtcaaaagaatattgacgttagttcatggggaatggaatacgttgaagaacgtcctcagcaacagaacgggtacgtaattctcattttgctatgttattgatctcacttgacactagtctgttcgaataattcgcaggtacgactgtgggatgtttatgcttaaatacattgatttttacagtagaggattgagtctacaatttagccaggtaataagagatgtcatcaaggtctgtgtttgcttatgaatctgtaccaatactgttgcattttgaaatcgagaaatatcaaattcctatccggttcaaactagaagaaacattacttaagcacatgagacattattggtcatggaattaaagtaggtgttggtgaaacatgtattaagagggatactataaaatatgttcatttcgtctttaattctatcgtttgcagaaagacatgccgtacttcaggttaagaacagctaaggagatactgagactgcgagctgactaatagtgcccccatcttggtgacataaccttgctattttacaaagccgattcatattagtttagcagccttatttgcttgggctgtggagaatgctagatatcttcgttgctttcttgaaatatttgtttgattttttcttatctagaagaagttgttgataagcttttagaattctgttttattgtttagtgaaggaataatcttcaattttgtaccctggcctgaggaataattttaagtttggtggaaaattgcagattgttatgcaactcttagtctataccataagataacctcatgaatgaatgtggtaatagtggttgcagagcgtgtaattacaactgctttgtgttctgttgtttagtggaaatatgaatctccattttggcttgagtaattgcatattttgtgatgtatccatctctctaagtctctagactaacctgaggtgacaaacgcagcgatagagtcgctggataaaatgcgtaaaggaagtaagaaagcagcactgcagatggttgacatggaatgcagttacctcactgttgatttacaactcttatgcattgtgtttggtggataatgcatatcaaacgtgcagagagtactgatcagtttacaactcttaaccggaaactgagattctcggttcggtttaaccggtttctaccgaattcacaggactacaaatattttaagttaggtaagggaaaccaaaagtccacatgtttctgatccacgtcagcatgaaattctaaacgacgtttcagcgtaattcatcttctcttgtataacacttccgattctaattagggtttatcgtttgcatcgctcttgccactacctccggagtctgtttcatttgtttaaggtgagtgaccacattgattttagaatgattatatatgtatggtttgaattcttgcttacctcttgttagctaaggttttatcttaaccattaatttagtaatataggattcttgttttcaaacagtga

SEQ ID NO: 9526 - DNA, 53 bp, Unknown
  misc_feature (1)..( 53): cDNA_ID_3086330_gDNA_ID_1972140_Annot_ID_179276 3000 nt of promoter + ATG
taagttatggcaaccacaccgccgcaactaacgtcttacccggtggtgctatg

SEQ ID NO: 9527 - DNA, 3000 bp, Unknown
  misc_feature (1)..( 3000): cDNA_ID_1829785_gDNA_ID_1972140_Annot_ID_179274 3000 nt of promoter + ATG
gaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcgtgccgctttacaatgcgaaagctgatcttgatcaagactggcgcgtgcgtgtgtttctttttcttaatgaattgtgaatttttatataacttgtttttttggtcttgtactatgggagggagggggtgtcgagtcaagaacgaaccgcgcgagtgggcgagatccaactcctttgtcaccgtgatgggacaacgacgtaaaagggttcgggtccgatcacggtggaggagttggtggttcgggtattgactggggtttggaaaccccctctttactctttttgtttgtgtttgttatttttattatgtagcgcgagtaagccacacgcgtggggtgtgttgtggttagaaaacgcgaactgtgagatgatgatgttatgttggatgggatctgtatcgtttcaagttaaaaaaaaaaaaaaagctgtctctcgtggagcattaaatgtattttgcaggcatattcattcatttaatgctataccttgtctccttcctttgcatgatatggggcttacgtattccgccattttcgttgcgccacgtcattcccttgacagactggtgcgatgaaccagacgttacgccgtcgttttctcccttctgtttgtttggttcttttctctttctcaatatgttgtttttaagttgcagacaggaaaagaaaaacgtaagcaagtgaatttaaatagctgtacggtggtgggctttattttaaagccctggcccgttatggctaatgattcctagatcttataacattaattgggcctacaacaatatcatgtgccattatttatccgttcattttgcaaagactttagattgatactgcactaataagcccataaggcaagtgaaaaatgtcatttaatcccccaactttcaaaaaatggtcattttatatatcaacttcgtatgtggccgtttaaaacatgaactaaaggttgactaattttttaaacatgatctttcgttgaccagactaaaatagacatgccgttatcagtcattaacggaacttctaatgtccgttatcatccgttaattttattagtcaagtttcaaattgtggccattttaaacatcaacttcttatttggccatttaaaacatgaagtaaacgttgactaccatttaagacatgaaaaattcgttgaccaggccaaaatagacatgtctttatcagtagaacctagaaactcgttaatgactgctaatctatccaaaacaacgtcgtttgagaataatcgaaagaacataaagattttttccatatgaaatttccatatcaaaaagttttaagcagaacccaagaacatagtttgatatagagataaccgcagtgccagtaattggaagcaaataaaggtgttttcgtttatatatttgttttaaattttaaaaggaatcatggaagcaaattgaagactcattataagattgttcgtcttgtttgagcggttgtagaaatagatttggggaactggagtttcatttagaaaacaatcctgattttctttggattattctcaaaacaaagtcattttagggatactaatagagtcgttaacaagtgataatgaatgttataagttcttttaatgaatgatgacaacatgtttattttggcttggtcaacgaatttctcatgttttaaatggtagttaactcttagttcatgtttaaaatggccacatataaagtcgatgtttaaaatgaccacaatttaaaacttgactaataaagtcgttaacggatgataacagaagttagaagttccgttaatgactgataacggcatgtctattttggcctggttaacgaataatcatgttttaaaagttagttaacgtttagttcatgttttaaacggcagcatacgaagttgacgtataaaatgaccattttttgaaagttgggggattaattgacatcttttcccataagacaatggttcaatcagtaataaccacatcctcattaacattcctcagatagtaaactaaccaatatatgttttattttacttcgtttctcaatctaatagattacttgaattgtttatagattacctcataggatgatgataattaatagtttaaaattttgaacagagacattattaaaaatgtctaaaaacagtaagaaattactaaaattatctgttgcaggagcaaaaagagggaagtggtcaaagatggtcaaatgaaaataatacagtgcccgcatattccgcgtgggcttagatgcaatcattcaaaacccccaaatccttttgcctaatcccgggatacgtaaatagacaaacaatacaggggtactttagtaatcacagcttgtcgaaatcgggcggattcatcctaacccgtcggatgagctgctgcgataaatcaacggtgaggagtcaatgtttgaccaaaaaaagagtagagagagatagagaaagagaacgaggctggcatgattggctttgcccacgagagagagagaaagattccacctgggttgggtcgtgaagaaagagaagaagaaaccgaagaagctcgaagaagaacgaaggagattcttcctttccccagatttttcgtttgaagaagaatcgaaaaacttagatttttggttttgctttcggagttattcgaatttgaaatatctgaatctgttgattcatttattctccgcatgaagctgtgttggtgaagtttttcggagatttagggtttctgagttgttcctcgtttggttggtgaataaagcgaagatg

SEQ ID NO: 9528 - DNA, 3000 bp, Unknown
  misc_feature (1)..( 3000): cDNA_ID_2994823_gDNA_ID_1972140_Annot_ID_179266 3000 nt of promoter + ATG
catgacacaagcttttccatgaatgtatttatgtccgccttcttatctttcttgaggaagatgaattcaccgaagatccaacttgagcttgacaatcaatcaaatccgaaacagaaacagagctttttgacatctttgatttagcagtctttgatcttgaggaatatcaatgaacactagatacactcacacttgcaggctttaaactggattttaaacatgaatagaagcattgattccatggaatgtggtaagtgacatagctggacttcttaaacaaatgtatgaacgggtagggttcattacaatgtagttatacagcactgagatttatggaagaaaaaaaggacacagctttaactatctacagagagacaagaacactaaagacaagagaatcataagttcaggagttcgttaaaatggctctattcaaatcacacattggcacaagaccactaataagataccaagtgggacaatcgaaagataataagagatagcatatcagagagagagagagattttttgaggagggagaagttcgccggaggcttctgtttctagtcggcgttgtgattggaattgtttgagcggtctttccagtcccggaattggaaacaagagggctaattttggtccttttggaaagatttgaaacgacatcgttattaagccctaattctactataacgatgtcgtttacgagaaacatacatatacatacttgagaataaagcccattaccaagagaccaattttggtctttttcgtatagtattaactctacggcgattgatctaagcccaataattgtggaacttgctcgacttaggtctcaatctctattttctaccaatgccaaaaaacaatttccttacaaattttttatttttcccatcaaaacaattcccaccaatttacatttaaaaatcattgtaatctatcacatttccttacttttaaaaccatttacaaatctatttatcgccaaaacaaaaacgggaaaaatgtttttggaaaaaaaaaattgacagaaaaattattttcggaatatttttggcgaaaaaaatcgatattctattttgttaacctaaaatattttcaaaatatgagtaaaatagtcattaaaaattaaattaacgtataaatgaaaatgactaacaggaaaggttataattaaaaaatgataattttggaagaacattttttacaatttctctttaatcattaaccctcgttgtatggaactccggtggcgttgagccacgaatctctatttatgaactctctaaccgtaaacatgactgcttccatcgggtctgtgatgatcttgttcccattcggatggactctctggcttgcgtttgctctggggcctttgttttgatattcgcggtagaacaatgtggacaaatccccactagtgctgctatttcatggagtccatcccactggatctatcaaaacatccatttaagattccataatcaccaccgttgataaatcaccccacggtcttactagaaacatcttcaccattctgtgaatgtcgacgtgtcggtcgagagactgtaaaaagcctacgtattcatagaatttttatttttatttgtgatgtttatgatagttttttgttcactttattttttttgttcaatctattttaattttcttaacactgatataaaaaatttcatagtttatgttgtgtatttattttttaattttttataatatttaatttaattttgtcaattattgttttatttaatgtgtgaattaattttagctgtaatgttttgatttcaataaataaaatttaggcaggccacaatatgatgacttggatgttgatgtagacatcgtagatcgaaagtgaacttttctattatatagacgtattttacttattttttgcttaatttatgcttacttttggtcaaattattttctctttattattcaaattatttcaataatcataacatattggtagatatgtagtcgctataaaaaatttggatgtaaatgttaactgatgaaataaactaggcctaatttgtgtgaaagtagaaacctattaattgtgaaagtttgaaattccataatctcggtcgcatattgaatactcaacatataattttggtagtgtttgaagaatcatatttgagacataatcaggtataatgaataaaagcagatgacacagcaaacgaggaagatgtcatcacttgtcacaaatccagtgcatagatggatcaagtgcaattctgatgaagtataaaaacattagagaaatactctgaaattggatggatactctatgacgaccaggtggtgtttgtaacatcttgcatagcgttaatcttgagctaaaaacagctttagaagctgaaagatagatttttggggtcagactgaaaactttaattaagttagggtaaatatgtaaggaaaaggaagtaatgtgtaattttataaatttcagaaagaaagaaatgaaaacttaaaactccgttttaattaccacaaggctcaagcccaagcccaataccgctaacgaaatccgacgaaatcacaaacattataatattacatagagataatcatctttctgtctctctgtctctctgtctcacgcgagaactctggcttcgtctctatattattgacccttttgatctctctctgtctcgctttcttcctcgcgtggacctttttcgaaaaatatcaatcccagaatttcgcttcattttggattataaactcccagatctgctactctctatctccgattttgtgatttttcaaaccctagatttctccggaagagtttatttttttctctgtaactaaaccgagatttttttttcaaaattccgacattaccctaggttgtgtattaccgtagaaaaccctagttcctttttggtattcttggtgtacagatcccttccttagtcagagtttttggttattagtgtttagaggtttgtg

SEQ ID NO: 9529 - DNA, 3000 bp, Unknown
  misc_feature (1)..( 3000): cDNA_ID_3042262_gDNA_ID_1972140_Annot_ID_179253 3000 nt of promoter + ATG
tggtcccaaagatctcagccacatgtctaaggtatgaatcaagtaactgagagatatatttgtatcagaacatgtataaggtaatttagaaaatggaatctaattgcttcatttaatgccaccaacaggaggatacagtgaattacattacacgcaacatgtggttccctgtttacagccctctcgttcacgagaaatagacaacaactctatataactcttctcaggtttcatagaaagccaaaagacaaaaaatcttcgcttcatcttttatttgtgatcaacattctttttttcttcaaaatgtgatatgttttaagaaaaacaatgccaaaaagagggcttaagaacaagaacagggttagttctaggtcaacctgtacttttcctttttttttttggacatttttccaacttcttacgattatttctgatgataatgattacaactttatatactgttttggcaataataagccaataatgatatctttcttctacattttcctgctttaccatttttgttctgataccaaaaggtttaaatggtttcgagattcaaccaactttgaagagttgttaatgcagttgcagaagcatgttaaccgaaaatcattccaaaccggagaatatcaactcgaaccagaataccaaaccggaaattccaacagtgatcgtgctatgtttaagttaaaatttaaattaagcaaacaccggagagtgattggatcggggaatttgggaaaagtatggagaagaagacgaaagtgctaattgtgggaggtactggatacttgggtcagcatcttcttcaagctttcgccggcaactatggcggtgaatgtgagctatacgacgtcgctttcactcaccattcttctccacttcccgctcgtttgctcgacgctttccctcattcccccgcgtttcctgtcgatcttaaatccggtctagggctcaattccatatcccaggactttcgtcaggttccgatttcgtaatctctagctcgattaatgttctttcctctaggaattgcttggtaaatgaacatgtgaatctgtgtattagactctctggtctgaaaagcaacactttgttccattgattatagcctgatgtggtcgtgaattgtgctgctctgtctgtcccacgagcttgcgagcaagatccagattccgccatgtccatcaacgtacctacttctcttgtaaactggttatcaagttttgagactaacaaaaccttgttgattcatctctctactgatcaaggttagttgccaattgcattagccactgttatagtgttaatctcatcatgagtcatgacttatgcttttgcacttggttttcatgtctcaatttcagtttatcaaggtgtcaagtctttctacaaggaagaagatgagactgttgcagtcaacgtttatgggaaatcaaaagttgcagcagagcttctcatcaaggataagtgtcaaagctttgcaatattgagaagtagtatcatctttggtcctcaaactgtatcacctctccccaagactctcccaattcaggtgcttcttaacacaatttctcagagatatatatacacacttgagttcattgagttagccatgaaactggtcgtcttttatgttttagtggattgatagctccttaaagaaaggggacacggtagacttcttccatgacgagtttcgttgccccatttacgttaaggatcttgtgaatatcactttcaaattaatagacagatgggtctctggtagattcttttttactgagtttcattctctcgctctgcatcattgtacataaaatgtagaatcataacaacatgttgttgctgctttcagatgataaacagatgcggctagttctgaatgctggtggacccgagaggctatctcgtgttcaaatggctcaaatggttgcagaagtcagaggatacgacctgtccttgattaaacatgtgtctgcatcatcggtatgtatgaggctttcacaaatgaatctcacttgttgaatattgcagatcagtcacttaatgagtctcagctattttgtcagattgatcgtggcgtagtgtcaccagcagatatatctatggacataactaaactgattcatacacttgagctctctccaacttctttcaaggaaggtgttaggttaacgcttgactctgaatctcattctcatatgctcccatgatagtattcccttatgtgctcttctttaccactctgcttctttctatggagaaaaatctcggtttgagaaaaccaatgtaaaacggttgatatggtttcggaattaaggtttggttttcaatcaataattgtgggattgaaacggcacacagtttgagtaagcaatgggcttgtcaataattgggcctaccctataacactggtcaaagcccggcgttcttaactttgaaagtgaaacttgatgatgtttaaatgtaaaagaaacgacacgtagtctagacacgcaaagtcgtttttagattcttcttcgttctagacttggcggaaaaagaatgttggagattggaggatcctgcgaagaccaaccagtctgttaattttgtataaacaatgaaacgaagaagatcttccgagaatattctctccttctcacgcataccctagaatattgtttcgtctctcttccttctacgtttgcttatttgccccaactcgacgcgaatcatcagcttttataaattctgtcaactcaaagattgtttctgaattggaatcttacaggtatggcttcattttttttttttttttttttttttgatgtaatcgaaaatcgcttgaatcgtgtgaaaagattgtttgaatttgcagaaaaattaagaatttgtagtcgaatgttatccttattgggaagatgcaataatcagatcaaactcaattacaagaatctattggtttactctttttgtttgataatttgtagaggtttagcttgagatgatatg

SEQ ID NO: 9530 - DNA, 3000 bp, Unknown
  misc_feature (1)..( 3000): cDNA_ID_3042254_gDNA_ID_1972140_Annot_ID_179255 3000 nt of promoter + ATG
taattggtcttcttatttgcagacaatgtgagcataaaaaaagcgcttctagctttgtctatggatttcagagtactgtgaacataataatatgtctttttccttgccatgtagaacaacaccatggaatctttccaaattaagaaatttcatgtttttttccatattcctactgataatctaggggtgggttttatctgaggcagatgcagaatccatgtgggttttgaatcatcattatacgattttacattaaggcaatggaatatacaaattcacatgaaacatgaaccaatcttataaatgaactatttctctacactagacgaacaattacatcatacttaagatcttattcaagagtgatgattaattgaagaaatcctaatcaaagctaattgataaagatctaaaatttcaaagaactgaacaaattcaacatgaattcgacactcgatcttaggaacaaggaatcattgttatggaacaagcattgaattatcttttgttgcaggcccaacaaagacctcataacagaacaacctatatcaagaataatacagtgggaacacatttctcaagaaaatagtctcttctaaaagatccatgagctcaatttctactatgattgattagtatgtagacggtggaatgttcagcagttaatcctatatgaaatcatgcatgaaaataaaataaaagatatgatttaatagaggaaataagttgcttaaaccgggaaaaacataaagcatcaaatgttcaaaagacaaaccaaaagaaatcccaagacaaaaaccaaaagttcaaaaaagaagagataaagagaagcgatcaatgatcctgataagtgatagcacacaatccttaagcatcctcctcaacaatgtttgaagactgttccttcttcgatctcttgttcggcttcttcacaactttagccacattctcctgcggatctctcgagacaccatcttcctcagcgttccttgagctagaagcaactagaccatcttctttagtcggagtcttgactttctttgctctatttttctttttaggcttctcagatttagcctcctcatcaccatctttttccttgacactcatctcagtttctacacaaaattcagcaattacgactcaatagaaatgatccattgcctattatgctagagaagaaaaagtatgtatatacaaccaagaactgaagttaccgttttcaatagcttcagaagtagcattaacaagacctatgatcccttctttctcagcatcatcactagtttggtttaattcagctagaagattatctacaacatttaaagctaatcaaggcttactagtgtacacaagtaacatctagattctagaactaagaatcaaaaacttctactaatattaaaaaaaaaaagaacataagtttaccattttcaagatccttgtcttggtcaatcatgtttaaatcagcatttgctacctccttttgaacgtcgtctattgaacacataaatcatacatattagtctataacatctaataggagggaacacatcactcaacaattgttataaactattttaccttgttcgattgtccctgaaagatcaatcttggcctcaacatctatggtatgaccatcgacaggttcctcttgatctacatcacaaatattctgattctcttccaacctagtgacagttccctcaccactttcaaggccttaagaaaaacagatataacaacacaacggtaaatcaaccgatactcttcaataacatttgcagatctcctatatactattcaataacaaaggttaccttttgcttccgttggcgtctctatggagagtttctttctactattgttggcacttttcgattttctcttcctcgtttttttctcaactgcttcaccaatctgcagctcacttttctcctggacacgtacgaggtcaacggatagaaaaaagtcctcgttactgaggccttgaagagcttttttcaatatcatagaatcggacaagtgataatcattaccactcacgttaacctacaaaccaaaaacaagtactccttccttaagttgttgtcgttgttgattccaaaacaaaaacgtgttgttagagaaagtgttgttaccttcaaggcagaaacagtgatgttgccaacacttggaaaacacagttcgtgttctttgcagaatttgtctgtaaaataaacaaacaacaataaacatgagtttaagagtttagttactacaaaaagttaccaaactaaaaaaaaaaaaagggaagagattatgaagagtcacctttgaaagaagacacgctatcatgactgtcaaggagtagccccaaacgggtatcaatactagtcttcacaaagacacattgcgaaccggaatcagccatcagtaagattattgtaagagaaatgcaaaatagggttttgatgaagttgagaagaaaatgaaactccactctctctgtttgatatttataagcgagtttctttcgtagaggaatatgaaaagctttatgttttttttgggaaatcaaaaacgcttaattacttgggaaaacacaacgtgtaggtcgattctctcttttcatcgtcctttcgtcttctctcttttggtttatgactcattgaaagggtttgaccagatcataacttctttctctatgggccaaataagtgggcctcacgttatatgaagacagagattctctaaggaaaccaggaatactaggaattgttgaaaagcaaagctataaggcgaggaagttagctaagggcttttcacaggacaatgggttggagcagatggattttatcaagagagatgcaagtctatctcaagcaaagaaccataaattttcaaaagacaagtacctggtgtagaatcattgaagaaacagctccaagtaatgccggtgtagaatcattgatctaaagtgaagtgaagtttatggttttctcttcatgagctaaaatg

SEQ ID NO: 9531 - DNA, 3000 bp, Unknown
  misc_feature (1)..( 3000): cDNA_ID_2183380_gDNA_ID_1972143_Annot_ID_179284 3000 nt of promoter + ATG
cccactgtgttggcctgcctaagcaaagaatctgcaggaagactgtttaaactgtttctcgaatcttcactcagacaaaaacccttcttgggcttgggaagatcattgctttcgtccatatgcaagaggactgaagacggtggcatggcaaggacacgactcagtcttaccctacacgaaacccgactagagtagcataaatgagctaagccatgagatgggttgttgaaaatctgaagatacatcaccaagcttctggctgaaaatgttttctgatagttagtactttagtgacacctttgacaaaactagcaaaagcttccaacttgttccctcccccactaaacctgaatcttactacagattcaaattccaaatcttgacaccaaaattccaaaaccagctcagattcaaaaaaaggaaacaactttcaagttagagagtcgcaaggaccttttctggctttttggagtaagatcctacaatctctaacatcaactcacttttctgcagctccaggctgacacccactgcaagaaatttggatgcaattcccaaaccagccaagatataaatgaaagaaccagtacttctccttaataagacagaagtaaacgtctagctttctatagaagattctcttgaaaaccaaatctttgtatgttattgagaaggatgactgattgcctttatgttttctgattgccagaaacaaaaaggaaaacagtactaaaagaacaggtgggacaccaaaatgtaagaacaacggcctcaaatcaaccgatccaatgaaagttggaccagtagtagtcgcatcaagatgaagtaaggaatcttcgcctcagataaataatcatatatgcactggatttcaccatgaggcagtaaagaagatggaagataccacaatgtaaggcgttaaattcaagaagaggtgtctctgtctgcttctttttccgtttcttgtgatattattatatgtatttcctgcaacatgtgggttgtctctgttaggtggattcctttgtgttcttgtcatctactgaatcccacatggtccatcatccatctaatcccttaaatcaatggaatcctccagaaacaggtgttgatcttctgatggacagaaaatgcataaacggcttagggtagtagatagatacgaatggagtttctttcctcacttatacatttacgagaagcattccactaaagcaatagtcttaaggtctgagaagagctcctcccactaacacacaaacaagtacagattcaattagaacacacaccaaaatttgatatgtacgatgctatataatatacgtatctagcttctaattcccaaacaaacaaatgtcaagctcctgatatgacttcaacagagaaaccctgatttgaaaaaaaaaatccatagcagagcaaaaaaaaaccacacctttccacattcgctaaaatggcaaagagcccagacgatgtttttacctgaaatgtgggatctgggaagctaatcaacgaagagactctttatatatgtgttccaccaaatgtgggatctgggaagcccaaacttgtattttgtcccacatcggttacatacctcaaaatgttttactttatatatgaaattaaatcaatacttgtacgtcgagctcagtaacgtgggcttgtgacccgtgtggggacaataagttggtggaacactggctcggcccacgggtcggatctgttgtggcattgttccgggctgcccagtccaagctgagagtgatccgtgtgtgttaagcgaaggcttggctcaggcggttcttgcagtggagggcaatgcgtgaggctggtttcacagagcagcgatcacctcccgctctcagcagtggacggatcacagctcgacgccactcagattcaccatggcctgctggctcgttcccagctggaccaccaattttttattttctttttgacaattgtatttatggatgggcctgagagtaatgaatatagacttctattcggcgattgggcccaaattctttatctcaatcttcaacattggtgagttgtgccaactcagacggggttattaatttgtgttatgcacattactttaatccaaagaatacagttttgctaaacccaccacatgcgtatgttttagttagtggtgatcctgagaagaaacagacgatataagaaggtgaattattgaacaaaagttataccatattatagtacaatgatgttgactttgaatacaaattggtaaccgaattactttgactcactttcaccactttgtattgtttttcctttcaagtttttataaagagagatttggcattttaataacatcctcacctaatagatttggtttaccgaaatggggaagaaggaaatagtctatttggtttaccgaaatggggaagaaggaaatattaaattagtgtgtcctataagtcaattctcctgttcatttctaatctattatctaatccttgcaatttgctgataaaacaatagtaattacaaaaagtcttaccccttttgagtttaaagaaaccaaaagtttggaataaaataacaaatatggatataagaggacttatgtgcctatgtggtgttgagaatccgattaaagatgtgaaaacaaacaaaaaattaacatgtaattctctgccttaatcatcaataacagtaatggtttttacttttttttttttattacaattaatgtttgaataatccggttgaatgatatcgttaatccgcttacattaatttccgatgattgttgttacaaagaaataaatagaaactggaagcatcatcataaaaataaacaataaatagtggaccgaccccatgaaaaaataatgaggacagaaataaaaggaaaccaagtctgaaacacaatgattgattaatcacttataaggcctaaactcacttttcctagttttgcccttcttttagctcatcaacagagagagagatagatccatg

SEQ ID NO: 9532 - DNA, 3000 bp, Unknown; identical to SEQ ID NO: 7615
  misc_feature (1)..( 3000): cDNA_ID_1441174_gDNA_ID_1972143_Annot_ID_179292 3000 nt of promoter + ATG

SEQ ID NO: 9533 - DNA, 3000 bp, Unknown
  misc_feature (1)..( 3000): cDNA_ID_1376881_gDNA_ID_1972143_Annot_ID_179295 3000 nt of promoter + ATG
ctccgcttcaatcgggtcaaaccccaatcggacggctctaactcctcctcaccaattcaaattttacaatgtgtctacaaaaagggctctgagattaaccaaatcagatcctttctatgccggagttgaaacactagatagaagaaacagagacgtccaacaatccaacgaatccgggttattaattggaggtaaaagtaatggttttgccatctgccgacgacagatcggcggtgacaacgatgataaatactagtctctcttttttcacaaacgggaagaaaaaaagaaagaaggatcaaagctcacaagccaatgctacgattctgacaaagagattgaagaagagtgatattcagaatcgcaggaaagacgaaatagagaaaaacaaaatgaactttttggttttctctccagaaacaaaaacttccgttttcttctgttcttttttttgtttgtttgctttcttcaaccattcttttttaattacattaatattgcacgtcgtgttattttattttaactttatgttttaaaaaaacatataaggaagtaagtactactcctcagtgttttaagaattactatattagttgactaaatataatttactcaattaaacatgcatttaatttgttcagtctcgtaatagacagtgattagtgattactgtattttaatttctcttgtttacgaattcataaagaaaagaaattagtagtacacattacacaacaacaaaacgtaatatagaaaaacttgacaacttggtctgactctgagccgtctctgctcggtctgctgtcaaaatcttttctttggacaattctaccccttgttttaagtgtattaaacattatatattcgaggccgaaagagttttcgcactttattcaaattgactaattgagcatgaaatacagcattaagaaattagttatttgtaattaacgaaactttgacctcactttttattctccacattgtatgatagatagatccattcattgaccattgttcatcgtgatgccaaaaaaaaaaaaaaaaaaaacattcattgtccactttagttaagctggtaataaagcgagtatagaaaataataccgcaaatatccgaatatattacctaatttcctaatataagacatgtatatataagtcgacggaaaagacggtaataattaatatttccatttaggacctaatgccatctcattttcatttccaaccgtaaatatttttaatgtgaaaacggtaaattttggtgcaagataagtaactttactaatactgttgatttgtattttgtagttgtagttaacaaaggaaattcggggaataaagaaacatagtaagggcacaacaaaaattttatctattaataaccacatggtcccaaaaagccataataaagtcgtatgatgacatgtttacacgaccatcgttagaaaattaatacatattacggatatcaaaatcacacccaattttcaaatctctttatctaattatctaaactgttccgtttttagagggacccaacaacaagccaaagcaaaaactttctggtaattgaatgtatattgtatcatttcgccaacaatttgtttgaaaatggatgatttcgccaacatagtttttggaagaatctgaagttttggaaccctatttataaattatataagtccattaaataaaagtatgggccgcgaaggaaaacgttatgggcttcgtattgggtttataatagaaagcccaatatgttaaaatttatgaaggaggctgggcttcacgtgagttattactactagacctctgtattcttctgaatctgacatatcgctgattttaatgcgacgtggagctttataagacgcaattcatcaaaatgaatgagccccactattttgttgttgttttggagtttttctgattgagggaaaagatgaaggggatcttcacagtcccccaacaacactccattggagccatttcccaagttggtaacacgtttatcaaagccctccctcgttttcatcaacaacttatcgattcatttgctttgtagatctctctttgtttcctgagctgagtttacttaggactaatcttcttcttcttttttttaaaagaaataaatgcatggcaagattgaaaatcaaattaaaattcagtaatcactatgctaaactaataccccatcaatttataatagaaaatcaaattttgatacgttaccggtggattttagatatactcatactaattaattactaggatttcgaaaatgactagacatcttcttgccatatttgctaagtatgattgaaatcaaactgatttaaagttagtaatacatatatatgctcatgattttcttgttttttggggtcaacatacatttctgcaaatcaaatatgctggtttaagtctactaaacacaaaagttctcatatattaatatattttcttttgtctcaataattctagtaaataaagtagaggaagagaatgatgcacgccagtagagatttttattcatataaaatcgttgtctttagaggaataatacatgccttaattctcaacaaaaatacatttataatgaggaaagtttactcaagttgcataatatatcaaagtacccaatgcacgaattctaatctttttttaatactaatcattaagtccattttgacgaaatatgtgaacgtcattacaaaaatcttcagaatattcagaccaattcaattttattaattacaaggattatcagcttcgaacataattagacggtaagagccgccctgttagggttttttgtcctcaatgccaaaatcctcccattgcagatattatatcactcccactgtctaataaacaactctcttctcctctctacccagagcgagtcaccttatcgtctctctatctcctccttcctatatccccttgctctctgggtttttgctcagtgtgctacgtgagagatagagag

SEQ ID NO: 9534 - DNA, 3000 bp, Unknown
  misc_feature (1)..( 3000): cDNA_ID_2183399_gDNA_ID_1972143_Annot_ID_179300 3000 nt of promoter + ATG
tgacacacagtcacactcacacacactgacaacatgcacacacataattttttatcaccagagtgtgtgctacatgctatatgactcttctgattattcattgctaactaattagctaagattgtcgtgaaaaatagtgggtatattaatgcgtttataactttatagatatgttcttcctttttaaaacatacaatgcgttaatcttaaggactagtgttttgagataaaataaaggacccacgagatgttaattttttgtcgttttgtagatatttttttatttttggaatatagcatagtgagagccaagtcggatagaagaagacaaaaaaaaaaaagagtagaaaaataaattaaaagagtaggaaaaaaacaaaagaaaataagactgaaatgaccaaatttaaataaattaaaaagaaaatgaatggggtagtcttaccctttgttaagatgccagaggaaaaagagattcatccagtctctcaacactttttattggttcccaatattgattcaacgtttgatccgtttcaagtaatataattattacttttttcttctataaagtaacaaaaactgtaactatttcctttagaaaaattcgtacacataatcaactggtccgtcgaaactttttatgaatggggtccttgattcgtgacgtacgtgcaattttgtccaaaagaaaacaataaaattagattcgggagtgattatcatcacactattaaacattttgttatatatttgtttcgtgaatcttctttatatacataggattgaatgtcaaatttgtctttaatttgatcagggatagaaatgagtttgttgtaatttagttagaagccaaaaacagtagaggggcttaaataggtcgcgaaaaggcaagtcatgttgtggaaatttggtcattacacttgtaaattgtattactgttccggaaaaggacattattcaatgcaaaaagaaagacgataacgttttcttccactaaacaaaactggaatattttaacatatcacggtcattaccattttattcatctaaaaactaaaatcactttatatgtccatttgaacttatctgctaattttattgtctattttgcgtcttaataaatagttttcgattttataccaaacgatcaatcgtctactttgcagcatatatacattactactaacaaaaatcacaaaatattaatttgcaaataccttttttgttaatttgtaggtagtgtatacaaaacaaatgcacgtgtgttatatatacataaatgtttgaatgcttttttctcatagatttagaaataatccagatactgaaaatcttagggaacgttggtgtaatgttatttcaaagatactactaccattaattttcaataattttaggtaaattggtaaaaaaaacgaaaaatatatctaatggttaagttataaactagtataatgtatggatcttgaattaattaaatctttagtggacaaaattacattatgaatttggatcatgaagacgtattcatatagtttatctcattcgaattggattccaaacaccatattagattgtaggtaactaggtaagaatcttgcttgcatatcttaatgagacgtggccattctagatttggcaaatataggtttatcccacaaattttatagactagcgaccacattacttcccaagagtgtagttttaacgcattgctaatactttattctatacgcctcttgcgctagtatctatttgatacgctataacgttattgatatggtcgtacggtagataaaacttttaactccgtaatcgtctaaccaatacatcagacattcatcacactcaatgtcatcgatcgatcgtggtaaaaataactggtattcaaagataggtgtgtcttcttattgtctatcttcttatgttttaattatattttcttctgtcatcagcatagttgtttctagattcgttcccttccaaagtatttttgtatgttcaaataaatatttatttatttttatatattttttactccaaattattacttgcgaaaatcatttcatttttctttgtggaaaatctaaagaagataagctattttgttgtttgctgcagttagctatatattgtttgtacaagacaacattggccctttctatttttgttccttcttttgtcccaaacaaaaacactcctctttatgtctccccctttcacaattatgatttcaatcaatcaacactaatttgaccacagtcgctggaaatacaaaaaagtaatttgtggtggcgaaaaaatatatatctactgttgtgtatataactttcttaaaatttgatttgaagatattaagacttttaagacttcttttttagtatgacaataattgaagaaaaatgttggatatacttaattccaatgactgaggaaataaccaaatcaacataaacaaaacaaataattagactacaattttttttgtctctttctttcttttgaatacttattgtccctttatatacgcattaatcactttcttaaatttatagattatattgtaatggatagatacggtttaacttctacatatgaacacaatataccatattactacctcaacttcaatttgaattatacatagtttgacaacccatcatgtgtatgtatcttatcttgcataatcaaataagaaattatatttattttcttacaaaagaaggaaatggcgggacctctataattttctagaggtttggtttgttcgtattgtattaatccaataaacaagtagaataaccaataatattggaccaaaacaagtgctttaacatatgcttttgcctcctcttggtctctactccaccactataaataaaactctctaactcttccaatctcccatcaccaaacaccacacttctcataagaaaaaaaacacaaacatctatcaaatttacaaagttttaaaactaattaaaaaagagcaagatg

SEQ ID NO: 9535 - DNA, 3000 bp, Unknown
  misc_feature (1)..( 3000): cDNA_ID_3042280_gDNA_ID_1972143_Annot_ID_179311 3000 nt of promoter + ATG
gacagcatgtggcacgcccgacaattctttttaagagtgcacccataacatatatgttcttatgctatcaaacaacccacaaggaacctgaagatgataactacttgatagagatgatatgacttcaatcaatctcgatcgggttcggttaagggcactaatagataacctgctatatgggagtgtgaagaccattaattggtttttcacatatatatgactgaagaaatcagccgtaaccaaatattagtgtttttgcatcagttggggccttgggggtcaattatggagtggaataatacatgaaaacttgaatggtcgcatgcagagcagaggtagcctttaaattaaagcacacatcaaaatgtagtgcaatgttgcgaacttttattcaactaaacaatttaacactcgatctttgtgcgccaatacctctgcacaacaaacaatttaatctcatcaatatgatccgattttgaagaaccaccttcttcttcagtgacttctctggctaccttccattaactgtcgctgtcataacgacgtggaagttaacttaattgacttttaaaagattaatgatgctgtatattggtcttaaaatggcacaaaaggttccgtctaggctttgtgtttcactttaagtctataacttaaaaaaaaaaaactactaatttagcaccaaataatatcataaccattttattataaatgactataattaacgtagaattggaattggtcagttggtctcgagataataatttagctccaacgaatcggacatatctatgcttttatgtttttttttgggtataagaatttgttattaattcttataccaaaattatagatatgatattgttttattttaaaacaaaataaataatatatatatgaatggtttgatctgatattggttacggttaggatacaaattttaatcctgataccatagaggttttattagttcaattttctttccgtttgtttatgctcaacttcagattcgttgtcttgcaatattaagatatggttcaattattgagatatcatttcagttacgttcgcatccgatttgtttaaggtaattgtaatgttttaatgatcacttttatttgaattctgaaaattgaagttttaaagatattttttaaataatcgatttcaacaaaatagaaagaattgtaatacatattttttttatcataatatgaattttatatttaatagaaagtttcgattatgcatttaatttcatacaattgacttttcgactgttcattttttttaattttattttacaacgacttttagacacttcttagcacgaaagaactaaacgcaacatgtgctttgtaattaaacgtcgaatgaatatgaattatatttgacctaggattacgaatgatgtcgatctggagtaataatttagaaccgaacgacgacttcgaaatattacaattgacttatagaatagatctcgacgtagattggtcttaaaataataattaagcaccaaagaactggagatggctttatgtgctctgtgttttaaagcggattaataaggacttttaattcgattggggaaaatagaagaaagcagaagtgataaatggaggaccctttgttgactcagagtgagcacatcgtcgatgacgttacaatccatggcgattcttcttcaaatgaagagcacatcgtcgacgttacaaccaatggcaatccttcatcagctgatgagaaaagaccgcatgagggtgtccaatggagtgatatatttacatttaccactgtttgtattttggtcgagtttgttgtggctttagtccagattgttgccgccattgttgttctgactctggcaaaagatgaacaacctccacaaaaaatgtttcctacactgatcctcagttataccggttgctgtattgccacactccctattctaggtttgcgtttctggcattcttaccgaagtgttagcacagagacaaggtataaactataatttgtatgttaattatttgttttaaaggcattagaaaccgaaaccgatatagtggttttattgatttgcagaatctacgaggtggtggacattttgaaaaagatgcttgaatatttcttcgtgggttgggttgtggtgcttttatggcatcttatcaacaactcatcatctatagataatactacgcaacagttctggtgcgcatcagaagaaaattataactatatattcgtgtcccgaaaacagactaaattaacgaagtctctctaataataccaccctgcattttccttttgcaggttatgtatgactttccttgctatcagctgcattctacatgttcttcgtaatctcccctgtgcgggagtttgttttctgtatcctatgatactatatctttcccaatcgatagacttcgttggtgacattactgatgagataaatttgactacgtctataatcctattatgctttggaatctttgcctgcattatctgtggttgttgttccagatgcttatgcagataaaaagaagaatgatcatgtcgctttcttctttcttttgtttaaaatgttgtaatactctatttatttatcaaataaagccaagtgtcacgattgaatcctatatatcttcctgaaattgttggtataaaagaacaatttagcgccagcgaattggaaaggtctatgttttgtgtttcaaattcaataaacaaaagcgactttatataattggttttggtgtagttggtcttaaaataataatttcaccaaataatttgaaacagtcaatgctttgtgtttcattgtagaatatactataatttagcaccaagtagttcaatagttatttcattgtaggaataccataattgacttaggaatggtcttggcgtctaatttgaaaggtctatatatgctttgtgttgcaacgcagattttgattgaatccaagagaagtagaagaaaatcataagtgatta

SEQ ID NO: 9536 - DNA, 3000 bp, Unknown
  misc_feature (1)..( 3000): cDNA_ID_2183434_gDNA_ID_1972143_Annot_ID_179314 3000 nt of promoter + ATG
ttggacataaaacctgaaatccaaaatccgatctgacatcgatccaaaaaatagttataaaattccaacgaaaaaataaattattctatctaaattatctgatctgaatccgatacgaaccgaaaaccgaaaagatatataaaacctcaaaataaaattatatatcaaaaattattagttatatttagttagagttttatattcaagattactaaataacaaaattatccaaaataacctagatatcctaaatttttttagttttatttattaaaattatacatttttttgtaaagagtaaccaaatttttcgtaaaactaaaacaaattttttacaaaattgaactgccggattatttttttttgcaaatgttctcatttgaaggaagaatttgagagaaaaataaaacactagttaacaattgaaacttaagaccggtcttaaaataataattaaagggaaacactagtttaatattgaaactttaggccggtctcaaaataataatttagcacgaaataattaaggcaacatgtgctttgcacttcaacgcggaatcatatgaattatacattgacttaggattattattgacgtcgattcggcctttaaattataatttagaaccaaccataattataatatcactacaattggttagtatcaaacaatttaacaactgttaaatatcactgcaattgacttttagaatagatcatgataaagatcggtctttaaataataatttagcaccaaataattagagaggctatgatttgtattttaaatcggttatttatggactttaatttcgagtgggaaaatagaagaaagcaaaagtgatcaatggaggggcctttgttgactaagaatgagcacatcctcgacgacgttacaataatccatggcgattcttcctcaaacgaagagcacatcgtcaacattacaaccaatgtcgattcttcatcagatgatgagcaaacacaggatgattgtggtgatcatttgagacgtataatagctctttttgtggatgaagggtgtgatggatttacatctagtcatgtttgggttatggtcgagtttgttttgactttgctccaggttgttgcagccattgctgtcctgactctgacaaaagatgaaacagatccacagaaagtgtttcgtacactgatcatctgttataccggtggctgtattgtcgtgctccttattctaggtttggatttctgggattattgcggaaggtataaactataatttgtttattctttgtttttaaggcattagaaaccgaaatcgatagataacagtttcttattgatttgcagattctacgaggtgatggagaatttgaaaaagatgcttgactatttcttcgtgggttgggttgtggtgttttcatggcatcttataaacaactcatcatctccagataatgctacacaacagtactggtgcgcaacaatactaaattttctaactatttagtatgtctcgaaaacagagtaaatctctctaatgatgataatccaccatgcattttcctgttgcaggttatgtatggctttccttgttgtcagttgcattctacatgtgcttcctaatctcccctgcgcggcggcttgttttctatatcctatgatacttcgtcttacccagtctatagacttctttgatgacattactgaaaagatagaggacattaactggttaatctttgtatacttttttggaatcttctcctgcattatctgttgcatttttacttgttgcagcagattatgtagataaaatgaagaatggatcatgtcgtttctcctttcttttgtttaacaatgttgtaatactcttatctatgtatcaaatataaagtcatgactcatgactgaatcctctcttcctgaaatcgttggcctgaaagacacgatgcttacgtcccaattacctctgcatggacgagcttgtgaaccgcatgtacaagtatccattcctttgttggtcctagagctgatccattcctgcatacgaattaataatccaattcaaagagagagtagtagaccgtgagttcaagtcttctgaagcagcatcacgtttgaaccacgttatcgatcggttcagtcttcaactaaagtgaagtcttaggtgtatgaaatgtaactaattagtcttccaacaacacttaaaactcataagagcaaaacttcttttaggaataagtaaaacagagcagaagaagcagtcaagttaatcgggattaccaagaaccaatggtcaacctccaaattcttcaaatttcctggaaaaacacataagggggaaagcaaaacaccaaatataaacacattcctcgagcgcttaactacgtaacaacaatattatcaatattgcatgattacaactctaaatctctatatattttgatgatctataattttttgctttgataaaataaagttatgatctttgatttaaaagtataaaaagatttggaataggagaaaaaaaaaaagcaaaatatagatataactgaaattcatagttgcaaaaggggaagtggagaactggagttcgtgggtgaacggttaagaaaggttggctggtttgacattattggtccatcatgcaacaataatatattaagagtttagaggataagaatttcaacaagtggacgtgccggagtggttatcgggcatgactagaaatcatgtgggctttgcccgcgcaggttcgaatcctgccgttcacgttttttgtttttattttaccttatcccagttttgtcctttttagtttcctcaatgttttcaatcccgcctatattttaccctagatttttaattaattgataccgaatcccgctttctgaaatcattttcaattttcaaaactcatctcctctctctctttcactctatctccttcgatctctctcggtgtcagtgaatttaactgaaatcccatcgccggggaattttccggtgatttag

SEQ ID NO: 9537 - DNA, 3000 bp, Unknown
  misc_feature (1)..( 3000): cDNA_ID_2183411_gDNA_ID_1972143_Annot_ID_179305 3000 nt of promoter + ATG
cgtcttctcaataacttctgatgtttataatggtcgcattttagttatatataacaattgaaccactgatcatctaacctcaagtgttcttaatttaatatcgataggtgccttatgactttcgatggtgggaagatcaaagatgtgtatatgtgtttcgccagcctcctcctggaacctatgacattcgaacagtctgagtaagatgaaatatcaaaaaaaaagagggaccctgagagctccatctaggtcccatgggtatgcaaatatttaaggctaggaaattaccgtaagagagttgcaaagaaaatcaatctcatcaatgaaattattggtcacggcccgttttttattgggccattactgggcctgttttataagagaatccagcaaagtcagcggtaaaggagttcttttttaataaaattaaaattttcttataaaaaagtgattaaaataacgtcacaccactatataacgcgacgggaccatcggtttcaaaaacataacataaaacaaataacatatttcttttaaaaattctttgtttttctttaaaatttttttaaagccatggttactattatactcacgtgattgtactgtagaatttaaataagtatgaagaaatggaccaccaccaaacatatccattatgtaaaatccaattgtatcctatcaattcatgttctaacaaatgtacatcttatatagttaatgcgataaggaggaatggagggaaaatctgagttcaaaacttgaacttggaccaaccaaacagtaaattttgcatgagtataaataattcttagatctctcttttaacttttttttttttgggtgactttgtttgtgttttgaatattagatctacctttttggtttgttgataaacattattaggtccatgacttcttgttgttatacgtccatctctcgttagtattttagagtcattattaaactttaagactttagagtaagtaagtcaaataaaataataagactttagatatacacaaccaagtttttagtttgaattcaaaactcgaacgaagtctgattatataatcacgtgttgtaactaatttcaaagaaactatgattgactcatcatactatgaaaatatcgttgacttattacagttttttcatcaacaaaatatatatacatctcatatggttgaagtataactactatcatatcatcattcatcaatcacttttgttgttactgttttcagagagattactacatagtagtacataacaagagaaaacaaagccatgacaagaaacatcaacaaaattctaaaaagcaagaagacgaagctggacaagatctctgcagcatttaacatacaccactccactcgcaatgaagttttatcgtgttgggacctccgattttggactttttttaattttacttactttggtaattaagtgatttttttttgctactacatgtgaaccaaaaagaaaatgaaaacagaaagttgtattaatggctagggattttaacttgtagctcggttgcttctcattaattagtaaacggtgtgaattaatggcatatataccattgtacgtaacaaggatcataaatgtggcaaaaattaaatcacagttgtagacaaataataaccccagatctcacgggttgatctcccaaatctatgtttaagcacgctactaaattcaaaaaattaagcactaatttaattaactcaagtctcccccaataaaaacacttcctttttgtctatctcccatatatgtaatggtcaacaagtcaaatttttaaaattcattatattctctgtacatgaaaacatttagtaatgtttctttttaaaaaacactgttttgatttaatgtcgttagtaaagtttattattttgatttctttttaactttccttaattatttctaaatgtgtcttctttatcgtttaaaccacactagtgtgtgcgtgtctccttcactttcaaagacagtctctttccccaaagagcggattcaggattcaccatctcgatctgtgtccaaagctcctatctttcttctttcttccctgaagaattttctggagcttctcaggtcaaatctcaaatctttttttaacttaattttgttatttctatcagaaagtttcgatttttatgctcatgcttgtgcatccgcgtacctgcatttcgttttgtgtttgagccgccaaagttttcaacttttttttttgggatttattgcaaatttgtcgatgttgaaaggttttctcaaggagaatgtgaagaaaaaggaagagaatgtgagttgattttaggcatagggttttgtgggttctttcagatttatgtagaatggtgcagctctgattcatgggtttgcaaatggtttctcacgatctgttcgttttcccaaggaaatgtagctgcttttttttttttttttgtcatcagattgaaatgtagctgcttttgaagagaaaagtctgatgcttctcttccgattttttatggatggtatttataaaagaaagaaatagtagttagattgtcgaatattggttttcctaatcttttttcttctctagattttataaaattggagtctttttctgcattactgtttgcattgttcaataaggaaatcaaataacttttgattctaccattgaatcttacggagttttgaaaaaaagtttgaagctttgaactttaatgtatcttctattgatacttttgttgatcagtggaaaattttcaaggaaaatcctctgtaagactcaattggttcgattattaagtcaaattggccatctttttttcagaacatttttatatgcatggttgcagattgctatctgctctgaatgttgatctctctattgccttaactaatgatctttgcgttcttttgacagatcagaggaagatgatgcaatcctaagactctaagacttcttcaaggctgtgttttatcgtgggatttttaaac

SEQ ID NO: 9538 - DNA, 3000 bp, Unknown
  misc_feature (1)..( 3000): cDNA_ID_2183387_gDNA_ID_1972143_Annot_ID_179297 3000 nt of promoter + ATG
ttctctgcttccaaaaccaattggaatgaagctcgaaggattctagcttggagcttgagtgatacaggagctcttcgagagatcaacactacgaatttacctgttttcttcctggaaaactcttcttcttctctttccactggagcaatcgctgggatcgttatcggttgtgttgtcttcgtagctctaatcggatttgggggttatttgatttggaagaaactaatgagagaggaagaagaagaagagatcgaggagtgggagttagagttttggcctcaccgtttcagctacgaagaactcgctgcagctacggaggttttctctaacgatcgtctgcttggatctggaggatttggtaaagtttacagaggaattttgtcaaacaacagtgagattgctgttaaatgcgtgaatcacgattcgaagcaaggtttgagagaatttatggcggagatctcgagtatgggtaggttacagcataagaatctagttcaaatgagaggatggtgtcgccggaaaaacgagctgatgcttgtctacgattacatgccaaacggaagtcttaatcagtggatctttgataatcctaaagagccaatgccgtggaggagaaggcgtcaggtgattaacgatgttgcggaagggcttaattatctccaccatggatgggatcaagtggtgattcatagagatatcaaatcaagtaacattcttttggattctgagatgcgtgggaggcttggggacttcggtttagctaagttatatgagcacggtggggctccaaacacgactcgcgtggtgggcacgttagggtatttggctccggagcttgcgtctgcttcggcgcctacggaggcgagtgatgtgtatagttttggtgtggtggtgttggaggttgttagtgggaggagaccgatagagtacgcggaggaggaagatatggtgcttgtggattgggttagggatttgtacggtggaggaagagtggttgatgcagcggacgagagagtaaggagcgagtgtgagacgatggaggaagttgaattgttactcaagttaggtctggcttgttgtcaccctgatccagctaagcggccgaatatgagagagatcgtttcactactgcttggctcaccacaagaggatttgttgactgggctcacgccggccgccgccgcggcagactccacggctgctcacgcatgagttgtttttgctttttttttttttttttttttttttttgtcttgtgaggaatagtaaagttgaaatttgatttacatgttggtctatgggcccataggcctgttaatattattcgaaagcctattcagatgtacataacgtaggagacatttttgtactacattgtttttcagtttcatttactctttttcagaaggtagactcacagtggatgctttaactatggaccatgataatattaacaaggcccattaatgagtcaaataagaataaaatagtagtattttcactattgaatcaaaccggaagagaaacggtagccatttgacacacctacctataaattagattggaacagaacgttggacgaccaataaatatgattcgcaacaagtaccaaatcacctgttttatttaatgaattggcctaccaataactggtttcatcatcctaagctacattccggtttgggacgttctcgatagaattggaatatttaaaaatggcaacttccaagaaagtggttgtttcgttagttttttttggaggaagttaacgaagaccaactttcaattcatggtccaattagaatcttcgactcagactaataaaagaaataaccataaaagaatatataaatcggtcaactgtactgtatatgttttttttacacacgtttaccatttaaattttttaatctctctttattcatgacctagtatacttaatttatacattgagaagtcaatttataaattcagtgtaaatttctctagacgttaatttacacataaccaattcaaaccacacacatatattctctcttaaaatgcaggtttagttttaagaaatcagaagaatatgaatattattttgaagataaaaagtccaaggctgatacaattcaattaaataatggcggactacgaacaagaaggggctgctgagaccacgtaacgagagtcgtcaacgtctagaagtaatacttacattcgtttgttttcttctcctcacgttactatttgtacattccaacttttgttttggttgaacacttgattttacaataagttaatcagtttctcactattttgatcattggaacatatatataattaatccggaaacgtaaaatggtggttggacccagtgtttttgttttgtaaagatctttttgtggccaaattaaagttttgtggttgcatttaaaatggcaaagacaacaacgaaaaactgtccaatatgattgttgcatgaaaaaacatgattactgtatattcaaaacctttaatcatgaatgagttcacactgtctagagaaatagtttagactttagtgtgggatcaattaattacttttaattaacgtctgatgcagtaggactccttctagatttcccagacagaggagtcacagctgacgtaatagttcttttttgttagctgatgtaatagtttctctttttttcctttattcgtaaattcaaaagcacataacgtttatttcttggtcacgttccgtctctgatttttccactttggtgaagaagaaacatacatgcatgtgcctaattattatgaatagtgaaatctcctcaatgcatatatatacggagcacacaaacccaacattcatatcatctttcatctacaatttctctcttgagtttcttttcatgtgttaaagtcttattgtcttgctaaattctttaaatctttcatctgacacaaacaaaaaaagagagaagaaaaaaaagaagaagactttgatttcttggatacaaaatg

SEQ ID NO: 9539 - DNA, 3000 bp, Unknown
  misc_feature (1)..( 3000): cDNA_ID_1818288_gDNA_ID_1972143_Annot_ID_179294 3000 nt of promoter + ATG
atctctcacgtagcacactgagcaaaaacccagagagcaaggggatataggaaggaggagatagagagacgataaggtgactcgctctgggtagagaggagaagagagttgtttattagacagtgggagtgatataatatctgcaatgggaggattttggcattgaggacaaaaaaccctaacagggcggctcttaccgtctaattatgttcgaagctgataatccttgtaattaataaaattgaattggtctgaatattctgaagatttttgtaatgacgttcacatatttcgtcaaaatggacttaatgattagtattaaaaaaagattagaattcgtgcattgggtactttgatatattatgcaacttgagtaaactttcctcattataaatgtatttttgttgagaattaaggcatgtattattcctctaaagacaacgattttatatgaataaaaatctctactggcgtgcatcattctcttcctctactttatttactagaattattgagacaaaagaaaatatattaatatatgagaacttttgtgtttagtagacttaaaccagcatatttgatttgcagaaatgtatgttgaccccaaaaaacaagaaaatcatgagcatatatatgtattactaactttaaatcagtttgatttcaatcatacttagcaaatatggcaagaagatgtctagtcattttcgaaatcctagtaattaattagtatgagtatatctaaaatccaccggtaacgtatcaaaatttgattttctattataaattgatggggtattagtttagcatagtgattactgaattttaatttgattttcaatcttgccatgcatttatttcttttaaaaaaaagaagaagaagattagtcctaagtaaactcagctcaggaaacaaagagagatctacaaagcaaatgaatcgataagttgttgatgaaaacgagggagggctttgataaacgtgttaccaacttgggaaatggctccaatggagtgttgttgggggactgtgaagatccccttcatcttttccctcaatcagaaaaactccaaaacaacaacaaaatagtggggctcattcattttgatgaattgcgtcttataaagctccacgtcgcattaaaatcagcgatatgtcagattcagaagaatacagaggtctagtagtaataactcacgtgaagcccagcctccttcataaattttaacatattgggctttctattataaacccaatacgaagcccataacgttttccttcgcggcccatacttttatttaatggacttatataatttataaatagggttccaaaacttcagattcttccaaaaactatgttggcgaaatcatccattttcaaacaaattgttggcgaaatgatacaatatacattcaattaccagaaagtttttgctttggcttgttgttgggtccctctaaaaacggaacagtttagataattagataaagagatttgaaaattgggtgtgattttgatatccgtaatatgtattaattttctaacgatggtcgtgtaaacatgtcatcatacgactttattatggctttttgggaccatgtggttattaatagataaaatttttgttgtgcccttactatgtttctttattccccgaatttcctttgttaactacaactacaaaatacaaatcaacagtattagtaaagttacttatcttgcaccaaaatttaccgttttcacattaaaaatatttacggttggaaatgaaaatgagatggcattaggtcctaaatggaaatattaattattaccgtcttttccgtcgacttatatatacatgtcttatattaggaaattaggtaatatattcggatatttgcggtattattttctatactcgctttattaccagcttaactaaagtggacaatgaatgttttttttttttttttttttggcatcacgatgaacaatggtcaatgaatggatctatctatcatacaatgtggagaataaaaagtgaggtcaaagtttcgttaattacaaataactaatttcttaatgctgtatttcatgctcaattagtcaatttgaataaagtgcgaaaactctttcggcctcgaatatataatgtttaatacacttaaaacaaggggtagaattgtccaaagaaaagattttgacagcagaccgagcagagacggctcagagtcagaccaagttgtcaagtttttctatattacgttttgttgttgtgtaatgtgtactactaatttcttttctttatgaattcgtaaacaagagaaattaaaatacagtaatcactaatcactgtctattacgagactgaacaaattaaatgcatgtttaattgagtaaattatatttagtcaactaatatagtaattcttaaaacactgaggagtagtacttacttccttatatgtttttttaaaacataaagttaaaataaaataacacgacgtgcaatattaatgtaattaaaaaagaatggttgaagaaagcaaacaaacaaaaaaaagaacagaagaaaacggaagtttttgtttctggagagaaaaccaaaaagttcattttgtttttctctatttcgtctttcctgcgattctgaatatcactcttcttcaatctctttgtcagaatcgtagcattggcttgtgagctttgatccttctttctttttttcttcccgtttgtgaaaaaagagagactagtatttatcatcgttgtcaccgccgatctgtcgtcggcagatggcaaaaccattacttttacctccaattaataacccggattcgttggattgttggacgtctctgtttcttctatctagtgtttcaactccggcatagaaaggatctgatttggttaatctcagagccctttttgtagacacattgtaaaatttgaattggtgaggaggagttagagccgtccgattggggtttgacccgattgaagcggagaggatg

SEQ ID NO: 9540 - DNA, 2159 bp, Unknown
  misc_feature (1)..( 2159): cDNA_ID_3050909_gDNA_ID_1972143_Annot_ID_179285 3000 nt of promoter + ATG
aagcttgtctttctcatcgattggtttgacctgttcagagctttccgacataggcttaggttgttcgtcgcgttgactttcgtctttctgctcgttgtttcccgatttgttgagttcggcgatgagacgatcgtcaaacactataccggaagatccctgacggcggaaagagattgttgatctttgaagaccctccatggatctatctctctctctgttgatgagctaaaagaagggcaaaactaggaaaagtgagtttaggccttataagtgattaatcaatcattgtgtttcagacttggtttccttttatttctgtcctcattattttttcatggggtcggtccactatttattgtttatttttatgatgatgcttccagtttctatttatttctttgtaacaacaatcatcggaaattaatgtaagcggattaacgatatcattcaaccggattattcaaacattaattgtaataaaaaaaaaaaagtaaaaaccattactgttattgatgattaaggcagagaattacatgttaattttttgtttgttttcacatctttaatcggattctcaacaccacataggcacataagtcctcttatatccatatttgttattttattccaaacttttggtttctttaaactcaaaaggggtaagactttttgtaattactattgttttatcagcaaattgcaaggattagataatagattagaaatgaacaggagaattgacttataggacacactaatttaatatttccttcttccccatttcggtaaaccaaatagactatttccttcttccccatttcggtaaaccaaatctattaggtgaggatgttattaaaatgccaaatctctctttataaaaacttgaaaggaaaaacaatacaaagtggtgaaagtgagtcaaagtaattcggttaccaatttgtattcaaagtcaacatcattgtactataatatggtataacttttgttcaataattcaccttcttatatcgtctgtttcttctcaggatcaccactaactaaaacatacgcatgtggtgggtttagcaaaactgtattctttggattaaagtaatgtgcataacacaaattaataaccccgtctgagttggcacaactcaccaatgttgaagattgagataaagaatttgggcccaatcgccgaatagaagtctatattcattactctcaggcccatccataaatacaattgtcaaaaagaaaataaaaaattggtggtccagctgggaacgagccagcaggccatggtgaatctgagtggcgtcgagctgtgatccgtccactgctgagagcgggaggtgatcgctgctctgtgaaaccagcctcacgcattgccctccactgcaagaaccgcctgagccaagccttcgcttaacacacacggatcactctcagcttggactgggcagcccggaacaatgccacaacagatccgacccgtgggccgagccagtgttccaccaacttattgtccccacacgggtcacaagcccacgttactgagctcgacgtacaagtattgatttaatttcatatataaagtaaaacattttgaggtatgtaaccgatgtgggacaaaatacaagtttgggcttcccagatcccacatttggtggaacacatatataaagagtctcttcgttgattagcttcccagatcccacatttcaggtaaaaacatcgtctgggctctttgccattttagcgaatgtggaaaggtgtggtttttttttgctctgctatggattttttttttcaaatcagggtttctctgttgaagtcatatcaggagcttgacatttgtttgtttgggaattagaagctagatacgtatattatatagcatcgtacatatcaaattttggtgtgtgttctaattgaatctgtacttgtttgtgtgttagtgggaggagctcttctcagaccttaagactattgctttagtggaatgcttctcgtaaatgtataagtgaggaaagaaactccattcgtatctatctactaccctaagccgtttatgcattttctgtccatcagaagatcaacacctgtttctggaggattccattgatttaagggattagatggatgatggaccatgtgggattcagtagatg

SEQ ID NO: 9541 - DNA, 3000 bp, Unknown; identical to SEQ ID NO: 7616
  misc_feature (1)..( 3000): cDNA_ID_1393632_gDNA_ID_1972143_Annot_ID_179287 3000 nt of promoter + ATG

SEQ ID NO: 9542 - DNA, 3000 bp, Unknown
  misc_feature (1)..( 3000): cDNA_ID_3630424_gDNA_ID_1972144_Annot_ID_179321 3000 nt of promoter + ATG
aattttgctttggtcataaaagttggggaaacgtttttgtgcaggcatgtcctcaaactctacttatttggtcactgtcgccgacattatgcactgcgacctgctcatggtattagaagtgatggttcggtacatggttcaccaagggactcgttcacacgcccctattcgctgcaatgttagctgagtgcattgtcgtgcaatgcataccggtcttgttttcacccaaaaccatggtacatttggtatcttcggaagtaattacttggtgttcacagagtttttcggagctcctgctatgcaacttttcatatgtacggtttcctctgtctgtgctttagaccgggcctgtccattgacaaaataacactcaaatagaacacaagatttcaaggatctgtcagagcaatatggttcaaatgagatcagtcatcaatttgattctgagcctgacttatgtgcacccaaacaatactaactacacttcgaaagatgcggctgatgtagcactagaagcactagctaagcaaacaacggctaaggttgtgtattcattgtaagccacatatctattttttcttcttatccggatgtttaatcacagagactcgacagtattcagaagacaataataagtataggtttgtggagagatgatctcactttacttgggatcaacgcgggcatcgagccaagcaacgatgtcattgattacagtgaaaatattttcgtctgtatcaccttctagaatgcaatggtagccacctggatagagttttagagtcttgtcttggctgactgcatgtttgtgaaggaatttactcacagtgggatctgtgactttatcagtgtctccatgaagtatcaacagtggcaacgagacctgcaacatagaaaagaaagatctcgttttttgcccctgtctatgatgagaagagctttcctttatttctttggttctacaactaaccttgtcaacttgcatctcaatgtctcttgttgcatttagaagttcaacagcagttttgagacgtgtttgatcatcgtagcatatcacatcgtactcacactttatccacagagaacaaaaacatcaaagacaaagttagcaaaaatgcttcagaaaatgtaccattgaaaaactaagagaaagtaccaattttcttttactcaggtccctgaagaagaagtcgctcaagtctctctttggaaagagctttgctttgggaaatagtgtcgacatcaagattaacgtcttcaagactagtggaggaggttttacatcttctgaaatcttgagacaacccaaggtcaggtatttcaaacatgaactaactagatgtaaaatgtgaatacagatacttccaagcactgaaaatcttatttgcagatttgagaaacaaatctccagacctcaattacatgcatagaaaatgatatagttagagacttaccttacacattggagcgacaaggataagaccatcccaagcttgaggttctttaagatgaatttttaaggcaactgctcctcccattgactgtcccagcaaaaaccggggcaaatttctcaattccgatctccctaggaatcaaaccacttaaataaaacccaaaagcaagattcaacaccaaaaagcaataacaggtacaatttagatatacctttcattttggtgaactgttcaatagcattgtctgctaagtcatcaaaacttggaatgtgaccatgtaaaccatctgataaaccaaaaccaggatggtctatagcataaaccccataaccaaaacctgctatttgctttgctatacctgtaaaacaacccaatttttttcccacatatattaaaagaagagcctttcaactaaatgatgcaagtagagataaatctaacgaaccatcgaagaagaaagtgcaagtgcttccatagccatgacagaaacatacagcagctttgatttcgtcgccggatttcggcaaccaactcttgcagaaaatatcttcccctttcgaatttctctcataccactatcattattcagagaagaagattcaacgactttgtatctccttcgaagagaccaaataaacaaaatcactgcttacctcctctgttctgatcccactcggagctttctgtcaccagatacaaatgattagaacggagattatgttaattattttgctataaaggtatgagtcaatgcaaccttgaacaagcagtgatccagctgaagctgcaagtcaacaaaagcggaacgggctagtcttcgtgcgggagcttgatctaagttctgtgaagcaatcagattcagctcgtcgctcactccatcgatcggagatcgtttcgcgcaaacaatcgccggcgcgaatcgtcgagtgatggccagagagctcccatatcggtatcggaaaggggagagagtagctggagtatcaaaacgcggagttaaagcacgatccatggattctggagattcaatcccagattggggaagaagacgaaaagagtaagattttgtgcgggaaatttctcacgtgcaacacgtgctacgacgacgacgacgacgacgacaaagttttcaactaccagaatgatgatcgacgtcaaccgttcgattgtgacccgaaaccagtcaaacccatttataaccggctaaaaccggatttggattttgagagatttccattatccaccattgtttgactccagattattgatgggcctcactattattgggcttttacttttttttgacgctattgggcttttactttataattgcaatttccattgaatcatatataaaccggatttaagaaaaaataaagaagaaatttatgattgggtcgcataaattcgagacgatggtgagatacactgcacagttagttgtgcatagtcccaaactataaaaactctctagaatcttcaaacgtcagtgtttacataagaaatgacgacttttcagtactcgctagtttttctcgttctcatg

SEQ ID NO: 9543 - DNA, 3000 bp, Unknown
  misc_feature (1)..( 3000): cDNA_ID_3042343_gDNA_ID_1972144_Annot_ID_179329 3000 nt of promoter + ATG
aaccttagagaaactgtatgcgtgggaaaagaaactgtacaaggaagtcaaggtattaatatttttaatatttgatgcagctttgtgtttctgaatcactaatgggaatctatatcacatatagattcttgcgtgatgttaaattgtgatttgcgtgtgatggcaggacgaagaaaagcttcgtgctatctatgaagagaagtgcaggagactaaaaaaaatggatagtcatggagcagaatctatcaagatcgatgctactcgggcagccattaggaagcttctgaccaaaatcgatgtttgtataagatcagttgattcgatttccagcagaatccataaacttagagatgaagagttgcagccacagttgatacagttaattcacgggtaaatcatctctctatattttgacatctttttacagattaagctgaaaaaactgatattttgtgttttgaaggttgataagaatgtggaggtcaatgctgaggtgccaccagaaacagtttcaggcgatcagggagagcaaggttcgatctctaaaggcgaacacaaccttacaaaatgactctggctctacagcaattcttgatcttgagatagagcttagagaatggtgcatcagcttcaacaactgggtcaacacccagaaatcatacgtccagttcctaagcggatggctcacgaaatgccttcactatgaacccgaggcaaccgatgacggaatcgctcctttctctcctagccagatcggtgcaccgcccatctttatcatttgcaaagattggcaagaagcaatgtgtagaatatctggagagaatgtgaccaatgcaatgcaaggttttgcttcaagcctacacgagctatgggagaagcaagaagaagagcaaagggtaaaagcgcaatctgagcagcgagatgcagagtcagagagaagtgtggtttcgaaaggtcggtcagagagcgggatatcagctttggatgatttgaaagtggatttagattcaatgaggaagaggctagtcgaggagagaggtaagggtaaagaaaccattaagcttgtgaacaacgcgtcttcgagcagcttaaaagctggtttagttcccattttcggggcactgagaaaattcacatcagaagttgtgaaagctcatgaaattgttaggcttcaacatcctcagacctcttcttgagtagagagtgtggacttaccacatttttgcaccgttttgaagttttgttacttgcaaattagacataggtctatatagaaggaaattgttgtatagatgagttcatattcaattattggttggttagtttcccttgtaaaccgtttttaaatggtgaagaagaagatatctagtttgccttgtaagccgttacttgctgaattaaaaagaatgtaatatgactgttcctggttgagattaaaaggaaaataggataaagctatgtggaatagattagagagtatggttaggcatgatctatgtctataagactataatagagtatctataatggctagaacttaaactaagaacgattatgatgaattgtcaactattggatcagttttggaagaagaaaagaaaaattacatatacagtaaaacctttataaattaataatgtttggactgcaaaattttattaatttatagaggtattaatttatcgataaattaataaatattaatttatagagagattttcttaatttagtaactttttaaaaaactttatgagattttttcattatagaaaatatatttctagaaccagttacaagtataacataataataatgactagaaaacaataccaaaaattttgatacactaaaatatgaaaactatagtcaaacaaagaacaaatatgaatttaagcaaaaaattattataaatatattttacagaatttttttacatataatatatatatatatttgatatatttatacaattattaatttataatataaatgggaccatatatttacatagaattttcaaaaaaattattatcttattaatttatcgatttgtgtaactttttacactggtcccaacttgggaccggaagaatttattaatttacagaggttattaatttatagagtattaatttatgaggttctactgtaaactactgtgacatttttcataacttaacttggaaaaaaatatgaaatttagatatgaaaaatcacaaattcacaacaaggtaaatagtttcaaactatgcacaatgttgcaggcgatagtttcaaactcttgacaagttgacatgcataaactacaaaactatcaaagatttctcatgttttggattcgtatttagtagttttatgcattttgttcattatcacacaacttaataaatcatcagtgtaggtacaattacaaagacaatagtctagaacttaaaaatcatttttacaagtgcagaaatgggctatgttgccatatggcttcacaatgtcaaaacgggagagatactatggttaggcatgatctatggtttagggttatcaatactggctaattatgtatcaaagtcaaaccaccatggctttcatttttttttggtcagttattttttttaaaatgcacattacattattatgttgactcagcaggatataataatgagaaaatctaatgctatttaaaatagagaaaaattaagaaataactttctcctaattgtgattttcttttcaatggttgattatggaagtaaatattgaaatatcaataaccgctgtgggtcaaagagtcaatgacaattattacttgcccaaaagttaatgaaaaaccaatgacgaggtttatccaatgaaaactctccacgtgtatgtatgaccagtaatcatccagcgatttcgtaatttccagtgtaagaaatgcgctcataaatatcatcttctctattgagaagaagaagaagaattcacaagaagaatattcacagagaagagagagcgataata

SEQ ID NO: 9544 - DNA, 3000 bp, Unknown
  misc_feature (1)..( 3000): cDNA_ID_2183484_gDNA_ID_1972144_Annot_ID_179331 3000 nt of promoter + ATG
aattccaaatccttatttgtggaattcgataacagaatatgaataagaaagacatatgatttcacatagaagaaagcctgacgcaaacgctaaattctcgaactgcgaaagagatcgctctttaccaccagagcattgtgttaacatcaacaagtccatgcccaacacggtgttacacgaaaagtcattaggctttggttccattggtgtaatcatctctacaatgatcactttacctttttccggtagacttttccaacaatttttcagaatctttatacaatcctcgtctccccaatcatgtagtatccactgtcaataacttaaccatattatatttcgaaaataatgagactcaattataatttatcgattcataaacatataaacttactttcataaagatggcatctccttttggaacttcaataaacatgtctccggagacatgcttgactcctatcattagtattagtcaaaccatacaaaagatttaggaggtacattagttagtaatactagcacagcaaatatactaagtatagttttgtacctggataaaaaggagcttgggttaaaacttgagctaagtcgaaattaacacctttgatatgaggatacttggaagtgatgagacctaatatggtgccgatacctcctcctacatccaccaaagtgttaacatcttcaaatcctctgtattcttctagaaccttcttcatgaccattgtggaagattccgacattgcgcggtgaaacaacttagagaactggtcatccgaactaatatattcgaaaagtctcatgtcgtgggcagagctgaatgcatcttttccttctagtatcacatccttgagatttgtcctatatatggaattttttcaaaaaaaatatcttcaaatgttcatttacgttttatgttcactaaccatgttttgagaatgacttggctatggagcaacaataacaaggacgagagagaaccagagccgtcactatctttcaagaagtacttgcaaatcggttcagctgcatatactctctcgatctttccggtttgaccattttctctgctttcaaccatacaacacttcaagatcgagtggcttacaagtaaccgcagcatccggtccagcaataccggcgcctccgggttagtgggtttgtttgggagactaacggctatctcagacggtgagagccacgtgccgttgctagcagcagcgatcgtatcaatgactccaagctctaaggcggctttgagaaccatggggaaagccacggcgttgactatactctccgcttgcaagctcaccattttctcgtcgatttcttgttcttctttggttaaacccggtttagggtaagtggttaagggatcttgaagatggtttgacataattgtcgatataggttgaaagattgaagaagatgataacaaaggtagagttgatttgaggatgtggttttaactttcacagttagtgatgtttttataaggagaaatcccaaagacaagtggactgattatgtttaatactaatttattgtcacggggatggacaaaaagatgatggttcatgtatttttttttgaataaaagatgatggttcatgtagatagtttgcgattgttgttgttgttgttgttttgatatagataacaatggcaaagaagattgaattcgagattcacactagtgccatgcactgagacgcgtgtagtagtactcaaatgcgaattaaaagttaactaatgaaagatgcgtcagagttttcatttttttcttcacatcgaaaaggttaaaatagaatatcgacgattataaaaaaaaaaactacaaattttaaaacggtcaactatataaaacatacgatgcgataggaaagaaaatcataaccaaagtttggtgatatcttcagtttcagtatgcttattgtggtgataaacaaagatttattatggacaacactaagtcactaactggtatcatgatatatatttcaaggaaaacctctttttcagagaaaaagatatatttctagaaatctcacaattaaagggaaattactgcaattataatttttcaatatatgaccataataaaactgacactttaggaatctttgcaaattaattatttaatggtaattttagattatttcttaaaattgtgaaatttttgtaaatcaaaactaataataataataatgatattaataaattccaacgagaagggatcataatctatatatattaattatcccaaaaaaggaaacaaaataattgtgaaatttttgtaaatcaaaactaatcatagtaatgataatattaataaattccaacgagaagggatcataatccatatatattaattatccaaaaaaggaaacaatgtcataatttttaatagtaatttcttaaaaccaatttattattaacaggtggatgatgatttaaatgcataagaagagaaaagaaaaaaaataattatatatgcaagtaaagtcatattactcactttgtcgttctattattttttctcaaatatcaatgcataatttattatgactattaataatttgcaatctttttctattggttaatttttaaaataaatgttagatactatatttatgggtatttaatattagaataacaaaacatttatggtctcttaaactttgtgcttatttagaaaatattataatctggaacgttgggagtgtagattagctgtcaaatatatgatttattacttaaatgtgtttatcttatttaggttattcttttaataaatattttggtttgactctcaaattggcattaattattttggtcaaacttaactttattgcctttaatttgagtaagaataaaaaaatatctgtgtgtgtgttgtctgtatatatatgtagacattgttgataagaaaaaatattcagtaccagataaacacaacaacaaaagaaaaaatatagacatatcatttgcatcatg

SEQ ID NO: 9545 - DNA, 3000 bp, Unknown
  misc_feature (1)..( 3000): cDNA_ID_3042311_gDNA_ID_1972144_Annot_ID_179334 3000 nt of promoter + ATG
ctgaaaccgccagcaagcagcagttagatagcataaagaaagtggcgaaacttgaggctgagtgcaggaagtttcggatgttggctaagtcatcagcttcgtttaacgatcatcgatctacagatagtcattctgatggaggggaacgaatggatgtgagttgctctgattcatgggcatcatccacattgattgagaagagaagccttcagggaacttcctcttccattgaacttgatctcatgggtgattttcttgagatggaacgtcttgtagcattgcctgagacgccagatgggaacggtaagagtggacctgaatcagttacagaagaggttgttgttccctcagagaactcgttagcttctgaaatagaagtactgacttctcgcattaaggaacttgaagagaagttggaaaagttagaagccgagaaacatgagctcgagaatgaagttaaatgtaacagagaagaggctgttgttcatatagagaactcagaagtactgacttctcgaactaaggaacttgaagaaaagttggaaaagttagaagcagagaaagaggagctcaaaagtgaagttaaatgtaacagagaaaaggctgttgttcacgtagagaactcattggctgctgaaatagaagtactgacttctcgaactaaggaacttgaagaacagttggagaagttagaagcggagaaagttgaactcgaaagtgaagtaaaatgtaacagagaagaggctgttgctcaagtagagaactcgttggctactgaaatagaagtattgacttgccgaatcaagcaacttgaggagaagttagagaagttggaagtagagaaagatgagctcaaaagtgaagttaaatgtaacagggaagtggagagcacattgagatttgagctcgaagctattgcttgtgaaaaaatggagctggaaaataagttggagaagttggaagttgagaaagctgagctgcaaatatcttttgacataatcaaagataaatatgaagaatctcaagtttgtctgcaagaaatcgagacgaagctgggggagatacaaacggagatgaaactcgttaacgaactaaaagctgaagtagagtctcaaaccatcgcaatggaagcagatgcaaagactaaatccgcaaagattgaatctttggaagaagacatgagaaaggagaggtttgcttttgatgagcttaggagaaaatgtgaggctcttgaagaagagatctctctccataaagagaactcaatcaagagtgaaaataaagaacccaagatcaaacaggtctgtctccaaagttcaggtgttagttaaacttagactgtgttccatcacaatcacttttttgtccactaaaacttgattactataattcaggaagacatagaaacagctgcagggaaacttgcgaattgtcagaaaacaatagcttcattggggaaacagttgcagtcccttgcaacacttgaagatttcttaaccgatacaccgataattccaatggctgcaaatggtgtaagcagcagcagcaactcagagagttggaaggttcacaaaaacgaaactttcatgacaagaaatcatcctgagtccatcaaaccaaccaaagaaacatctccatcttcttcttcttctactgcgtctgctgctgtttcaatgccagtttcaacaaaccgagggagttctgagaagaatcgcaatggatttgcaacagtattcacaagaagtaaagacggtatccatctggctatataacataactttggcagagtaggcagagaaacttatctcttagggtttaaaaaggatccgtttttaacaccactttgttcccttttccagattttgaatccatagtagtagttttaaaagttaatctctagtgtaatgcagtggatggatattccataaaagatgtttcaaaagttttcaattttctgttaagaggttttaggaagtttctatgtgatgttgttatgaatcataatataagacaataaagaagagaagccaccatcataagagaagaatcaaagactaggcatataaagagggttcctataaagagagaaacatactattgaaaagttcttagacttgaatctacttggagacgaatatacataataaagaagactgatttaatggacgatcaaatttgcaagtgttggaagagaaactcgacttgaactctagctttccttgctttggatttagcagctttccttgctttacgtttatcgctaaccatcttcttcataagctccagtttatctctgataaaatcttcatgtccaaattccaatactccagttcttcctttaactattttgaacccatgagaacgaaggttggagaaaaaccgtgagaggtttgtgcccaagtctacatatttaggcagaatccttctgtaaaactctccaacattccagataatgaaactgttgttgctttcgctccacgatatgattgcatccgttgaagcatcatcaacaacctcatacactctcatgtagaaattgtaacccatccctaaaacctcacaaacttcacaaattagaatcttagaataattagggtttcgagattttagcatagagaggaagagcaagagcattatttatagacgagctatcaattcaaaggacggtcaagatatcagcaaaatttcagcggtcaggattaaaagttacaaagtttccttttttctattttgtttccttttttctaatacgcatatattatgtatataaataagatagctttcacctaacaagcatccgaggttctatggtgtagtggttagcactctggactttgaatccagcgacctgggttcgactcccggtaggacctctttttgtttcttacatttttttagttattacttttcaaaattaaccctattatatcactcccacttctcttcttcttctgtcgccgaaaacgcagcttaagctaaaacccctcagagagaacaatg

SEQ ID NO: 9546 - DNA, 3000 bp, Unknown
  misc_feature (1)..( 3000): cDNA_ID_2183488_gDNA_ID_1972144_Annot_ID_179332 3000 nt of promoter + ATG
ttcaaggtggaattttttgagttgattacatattttcaagacatatgctgatttaatagtatattgcaaatatgtaatcaactcaatgttttaaaattgttagcctaagtttaattatattctcacttgaaacaattttactgcatgtagtacgccaactggccttggacttcagccatgtgtttcacatggtggatttgtattcaacaagcctacccacccatgagttttaccagcaacgattaaaacaattgcaaactcaacgcgtctaagcaaagaagaacaacaagttgacgaaagaactctgagctttgcccacctctactcggtatggttcaatgttactatagattactttctaacattaaaacacacactgtttttggatttaaaattttattatagacttaaaaatttaataatagtatgacgcttttaaatgattataggatcaatcacaagttagtgcttccttaaagatattttcctgcgtgggttagaagaaagtgatatcctgattcacgtggttcggttgacccctacttttgttttcgctatggaattataaataaataaaagagaactaaacatgtattcattccatttcattatgtgagcctgaattgtgtgacatgatcagaataccaccacaaaataaaatacgaaactcatcacaatcctaaagctttgattgatacaataagacgcggctaatttaggaatcaaatcgaatcatccacagattggtaattcttagagtggagattatacgataaatcacagataatgggaacttcaacgctcaaaaatggattggttttgtaaactattacattgctctcgagggatattttatttagggtattttgaatttttatgaatcaaatttatttcctacccggccatgacacataaatcaaagataaatatctaatttttattaaatagatttagttctcaagattcagtaacgcatacatataaaggaaacttatcaatgagtacatgaacaatcatgtccacttgcttgatttatacaaacgcaattaggatagtaaggatccttagtttcatctttgcactgttgaggaccccgagcacgaattggactacaatatgttcccggaaagtattcaacaagtacaggtggacgatcttctgcctccactgtttcatatcaaccacaaaaatattagatggtggatgaaacgtgttagataaatacaaaattgataacacaaaaatttacattcataacattttttcatcagtcaatgttttcatattaagcaagtatataaacaatcgaaattatatgaattatatatatctcacctttagcattatacatcacgaaaaacatgagaacacaaagaaccacacacgcactaacagatttcatgatgcaaatgatatgtctatattttttcttttgttgttgtgtttatctggtactgaatattttttcttatcaacaatgtctacatatatatacagacaacacacacacagatatttttttattcttactcaaattaaaggcaataaagttaagtttgaccaaaataattaatgccaatttgagagtcaaaccaaaatatttattaaaagaataacctaaataagataaacacatttaagtaataaatcatatatttgacagctaatctacactcccaacgttccagattataatattttctaaataagcacaaagtttaagagaccataaatgttttgttattctaatattaaatacccataaatatagtatctaacatttattttaaaaattaaccaatagaaaaagattgcaaattattaatagtcataataaattatgcattgatatttgagaaaaaataatagaacgacaaagtgagtaatatgactttacttgcatatataattattttttttcttttctcttcttatgcatttaaatcatcatccacctgttaataataaattggttttaagaaattactattaaaaattatgacattgtttccttttttggataattaatatatatggattatgatcccttctcgttggaatttattaatattatcattactatgattagttttgatttacaaaaatttcacaattattttgtttccttttttgggataattaatatatatagattatgatcccttctcgttggaatttattaatatcattattattattattagttttgatttacaaaaatttcacaattttaagaaataatctaaaattaccattaaataattaatttgcaaagattcctaaagtgtcagttttattatggtcatatattgaaaaattataattgcagtaatttccctttaattgtgagatttctagaaatatatctttttctctgaaaaagaggttttccttgaaatatatatcatgataccagttagtgacttagtgttgtccataataaatctttgtttatcaccacaataagcatactgaaactgaagatatcaccaaactttggttatgattttctttcctatcgcatcgtatgttttatatagttgaccgttttaaaatttgtagtttttttttttataatcgtcgatattctattttaaccttttcgatgtgaagaaaaaaatgaaaactctgacgcatctttcattagttaacttttaattcgcatttgagtactactacacgcgtctcagtgcatggcactagtgtgaatctcgaattcaatcttctttgccattgttatctatatcaaaacaacaacaacaacaacaatcgcaaactatctacatgaaccatcatcttttattcaaaaaaaaatacatgaaccatcatctttttgtccatccccgtgacaataaattagtattaaacataatcagtccacttgtctttgggatttctccttataaaaacatcactaactgtgaaagttaaaaccacatcctcaaatcaactctacctttgttatcatcttcttcaatctttcaacctatatcgacaatt

SEQ ID NO: 9547 - DNA, 3000 bp, Unknown
  misc_feature (1)..( 3000): cDNA_ID_3042299_gDNA_ID_1972144_Annot_ID_179347 3000 nt of promoter + ATG
acttaagttcttgctgtttggtcccactgtaccttttaacagtttacactatcgaatcaatcccagtttcatcttcgttagctcgatgacccaattaatgggttttgcttaagcatcgcagagtttaaacccgataaatgattcttctcgtttgtgactttagggtcatcattggcatacgtactgatctcaatgcataaaagatttgtactttgaaaattttggatttggtatttgagatattagcagtaaagttttttctctctgttcttctaaatatttccaaacttgattacttaggtggcgaagagattagagaagttcaagactactattttcactcaaatgagcatattggcagttaaacatggagcgatcaatttaggccaaggctttcccaatttcgacggtcctgattttgttaaagaagctgcgatccaagctattaaagatggtaaaaaccagtatgctcgtggatacggcattcctcagctcaactctgctatagctgcgcggtttcgtgaagatacgggtcttgttgttgatcctgagaaagaagttactgttacatctggttgcacagaagccatagctgcagctatgttgggtttaataaaccctggtgatgaagtcattctctttgcaccgttttatgattcctatgaagcaacactctctatggctggtgctaaagtaaaaggaatcactttacgtccaccggacttctccatccctttggaagagcttaaagctgcggtaactaacaagactcgagccatccttatgaacactccgcacaacccgaccgggaagatgttcactagggaggagcttgaaaccattgcatctctctgcattgaaaacgatgtgcttgtgttctcggatgaagtatacgataagcttgcgtttgaaatggatcacatttctatagcttctcttcccggtatgtatgaaagaactgtgaccatgaattccctgggaaagactttctctttaaccggatggaagatcggctgggcgattgcgccgcctcatctgacttggggagttcgacaagcacactcttacctcacattcgccacatcaacaccagcacaatgggcagccgttgcagctctcaaggcaccagagtcttacttcaaagagctgaaaagagattacaatgtgaaaaaggagactctggttaagggtttgaaggaagtcggatttacagtgttcccatcgagcgggacttactttgtggttgctgatcacactccatttggaatggagaacgatgttgctttctgtgagtatcttattgaagaagttggggtcgttgcgatcccaacgagcgtcttttatctgaatccagaagaagggaagaatttggttaggtttgcgttctgtaaagacgaagagacgttgcgtggtgcaattgagaggatgaagcagaagcttaagagaaaagtctgaagtttgaattagaaagataccttatttttatctagttgtgtaacttcttcttcggttccatttcgggagagactttgatttagcaaagcaaatcaataaagtaaagtttacgttatcaaatgcaataatagtctttagagtcttttgttgaatcttgaaaagtccttaatgagtaaattaatagattaaggttgaatattctctgaaagactgaaattgatgaaattattatattttagtggtcggattatcttttctaaagccgaaagttaaataaagtaattgaatgcatcagaagaacttagatctcagtgaaagcgatgttagcttaatcaatcaaatactagaagaaccatttttaatctaatgtcattagcttaagattgtcgttttctatcttttgaaaataacattatacaatgtcattagcctccggctccgatttaacgttttccagtatataattatatatgaataaatatacatttattatacattatattggaaatttgataaaatattgtcccatgtgagcatttttttaaagtatatatatgaggcctagtaatgcggagtgcaccatgcgaggatgtttggtaaatatgtttttattcacaaattggatcaaaacccattttttgtgtttcttatctttattgatatttttgtttccgaatcaagtaattaatctctaccgtcgattagtagattacctatctttacagttttcaccaactatcttcttcccaatatgaatcgttgattttattttagtctatagtcacactttttctattaataaatataaagtatacttactatgaatatggattaaaattttaaaatactctattgaaagtccagttcaactgttatattaatatagaaaattcccccaaaaagcagagattttttcagcaaaattttaaattttgtaaaacgaaaaagttatgtttatttgtttaatattaaaaaattgtgaccaatagatgtgtgtgtagcggcacgtgccggcctgcaacagtaaagctaaaaagcgtccggctcctaatattccccgtcaagaccgtgacttcttcttccttaactcagatccaacggctattgttatacgctttcgttaatcaaccgtcagattttcatctaacggtcaatattaaatctaactccttttttcttgtctcttaaaataatcccaaacccgacgcaaagcttctctctctctttctcgatctctcctaagcaaagtgagcttcttcttcttcttctccttctttttagcttcgccgtgaaaactctccggtatcggaaaacaaaaacgacgtataagaacaagatattgctggagttgagagatcgctcgtcttcttctccgttttgcgatgcttggcacggtggtgcagtggtggttaacatattaccgtttaagatttggccggaaaaatcgagaacgaaagtggtgattctactcttaagccttcaaaatcaaagcttttttttgtttctttgttctgttttttgcaaaaaataatttccgcggagatg

SEQ ID NO: 9548 - DNA, 3000 bp, Unknown
  misc_feature (1)..( 3000): cDNA_ID_2183522_gDNA_ID_1972144_Annot_ID_179341 3000 nt of promoter + ATG
accgactgaaatggagaaaataacaaatccaagcattattgttgcaattctatgtaccttgacaggctatatgacttgagagcctccccaaatttctgcctaactactgttccacttcggcattctgatgtattggactgtagacaaaaatcattagagacataagctattttgaaagtaaacgtttccatgccagaagaggaaactaggtcttttagatacatatagcggaaacagttcatacctctaggattttaaatccttgttccttggcgcatgcatgaatggctgcagatttcccactctgcaacacaggcacaattgtactcataaacatgaaactcagaaagcattgtagacgtaaaaactgacagttcatggcagaatatctaatcacacaccccagctggaccaacaattaagagaacattcttctggctatcttcagcaccacttttttctgagtcagagtcactttcagaacagttgtaatcagcatcttgcgatttatcttcatcactactcaaaaagtctttgtttggctgaaaccctctctcataccattggcgcagccattcattcattacctttacagattcagtattaccacatacctgcaagatacgtgggtaagaaagtgtgagaaatttgtgtttggtaagaagatataaacaggcatatctactttgaaagcagtatgctcaaattgtctgacctccgaggcacttcttggctggtacttatctacccataatcgattacaaggttggccactggagtcattactgcatagattagaaattatagatcaagcattctagaaagaacaaaaagtatgctcaacttaaaacatgtgtgctgctactgatatcaaatacaaaatcactacctttctcgacatgacaggtgttgcatttcatgagaaatattggcttcaccaccagcatcatcagacaagttaattgcttcatgaacttcacaatcctaaaaagaatgatagaaaataaccctttattatgaatggttccaacaaaccaaaaaataaagaccaaaagagaaagttttaggtcatcaccgattctgctccatctaagaagccgaggcacccacgtttctcctcctggtcttctattaagactaccgaagatgcctctgcaataccttctgattgactagtgcattgttcaggctcctcatcatcgatgacacacacgtcaggatgtgaaagagatggcaattcatttaaatcaaactccttgggccgaggttcaagagagttaaattttatttgttgatcaggactctcagtagtagatgtttgctcatagaaagtccagttcttccaatcaagggtggttggataatcatcctaagaagaagattttgctattcagattcctttattattacaaacgatcgaagaagttaccctatatgtattagtcatacctgaaacttgtcaaatacatggatagggccaatggtgacgattttatctctccctcgaccaagacacgtaccattctctgctgcaacagcttcttgatttcttttacctcctttccaagtcgagaaaaacggatgtatttgcttcccagcagacatccgcgaattttcctgatcaaatagaaagcaaaaaaaaaacaattttagatgagacaaaaaaaagtcacaccaagttttgccaaaacatgcttaattaacttacctcagctcttaacttagcttccaggcgcaaattgggaactggaggtgaaacattggcagcaatcatctgatcaccagcagctacaattccgtttttagttgcacatttcttaggagttgtttttcgaggactctttcctttagccacctaaatcagagaaaaaaaaatagagagatcactcttacaaaatcttctccaaagtagttccccaccgtaatttatagacgaacacaaaccttcttggtagctccgttcttcggagttctctctttctgttttctcgtcttcttcccttgactacgaccatctcctacttctcctccttcatcgcacatcggatctccattagagtcaattacatcctccggtttatgggggagcaaagacgactgaaccaatttccgacgaacattccgccgtggagtctgatccattgcaatcaccgtcgcaattggaggaaatcagagttacggtagaatctagggtttatgtgtgaatttggggatcttggtaaaattaaattataacgttaaggttaaaagatgacatatgtctgatgcttcttttgatgaaagatttgttttatagttaggtgagaatttggagggaagaagattcttttttcgctatttcccgctaaactttaaggccgtgtttgtctccgtctctctcgaaccgcttcttcttttttttttaatttttttgcagctctttttacacacataaattctttgcattacctctcgggaaaaaaggaaagtgggcttctaagtgggccttaatttcaggcaattaatttaccggattacccttaaaggcttaaaccgattctggtagggggggataaatgttgagtgttgaccgttaaaccgttgaattatcccacgttgtacatataaccggtaggctcaaaccgaacggaaataaataggggcaaatccgtcattgaacattatgttatctcctaccgttgtcctaccgttgaacggaaataaacagctgtgagctatttcgataaagattgtaacttttcctctctctctctctctacttcgaacaggaagaagatagattctctcagttctttcaaatccataaaaatatacctggaatcttgtttctatacttcttctgtttctcatactctccactaatactaacatttttccagaattttgttaaaccctacaaaaatttgaactttttaaaaccctagaaaattccaaattcgtaaaaccctagccaagttcctctattgcgtgaggggaactcatcagaacccacgaatcgaa

SEQ ID NO: 9549 - DNA, 3000 bp, Unknown
  misc_feature (1)..( 3000): cDNA_ID_2183518_gDNA_ID_1972144_Annot_ID_179340 3000 nt of promoter + ATG
aaataaaataattcgcttaggatggaaataattaaatttgcagaatcgagatttttagattttttgaaattaaatatgtgcgctgaataaaatacatgctttatggagaaatttctaggcaagtgaagataactggttttccatcattatggcagaggatgctctaggttcaactacatattctttaaaccaatttcttttttaaagaaaaaaaaaactacttatttcctttgtccctttgaacaaattatcgtttatatacaataagaatcaaaaacttaaatgggcttttcgttatccaaactaatttgggcttcttcttggattgaattgggtttggttgcccagacttgcaagactgtgaaccggacaattttaaaccggaaaaaaccgtcaaccggccaggcattcaatacaaatttaacaatgacaaaccaaagtactagcagtgttcatgagattgtcttgcattcaaacttagaaaacaaaaaagcaagaaccaatggggatgagtaacgcaatgaatgagtaatagctcaatggacaagaagctatagaaatacttccgcctggaccattagctggattacccgggattgaattgcttgaagaaaccgtagctcctccaggtgaagccgcggggactgcggctatagatgatcctccaccagcaatatcatcaaactctggtgatggcgaaggtgaaggtgaaggtagatacatcagttcctttggaacattatcaggcggggctataagcggtgctaattgttgcggtcctgcaaattgtttttaccaattgcatttcagctggagatcaagatttcactcattgtgttttatcataacgcatgagacagtatacttaccagggcatcgaggttgaagagacatggacaacctgaaaaacaaacaaagagagacggagggagattggttatataggttgttaaattcattagcaggggaaatgtgataaggaaagactcattacgtggtcaagatagtgccgctagcgaaaccgttgtaactacaagtagtaagtttacaaccggagctactctgctgcgaagtaatgttaccaagcatgaagttgctgtttctacatctcatactggaacaagagactgatatagaagcaggctcacaatacatactgcatcacaccaatgctaaatatcagcaaatcatccaaaattcgactaacaaaactcaatcgcttaataccttcggcttccgagaacacagctgcattgtacacagtggcctgcagtgagagcatagcttccatttggaatgattaatccgtaatccgtagcgtatttggggaaatttgaactacaagctgagaagttttgatacaaatagacagaacattcaataatctgttataatctgtgcttaattggcaaatttctattcaaagattgaaactttagaactcttctaactaaataaagaagagagactttggatcttacctagcaatgggacagcgaggatatcaccaggattgatatcaggagctcccatagcattcacgtttgttaaatcagtaacagaggtcgagaatctctttgcgattccagccatagtgtcgattcctctcacaacgtaagatagataaagcgccggaagagattcatcggtaccattgaagcaagcgcaaggcaatggaatcacaagctttgtacctacatcgagaaccgaaaggtcagtctctgaattcgcgacctgaatctgctccggagagaccagaccaccgtaaacagagtcagcaatcgatcctagtgtgtcagaagtacgagtcttgtaatgagtcgagagggattttctgattccgtcgacacaggagcaagtgattgggatcttgaggaagagcttagcgggaaggacatggttctcgacgtctgggtaagagatatcaatggagttagacaaaagcattgaaactgggtctacttggaagagagaagcgacttctgtgactttgaggtcggtgtagagagtgtagcctagcaatgagttacaagtgtctttactggagcaaggctctattgtggattttgcagtcgccattgatgctaagcttgaagctaaaattagaaacagaagtaagggtttttctggattcttcatttcgattcgtgggttctgatgagttcccctcacgcaatagaggaacttggctagggttttacgaatttggaattttctagggttttaaaaagttcaaatttttgtagggtttaacaaaattctggaaaaatgttagtattagtggagagtatgagaaacagaagaagtatagaaacaagattccaggtatatttttatggatttgaaagaactgagagaatctatcttcttcctgttcgaagtagagagagagagagaggaaaagttacaatctttatcgaaatagctcacagctgtttatttccgttcaacggtaggacaacggtaggagataacataatgttcaatgacggatttgcccctatttatttccgttcggtttgagcctaccggttatatgtacaacgtgggataattcaacggtttaacggtcaacactcaacatttatccccccctaccagaatcggtttaagcctttaagggtaatccggtaaattaattgcctgaaattaaggcccacttagaagcccactttccttttttcccgagaggtaatgcaaagaatttatgtgtgtaaaaagagctgcaaaaaaattaaaaaaaaaagaagaagcggttcgagagagacggagacaaacacggccttaaagtttagcgggaaatagcgaaaaaagaatcttcttccctccaaattctcacctaactataaaacaaatctttcatcaaaagaagcatcagacatatgtcatcttttaaccttaacgttataatttaattttaccaagatccccaaattcacacataaaccctagattctaccgtaactctgatttcctccaattgcgacggtgattgcaatg

SEQ ID NO: 9550 - DNA, 3000 bp, Unknown
  misc_feature (1)..( 3000): cDNA_ID_2108834_gDNA_ID_1972144_Annot_ID_179339 3000 nt of promoter + ATG
ccaactttaatcacctaaaagcctaaatatgtttaaatcaataactggagaaagatcagccatctaaacgtcgtcggtttatcaaatttttattttgttttctgacggcaccggtttatcaactgttaatgtcaacattttttatctaagccaaacgttttgagttttgacggcctcgacgacattcataaatatttgtgtaaactcactaaaaatcctaaaataatcactgcttgagaacataggcaacatttaacatccgattggcgtcaaaggatttcattaaaaatgtagaaaataagtagtataatgatttgttcataagttgattccatagttttgttattctactcattagctggtgtagtaagcaaagagacaacaccacccatgtgcttagtagaaccatacacacacacacttagtggcaacaccacttgactctagaccataatgatcattttctgtctccatttcgtttctgattttataatttcttggatcaatgttcaataattgaatcccaaatatggaacaataataatggtggttgttaataggacaaaagtttctctaaatagatgcgtttttttttaacttttgtaggtttctttccctatctttcgagatagtttcttcatttgcttttgtgaaagattggtttatgtgtcacggatcgatcattgatgaataatgtgagaaaatgacttgctctttatgaagagagtaactgaaaacgatttgatattcaaacaatatttcaaaagttatgtttctcttttgattatgatctttataacaaacaaccaaataaatatccgatcagcttttcttgttcaacaatattttgatctatatacaaatactatcattcattgataaaatttaagatatgtaatgaactatagtatgttctattgttaggatcctacatctaaagttagatggaatctaaagtaatatttaaatgagatacactaattcattaattgttatttagttttgagttagggtctctattaaacttgagaatctaggttattgatccgggtggagtaacctaagaatgatatgttgcatgtccaatcttgagatttggttccacatgaagggatgagaattattgtcttgaaagcatgttaaattttttacaagatgatgcaaatagtaattaacatatcatgatcaaatcttgtaaattgaaaaaactcaaccttttgaggggaaacagctacaatatatactaatgattatctagctactcgtctaagaatataaatgtttagcatttaggtgaccaatatcaaactccgagctacttgccttacgttttacccttgcaagtaagtcaaattaaatttctattcattactaatcacattatgaaaaagggaaaccaaaacttgctgcctacttcattctttttcttgaatctttcgatttttcttaaaaattattattttgataaatatttcttccctatcttagtgttcacataaagtgtgaccgtaagatgggttagctttctcgtggtttgaccaagtcattcaaaaactcaatatactcaatgcctgaatggtcgtgcagcaacatatatgaagtctgctggctacatatgttaaagttggtttcgagtatgtaattttatatataatcttttaatttgttgaaataattttagatattttatacaaaattacaacctatacctcaaactatatattatactatatgcattttgcttgtagtcctatgaatatgagatttgtcttagagtcttcaaaattttatatttcatgaccgatcaacgttcaataaagtcgccgcttctttaaaagaaaaaatttggttgccaaacctattattattatagcttgagatataacttatgatcctacttttaatgcagtttcgaaattattcttctccaagacgaaaagaattgagaaggttggtccataatctttataacttctaagactttaacgtacaaatgatatatcgtcgttggttttttgcatttaaccagaaccagtttcttgtttatttatattttaattaattaattacaaacccctgaacagtaaattaatattggattttaaaacgttcaatttctgtagagcaataatatttcgaatttgtaagatacacgacaatcgatttgaaaaatagacaatagtagtgggatgtcaacgtcatgaacatgtaaggtcatcggacggcagcgatctcccccatatcctcggacgtatgtgggacaaaataccaccaaacaaaaaaaaaaaattgttgctgcatttctttaataatttgcgttatcataataattaattaacaaaaaaatatcaaaatatttccgataaaaacaaatcttcaacaaaatatttaacaaaaaaaaaaaaaattgcgcattttaatgtagtttatgtagtatttcctagtcacaccattatttacctgatataaacaaaaaatagtataaaaacagtaatattatttatcaccatggtttagtgaatgtacatgaaaaatttgttaccataccaatgagttttggaaaattgaaaattgactcagaaaacatgaaaatacaattttgtgatatttgttttgattcctgaatgaatttaataagctcacaaaattaaaattgcgaaattattcttaataaataaatatttcttactaaataaaaggaaacctacggaagagcaaaacataattttcatggcataaagagtgagagagagagagtcatagacaggagacgtttgagattgatgaacagcgaattcgaaacaaatcacatggaagaagagctctctttcgctaccgttaccttctccacttttctccttcattagggttttctctcttatttagctgcgcagctctctctctttcttacggattcacttcttaaaactcgttaatttcttgtgggtttttgtctcttttgcgatctgattccgaaagttgagtgagagtgagagaatc

SEQ ID NO: 9551 - DNA, 3000 bp, Unknown
  misc_feature (1)..( 3000): cDNA_ID_2183508_gDNA_ID_1972144_Annot_ID_179337 3000 nt of promoter + ATG
actacttgtgcaaaggagagtgtcaaagcaagtgtaagcaataaaattacatcttccaaacactccggggtagtatctgctttaaaagtaagtacattagtatatgttagatctttatttgactatccatatcttcctgtgataccagttaataattgtcacaggatattagcaaccacggcgaagcaatcattgggcagcggattaaattactctctcccacagatggatggtaaaaaatttcttatacttggccaaatatatatgctggagcttctgtaatattttttttgtccttttttaccagtttctatcctggcactgttgagaagtttaattctaaaagcaactctcacaaggtatccactggacttcgaagtccttattttgttttttcgttgttgactcttgatccatttgtccccatgagttttaccttactattgatcaaatactgtacttatattataaatttttagtgcggaatatttctgcactgcatatccatggcatatgatgagatgattgacaagacttattgtcttgtcattttatcttcctttgtgctaatttcagatgacactgaattcatgttgactttgaacatgctctattgagttcctttgcttgaaactcaatagtatgaaggcatcattagtatttttttccatttaactatttgattctatgtgctgggttatggtagaagttggtcatatagaactcgaatagcgtacatctttgcagctagtttcattggccccttctctgccttctttctgctgcgctatttgccatggcttctgttttgctttgttgcagattattttcgacaatggggatgttgaattggtttgcttggatagcgagagctgggagaccctgagccatgaatccatggggcaacaggtaaatggaatgctttatgtgtaatccatgatacaaatgctaccatcttggaacccaaaatgaactcgacaccagtacaataggtaacatctctgtttgaattttctttattcaggaacgattgggaaaggagacagaatcttatggttctcggaattggtaggttacgatcaaccaaatttctttgaactactgaatctctgattgtattaagaaacttacatgattggtgcttttttttgttcctttcgctggatatcattaatttttttgttgacgctcatttcctgtgtcatctgtaataatcttactttctgcagcgtccctgaaattagtcatacgcttgcaaaggttactgcccaaaagcagacaactacaacaaagcagcagaacaaaaaggtgcctgccaaattgaatcctccagctggtaaattgttgcaaacttctcaattatttattgacgctacttcagttgtcgatttgagatatttagctcgttagtggctgagtccgtctggtgcaagtataaacacatgaggcttcctttaatatatctacctttcacaatgaatgagtctccatagaatggggaacagtttcttcttcttctcataaaagaatagaaatttcaaatttgttcagattttatatgtgctaacatttttcatgattgcttttggatttgaaatctaaccaagagtgccatgtttcatgatgtcagcaaaatcgaaaaaaggaaattcggattctggagaaggatcagtttcagaagtgaccgacacaagtgacaatattgtaagcgtcgtctcgtttcaaaatttgttattagagaaatccttccttcactctttctaataattgctaatatgaccaatgattataactctattcagaaatcagaatgccgtttgattaaaaagtctattgctcaattttcagggaccaagaagaagtcggagacagagaatttcgtaggaacatgatcctgtttaacgacggagttcctcctaaatatgttgataatctcgtacaaaataattagcgaatccttgactagagttaaagtgttgatgacccacaccgaaaagaaaattaataaaaagaaaaagttggtcactttttgttggtttctcgacttcataatcaaccaggtcaattagttttaaacttgtctaaactcaaccaaaatcttcctaatttcacataaatccattttcttttagttgcaaaatttgttcatatttgatgagaagaccatgttattaggtttaaatgcagttcgattggttgtgaaattaggtttgaaattgacaaataagagcgttttgtgcaatgagaattggcgtaccaacaggaaagaggttatttgcatggccgttgtcagattgatgacctaacaattacacacatccaacggtccatatcacctgactatacctccacgtatttatttcctcatccaataatttcaaaataataataaaaaactaataactttgttttcttcttatatttttttcgtttcgtctttccgcctccacagtcctctcgacgtctccgctaaaagaccattataccctttactgttctctctgtcttcctcctctctatatttgagcctcgctgctgttttccattttttattgttcccgacgacgtcttctctggttccgttctgcttcgatcacggtatattccatcttcctctctttcttatgcttcacattcccgattacattcttcgaatgtgtttgtttcatggaagtgtgtgtgtgttttttataaggctagattagtttgttctacactcgcctttttctcagatcttttgaaagttaaactcaattcctccgtcgatcaaacgaaatgtagtaaaattagttctcgagggggttcttcttaacgaatatgatttacttgagtttatttcgtgtagctcttctctgtaatacatacaactaacgcgtgtattaaagttggttttattgaaattgatttatgttattaatattgtgatggggttttggttgcaggaggtggacgtgttttattagccatataattctttgtttgggggtttagtgaaagatg

SEQ ID NO: 9552 - DNA, 3000 bp, Unknown
  misc_feature (1)..( 3000): cDNA_ID_2183504_gDNA_ID_1972144_Annot_ID_179336 3000 nt of promoter + ATG
gaggtcaaatccgctatttgctctctggtggtgcccctctttctggtgacactcagagattcattaacatctgcgttgggtaaacgaatccctgaatatctccttgaggcttgctactctccaatatatcttttcgtccctttccatttctatgatctaacactgatattcctcagggctccaatcggtcagggatatgggctcacagagacttgtgctggtggaaccttctcggagtttgaggacacatccgttggccgtgttggtgctccacttccttgctcctttgtaaaggtaacctctttacctgatttgtccacttttaatactttgttagctatttattagtttgtatgtcgtagtctcttgtgatcatatgcttatatcttgtttcagctagtagactgggcggaaggtgggtatctaactagtgataagccgatgccccgtggtgaaattgtaattggtggctcaaatatcacgcttgggtatttcaaaaatgaggagaaaactaaagaagtgtacaaggtggcaaatcaacattattggtttcggcaatgttaaaagaattggttggtttggttcttcctctaaccgttttatacacttgaatgttcaaaggttgatgaaaagggaatgaggtggttctacacaggagacataggacgatttcaccctgatggctgcctcgagataatagaccgaaaaaaggatatcgttaaacttcagcatggagaatatgtctccttgggcaaagtatagttttctcaatccgaatacccttttttgtcttcatcactcaattctccggagaagcttcttaaaacattcttttttttcgcaggttgaagctgctctaagtataagtccctatgttgaaaacataatggttcatgctgattcgttctacagttactgtgtggctcttgtggtcgcgtcccaacatacagttgaaggttgggcttcaaagcaaggaatagactttgccaacttcgaagaactgtgcacgaaagagcaagccgtgaaagaagtgtatgcgtcccttgtgaaggtatgttcattgctactcattaccaagctatttgagtcccccagtcatttccttataacatctgtgttatgcaggcggctaaacaatcacgattggagaagtttgagataccagcaaagatcaaattattggcatctccatggacgccagagtcaggattagtcacagcagctctaaagctgaaaagagatgtaattaggagggaattctctgaagatctcaccaagttatatgcctaaatttttcttcttcctttactttttttttttttacgtctcgatgcattcgaaagacttaacagatgcacaaaaacttaattctaagaatagttatctcttttctcattgatgtttctgtcttttcgtgtaatttgtgtgggaactaggacgagacagaaaaaacagagtaatgggtctcttactctcaacaatctttttaggctttgagaccatgtctatacaacttaatgggcctttatcaaaccacgtcattaagcctatgcatatagtttttagtttatttgtttttgggactcgagataaacgacaaaaggaaagagactatcaattgtaatctggagtgaaaataaagttaatcttaccaactaccaacaattaagaaaagataaattggagattagtgtataaattaattatattgtacttaacagaaaaaaaaaaaaaaaaaagtagaaagcagagtgagagatgggagcaatctaaaccgtcggataaattgtgaatctcactgattttgtcagtgaacccaatgaccagagtcagcgagacgcgtgagctcttctttaatcacattattattattaaaaccgttacaacttccttaaattcaaaagctgctttctaaattcgtaatttaattatcctaaattattgtcaataatgtattctcgggcgggaattgttataagcactttaaatgtcaataattcaaattaattagtacgaaattacgttttaacttttaattccttacatttatatacacaaaaataataattccttaaaaaaagctgaaaaagttaagatttaaatgttttttgagttcacagctccacatacagaagatcacatgctctatctctctttctatcttttgaattaaagaagaaaaattagagaaatatttcaaaaatagcaaaaaacaagataaagagaattctctcttctctctctctctctctctctcacgctatatctctgccttgtcgctgttaataaatcgtaatagtgtttcagacagtagtagaagaagaagaaagcttcttcctttttgcttgtttaatcgctgatttttttttgtttccattggggcattttgggatctcaaagttcttcatacagtccccaaccaaaaggtatttacttcaccaaacatttggtctctttcacaatattctcttcctttgttcgtttttttttaatttatctacttaagtgttctctgaaatagaccaatgtttggagtgtagtttgagacttacttatcactgttccattaccctcgtagcttttatttccttctcttggatttggggttttggtagattttcccttatgcctcaacgagtttcaaatttaaagtttcaagcttttgttctttgtcttgtagctttctcaaccgttggtttttgattatgaaacggacatctggaaccacatttgttactataaagacaaattcagttcctttaaatcatttctaatactttgtgttaaatgattggtttattcaagattttctcttatcttgcatgtttgctgattggttcagtttacttcatcttaaagtttgtttcttctttgactatgtttatgtatgtttcagcatttttaaagaatccaatgtatgtgtgtgtgtgtgtgtgttttctctctcattcagatcctgagactgttatgtgctgattgtgatcttggaaactataaatg

SEQ ID NO: 9553 - DNA, 3000 bp, Unknown
  misc_feature (1)..( 3000): cDNA_ID_1395753_gDNA_ID_1972144_Annot_ID_179330 3000 nt of promoter + ATG
gctgtaagtgtctctaatggatcattttttcttggtttcttttccattagtattgcaggcactaatgtctagctctgttgtcttaggttggagtgttccctaaattatccggggatgagtttgattctttcatggcccttgctgagaaattgcgtgctgactatgatttcgcacacactttggatgctaagtttcttcctcgtggagagtctgtggaaggacctgcagtgaggctgttcaagccttttgatgaattgtttgttgactccaaggtaaaggggaaccttttcattttgtacattacatcaatgagaagtcaagttttatgcaataatgtttcaaattatttatttgatttgcgaatcatggattcaggacttcaatggggaagctctagagaaatttgtcaaagaatcaagtatcccacttgtcaccgtctttgacagtgatccaaacaaccacccttatgttgccaaattctttgaaagccctgccactaaggtaattctcagtaaagttattttggatctcactgcagtgcaatacattaatggacgttttcagttatgccttgcatttttactggacaagtattttagatttctgaagatggtagtttagtaatttagtatgtgcttgaaggttaaaagcttttctttgccggtggtagtgttaactatgacaaaagctgtgatatcataaagtagtgattgaatttgggtaatagcatcatagttctctagataattgtaaaagcatttgttctgtttctgaaatttcaggcgatgatgttcgttaacttcactggagcaacagctgaagctctaaaatcaaagtaccgtgaagtagctacatccaacaaagatcaaagtcttgccttccttgttggtgatgcagagagcagccaaggcgctttccaggttactacacatttaagttttgtctcttattatcattttctcatgccaatgttaacacatctctaagaaatttttttcttttcatgtattggtttaacagtactttggactcgaagagagccaagttcccctcatcatcatccagaccccagataacaagaagtatttgaaagtcaacgttgaggttgaccagattgaatcatggttcaaggacttccaggtttcattctcttttgcacacattcacacaaggttttatgaaaaaagaagtacgtataaaatcaatataacctaaacaaacaacatgttttcttcaggacggaaaagttgctgtccacaaaaaatcccaacctattccagctgagaacaacgaacctgtgaaggttgttgttgccgagagccttgacgacatagttttcaagtctggaaagaatggtgagtacattatttgaaaactctaataatggtttcaatttttttgcgaacgcaagactgataaacatcaatttatctatcagtcttgattgagttctatgcaccatggtgtggacattgtcaaaaacttgctccaatcttggacgaagtggctttgtcattccagaacgacccaagtgtgatcatagcaaaattggtaagcctctcttttatgttctttacatgtcaaactataacttgatatactcctcctggattgacttaaccgtgtctgtgtctgtgcaggacgcaaccgcaaatgatatcccaagtgataccttcgatgtgaaaggattcccgaccatttacttcaggtcagcgagcggaaatgttgtagtgtacgaaggagacaggacaaaggaagacttcataaacttcgttgagaagaacagtgagaagaagccaacttctcatggagaagagtctaccaagagtgaggaacctaagaagaccgaggaaacggccgcaaaggacgagctgtagaaatctcatgagttttgtttcggaatttgagtaggagcgtttctcttcttcaccatatccaacagaatcttcttttttctttagcagttttacagttttatcttttttgctctcttgttcgaacccaaaattatccccattaataaaaagttaaacctaataatcatttaatctgttttatgatttgaccatagggttggttagtttggtacgtctatcatttttggtggactgttcggtaaatcgtcctgttgattttgttcgttcaccgatagagccaaactctcaaatctcaatctctgagatagaatcaacaatgtggtcaaatatataacaagtatataaatatgaaaagttcagtttatatacaatgtgattaataggaaaagttgcagtaagaatatgaaaattttagttgaatatctttaaaacgttacttttgaatttaatactgtgtgtgagtgtttctcccttaccaaaagatattcaactaaccttcgaggttaattaaatttgtataggtaaagggcaactttaatccgaatcatatgacaatgacatgacaaatgatgatcgcaatatacataccaacaaatgataaataatttgatatatatattcgaagatagaaagacgacaaatatctactacatattacaccaatgaactagctctgatggctccttaaagtgatagcctgattcatgtggtttcgtggacccaatggtcctgttaatatactacatgatttatttgtgtgtccaagcattgtgtatatcgtatttgacagaattaatagctttcgctgatgacatgtataattttttctaatcatcggaaaattttggattgaagtgtagacatatactgatcagtgcatgttaaaaatcatatattttgaatatgtaaagtgttcaccataatcaggcatatatagttgcaatcgtaaagaagtacttgaacccatcccaacaattcatgatatgtatctttcatttatttcacgaattcccaaggaaactaaaatagtatacgatacacttggcttcagattgtttccctatataatggcactaactctccatgttgaaaccacattaatttcttataaccaacaacaata

SEQ ID NO: 9554 - DNA, 3000 bp, Unknown
  misc_feature (1)..( 3000): cDNA_ID_2183480_gDNA_ID_1972144_Annot_ID_179328 3000 nt of promoter + ATG
tttatggactaattgaaataacgaggtgaaatatgctatgtttagatgctggacctccttcaccagctgatcatttgagagatgttttctacagaatgggacttgatgacaaggttattttgattttgttctcttttgtgttattcatgtcaaacgtgaatatttttgttattctgaatattctttttgacaaacaggaaatagttgccttgtctggtgcacataccttagggagagccagaccagaccgtagtggttggggaaaacctgagacaaagtacacggtattaataaacgacaaactgaagctaccttatatatagttctagggatgatagtgtagagagatgttatggaaacgttcaaaatggcagaaaactggacctggagaagcaggaggacagtcatggacagtgaaatggctcaagttcgacaactcttatttcaaggtctatctctctatctttcttagtaacttggtttgggactgaaaaagagttttctatgaagttttctaaaaatagttttatcaaccattgacttctatgactttgcaggatatcaaagaaaagagggacgacgatcttctggtgttacccactgatgcggcgctatttgaagatccttcattcaaggtttaaacaacagtgattgctaataagatgcctcagaattagtagttcactgttacttaagaggaaatgtttttaaaaacaatagtttcttacagaactatgcagagaagtatgctgaagatgtggctgcatttttcaaggactacgctgaagcccatgccaagcttagcaatctcggtgcaaaatttgatcctcccgaggtacaaggaaaggggagaaaatctaatatctatgcacttgtgtataccattataaaccatacgtttaaaatccagttcagtgacttaaaatctaaaactgctaatgtgtcactatgaaactaatcagggcatagtcattgaaaacgttccagagaagttcgtagctgcaaagtattctacgggaaaggtttgtccttacaaaacaaaaatgcgcttgtgtagcttattctaatataggattcggttcttgtttttaatctctccggcaatattttgcagaaggagctttcggattcgatgaaaaagaagataagagcagagtatgaagcaattggaggaagcccagataagccattacccacaaattacttcctcaacatcataattgccattggcgttttggtcctcttgtccactctctttggtggtaataacaactccgatttctctggtttctaattgacaaattatatattttgatttctcttacctacatacataattacgtggtgatcatatattccttgcaaacaaaaacatcattgttaaagtttgcttgaataaaatcaccttataaataacattgtttatttggtttttagaattttgagattagtgtgagtttcttaagtataggatactaaaataatgtgtgtgaatcactgctacgcctttgcacgaatagattcaaaaattaaaataagtttttttgagattcattaaagattcttctctttttgtaaagaaagaaaagtcttgtcgcttggattaggttaaccatcgaccatcgtacttgtttccaaatctatacaaacaaaggtgattatttttttcatgaacaggtttagagaacttttacaacaccacgtgtgacataataaacgtgcatagttatgcttgatcggtccttctcttctcaatttttttaatacccaggaagactattggctaactaatatttagtttgttgggataatcaatgtgtacttaacaacaaccaactttaaatattaaattctgaatctagaaagatgtatgaatttaggttggtatggaaaatgatgttccttcttctagtgacgcaagaatgcttacggtgaaccgatgggattggtcagactcaatcaatcccattgttctaatcgatatttgaaacttttccctcttttacttttgtatatatgattgagcttatgtttcctctgtattttatgacgaaactaatttcatatagtatattgcaatcatgttagtattatattgattttgaggaaacattatgctatggatttggctgtttggtgattgggataatgaagtgcatgtgagcttgattttggtagcacatgtcctactttttcatccaatagtcttaatgtctcatgttatagatgcattattttgttatcaacgacattatgatatgggaaaaatgtgaaatttattaagagaactttttttacatcatggtgcgttgtactgctgttgtgtcatgtgtgcacaaaaatagaaataatgggcaaaattagtagggaccaaaactaaacaaatcttaatctttagggaaaatatcgtaaaaaactaaattcccgcgtcaattgtgaaaatgacaaatacacgtagacgacaaaacaaaaaaagaatacacgtctccttcgttgacagtctctcccggtgaattgcgaagaatttcagatattaaaatcttttttcgttcctcatcgcggccactttcttcttccccaattcaatatgcaattaatatattgcccagatcccctagctttcttcttcgcacatctttatccattaaatttactaaaaagttgaaaatttaattgcaagacgacgactttgaaatttccttttttgttttctttcatttgtctttctcctctgattcatgttttcacgttttcatataaatcagcaaccatggattcttctgctttttcctcctccatcactcgtataaaactcgttttcacgaaaattcttacttaggttcttcaaatcacaattttgctctgttccttagaaaaagctaaactttgctctgtttcttcaacaaaaaaagtgaactttgctctgttccgtccatgtccgatgatgatcggagtggaagcagaatgagatttgaagcaaacgtctagagttccgacgtt

SEQ ID NO: 9555 - DNA, 3000 bp, Unknown
  misc_feature (1)..( 3000): cDNA_ID_3042319_gDNA_ID_1972144_Annot_ID_179324 3000 nt of promoter + ATG
ttttttttgccgttagtgtacgctaaatcatagacctcttcgtggttataaagaaagaaacttaatttgtctcgaatttgagtttggatgcgacgttttacgtactagttttataaaagtaaatgttatagaccttgaatttcaaagtggaatgtattttacacacacaattgatacaccaacaattgtggaagcaaggatatagagtatcgatctttaatggagaagaatatatccttaaagtaatcattactttttaattacggcggaaagagaatagttaaatttacggcgaaaagaatgttcattaatcaattgatgacgttcgtttataatttcaaataagatcgaaaataacaggtgaacaaagaaaaaatagacattaaaaatagtaagatcgaaaatacaacccttaaaaatctcacgaaatcaatgagagaaacaattttgagatacggtcaacgtttggtctcctttaggaaagtacacgcataagatcgaacgtgtcgattcttattgctcgttcccaaaatcgacatgctctcggaccgctacattccaaatagtctgacgtaagcaatgacaaaactcacctacattacagtctgccacgtgtccctctccatctacttcaaatgaatcctccactatacagatttaaccatttttctatttttgtttgagattcctttccaccaacacaaagcccctgtctatccgccatgtgtccacgacctttcttatatatatagtcatctttcttctttgctcgagagaagtttcaactttcaaacatatctttacagttctttcttgctaaacaacaataaaggggaaaataggttaattatgatgaaatctggggctgatttgcaatttccaccaggatttagatttcatcctacggatgaggagctagtcctcatgtatctctgtcgtaaatgcgcgtcgcagccgatccctgctccgattatcaccgaactcgatttgtaccgatatgatccttgggaccttcccggtacgtttctttcttttcccctttaaatcacactatacactaacagtaacaggattctataaaatcggtctaagaattaataaaccggtttacaatttacagacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcgtaagaaaaacagtctaagagtgagtgaatttatcagttcaaaccgaactttgaatatgattttgaatcggtttagttaaccggacgtgtttttgatattcttgaacagttggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctgagttgtcacgtgcgattagagttagtggaaagtggaaactatcactgtctgttttcgcacgtgtcgggtagccgtcttgaaacccgctagctgatccagaagtgacctcattgggcttttcaacaacaattgggccttagcctttcttctcccttagtaagacaagctactgtattgtgttgttattttcaggaagcaatataaattcattttaatcacttatatattctttacatttttttttcactcaaaactacaatctagcttcttctttttttttttttttttttgttatggttgtactacaatctagctttgttatatatatatataagttaaaaatagtaactaaattacaaactaaaataaaataaagaaattggaagatatcactagtgtttggggtattagggagggaggggagctcgagatccgattttactgactgcatggtatcgaaaaagtgtcggtaatggtagggtctgacagataacagtcttatcgttgcaacttgcattcaaacaaatctcattgttcgctttaatttctaattaatttgtttttgtcttttgtatatttatttgattttgacacgagtttgtctttcctaataagaccgaggcatgattagtttaaccggtttgaattgtttaggttaaatcggagtccaagtcaaatacatcgctatctaacgaaaacgacgactgaaatttcgtaaagttccttactataaaactgatctaactatcttctacaagaacaatataataaatttgatgcattatgaattcacaagttttaaatctttatgattttgtagctcatgaaattgaatgatgtttcttttattatcacatgtcattaaataaaaatagttatgagtagatgacataaatactatttcaaataaatttatcctccatctaattgttatgagatgattatttcctataacatggtatctactatatggccgtctaaattaagtatcaacgtttaaactgcgcaatgctcaagttttcataagatgtgatttgttagaggttaattaagaaacttgcgagtgtatatgtggtctctaatctatattttaatctataaaaagggaagtgaaaatcaagattaaaagcttggatgtcatagtataaaagaatagtaaagtaaggggaccagacatatttgttgcgaactggaaaaaa

SEQ ID NO: 9556 - DNA, 3000 bp, Unknown
  misc_feature (1)..( 3000): cDNA_ID_2183469_gDNA_ID_1972144_Annot_ID_179325 3000 nt of promoter + ATG
aagttgcacgaaattgagtgtgagagagatcagatatataaacaaatactcactcctataagggagcagcaattctacaaagaaaaagcctcctttttgttgccctgtgtcaaaaaagaaacctttttggtgggatttggtttcgctttcttgggggccaaaaagaggagatgatgaatccgaataagcagcaaagaagaaacctttacttcttcttcgtcttcgtcttctatgtcttcatcctctgtgctcgctttcaaacctctgaagctactaaagactcgtcggctcaagtgaagttacagaatcgtcgacttagctccaccgtcgtgtttcctgtctccgggaatgtgtatcctcttgggtaagtgccaaatttcgcatctttttgtttcaatttctctgttttatgctacttttcagtgacccattcgtgggtttgatcttgtttctttgattttccttaacgggattgtgttgacttatgtctggattttgaattggtgcggatactttgttggcttctcttgcatctgtgtggattcttcacttgtaatctatttcattgcttgacaagatgtgaaatcttcattctattgatctttgagatgatttcaaagcttgctactttcacgaattgaagattttgggcaatgttgattctgattttcaccttgtattgaaaacgcccaatttgattgttgaagtaattaacgaattcatctttgcaggtactattatgtgttgcttaacattggcaacccacctaagctctttgacttggacattgacactggcagtgacctcacttgggttcagtgtgatgcaccttgcaacggttgcacaaaggtaagcgttgatatgctttttagtgtgtgacataataagcaaaggttctatcttagaatttctttctctttctttgcagcctcgtgctaagcagtacaagcccaatcacaacactttgccttgttcacacatcttgtgttctggtcttgaccttccccaggacagaccttgtgctgaccctgaggatcaatgtgactatgaaatcggatactccgatcatgcatcatctattggtgcacttgtaactgatgaggttcctctaaaactcgcaaatggctccattatgaatcttcgtttgacatttgggttagttttattctaccttttttcacacattagaaaagaaaaacactaaatttgcggttgtacaagttcctaatttttgaatcaaattttcttttagatgtgggtatgatcagcagaatcctggtccacatcctcctcctccaacagcgggaatacttggccttggaagagggaaagtaggcctctcaactcagctaaagtccttggggataacgaagaatgtgattgtgcattgcttaagtcatactggtaaaggctttctctctattggagatgagcttgttccttcttctggagttacatggacttcattggctactaattcacctaggtgagcaatctttgagcattatcttctttataactgccacttgtttactcacacttttataattgacaagttgaaattatggtgtgaattttttctgtagtaaaaactacatggctggaccagcagagcttctctttaacgacaagaccacaggtgtcaaaggcattaacgtagttttcgatagtggaagctcgtacacttacttcaatgcagaagcataccaagctattctcgatcttgtatgggataatttcttctctggaaaaaaaagattagcttcaccgtttatgtttttccacttttttatgactaatttggtctcctacagataagaaaagacttgaatgggaagcctttgacggacacaaaagatgataaaagcttaccagtctgctggaaaggcaaaaaacctttgaaatcacttgatgaggttaagaaatacttcaagacgattactttacgatttgggaatcaaaagaatggtcagctatttcaggttccacctgagtcgtatctcataatcaccgtaagtcacacatatactggcctagatatgacttgtatctccataaaaatctatagctgagaagtctgtttcttctggtttgttttctcaggaaaaaggaagagtatgtttgggtattctgaatggaactgaaatcggtctcgagggctacaatatcattggaggtacgtatatatatactaagtttttctcaggtttcttttgttcataacttgacaacaatatctcgtgtctatgtgtgtgatagacatatctttccaagggataatggtgatctatgacaatgagaagcagaggattggatggatttcttcagactgtgacaaacttcccaagtctgaacctttattcacctctttttaatatatcatttgatttgatttgtatcgtcttcttctgtttcatcaaatcaataataaaatttctcttttcttcttgtgttgccttgttgcctctgaactattctgttaacagtgtgaatcacgactatggaggagatctgtcggaggaagcttatccaataggatttggtttgataaaagagcttttctcaggaagtgattcttcaaagaacaagaacttggtctcagatggagagctttgacacaagagaagagtcttttttaaagtggtgtagtaaaaagattttgaggtttttggtttttggttttgttgttatcatagaaacaaggaaaatattttgtgaatatatatatcatcatataatagcaaaatgcaacagagtttaagcaaagattcagaaattttcacttgttggggtgttttttttatgtaaccggaagctttacgaaaatgaccccagcataagctacatttcttgggggtaaaatgggaattcgacaacgaaggtagagaaaatggcggaaggaaagagccttgagggtttggcgccattaccggggagagagtgaaattagggctgagcgagagagattctgaaataatttcttttacggcggtgaagatg

SEQ ID NO: 9557 - DNA, 3000 bp, Unknown
  misc_feature (1)..( 3000): cDNA_ID_2114103_gDNA_ID_1972144_Annot_ID_179327 3000 nt of promoter + ATG
aagactcttctcttgtgtcaaagctctccatctgagaccaagttcttgttctttgaagaatcacttcctgagaaaagctcttttatcaaaccaaatcctattggataagcttcctccgacagatctcctccatagtcgtgattcacactgttaacagaatagttcagaggcaacaaggcaacacaagaagaaaagagaaattttattattgatttgatgaaacagaagaagacgatacaaatcaaatcaaatgatatattaaaaagaggtgaataaaggttcagacttgggaagtttgtcacagtctgaagaaatccatccaatcctctgcttctcattgtcatagatcaccattatcccttggaaagatatgtctatcacacacatagacacgagatattgttgtcaagttatgaacaaaagaaacctgagaaaaacttagtatatatatacgtacctccaatgatattgtagccctcgagaccgatttcagttccattcagaatacccaaacatactcttcctttttcctgagaaaacaaaccagaagaaacagacttctcagctatagatttttatggagatacaagtcatatctaggccagtatatgtgtgacttacggtgattatgagatacgactcaggtggaacctgaaatagctgaccattcttttgattcccaaatcgtaaagtaatcgtcttgaagtatttcttaacctcatcaagtgatttcaaaggttttttgcctttccagcagactggtaagcttttatcatcttttgtgtccgtcaaaggcttcccattcaagtcttttcttatctgtaggagaccaaattagtcataaaaaagtggaaaaacataaacggtgaagctaatcttttttttccagagaagaaattatcccatacaagatcgagaatagcttggtatgcttctgcattgaagtaagtgtacgagcttccactatcgaaaactacgttaatgcctttgacacctgtggtcttgtcgttaaagagaagctctgctggtccagccatgtagtttttactacagaaaaaattcacaccataatttcaacttgtcaattataaaagtgtgagtaaacaagtggcagttataaagaagataatgctcaaagattgctcacctaggtgaattagtagccaatgaagtccatgtaactccagaagaaggaacaagctcatctccaatagagagaaagcctttaccagtatgacttaagcaatgcacaatcacattcttcgttatccccaaggactttagctgagttgagaggcctactttccctcttccaaggccaagtattcccgctgttggaggaggaggatgtggaccaggattctgctgatcatacccacatctaaaagaaaatttgattcaaaaattaggaacttgtacaaccgcaaatttagtgtttttcttttctaatgtgtgaaaaaaggtagaataaaactaacccaaatgtcaaacgaagattcataatggagccatttgcgagttttagaggaacctcatcagttacaagtgcaccaatagatgatgcatgatcggagtatccgatttcatagtcacattgatcctcagggtcagcacaaggtctgtcctggggaaggtcaagaccagaacacaagatgtgtgaacaaggcaaagtgttgtgattgggcttgtactgcttagcacgaggctgcaaagaaagagaaagaaattctaagatagaacctttgcttattatgtcacacactaaaaagcatatcaacgcttacctttgtgcaaccgttgcaaggtgcatcacactgaacccaagtgaggtcactgccagtgtcaatgtccaagtcaaagagcttaggtgggttgccaatgttaagcaacacataatagtacctgcaaagatgaattcgttaattacttcaacaatcaaattgggcgttttcaatacaaggtgaaaatcagaatcaacattgcccaaaatcttcaattcgtgaaagtagcaagctttgaaatcatctcaaagatcaatagaatgaagatttcacatcttgtcaagcaatgaaatagattacaagtgaagaatccacacagatgcaagagaagccaacaaagtatccgcaccaattcaaaatccagacataagtcaacacaatcccgttaaggaaaatcaaagaaacaagatcaaacccacgaatgggtcactgaaaagtagcataaaacagagaaattgaaacaaaaagatgcgaaatttggcacttacccaagaggatacacattcccggagacaggaaacacgacggtggagctaagtcgacgattctgtaacttcacttgagccgacgagtctttagtagcttcagaggtttgaaagcgagcacagaggatgaagacatagaagacgaagacgaagaagaagtaaaggtttcttctttgctgcttattcggattcatcatctcctctttttggcccccaagaaagcgaaaccaaatcccaccaaaaaggtttcttttttgacacagggcaacaaaaaggaggctttttctttgtagaattgctgctcccttataggagtgagtatttgtttatatatctgatctctctcacactcaatttcgtgcaacttgcagcagaggtttctttgagttcccgtaagctaaattgagaaacttggcatttggctaaaagaaactcaacgcccaacgctcactacacttagcgtgtaaagcacgcgccaaccaggattgactcaaaggcctaacgatcttcaaatgtacagggcccaatatactcggcccataaactctaaaactattcaaatgttaggcgcgtgacgttcacctgtgaatcagctgatagaaatcattatccaatatccagttatgagtgggtgactccaaatagatccaactggcaacgcattattgacacgtgtcttttcatttctcttcttccggcgttttctctccgccgtttcgccaccgtacgtgaca

SEQ ID NO: 9558 - DNA, 3000 bp, Unknown
  misc_feature (1)..( 3000): cDNA_ID_2990097_gDNA_ID_1972144_Annot_ID_179322 3000 nt of promoter + ATG
acaccgcgaaatacaaatgaatacatcacaagaaatctgcgtgtatgatagtcttgatgtatgagcttaccttggcagtgttgaaggctacattcttgcagtctggcaggacacttacagattttggagacaaacgatatgaagaattacgaaactgtacagtagactcgcatttgtcttgattcaccagaatggcagcgcataggttcgccttcttcccaaacacaaaagcctgttaaataagacgtaaagatcactattacaacattcttcatgatatcacgatactgttagaattttcttacagtttgtagcttccccaatgatattgtagtttgcagtcctgaaagtagaggctcttcacacaacttaactgcagcatgtaattccttaaggtgtccccattttggttgcctaagtaaccctgcagcaccaaccatttatgttgtactttcagatgaacatctgattttgactgtgaatggtttgaaatattaccatattcatcaagtggagcctgatcataataactggtgattacgaactgtgaagcatttctcccgaagttggttcctccatgatactaaaataagatacaatgtcaaatcatcattattcttgcttctcttatacattagagatttttttagtgagactggaaaaggtaccatgtagtagtttacaaagcttccattcttagcgatgaaaagagcaacatgaaacgctatatcctcagctgaccttatcaatggttcctcaccatatgtttgataactatacaaaggggtcagctgaaagttagtagtttatatctggggattgggaagtacacaataatgtagtgaatttgagtgaagaccatacaaactcgtccagttctcagtccatattgcaggtttgttgggtgaattgggtcctttgaatgtttctccacattgcctcccattgcaagcattaacctgaggcaccatagaaacaataagaaaactaaaaaaaacggattcagaagtggaaaattggcagatgagccacattgcaggacaaacataaaaaccaaccaaaggatcaggggcatcatcttgcttgcacataacccatggcactcctgtgtcaagctcaacagccaattttgctgtccatttgacatatgatttcccttcttgtcgaaaagctctaccaaccatcccatactcgttctcaatctgttttgcacataactttaagatcattaaaaaaaaaaaaaaacttcgaaggaaacatacatgaaaaaccataatgtaaacctgtgagagtatgataggtcctccttgggaagcatacaagttttccgatttcatcagcttaacaatcattttcgcatatctcttcatgtgatactgcaaataaaacgtaatcttctttagaccatagaagtaaggaagccatctgagttcagtaaattaattaccttgaatggctcattatctgtcctgaagacaatcccttggacattatgcaaccagaaaggcaaacccctgcaatgtgttattgaaaaccctaaaattccacgaacattgtgttttaccatatcggaaaatctcaacgatctaaagacggaaagagtttacccataagaccattccccttggataaaaggtccaatccgaagacagacatataagccatgattttttacttccttgataaacttcacgatatcacggcttccactgaaatcgaactgtagattcacaaaaaccatcaatcgcataaatacctaaattcgtctgtatagggtatagagacggagagactgacctggccttgttgcggctcgtgaacgttccagaacacatatgtgtctactacatctattcctccagattttgcctttgctatcaaggacggccacatctgcaagttcgatttcccattaatatttgcagaagaagaagaagacaaagagatcccgccaaattttattggaagtttcatacgtttcagaatgtttggggtcgaataataataaatcagaaaataagagcacttaatttcacgaaatccataaaactaaaaccaaatcagaacgtttggggtcgcataagaataaataagaaactaagagtacttaaactcgcaaattcgataagttcaaaacggcctagtcggaaaagacgattttatcctctctctctctctactcttaacggctcatgtgtttcgtattagcaacctgccgccgacttagtgtgctaattcacgtgactgatcggcgcgatttcgccgggaaattgcagaaattaaattccggcgacgttacgaaacttctagatatagacggatcggtgagaacggagagagaattacctgaggagtgctgcgagtataatggattgagccggagaaaaggatcttatgttcgccgtcgatgatcagcgagcgaccgtcgtatgttacgtttgcgacgtctccggcaactataaccgccatgagaacgagaaaaactagcgagtactgaaaagtcgtcatttcttatgtaaacactgacgtttgaagattctagagagtttttatagtttgggactatgcacaactaactgtgcagtgtatctcaccatcgtctcgaatttatgcgacccaatcataaatttcttctttattttttcttaaatccggtttatatatgattcaatggaaattgcaattataaagtaaaagcccaatagcgtcaaaaaaaagtaaaagcccaataatagtgaggcccatcaataatctggagtcaaacaatggtggataatggaaatctctcaaaatccaaatccggttttagccggttataaatgggtttgactggtttcgggtcacaatcgaacggttgacgtcgatcatcattctggtagttgaaaactttgtcgtcgtcgtcgtcgtcgtcgtagcacgtgttgcacgtgagaaatttcccgcacaaaatcttactcttttcgtcttcttccccaatctgggattgaatctccagaatcc

SEQ ID NO: 9559 - DNA, 3000 bp, Unknown
  misc_feature (1)..( 3000): cDNA_ID_3042454_gDNA_ID_1972154_Annot_ID_179403 3000 nt of promoter + ATG
ctaagagagacccaaaaatttgaattcacatatcttactgttagttaagagtgttaccgtctcactagtacgttgcagagaagaactatcctttcattgggtaaaagtgacgacacaatgccaccaactgtgttggaagcattcttcttcctctgctcaaatgtatctccgttgtcatccatcacacgaccagttcgacttggcttatattctttacattcaagcacagatttcaccatcaccatacactgaataaaaaaatcttcaaatggcaacaatgcctgttcggggtccgttatcttgtttaagcagaaatccactacaactggaagagcacatttatctccaaacgaaaatggatgcctgctttgaatagcacctaacaccttcatcagcttgacacatgccttctttacaaactcccagaatttaggatctcgattttgaaaagatgaatctgcatggaggctccacacaagttagcaatacatacatatatatgtgtgctgacaggtcatatgcatgaaaaagagtttccaccacacaaaaaaactcacaatatggaagaaaggattgagccgcattcaagagcgcaggagagacttctttcactggttgtatctcctgagagaaacgagttagctgtatattcttttatctgcatgaagagcatatgccggagagcaagaaagatttctctatcccgatgtagtcaaccaatctattaaggttatgatttcaacttaaccattggaagatagcagaagaaatggaaagtgcggggaacggaacacatatttggcgaaactataccacaagttcatagaagggagatagctgaaggtgaatgtgataatgaactaaaaagattcatgaaaaagtatagtgtatctacctgtatattattggcatcgcttagaaatcctgaaattatcagttggcgcactattttcaaacataaaaaccacctctcacaagtcagaaaaagctcatcgtgatgctgctcggcactatttgaaccatagctctgaaccattgttgaaaagccatgtagaattgtttggacatcagtttgccaaaggtgccaactaaagtcgaagaattgcgacgagatctgccaacaaattaaactggaccttatccttaactaaagcaaaaaacgaagctttggtccaacaataaattcattcaagaggagaaaggaaactgataaggggttgatgttagtagcagactcacctcagcgaaggtcttctgatccgcagtgagacgtttagtagacaattcctttaaggttcgaaaaagaatcagaaagattctgtgagaagccagaacgtcagctgagtgaagctgttgcgctagtaccgaaaagagatcaggcctgatatcatgaagcacgcaatgcataaactcagtaaatcaaggaagatagtgtccagttaatatgaattaagaagggaaaatgctgaccattccctaggataatcaaaacgggctatcttcgatatgagaacagccaacatttccgctatctgcaataaagcaaacaaagtcagatagatatgcttacaaagtatatgcctcaaatggtgtagtcaaggaaaaaaatcaaaagtaaatgctacaacacctggtagttctcttctctcaagtgagacaacaatttctgcctcagatgactcttttcctcgttgctcatactcctgtaagaattgccagaaagagtgtcaaggcctaacatacagggtagtatctttgcagagcgaagaatctaaacgagccagctaaaaagaattataagtagaattgccgattccggaaacaacttgaacttaccatgaatttcttctgctcttccaatgacggttgatactgttcttgaaatacactgaggccattaatctaacgtccacatgggacaccaaatccttggatgcaattacttcctgcaaccaaaccagaggaaatgagcgagtaaaatcaagctgacatttgcagaaaccacaagacacatagattagaaacgctaccataaggcaagaacagaaaccaggtctactctccgacagagatagagccgcctccgccggccgccgaacggtctcgtcaccgctcattgaattagctaatagcgtgtacatcgccggcaaatcggaagccgataacgccatcagatccgacgatattgttgacctaattaaccaaggaaacgtcgaggatgaaccctagaggtttgttacgacgacgataaaatctcacggcgaaggaaggaaaacgcgaagctagtagagacagagaagagaagaaagatcgtcttcttcttcctccgtctttcaacttctcttaagctcttgaaacgtaacaatgtcactagtgaaaatgatttcctcttttttttttaacagtcgaagaaaaaagaaatacttaccgtcgctctgatcggattccgatcacccaaccggagactttcgttttgggctaactacagattattgggcctataataaataagcccaaattaataatcgcgcgtgatcttaacggcgcgtgaacgcaaataaacaacgatcgctcgtgtttgctaaaatcttattggtggagatacgtgggattgcatcaaatttgccacgtatgatacccgccttaaattgagaacgggaagcaaccggaatttattttcaggaaatacgaaacaacccctgctagtttttgaagtgagtaattgcccctaccaatttcttaatccaattgacaattttggtgtcttttgtaagactattaaatatggggaatactctaaattaattaaaatatatatgtcattcgagaaatttcctttttttcctttaaaccctgcgaacctatttaatgatgtccttctcgatttttctcgaagcgttgagtttcgtgaataagacacgcttagaagaggaagaagaagattcgttgacaacaaaacaataaaagagaaaaagattgagaggttgtactttcgggatg

SEQ ID NO: 9560 - DNA, 3000 bp, Unknown
  misc_feature (1)..( 3000): cDNA_ID_2105368_gDNA_ID_1972154_Annot_ID_179420 3000 nt of promoter + ATG
cttatccaattcggaacgtccggtcaagtcgccggtttcattggcgaatcaatccaggcgagattaatttgtacttatttcttatatcaaaaaggtatttatgattatgataatgaatatgcatgtaatgtagtctatatcctgtaacagggtgttggaggaatcgtagagcttgctcccggatacttaccggcggcttacgacatcgtgaggaaagccggaggagtttgcatcgccgatgaagtccaatccggttttgctcgtaccggaacccatttctgggggtttcaatcccatggtgttatccctgacatcgtcaccatggccaaggttcatcattatcatgattcatgcatcgttatcaatttatcatcatcaattctaatttggattttgcaggggatcggtaacggtataccacttggagcggttgtgacgacaccggagattgccggcgttttaagccgtcggagttactttaatactttcggcggaaatccaatgtgcacggccgcaggacacgcagtacttagagtccttcacgaagagaagctccaagagaatgctaacctcgttggctcacatcttaaacgtagacttacgctactcaaaaacaaatacgaacgtgagttacttcttgtccaaattaaaatcaattttaaaatttttctttattgaatatcttatcctttctctaatttgtttagtcattggagacgtgagagggagaggattgatgctaggagttgagtttgtcaaagaccgcgacttaaaaactcctgcaaaagcagagacccttcatttaatggatcaaatgaaaggttagttgtgttcaatcctaaaccaagtgaaattgatcactctcatcatataaagttgatacttatgcatttaagatagtgtttaatacaaatcttttggtatcaagaaatgggagtgttggtggggaaaggtggattctatgggaatgtcttcagaatcactcctcctctctgcttcaccctctccgacgctggttagctccttagtttaacatatatatcttcaaattggtttctttttgtttcatttttttattcatgatttatgttgtttcaaatcttgtattttgtagatttcctcgtggatgtgatggatcacgccatgtccaagatgtgatttactatctttatccgttctctaatgatcactcacccttgtatgtgtatataaataacacaatacatcataaagtagaattacaattggtgtttaccgaaatatatcacagatgcaagtatatgtaactaaatgtacagtactgtatacacttgatagaatctacaaataaataaaaaactcgctgctaatgatattccacaaatacatatattgatccgaagtttcgagtttagagtaaaacttgaatgatacacctgtggggcaaaacagttggtcatcaaagacgaggaagtggtagaaatggcggcgccgcggcggagtaggaaaacgatgtccggagagctgtcctgatcgcggaaacgagactcgtcagcacgaatataagttcttcaagtatgcatagtgtctttcttatcatcgaatcttcttgttttctcgatgcgagattcccaagtgagagagagggagttgtgatatttttctgctgacttttagatatatatggcctttgataatgttattcagacaaacaaagtgtcagcttgatgtttgtgtccaaaattgataatataatggaataattgcaaaacggaacctgaagttttgattaacatggaatttgaacccaatattttttccctacaccaaatttttagtttttcggttttcatttttttaccaactacaataaaccctagatgaattcggtttagaagaccagacattgctatgtaagagtagaaaaaccgttggtgtttagattacactaatttaaacgttataacacaaaactgattaaaacataaatatacttatgaagcgtgtgcaatgatgatcccttcatgtaccccgttgtacggaatcctagaggtgattcgaagaatttatggtaactcacgtaacaaagtgtcagctaagtaatttatggttacgaaaatacaattgtctcgtttaaaaaaaaattaatatagttttaaaaaatctaatatcgtttttaaatttaatatcatttctctgttactagtttagtagcttgaatttttgttttcgtaattaaactagactgattttttaaatttagatttagaccgtgattagaataaaagtgagttttaagttgcattttaatcaaagaatcagattgaatttgcgattaacttctcagttaattagtcgatccattgatggtgttctttgaatttgtttctcaatgatgcatacaaaatttcaatttccacattttaaacataaattaattttaaaattatagatatttagtatacctctcaatcttataatattagtatttaataacattgcattaaagttagtaattaattagagtggatttttgatctgaagagggtaaaactaaaaacggaaaggagaaaaagaatgaaagagaagtggaaagaaaacgcaaatgcattgaagactttccctttgtctctctctttgacaaaatcccaattttcgcatcctcactttctcctctgccttttttttttctcttctgccgccaccaccaccaccactgttaattcgccgccgcttccacatcaatcgccgtcgtagccaatcatcatcgttcttcatcctccgcttctcctgattcttagggtttccgcttccgcttctctgtcgagggtttttcgagctggattctctgctcctgcgccgctggtgcagcggctttgttgattgatctggatttctccgtcttcctttctattttattttctgtatctcgcacaatccaaacaaaaaagctagggctgaggatttgatttgcgtgatttctgggggtgtgttaattcgggggtgtgttctccgatttgg

SEQ ID NO: 9561 - DNA, 3000 bp, Unknown
  misc_feature (1)..( 3000): cDNA_ID_3042424_gDNA_ID_1972154_Annot_ID_179421 3000 nt of promoter + ATG
ggagttgtgggcacttttctaagccacttcttggtggtgcggatgctagtcaagagattgcagccaaaagagaagagaaagaaaaattcgcacttgagcatattgcaaaatgccagcactcttgtaaatagttttgtctgttatctctggtttgttctatacctatactagtcgcctgaattgacttcctacattttaccttgaccagctattagcaagctcaacaataatcctattgccaactgggatacaaggtttgaaacgggaacaaagacagccctccttcacccattctctcctattgtagttgctgcagacgagaatgaacggatcaggtatgcgagtttcatcagagcatcgttaaaattgaatgttagaacaacttcttgcattcaggttaaccctctgttaggaaaagtacagggtagttcccaatctattggattaggtctcggtttagtttagtcatttagaaaaagcttccctttgaaacttatcttaaactttgatgttctctcttgggacctctttttatcgagaagccttaactgcactaagtatttcactttatttctcttagagtgtggaactatgaggaagcaactcttctcaatggctttgacaatcatgattttcctgacaaaggaatttcaaagctctgcctcatcaatgaacttgacgactctctgctacttgttgcatcatgtaatgttcacaactcttgccaccaagtctttcagatgtttgcaagttgattgaatatgggtgttgagtaatggtatctatgtcttacacatgcttttgggatttgggtaggcgatgggtcggtccggatatggaaaaactatgcaactaagggtaaacaaaagcttgttactgggttttcttcaatccagggtcacaagcccggtgcccgtgacttgaacgctgtcgtggactggcaacaacagtccggttacctggtttgtgatttcttcaatcatgctatgcacgatatttcttcttagttttccaagttacgaagcctgatttattgttatttacgggttactggtatttaacagtatgcttctggggagacgtcaacagtcacactttgggacctggagaaagaacagcttgtcagatctgttccctctgaatcagaatgtggagttacagcacttgtaagtctgcatgaacaaccttctgtttaaaacatagaaatgctctaggatgtcatcatttgctacaatctgatgaatcgaagagatagtatgcataagctatcgtcttatagttctttttgttgttttggaagttcatggttatcatgcttttccttgatcaaaacatttttgaattacaaaacatgtgaattttgcttactttatgttatctttgtagtctgcttctcaagtgcacggaggccaactcgctgctggttttgctgatggatctttgagactctatgatgttcggtcacctgaaccgtaagttggtttaaactttaatgttcattctttaacagaactcctcaaaataatctaaaatgagagcaccaaaaaatatttttgaatacatcacttaatatcatttcttctattgaaggcttgtctgcgcgactcggcctcatcagaaagttgaaagggtggttggcctcagttttcaacctggacttgaccccgcaaaggttgcaaaccaaaattgatctatgaactgtcagctttcatacctttttttatagcatatattggttcgggtttgaagaatttcgtcttggtttggtttttaattctcaagagtttctcaactctttgtcgttttcctggggccaatatctattctgttcttatcttcaggtggtgagtgcatcacaggcgggtgacatacagtttcttgaccttagaacaacaagggacacatacctgacgattgatgcacacaggggttcactcacggccttagctgttcacagacacgctccaataatcgcgagtggatctgcaaaacagctcattaaagtattcagtcttcaaggggaacaactagggataatccgctactacccatccttcatggctcaaaagattggatcagtgagttgcctcacatttcatccgtaccaggttctgctagcagctggagctgctgactcatttgtctccatatacacccacgacaactcgcaagcaagatgagtcacaaccgtaagtgaatatgttgcatttagcattgctcttgtgataaaaagaaaagcataaatcagtgcaggtcgggtcggttttgggtcggggtaaagtgggtgtggtttatagtattcgttagcctccgtccaagataaaacaagatctaagttaacactaaagaaggaggcttcaccaaataagttatatctctacctatgcaacaacgcacgtaaatggtgtctgtaaatagtttccctgttttgcttttcattttctcatctcttgggtgtgtgatttcctttttattaatcttttaagtcattctgtttcctaatttgtttcatgtgtaaaaaaaatggtaaaagtaatggtggaagaaaatttgcattttcgtgacgatgctttgaaatgttgtctgttgtttgttcaagttgggatccgttggaaataggcttgcaatttttcatgctacgcatctctatgattggtcaaataccagtttatgtcagaatccaagtaattatcgaaaaatctgatcactcactaggatttctttggttatcaataaagagatgactaacaatcattaacaatcataatgaatgacgatctttatcattttggttaataacaaaatctacgaacaaaaatccgttaggacattttttactgacacgtgcaaagcaaagctctcccgcgtgcaacaaatgaaagctttttgtttcgatgactgttttactgacttgtgagttctgactgacgatgaaaaaaataaaaagttcctcaaggaggtgtaaagattattgtacggagaattaagcttcctttggag

SEQ ID NO: 9562 - DNA, 3000 bp, Unknown
  misc_feature (1)..( 3000): cDNA_ID_2183772_gDNA_ID_1972154_Annot_ID_179417 3000 nt of promoter + ATG
cggcgcagacagaagaggaaaccacatcggtcttaatttcaacaacctctcctccaatgtacaagaaccactcatttactacgacacagaggatcgaaaggaagattttcagctcgagagcggcgaaccaatccgagttcttatcgattacgacggatccagcgaaaccttaaacgttacaatctatccgacgagattagagtttaaacccaagaagcctctaatctcgcgacgagtttcagagctgtcggagattgtgaaggatgaaatgtacgtcggattcaccgccgcgactggaaaagaccagtcgagtgctcactatgtaatgggttggagtttttcaagctgcggagaaaatccaatggcggattggctcgagatctcgcggcttcctcctccacctcgcttgagtaacaagaaaggttacaattctcaagtcattgttttgattgttgctttatcgatcgtcacactggtcttgcttgtgttactatttatatttgtgatgtacaaaaggcgaatccaagaagaagatactctagaggattgggagattgattatcctcataggtttagatacagagatctctacttagcaacgaagaaattcaaagagagtgagattatcggtactggaggatttggaatcgtttacagaggaaatctatcttcttcgggtccaatcgcagtgaagaagataacctcaaatagcttacaaggtgttcgagaatttatggcagagatcgagagtttaggaagattaggtcataagaacctcgtgaatcttcaaggatggtgcaaacacaagaacgagctcttgttaatttacgattatatacccaacggaagtctcgactcgttgctgtaccaaacgccgagaagaaacggcatcgtgttgccgtgggacgtgcgtttcgagatcataaagggaatcgcgtcgggactgttgtaccttcatgaggaatgggaacagatcgtggttcatagagacgtgaaaccgagcaatgttcttattgatgaagatatgaacgctaaattaggcgattttggactcgcgaggctttatgaacgcggaacgttaacgcagaccacgaaaatcgttggcactttagggtacatggcgcctgagctcacacgtaacggtaaaggctcaaccgcgtctgacgttttcgcgtttggcgttttgttgttagaaatagtgtgtgggaataaaccaacgaatgcagagaacttcttcttagctgattgggtaatggaatttcatactaatggtggaatcctttgcgtcgtggatcagaatctcgggtctagtttcaatggcagagaggctaaactagctcttgttgtggggttactatgttgccatcagaaaccaaaatttaggccatcgatgagaatggtgcttagatatttgaatggtgaagagaatgttccacagattgatgaaaattggggattctcggattcttcgagagacgatcataaatcgaatgttgtaggttatgtttcgtctgatagagcctcgagctcgaatactttttcgtctttctccaatgtttcttcaagctctatcgttagtggtagatagtttcatagcacttttagcatagcttatttattttctagaaacagaacattttgtatgtttttactatttatgctaagaaggaactaaatgtatgacgtgtgtgtcgattatgtcttattatggaccagtgaacccattacccatattactaagtgaatgatagatacaacttgtacaatacaagggttcattgtttccagctttattaggtacaatattatttttgcattactaaaaacagacttttcttttgtctaaacatttttttgtaaattataacataaaatgcaaatagcaaacaaaatatattttcttattccaatgcaaacaaaatatctttcttattccgttttagtttgcttttgttatcaactcaagactttgatcggtgacttaaaacaaatgttaaaaagacgatccaatccctcatatatgattgaaaactttgatacaaaatgagattgacagaagataagactaacaggtccgttctagattctttccaaacgtaacagcatgattggatcattttaagcaatttcaagtggagaaaatagaaaaatattgtgtgttgcccaattatttcaatcaacaattcaaaattattatgatatgggcttggtaggttgatggtttcactttcataacacaacgacaagtgaactacgaacctatgcctcagtttgtgtccaggttcatgatggacatgcctataattagaaacgtgtattgaaagaaagcgtctaaactttgcaattggctacagaagttttaaaacaatgattgcgttgtgaacattactgaattttcataacaactcaaaccattttttacaaatattacgacacagttgttttgttactgtgatatctgttgtttctatgctttaaaatttaaataaacaactgtgattcgttgtatagaaccgtgtatcagactatcactatcctacaagttaattaattacgccaaaaacaagttaattacgccaatcaaactaaagaaaactataataatagcgtgactctatggtttggtactttggttaatgtgctgcttacttgctcatcttatctatgattagaatatttacttaataagtggagttttaaactgtatttctcatgtattttagtgaatctcatattaacttattaggttatactttttgataaataatttaggttagacttaggtaagataagtacgtattaaactgggatgaagataaaacaatgccaaaacaaacggacacgcttcagctgatgatagatttaattttgccaatagtataaaccagttacgcctttttatagaacaactctgccatacttgataattcatacactctatctcttctctctctcaatctctcaaaagatctccggtaacgttttaacgtcggtgaaaaa

SEQ ID NO: 9563 - DNA, 3000 bp, Unknown
  misc_feature (1)..( 3000): cDNA_ID_3042446_gDNA_ID_1972154_Annot_ID_179406 3000 nt of promoter + ATG
ctgtcatactcttgacggtcgatctcttcatcacagatggaactccagaactcaattgcttggagggcaacgctctcttcatctccctttacagcattcgatgtgagctcaaagagtgtttgtatgtagtgctccagcacctcatagtatgtggatgcaatggacacaaggcactcgaaagcagcttgcctgatctctgcctccttggaacatgctgtctcgcataccatcttcatgatgtaattcctctccatttcattctcaaaatttgtctgagagaaatccaaggcatttaacagtgcctttgttgctgcgagacgaacttcagcagtattttcagactggttcatgccctgcacaactgctgtgaggacagaattcacttcatcttgcacaagatcatggtgtgatatctcttcacagacatagcctagagtttccaaggttgattgcttcaagtgtgcgggactgccttgctgagtcatattgttaagcagcgatccaacaagttcaggccactgcttctgaggaatttcaatggaggctaccttagcaataacctgagctgaagtatgccttgcctctagggcagatgaaccaagagttcttagtaagcgatccttgatctgggatttaagagcaacatcaattgcaaaccattgtttcaccagatgatcttttgtggcagaatctttggcgtccagagaattctttagcagaataccggctagtcgacgggattcagcaggtttatcattgttttcaagctcaaaagacaaggataacaagaacagcggcaagttttgttcttggaactgtctgagactagcctctgcttcagtacggactcttgcatcggctgactgggcagccagaaggaactgtgtgatctccatagccattcttctctctgcacaataaagacatacaccagtatcagcgacaaaacagtagtcaaatagaatcacatccagcacaattctaagcaaaagtaaaagctactgaacaaagtaatggtatgagtatagaaggcaataatactattcaaaccgtacaaaggttcaatccagagagcaaacaaattaatatctatactcagagaaaaccataggagaatctctgctctgagtaattaacaaaaaaatcactacaaacaaattccagtataaaatccgaaccaaagttgactcaacaatgtctttgaacttcgaaaaaagcttaaaccctaatcgtgaagaacacagcgagcgagtaaagaaccaaattaaaatcccagcaaaattaaaaaccctagcagtagtagtgacccaataacctaatcagaaaacatagatccagtaacagatatgcaaatcccgaactcaatacacactacaagcaatagacttacgtggaaattaaggattttttcgcttgagaagacgcgtaaacgctagggtttttcgcttcaatccaaaccctgtgtccctgtcactgcaaagcctatcgagaaaaagcttctccaagacggcgctcgaagcaggggaaaaacctctggtggatcagaaaaaccctagacttgcagagagaaaaagagtcgactgtgtggaaaggaggcagagataatgaggagactgagagaggtgaatgtgaatttcgaatataaggaaggagcgggtggggaagggcaaagcagaagcttaaaactattttatttctaaaatcaccccattaacaattctttattctacgtaacccccttatatttgccaataatttttatttgttacctcgacttcaaaattagaatccagttttggcaaaaaaaatactaaaatccagattaattaaccaagattacaaaaacaaatttaagtttactttagtagtttgtttgtttcataattcaaatttaagtttttctaaagtagtgtggatgtatttagttatgtataatgtatttgaggtttcaaacttaaatgttcatttacttggacccatgactggttatgatacagttcattcacctaaggttgtgccaaaatgaataagcttgcaaatagacgatggttataaatttggataaaagagttatttactcatttgatgtataacaaacaaataacaaaaagtcccaaagtgtgtcgaataattatggtaaacaaaggttatttcagatacaaatacaaagtctatggggtgatttaggaataaagtgtttttagcttttgagccttgcccttccacagttccacacccgcttcttctctgtattcgaaattgaaatttcttttctcatatctctctctccttcgacagtttcaagtacagactctctctctgtctctgcaaactctagggtttggtttttgctcttcttcgagaagctttttgtggatagaatctgcagtgagagggacgtggtgtttaaattgaagcgaaaaaccctagcgtttacgcaaaccttaatttccaggtaaatctcttgcttgaactgtgtattgatctctggatttgtatatctgtttatagatctatgctttcggattaggttttgggtcactagtactgcagggtttttaactttagttttttactcgctcgctgtgattctgccacttatttgtctctcttccttcttagaaattgaactcgtgttcttcacgactaggagaaaaagctttttccgaatttcatagaaaacgctgggtcatctttggttcggatttcatattgggtttgttttcaatgatttttgttgtcaattacaccaagcagagattctcatataattttctcggagtatggatatatttgctcataatgttcaaatgctcttgtttgtaccatctgattgaacttgttgaccgtttgtatagtattattgccttttatacttgtaccattactttgttcagtagctttccctttttttttagaattgtgctgattttgttctattaacccctctttttttttgctgattatggtgaatgtccttgttgcgcagagaccagaatg

SEQ ID NO: 9564 - DNA, 3000 bp, Unknown
  misc_feature (1)..( 3000): cDNA_ID_3042442_gDNA_ID_1972154_Annot_ID_179407 3000 nt of promoter + ATG
aggactgtcatactcttgacggtcgatctcttcatcacagatggaactccagaactcaattgcttggagggaaacgctctcttcatctccctttacagcattcgatgtgagctcaaagagtgtttgtatgtagtgctccagcacctcatagtatgtggatgcaatggacacaaggcactcgaaagcagcttgcctgatctctgcctccttggaacatgctgtctcgcataccatcttcatgatgtaattcctctccatttcattctcaaaatttgtctgagagaaatccaaggcattaacagtgcctttgttgctgcgagacgaacttcagcagtattttcagactggttcatgccctgcacaactgctgtgaggacagaattcacttcatcttgcacaagatcatggtgtgatatctcttcacagacatagcctagagtttccaaggttgattgcttcaagtgtgcgggactgccttgctgagtcatattgttaagcagcgatccaacaagttcaggccactgcttctgaggaatttcaatggaggctaccttagcaataacctgagctgaagtatgccttgcctctagggcagatgaaccaagagttcttagtaagcgatccttgatctgggatttaagagcaacatcaattgcaaaccattgtttcaccagatgatcttttgtggcagaatctttggcgtccagagaattctttagcagaataccggctagtcgacgggattcagcaggtttatcattgttggcaagctcaaaagacaaggatactaagaacagcggcaagttctgttcttggaattgcctgagattaccctctgcttcagtccggactcttgcatcggctgactgggcagccaacagaaactgtgtgatctccatcgccattctggtctctgcgcaacaaggacattcaccataatcagcaaaaaaaaagaggggttaatagaacaaaatcagcacaattctaaaaaaaaagggaaagctactgaacaaagtaatggtacaagtataaaaggcaataatactatacaaacggtcaacaagttcaatcagatggtacaaacaagagcatttgaacattatgagcaaatatatccatactccgagaaaattatatgagaatctctgcttggtgtaattgacaacaaaaatcattgaaaacaaacccaatatgaaatccgaaccaaagatgacccagcgttttctatgaaattcggaaaaagctttttctcctagtcgtgaagaacacgagttcaatttctaagaaggaagagagacaaataagtggcagaatcacagcgagcgagtaaaaaactaaagttaaaaaccctgcagtactagtgacccaaaacctaatccgaaagcatagatctataaacagatatacaaatccagagatcaatacacagttcaagcaagagatttacctggaaattaaggtttgcgtaaacgctagggtttttcgcttcaatttaaacaccacgtccctctcactgcagattctatccacaaaaagcttctcgaagaagagcaaaaaccaaaccctagagtttgcagagacagagagagagtctgtacttgaaactgtcgaaggagagagagatatgagaaaagaaatttcaatttcgaatacagagaagaagcgggtgtggaactgtggaagggcaaggctcaaaagctaaaaacactttattcctaaatcaccccatagactttgtatttgtatctgaaataacctttgtttaccataattattcgacacactttgggactttttgttatttgtttgttatacatcaaatgagtaaataactcttttatccaaatttataaccatcgtctatttgcaagcttattcattttggcacaaccttaggtgaatgaactgtatcataaccagtcatgggtccaagtaaatgaacatttaagtttgaaacctcaaatacattatacataactaaatacatccacactactttagaaaaacttaaatttgaattatgaaacaaacaaactactaaagtaaacttaaatttgtttttgtaatcttggttaattaatctggattttagtattttttttgccaaaactggattctaattttgaagtcgaggtaacaaataaaaattattggcaaatataagggggttacgtagaataaagaattgttaatggggtgattttagaaataaaatagttttaagcttctgctttgcccttccccacccgctccttccttatattcgaaattcacattcacctctctcagtctcctcattatctctgcctcctttccacacagtcgactctttttctctctgcaagtctagggtttttctgatccaccagaggtttttcccctgcttcgagcgccgtcttggagaagctttttctcgataggctttgcagtgacagggacacagggtttggattgaagcgaaaaaccctagcgtttacgcgtcttctcaagcgaaaaaatccttaatttccacgtaagtctattgcttgtagtgtgtattgagttcgggatttgcatatctgttactggatctatgttttctgattaggttattgggtcactactactgctagggtttttaattttgctgggattttaatttggttctttactcgctcgctgtgttcttcacgattagggtttaagcttttttcgaagttcaaagacattgttgagtcaactttggttcggattttatactggaatttgtttgtagtgatttttttgttaattactcagagcagagattctcctatggttttctctgagtatagatattaatttgtttgctctctggattgaacctttgtacggtttgaatagtattattgccttctatactcataccattactttgttcagtagcttttacttttgcttagaattgtgctggatgtgattctatttgactactgttttgtcgctgatactggtgtatgtctttattgtgcagagagaaga

SEQ ID NO: 9565 - DNA, 3000 bp, Unknown
  misc_feature (1)..( 3000): cDNA_ID_3042438_gDNA_ID_1972154_Annot_ID_179408 3000 nt of promoter + ATG
tcttttcacggtatgaccattgttctttcatgttgagaagtgcattgtttgctttgaaaggatttaatctgtcttatattgttgattcttcattgactaacacaaactctcaacagatgagatgcatggcaagatataattctgtatccattgaagtaaatagatgtttgatttatacatttcagtaaaaaaaatctgataactaattgttctctcaaatatttctagatatttggtggtgttggtattgcatgtctaccattaggacttatcactgcattcatcaggcgaccaaaggctgttatcactcgatcacaatatataaaggtctggttattgttctcctctggaagcatctctctagatcttgagtcaatccctctgtctcttgcatgattaactccataaatatattacaggaggcaaccgaactaggtaaaaaggcaagagaactaaagaaagcagctgatggacttcatcaggaagaaagaagtggtgctaagggcaggaaatggcggaaaaatgtgaaagcagttgaaaaggtacctcatatatctcaaggttcagtatcttatctaaattttgtttcataagtagcaacttggaaagtttgcctattcatactggtcccttgtgtgtaaagaggctttggtcgtctgtggagttatgagaatgacaacttgtagtgaaaagctagtgagatagtagaattggttattgactttattggtagcttttctttgcttggttgtggatttaagctgtgtcccctcaatcctataattgaatgtggtaaccctgcaggagttgctccaattggaggaagatgtgaacctcttagaagagatgtatcctcaaggagagcaggtaagacgagtgtatcttagaacttatactataatatttttcttgttcaactattttattccctggtacctttttccaggcagaaactgcatgggctttcactgtgctcggatacttggccaagtttattcttggaatcgtagggttagtacatctaagcagaaacctcctttgcatttttttttgttacatgttgtataaatcatgcataatgcatacagttcttgcatatttaggtttgcactcttaagctcccgagctaagcgtctttttaaatggcaaatttttaatgtctttgtagattgatcgtttccattgcttgggttgcacacatcatcatatatctactcgtcgaccctcctctctccccttttcttaacgaggttttcattaagcttgatgatgtttggggtaagttcatacttttgtccttgttatcctgtataaggtttcttctttgtttctaactgactccatgctggtacgtgtggaaatctccaggtcttttaggcactgctgcctttgctttcttctgtttctaccttctacttgctgttatcgctggggcaatgatgctgggtttgaagctggtcttcattaccattcatccaatgaagtaatccatctaaccggtttcaacattatttggctattttccaaggtcattcattaccttctcttgattgctgattggccatatcaacttatttcagatggggagctactctaatgaactctttcctcttcaatgtcggcctcattcttctttgttcaatcaggtaagtctctctggtctcttcttctgcctttgtatctgttgggatcaagtgcactctgataaacggatctagatcaagcatgtttatgtgcatacattaacttatcagtgttttcatgccatcactaaaactaatttcctttccggcgaatgcctgaatcgaagtttatagttactttactcatgcacttgggtatcctttgtactctattagatgtcaaaccaagacttttaatatacagctgctaccctcacaattacatgttaatcctcacagtctgagtaatgtggttcatttaaaatgcagcgtgattcaattttgtgccactgcatttggatattacgctcaagccactgctgcccaggagatatttggccacacattgcagtcccttagaggaattaagtacctttacaagtaagtagaagtggtataacatatagcagtcatatgctatatccgtgatgcgtcttattgaggttttatatttcaggtacaatgtgttccaaatcgggtttgttatcctggctggactgactttcctatattacattgcctttgtaagtcctcgttgatgttactcctcgggttttctcttctgtattaagtatttgtagaatcatatggtctttggtgttttggcagggatggagaagaaaaaaaactagtggccgtttccagctctcttcttaatgtaaaacgttttcacggggatctgattgagtgctgtcgacaaagtttctacttgtttctggatcatcatcgattccagaagtatctagagactctgcttctgaggtttattttcctgaatgtattattaaatttcttgtgagtgtgctgtttggttgcgcaacagttagctgtcctgtcttggtctattgtactgtctcggatgcgatcatgtaatcatattttcttaatgagaagccttcttcgaatttttacaagacagagacttcctttgtggtttgagacaattgtaaccgaacctaaccggattatcaatattcttgaatttgtttagtatgcaaggcatacaactatacaagtggacatgtgctgctgaagtgacaagtggcgttgctatgcgattcgtcaatagcttcttttgcccaatcagcttgcttgcctcatctaactctaaaagacagacaggatagataacgcgagctttttatagataaggctgattttgtttcctaccgtcagatggatttgtttctccatctaaccgtcaagattcgttctctgagatctctcccacacacataccgccacttaaaaacgccatttgcttcagataagttacaaaccgcaaacgcgacagaactaactaacgacgccggagatg

SEQ ID NO: 9566 - DNA, 3000 bp, Unknown
  misc_feature (1)..( 3000): cDNA_ID_2183718_gDNA_ID_1972154_Annot_ID_179404 3000 nt of promoter + ATG
tttgacgatctgaaggcaccaatgatacaaacaggagtgttctccccacaaatggagtcaaaatttggtcttgacagaagaggtatcttttctgaggactcgttaggggcttggcccgcctgactcttagaagagaccttcttgttcttcttctctaatccttcaagcaatttaccaagttcctggacagctgatttcagatttttcacagtgatacctgttttcaagacttgcttctccccattcgataaccaaccaactattgccggaaacttgtctacccccaacttttgtatctttggatcagaagtatcatggacctacaagatcatgagaaaaaaatactttagctaaaaagatttcatgtctaaggaattctaataattaagttcaaatttgctgactcgtcattaaacgtggaccagggaaccaccccataatttctacgaccatcagactctcgcagtaacaataattgtaggaatagtgatgtaagtggaaattaaagccaaaatataacaaacctctgtgttgtaaaagacaaatcgtccattgtacaagccacttagaacccgccagatgacaggagtgtctttctttgttgacagaagcaaaactttaggagtcttttgtgagctaacggcagatacatcgaatgtattcagatcaatcttttttgagaatctcggtagatgttcctggcagaagcttttcaccttctttgcaacaagctcttcagtatattctgctaaggtagctttgccacttgatgtgtatgaataaacaaacatccttggagccctacgaggaactatgcctagttgtttgcaaagagaggattctgtttcacaatttaatcgcccaacctgtaaacataaagttaaatcacgtaaacaacaaaagaaactacacttcttcttttaagaacgaaacagaaaacccaaaatcaactaacttgacaagcatatgttttacctttaaagctccttgcaacgactcagcaacttcctctatgatggattcatggtactggcttcccctctgagatggaagatacgacaacaaaagccaagtcatcccttggtccacaacgtccttcttatagacctgagagttaatggttttgatagctgctacagtactgctctttgatttagattcagcattcgatgagctaccaaagccaccaaactgctcctttcctttagaactaccgcccgaaaacatggaaaagatatcatccataccaaaaccaaaggagctttcactaggaccgccaaacgagaaagaaaacgatttggaacctcccccaccgcccatattttgccaaccaccaggccctccaaagttgaaaccaccaccacttgaggagtaagaatacccaccattacctccgggaaaccccgaatcaaatccaggctgtcctttctcatctccataaagatcatagtttttcctcttctcttcatcagataagatctcatacgctgttacacatagataagggtttaaacttgtcaaagccagatcaacaaaaattcaatttgtgccacaaacacatggccatagaacaagaataatcttataatatactaaaagattcgattacaggacacatctcctagggaaatttgatacctaccattattaatctcagcaaacttctcctgagcacccttatctttgtttttatctggatgatatttcagagattgcctgccaaaaaaaatcacaagctacatgagtaaactatttgttgatcatcattcgaattattagcttaatcagcgactagaaacgaagggtgcttacttgtggaaagctttctggatttcacgctgctttgcatccttagatactccaagaacctgaagatgcattcattagttaataatgtttataatcaatagcaaaaactactgagcaaaacctaatatatcaaaaatccttcttttctataacacccacaaatttgtcagcccaaacttcaatgagaaaggggacaatcaaaagtaatcattatttccggccccaatcaaaagacttgtgaatggaaagaaaacaagatgaatcacaaaccgtaccttgtaaggatcaacgctcttcgctttcacattcaacaacaacaatgtcgacacaagaacaacagatatcgccaatcttgttctcaccatcccgaaagtacaacctctcaatctttttctcttttattgttttgttgtcaacgaatcttcttcttcctcttctaagcgtgtcttattcacgaaactcaacgcttcgagaaaaatcgagaaggacatcattaaataggttcgcagggtttaaaggaaaaaaaggaaatttctcgaatgacatatatattttaattaatttagagtattccccatatttaatagtcttacaaaagacaccaaaattgtcaattggattaagaaattggtaggggcaattactcacttcaaaaactagcaggggttgtttcgtatttcctgaaaataaattccggttgcttcccgttctcaatttaaggcgggtatcatacgtggcaaatttgatgcaatcccacgtatctccaccaataagattttagcaaacacgagcgatcgttgtttatttgcgttcacgcgccgttaagatcacgcgcgattattaatttgggcttatttattataggcccaataatctgtagttagcccaaaacgaaagtctccggttgggtgatcggaatccgatcagagcgacggtaagtatttcttttttcttcgactgttaaaaaaaaaagaggaaatcattttcactagtgacattgttacgtttcaagagcttaagagaagttgaaagacggaggaagaagaagacgatctttcttctcttctctgtctctactagcttcgcgttttccttccttcgccgtgagattttatcgtcgtcgtaacaaacctctagggttcatcctcgacgtttccttggttaattaggtcaacaatatcgtcggatctg

SEQ ID NO: 9567 - DNA, 3000 bp, Unknown
  misc_feature (1)..( 3000): cDNA_ID_3042522_gDNA_ID_1972155_Annot_ID_179440 3000 nt of promoter + ATG
ttataatttaaaagtaattttgatgcctttactaaaatcatagaaagtaaataaattataaacaagtgctaaagagtttttataatcttgttattagttattctataatttagtgaagtttctcaaacaatatatctatttgatgattttttcatgattttattttgtgaagaaaaatgtataaaattataaactaataacacaatagtttaattcattaacaatcatacattttttttaattaaacaacacaaaaaatttattgactttattaaattttgattctaataaaatcagatttatgaaaattttaaaagacttttaatttacaaatcaaaaactaataatacattttaacagaaattaataaagttttgattgaataacaagagtcaaaagatctactaaagtttttaaaacaatatttcaatcacaaaccattttaggtgattttatttattttaatataatttctttctataggcagtagtgtggaccataaaattactgttaatttacttcctaaaaaggattatttaattgcaagattctaaactggattattcccacaatacacctttgtaaataaaaaccattaatccttcacaaatacagagtcgtgaacttaacgtctctctctattcctctgcttctctctttctccctgtgaaaaaatggactcggtggctctctactgcaccgctggtctcattgccggcgccgtctactggttcatatgcgtcctaggtccagcagaacgaaaaggcaaacgagcctctgatctctccggcggctcaatctccgcagaaaaagtcaaagacaactataaccaatactggtctttcttccgcaaaccaaaagagatcgaatcagccgagaaagtacctgacttcgtcgacacgttctacaatcttgtcactgatatctacgagtggggatggggacaatctttccatttctctcctcatgtccctggaaaatccgacaaagacgccacaagaatccacgaagaaatggccgtcgatctcatcaaagtgaaaccgggacaaaagattcttgacgctggttgcggcgtgggtgggccgatgagagccatcgcggcccattccaaggcccaagtcactggaatcactatcaacgagtaccaagtgcaacgagccaagcttcacaacaagaaagctggacttgattctctctgcaacgtcgtttgtggtaactttttaaagatgccgttcgatgaaaacacgtttgacggagcttactcgatcgaagctacgtgtcacgctcctaagctcgaagaagtatactcggagatcttcagagtgatgaaaccaggatctttgttcgtgtcctacgaatgggtcaccactgaaaaatacagagacgatgacgaagaacacaaggacgtgattcaagggatcgagagaggagacgcacttcctggactaagaagctacgctgatatagccgtgacggcgaagaaagttgggtttgaggtagtgaaggagaaagatttggctaaaccaccgtctaaaccgtggtggaaccggttaaagatgggaaggattgcttattggagaaaccatgttgtggttgtgattctttctgctattggggttgctcctaaaggaactgttgatgttcataagatgttgtttaagactgctgattatttgaccagaggtggtgagactggaatcttctctccgatgcatatgattctctgtagaaaaccagagaaagcttctgaatgaatgattgagaatcttcttccttgttctcgtttttcttcttctttctttctaagttcatgttttgccccttaagaatctctttgtcgtcgtattaatgttatcactttgttgtttattgtatttttttttttcaatttgatttgtttaaattgatgatggatcactggaaattagtttttcgctcttcttaaatagtttctgaaagaattagccgggaaattctattggagtgatcctttacctttttaaaattttgtagagtttacaagtctctgtttagttttaatttctaagatcaaactcggaataaaccggattagcacgtctatagagttgcataaacttttagtatcatcaatgagggtagtttggtaagtccttaggtgtcacattgtgtctgtagtagtgagtcgggagtggtcgtgtgggattttgtgggctgtccgatatgcatatgttattgtcgtcaactgtctgatatattaatctatgtatcttttaaagatttgattttgatttattttaggcttatggtttgtcgcattgcggtagtgggtagcagcgtggtcgcacgaactccggcttaccttagaaaacgatattttatttagttatttagtttttttttttccaatttgttttgtgcattactaaaaagattgtgtcatttgtgtgtaaaagtttactaaaacactgggtcatttctatagtgggcttttataatgatgggcttaaggccaatttttattggtttacctcacttccagttccaccgggagtggatatatgcttatattcgtacgtgacatcaacaataatacgcgtatacatgtgtaagtcaatggacaatttgggtcgaagctgagaaaattgtccaaactatgagagctgacgcaatcttttgttttcttttggccgatacattttccgcttaccagatggaaaagaaaccacaatgtcgaatttatccaaccggttcaattagtcttacttggatgctggtggaattttccagaatgacaacaacttgaacaaaataaacttgaattgcttttagaaacagcaatctcaccaagttcacatattccttttatattcccacgaaaaaaatctaatcaacagtgaacacaatccacacaagttaaacaagtggacataaaagtcttggacccattttaaaacatctatccacattaaatcattcactgatctctaaccaatcccacacacactaccacaaacaatg

SEQ ID NO: 9568 - DNA, 3000 bp, Unknown
  misc_feature (1)..( 3000): cDNA_ID_3042490_gDNA_ID_1972155_Annot_ID_179465 3000 nt of promoter + ATG
catgagaaaataatggattaacaaaataataataataatataacagaaacaaattactcgatgttaaaatgctagttttactagactacttatattatcatgttaaaatcactttttcaaacatgaaatgtcaaaatgttctaaaatgttatgaataatatcaactcaataaacgtaaattgatactcaacaaaagtttataccaatgtatatatatatttataatacttaatgccatactgcgcattaaccatttacttgataaaaaatacacgaaaaagcttacggattcacatcatcaccacgccacacattagcatcatcatgccacgcattagccatttcgtaaaattattaccataaattaaaaaaatacaagaaaaaacagaatacctttttccatacaaacaatatactatgtgaatttacaagctgtcagattaatcaagatcttctttatcaggaaacgtgggtccggataaggtaaggggtcaatttcagtctcggactagtcggctacaaaatcttgcgagttgctaaacaatagaaatttcaaagataatcataacttcaatctcaacctaacagtctcatactattaactatagaacccgaatcgagaaagaggcaataactcatagtattaacaaatatagtcaacaattaattgctatcacacccatatcttagagacatccgttaatacctttagaagcgtcatttttgaccgcaattttgttataaagtaacgaggaaataaaaaagaatatcatattggatgggattgtgacaacatcaaataccaaacccatcatcaaacaaaaaatcccttcacatgagtaacgtacggatcaagaaacggttacaccaaccctaaacctctccaactaaacggaggtccccgctcctgatcactttcttatccttaattatatattcccgaattttatgcacttaaaaatttaatgtaatactccaacatttaattaattgaaagttagtgaaaagaatttataaggtaaggaagttcaaaagagtcgataaattaccttaatgccattgggcgaattcataggtgtgaggactcgaaccatcggctcagtctcattgattggcttaggctcaaagatacgaacccaagcaagtcttggtgcgtccttaagtaaccgaagtttgaaagaatttttgtcgagaggactattaagaaacaaatcagcattaggataaaccctcaagatcttctccataatcgacggtccggttaactcaaaccgcctcgctcctcctaccaaacacaccgcaatcttcgacttaaccaactcctccctcttcctccgccgtcgattttccatctcctccgcttggataacgtcgttagggttcgaatctgacaattcgacggtgaaatcggtgacggttagggtatgagtgtagattaggttacgaagaggggctagagttggaaaaggatcaagtgagagagatgagaaagagattaagacgaggagggtgagagatgggattatgagaaggaggagaagacgacgatcgacgtcggagattctcctggaaacgtacataacggcggcgtaagtgatcgtaaccctaatctgtgagaataaccaccaccgtggattgttcacacacgtttcatttgccgagagagagatttttgtatttatagagttttgattttcttcaaaacttttgaagtgattcggagaggcgctggtttgttggagtggaaggtgaaatcaacattacgcgtgggtttggttttcgttttctcttttcttctagagagagatatgaaatatctatgtagctctgtataaaaccgatgcataattaattaaaatatacgtatttgattacgttttcaaaaaggaaatgatcaatgttacttttgtttttttcacgtttctttgtttgcttagtaaataatttatgaatgtttgaaatactttggtgaatagttttagtgctcgatcgttacagtaatcaattcgaataaactcttcactaaatatgctcgttacagtcttcacgtttattgtaactgttagacccccactcattgtgtattaggggatgttgacaagtatattgaagagattgatatcttgaaaggcgtacgtggactagtaaagaaatggatagtttgggttgcaagaaaagttttactttttgtattcaacaaaaggaaaagaaaagtattttttgttatccaagatatgactttatgtagtatattcatttgagagcattgtattaattagaatgttcacatatatcaatatataattatatatagaatttgctcttcaattgtaaagaagaaatgaggttccaaatttgttattagtgctctaaacatatatttttattaccttagaaattaatatataatatttctttctttgctttcccatgactttttactgtttttggtaacaagataatactttccctagtatataagatttttaaagcttttttgttgttgttcccaattagtttttctctagtttctagtcataatttatattaattccatagtttatgattatttaaattatgcagtattttttattggttaaatttttattaatgataaaacatgtgattttagccaaaacatctaataaaatgggacatatggagtactacaatagtgatagatcttttatttacctgtttattatatatgaatctattcaattttcatttatttacatgtttatttaaattatttatttaatttgcatctaaaatttgcaaaactattgttgggccatgagtgtcaactgtcaaatgtcaaccatagaagcaaaaataaaacagtttatgattcagtttgtaaaagtgggcttatttaaatgaatattggcccattagtatcatcttcacgaaacccagcaaaatcagagagcggcaaatcgttgaagagagatcttcttcttcctgaatccgtaacgttagctcaggcgtaagagcata

SEQ ID NO: 9569 - DNA, 3000 bp, Unknown
  misc_feature (1)..( 3000): cDNA_ID_3019521_gDNA_ID_1972155_Annot_ID_179467 3000 nt of promoter + ATG
tataaatactccacaatttttatatgattttagtagctcaatagagaataacaatagaaaagaaatggaaggaacaatgaggtgctcagcgaattacgtcccgctttctccgatcagctttctcgagagagctgctgtcgtcttcggctccagaacctctgtcgtgtatggtgatattcagtacacgtggcaccaaacacgtgaccgttgcgtccgccttgcatctgctctctctgaccttggtctctctcgccatgacgttgtaagtggttaaacgacttttatatattggtcatacttttttcttttgtttaaactatttcttttatcaggtggctgctttagcgccaaatgttcctgcgttatgcgagctttattttggagctccgatggctggagcagtactttgcgtgttgaacacgacattcgattctcagatgcttgcgatggcgctggagaaaacgaagccaaaagtattcttcgttgactctgagttcctctctgtcgctgaagaatctctcagtctcctctcaaacattgaagaaaaacctctcatcatcacaatcacagaaaatccaacagagcaatcaaaatatgaacaatacgaggattttctctccactggaaaccctaatttcaaaccaatacgaccagttgacgaatgtgatccaatcgccctcaacttcacatctggaaccacatcgactcccaaatgtgtcgtctatagtcatcgcggtgcctatctgaacgcaactgctgttggtgttatgaatgagatgaaaccaatgccggtttatctatgtacagttcctatgtatcattgtagcgggtggtgctatatttggacagttacggcttttggaggagtcatcgtctgtctcagggaagtcaacgacgaagttatatttgatagtatcgtgaagcacaaggtaactaactttggtggctcgcctccggttctcaacatgattgctaatgcaagagactcggtcaagaagtcgtttccatggaccgtacaggttatgagcggaggatcctctcctcctgaggtaaaactaactatcacagagttttgaattacatgtttgttcaatcaggcttatttggttgaacttccatattttgaggttatatataatcaatcccttgctttatacgttagctccgtcacagtacattaatatttaacatagaatcatagtaaagatattaatttatttggacaggtcatgttgaaactcaagaagctaggattcaaagtgatgatggcttatggatgctcggaggtgtatggactaggaacagcttgtttgtggatgcccgagtgggagactctacctgaagaggagagtttaaggctcaaggcaagagatggtctcaaccatttcgccaaggaagctgtcgatgtattggacccaaccaccatgaaatcggttccacacgacggaaagactatcagggtaattgctctccggggaaatacagtcatgagcggttacttcaaggacaaggaagccactgaagcggcttttcgaggtggatggtactggagtcgcgacatgggtgttatagatcctgatgggtaagtaaatgaatcatgcattactttgaatgtattactttgaatttatttatgcttatgatgtttccacatgcgaagctacatacaatttaaagataggtcacaagatgttataacatgcggaggagaaatcgtgggatcaaaggagatcgaagggattctctatagtcacccggcggtttatgacgcaggggtcgtgggtcgaccggacgaaactttaggagaatcgatgtgtgctttcgtgaagctcaaagaaggagctgaagcgagagaggaagagatcattgagttctgcaagagaaagcttgggaataagaacatgaagatgattccaaagacagtagtcttctcggatgttcctaagactcccactgggaagattcgaaagaatgttctgagaaagatggccaaggatatgggttatgttcaattgagagctgtggagtaaatgaaatgataatttatcaatgcatctaataaagttataaaaaaaaaaaaaagtgtaaactttaagctttagtttatatgttctgatgttctatgttattttgacatttataaaaaataatgaagtctcatttctagtagactgatcttaacataagacaaaaatatatatatcagtagatgataatgggtatgactcggcaagtattattctcttgatactattatgtagtttcattgtttaagcacactgatagtttaatactattatgtcgtttcattgtttaagcacactgatagtttgatatttttgtatcaggtgctgttgattgaattatgtttttttttgttcttgatttactttttattggggtagtattcatgatgattaatggagactatgttatgtatataatgttagaaacctggaaatatctttcacaagttttcacctttaagcaattcattttgatagaaaaataaatattatgagattaatctttcttccatggatcaaggcaagctaatagctatcatacaaacttataccagcccagatcaaattaaaccggagagaaattggaatgcccaatcagaaatgcataaatgggccaaatgtgaagaatacggcccaataattgttttttccatcagaatgataaacctgaaatgttttcttttcggcaagcttctctcctcttctaacatggtcgcatctgctagaaccagatacacataattgaaacgagtttcgataaatggaaatgttcgcttactgatttagagtttagatttttagtttgtgaagtaagttttcgccttttctaatctcgaagaacctcagaatcgagcctggaaagccatgtacagagctctgtaagttgttttggcaatttttttttttttttttgtgttgcctactatttcaataaatgttcattgacttgcttcgtgtttgtgcaatgaagatg

SEQ ID NO: 9570 - DNA, 3000 bp, Unknown
  misc_feature (1)..( 3000): cDNA_ID_2037860_gDNA_ID_1972155_Annot_ID_179466 3000 nt of promoter + ATG
cctatgaactgctcttttccttatttggtaatgtaaatgcaccatatgaagagggcaacatgttgtcccaagtagactgttgtaaaaggattaacgctatagaaatggacatgatgagaaatggttttcagcacagtcctatctcaaggctgaatgtggttagtttctgctccatatagataggtcttgacctgttttaagcagattaatcaaatgtaatattaatctggaaaatcccttttaaggcgatactatcaatctttacttcttcattgtgtatgtttgtgttatatatcagaacaatggacttatcgtttacactttcctttttctttcccagcttagagctctcggagctgaaggtatggtgaatgagatgatccgacacctgcaaaaggctgagaacctcagtgctcacagcaatatgtatctaggaacgcctacatacaacatagtgcttcattcacttctcgaggcaaacgaagtaagttttcatggtctaatagctttatcaaatttccactggaccagcatatatagcaatattgatcgctacttaaattacatgcagactgacatggtgatcaatatattcaaacgtatgaaatcatgtggctgccctgcagacgttgctacctacaatataatgattgattgttgcagccttattcactcgtataaatcagcttgtgccctagtttccatgatgatccgtgacgggttttctccaaaagctgttacatttactgctctgatgaaggtaataacaaagtatctgattacaattttaaaagtttgctgccattgtttctcaagaacttgctacaagtaagtattcagttcaggatgaaagaattctacacacagtacagacacataccaaattttcttgaaccatcgctcacgctcagaacttccaattttttttttggaatctagcagcttattgctgttcatttaattttaattaactaaagctgtgtatcctcttagattttgttgaatgatgcgaatttcgaggaggcactcaatctcttggaccaagcggcattagaagagatacatcttgatgtcttatcatacaacaccattttgcgtaaagcgtttgagaaggtaaagatatttgttgtaaaaacgcttaaagtaatgaaagtgaataaactgctttagtatacacataacttttgtctgcagggaatgattgatgtgattgagtacatagtggagcaaatgcaccgagagaaagtgaatccagatccaacgacatgtcattatgttttcagttgttatgtggagaaagggtatcatgcaacagctatagaagctttgaatgttctgagcttaaggatgctcaacgaagaagacaaggagagtcttcaggacaagaaaatagagctagaggaaaatttcgtcatgagcgaagaccctgaagctgaaacaaagataatcgaactgttcagaaaatctgaggagcatcttgctgcagcacttctgaatctaagatggtgtgcaatgctcgggggccggataatatggtcggaagaccaaagcccctgggccagagcactctccaacaagtacggttaataggtagaatgggaagtgttttcctgaataagagctggtgttgattatctgccatttcactaagctgctccgttttggttttgtatcctatacaaactagttagtgacaacacagttttggaggtcaccaatcgattcggttagatgagacggatcaacaatacggttagaagcatttttaagcggctacgaaccacctaaatacaaggcgacttgcgaaccatcaaatgcgagttttgttatttactttagattcttactgtaacttttgtttatttttacctttcaacaactgtgtatcaaagaattagccaaagatattccaattgcacctggttatacaaagttataagtatgttttctgaatatggatttaaccacttttgaaataaaggtaacaagtgcaatgcatatgatattgaaacttgatcacttgaaacaaagaagagaatatttactgagaaaacataaaggacagatggaaacgacagaaacaaacttaataatgttacaacttgctcctgtttttcttttgtagtttactcatccaaatacaaatcactgtccatagatagaggaccaatcctttacttagctgatttcaaaccatagaataccaaatttctaactaaagtatattgtacaacaatgcaaaacaaaaaataatgatactttcctaaattttaaataaataaaaagaagaagatattttctcttttaaccaaaatgatttatgtttgttacttaattacattactcactaactattatcttttacttaataactgaggccaattctcttcttctttgtcaactattagggacatttgttttttttttggccgacttggggacatatatctttgagtgttatatgtatgtgtattccattgattcatataaaggccctgataataatgtttttatcaatgtgataacaactaaagttaggcaaatatgagtttaaccgaattacgtataagctaatactcaatttaagactagtaaaaaaaatcaatgctgccgactgccgtcattaaagattttgatattaatctttgctttattttaccctaaatgtataatgtaagctaatatatatcaaataattgttagtcaaaagtcatcaaaattaacagatttttattaaacagattgtaataagatggaaacctctctataagaagtgctcaaaaacaaaggaactcaatttctctctctctctgatgattttgtttgtttgaagaaaagagaatattgttgtttgtctctcgtgatcgaaacaatgctttgtgattctcaaatacagtaacattttcaacatgctttgattccaaaaatccaaactttcattctctctctcaatctctctatatctccgagcagcgaggtagttgcacggcggccgccatg

SEQ ID NO: 9571 - DNA, 3000 bp, Unknown
  misc_feature (1)..( 3000): cDNA_ID_2036400_gDNA_ID_1972155_Annot_ID_179463 3000 nt of promoter + ATG
agcacacccagtagatagactgctgaaactgtaaacaatgaactcaccaattaatcttaccaacatgtgcatcaagggaagcaacacattccaatgttgaagaattcgattgaccatatggctcaggaatctgccatattgctgctccatatgagtcgccttgaaattgaaaacaacaacactgtaattctcctctgacaacactgtagtttcaatttctgaaactttatgcattcaatcggaaaagtccgattttttttacttcaaatcaactcaaaattagaagtttcgagatgatgagaattaccagtggagaagacagtagagaaaatgcgttgatcaaaaggggaagaagcaaggtcccaaatttcattaggatgcgagaacaatccctcacataacagctcagatccaccagaagacaaacgaagcaaatgaaccttaaaatttaacaaagtcagaatcttccgatccagaaatagaacgaaacagatcttaagaatcaatcacctcattttcttctttcaagcttagggttccagtgaggaagctagtgtgatctctatctgctttaacatccgatatacatctggcctgaaaacagcaaattttccaccattaagaaagctcgtaaattgacaaaggatcgggcatgaagaagatcgtgaactacctgatacttcaaaccataaccaatacccgatgatcctccttgcattatgctcttacgcctgagctaacgttacggattcaggaagaagaagatctctcttcaacgatttgccgctctctgattttgctgggtttcgtgaagatgatactaatgggccaatattcatttaaataagcccacttttacaaactgaatcataaactgttttatttttgcttctatggttgacatttgacagttgacactcatggcccaacaatagttttgcaaattttagatgcaaattaaataaataatttaaataaacatgtaaataaatgaaaattgaatagattcatatataataaacaggtaaataaaagatctatcactattgtagtactccatatgtcccattttattagatgttttggctaaaatcacatgttttatcattaataaaaatttaaccaataaaaaatactgcataatttaaataatcataaactatggaattaatataaattatgactagaaactagagaaaaactaattgggaacaacaacaaaaaagctttaaaaatcttatatactagggaaagtattatcttgttaccaaaaacagtaaaaagtcatgggaaagcaaagaaagaaatattatatattaatttctaaggtaataaaaatatatgtttagagcactaataacaaatttggaacctcatttcttctttacaattgaagagcaaattctatatataattatatattgatatatgtgaacattctaattaatacaatgctctcaaatgaatatactacataaagtcatatcttggataacaaaaaatacttttcttttccttttgttgaatacaaaaagtaaaacttttcttgcaacccaaactatccatttctttactagtccacgtacgcctttcaagatatcaatctcttcaatatacttgtcaacatcccctaatacacaatgagtgggggtctaacagttacaataaacgtgaagactgtaacgagcatatttagtgaagagtttattcgaattgattactgtaacgatcgagcactaaaactattcaccaaagtatttcaaacattcataaattatttactaagcaaacaaagaaacgtgaaaaaaacaaaagtaacattgatcatttcctttttgaaaacgtaatcaaatacgtatattttaattaattatgcatcggttttatacagagctacatagatatttcatatctctctctagaagaaaagagaaaacgaaaaccaaacccacgcgtaatgttgatttcaccttccactccaacaaaccagcgcctctccgaatcacttcaaaagttttgaagaaaatcaaaactctataaatacaaaaatctctctctcggcaaatgaaacgtgtgtgaacaatccacggtggtggttattctcacagattagggttacgatcacttacgccgccgttatgtacgtttccaggagaatctccgacgtcgatcgtcgtcttctcctccttctcataatcccatctctcaccctcctcgtcttaatctctttctcatctctctcacttgatccttttccaactctagcccctcttcgtaacctaatctacactcataccctaaccgtcaccgatttcaccgtcgaattgtcagattcgaaccctaacgacgttatccaagcggaggagatggaaaatcgacggcggaggaagagggaggagttggttaagtcgaagattgcggtgtgtttggtaggaggagcgaggcggtttgagttaaccggaccgtcgattatggagaagatcttgagggtttatcctaatgctgatttgtttcttaatagtcctctcgacaaaaattctttcaaacttcggttacttaaggacgcaccaagacttgcttgggttcgtatctttgagcctaagccaatcaatgagactgagccgatggttcgagtcctcacacctatgaattcgcccaatggcattaaggtaatttatcgactcttttgaacttccttaccttataaattcttttcactaactttcaattaattaaatgttggagtattacattaaatttttaagtgcataaaattcgggaatatataattaaggataagaaagtgatcaggagcggggacctccgtttagttggagaggtttagggttggtgtaaccgtttcttgatccgtacgttactcatgtgaagggattttttgtttgatgatgggtttggtatttgatgttgtcacaatcccatccaatatgatattcttttttatttcctcgttactttataacaaaattgcggtcaaaaatg

SEQ ID NO: 9572 - DNA, 3000 bp, Unknown
  misc_feature (1)..( 3000): cDNA_ID_3042504_gDNA_ID_1972155_Annot_ID_179452 3000 nt of promoter + ATG
aaacaaaagatgatgctaactttctattcgttctaaaatctaaatctttagttttagtttgtttatgtccacgatcatttctttgataatacttttggcggattcacaagcgcaaattacccgtcttattgtagcattaggactaaaaatgagatccggtagcattgcaacaacaccttcctaatcgattgagccaatcggacttatattacttgttggatttgtttttttttttgtttagagtatccaagatcatgtatttacaatttcaaagatcatgcgttactagattggcctcttcaacatgtttagtgaataataagttaaaataacacctaatcgttgaggattcatagcgtgataagaattaaataaccaagttcttattggtttgtttgtattttgtaacgcatagaatagaagaaagaaaaaataaggaacgttataaatttctaaaaaatcatcatttcttctcgaacaagcttgttccagcgtggcactagtcaataagtcaagtggacccacgtaaccgacatcacgtcttttacgccaatcagtacatactattgggtcctacaaaaggacaacttcccatgttatattgacacgttttaagatgtaattgattaatctaaatttctctctgactcttttctttgtctacatccgacgttccatttctgactatgagctccgtcgtccgatttgcgctaatgcttgacacgtgtcttccaatctatggtgcattaaattgttaatcctttcaaaatctgtaatccatttttggaatttgcaagatggttcctatatttgtgaatatatatatatatataagaaagcccgaaactttaagaacaataatttatagggacatcccattctttaaaatctcttttgcgttgtcaaaaataaattatttttgctttcagaggaaatgaaaaaacatttttgcttattccatattattcttactctatttaaagtttgaatcagttttctttaacttgataaaccgatcattgaactacaaagtccacataacaagtattaaaacaaacaaaaaaacttatgaaagtctaatatttaaattaaaaacagtacacgccttgaacaaaccatttagtttgttttcactacttttgaaaaaaaactatctagttgccattcttatccattattttttattccactaaattgatatcagatcacgtaagcaaactattaacaattaattaatgaattcttcttaatccaatataactttatctaattaacagaaaaatgataattaacgtggggacgaaggagaagatgccataaaaagcgggtcattttgtaatttcatataattagatatatgtttttaaattgcaaaaaaaaagtgtacaaagagcgtgaaatccgcggtggcttggacccctcccgagtcctcaacactatataacacactttcttctctaatctccatcacctcttattttcatctgcttttgaatttcaaaccttcacataaaaaaaatacttttgaatccgtgtttcattcatcgaatctttttccgataactatggctgaggaaatcaagaatgttcctgaacaggaggtgccaaaggtagcaacagaggaatcatcggcagaggttacagatcgtggattgttcgatttcttgggaaagaagaaagacgaaacaaaaccagaggagactccgatcgcttcagagtttgagcagaaggttcatatttcagagccggagccagaggttaaacacgaaagtcttcttgaaaagcttcaccgaagcgacagttcttctagctccgtaagtttagatctgatctgttgatgataaactataacatgatcgaatgcttttcttatctaactatatgggtctgaatttatacagtcaagtgaggaagaaggttcagatggtgagaagaggaagaagaagaaggagaagaagaagccaactactgaagttgaggtaaaggaggaagagaagaaagggtttatggagaagttgaaagagaagcttcctggacacaagaaacctgaagacggttcagccgtcgctgcggcaccggtggttgttcctcctcctgtggaagaagcgcatccagtggagaagaaagggattcttgagaagattaaggagaagcttccaggataccaccctaagaccaccgtagaggaggagaagaaagataaagaataagaagattatcattaaagatattaagaataatgatggttgatttgctttgtttttttttttttttattgtgatgattgatcatcttttgcttttgtgatgtgtaagtttgttggcttttttgttgattacaatttcttattttctcttgtatatggtttttaaaaacaaaagatctcaaggtattttaatggtatgaatattttcatttgattaagtgatatggatgatataattttatgtattgataatcttcaactattgctcaaagccgtaaacatgaccccagtttgattagcattcaagttcgtatgtaggaaattaaatgcgttggtatagaagaaacatgatcgtgtatactcttctttttagtgattgatttggcattgcggtcgacacaactactcaaaacgtgtaagaaaatggaccaacttagatatttttgtagaccagttgacgtaacgtttccctaatatgctagttatgataagatcacatattcacatgagatccagctaatcacaaaacatttccattaatggaccacatccttagttaataatgtctttaacgctcatcattgtgggtatatctaattatctataatcttgtatgtgggattttaatgttgggtaagaaagcccaatgggcccattaataactaaaacaattcagataccgaaatcaaatacgacggtgttctgtggatataactccgagttaggtcgtttttccggttaggacaatttaccgccgactagtaaacttggagtttcattcaccggtggagatg

SEQ ID NO: 9573 - DNA, 3000 bp, Unknown
  misc_feature (1)..( 3000): cDNA_ID_1442644_gDNA_ID_1972155_Annot_ID_179453 3000 nt of promoter + ATG
atcacagcagattaaaaaggaaaggataagccggagatctctaacctggaggaagagaaattggaggtggaagagaagaaagaaacggaggcccaatcatgctttgatctaatctgatattccctgagctgttctgctagattcgatcttgttatcatcgcttcttctccaccaagtcccgatcacagtcccgattcgacgaagagctcaagaagcgtttgagaatcacgagatgtaggaaaaatctatcaccaacatataactagaatctagaaatccaaaacaatggaaaaacaaaatctgtgaattggaaaatttcgcatcaaaattttacagcgacgaaacggtgtccgattcgttaggaattcggcgaacgttgcgtggactctctcggtgtcaacaaccgggtcgggttatagatccgatctggattcttaagcccattttatgggtattgggcttttaccgttactcttttgttttgagttgtcatcatatatgaaaactttgttccgatgccatgaaatttgggcttttaagaatcatgaaaactttgttctaacagaaatagaaacatcaaagaaaaagaaataaaacagcgatgcatcgattgattctcatgtcccaccaagtaaagcgagtgctaaatattgttgaatattcctgatttgaccacaataaggaaaatatcacgcccataaaactcagacgggcggtgaaaaagaagaaatcgacagaagaacaaacgcatgacgttcattacttagcactaatctgaaactttcgaattatagtatttgatccatatgtattctacgtttttcagaaaactttgttcagatatctcaaactttcgaattaattaatattattttaaaatctatagtttagttgtgaattctaagtgtcggctacaatttgtcggttcgctatcaccgaaaacattatccaaagaataagttaagagctgagcttcggtgtatatgacaacaagaaccaaaaagacgaataagttagtattgaaaaagataggtttgtttgatatgtgtgttgatacgtcacggttcgtgctacgtctttgttaaatttagagaccagagattactgatgtggcacgtcggttcattttttttattttaggcgaattttaagagatgatgcatttaccgattaccatctgtccttcattaatatttttagtatatctttttcaataggtcgaaaatgacatcccacacattaacatattaattcataagaaatccaagtcatcttatgctcatttgtctactcatgatttcattatctacatctaagtttatctttaaaaactgcatgaaaacataaccatttacgttgaaaaaatacatacacaaacccttttcccataaacgagattacgaaagattgttttatgtgccccaaaaatggtaaacaaaagatgatgctaactttctattcgttctaaaatctaaatctttagttttagtttgtttatgtccacgatcatttctttgataatacttttggcggattcacaagcgcaaattacccgtcttattgtagcattaggactaaaaatgagatccggtagcattgcaacaacaccttcctaatcgattgagccaatcggacttatattacttgttggatttgtttttttttttgtttagagtatccaagatcatgtatttacaatttcaaagatcatgcgttactagattggcctcttcaacatgtttagtgaataataagttaaaataacacctaatcgttgaggattcatagcgtgataagaattaaataaccaagttcttattggtttgtttgtattttgtaacgcatagaatagaagaaagaaaaaataaggaacgttataaatttctaaaaaatcatcatttcttctcgaacaagcttgttccagcgtggcactagtcaataagtcaagtggacccacgtaaccgacatcacgtcttttacgccaatcagtacatactattgggtcctacaaaaggacaacttcccatgttatattgacacgttttaagatgtaattgattaatctaaatttctctctgactcttttctttgtctacatccgacgttccatttctgactatgagctccgtcgtccgatttgcgctaatgcttgacacgtgtcttccaatctatggtgcattaaattgttaatcctttcaaaatctgtaatccatttttggaatttgcaagatggttcctatatttgtgaatatatatatatatataagaaagcccgaaactttaagaacaataatttatagggacatcccattctttaaaatctcttttgcgttgtcaaaaataaattatttttgctttcagaggaaatgaaaaaacatttttgcttattccatattattcttactctatttaaagtttgaatcagttttctttaacttgataaaccgatcattgaactacaaagtccacataacaagtattaaaacaaacaaaaaaacttatgaaagtctaatatttaaattaaaaacagtacacgccttgaacaaaccatttagtttgttttcactacttttgaaaaaaaactatctagttgccattcttatccattattttttattccactaaattgatatcagatcacgtaagcaaactattaacaattaattaatgaattcttcttaatccaatataactttatctaattaacagaaaaatgataattaacgtggggacgaaggagaagatgccataaaaagcgggtcattttgtaatttcatataattagatatatgtttttaaattgcaaaaaaaaagtgtacaaagagcgtgaaatccgcggtggcttggacccctcccgagtcctcaacactatataacacactttcttctctaatctccatcacctcttattttcatctgcttttgaatttcaaaccttcacataaaaaaaatacttttgaatccgtgtttcattcatcgaatctttttccgataactatg

SEQ ID NO: 9574 - DNA, 3000 bp, Unknown
  misc_feature (1)..( 3000): cDNA_ID_1024170_gDNA_ID_1972155_Annot_ID_179455 3000 nt of promoter + ATG
tgctcaaactctgaagcgatcggagtctcctctggttttgtttcgtctttcttctttcccaagaaatcgaacaatccacgatctgtaacctctgccgatgattcctctgttgctacctttggcacctcctgttcaggaacattcttgatttcctcagccatagttatcggaaaaagattcgatgaatgaaacacggattcaaaagtattttttttatgtgaaggtttgaaattcaaaagcagatgaaaataagaggtgatggagattagagaagaaagtgtgttatatagtgttgaggactcgggaggggtccaagccaccgcggatttcacgctctttgtacactttttttttgcaatttaaaaacatatatctaattatatgaaattacaaaatgacccgctttttatggcatcttctccttcgtccccacgttaattatcatttttctgttaattagataaagttatattggattaagaagaattcattaattaattgttaatagtttgcttacgtgatctgatatcaatttagtggaataaaaaataatggataagaatggcaactagatagttttttttcaaaagtagtgaaaacaaactaaatggtttgttcaaggcgtgtactgtttttaatttaaatattagactttcataagtttttttgtttgttttaatacttgttatgtggactttgtagttcaatgatcggtttatcaagttaaagaaaactgattcaaactttaaatagagtaagaataatatggaataagcaaaaatgttttttcatttcctctgaaagcaaaaataatttatttttgacaacgcaaaagagattttaaagaatgggatgtccctataaattattgttcttaaagtttcgggctttcttatatatatatatatattcacaaatataggaaccatcttgcaaattccaaaaatggattacagattttgaaaggattaacaatttaatgcaccatagattggaagacacgtgtcaagcattagcgcaaatcggacgacggagctcatagtcagaaatggaacgtcggatgtagacaaagaaaagagtcagagagaaatttagattaatcaattacatcttaaaacgtgtcaatataacatgggaagttgtccttttgtaggacccaatagtatgtactgattggcgtaaaagacgtgatgtcggttacgtgggtccacttgacttattgactagtgccacgctggaacaagcttgttcgagaagaaatgatgattttttagaaatttataacgttccttattttttctttcttctattctatgcgttacaaaatacaaacaaaccaataagaacttggttatttaattcttatcacgctatgaatcctcaacgattaggtgttattttaacttattattcactaaacatgttgaagaggccaatctagtaacgcatgatctttgaaattgtaaatacatgatcttggatactctaaacaaaaaaaaaaacaaatccaacaagtaatataagtccgattggctcaatcgattaggaaggtgttgttgcaatgctaccggatctcatttttagtcctaatgctacaataagacgggtaatttgcgcttgtgaatccgccaaaagtattatcaaagaaatgatcgtggacataaacaaactaaaactaaagatttagattttagaacgaatagaaagttagcatcatcttttgtttaccatttttggggcacataaaacaatctttcgtaatctcgtttatgggaaaagggtttgtgtatgtattttttcaacgtaaatggttatgttttcatgcagtttttaaagataaacttagatgtagataatgaaatcatgagtagacaaatgagcataagatgacttggatttcttatgaattaatatgttaatgtgtgggatgtcattttcgacctattgaaaaagatatactaaaaatattaatgaaggacagatggtaatcggtaaatgcatcatctcttaaaattcgcctaaaataaaaaaaatgaaccgacgtgccacatcagtaatctctggtctctaaatttaacaaagacgtagcacgaaccgtgacgtatcaacacacatatcaaacaaacctatctttttcaatactaacttattcgtctttttggttcttgttgtcatatacaccgaagctcagctcttaacttattctttggataatgttttcggtgatagcgaaccgacaaattgtagccgacacttagaattcacaactaaactatagattttaaaataatattaattaattcgaaagtttgagatatctgaacaaagttttctgaaaaacgtagaatacatatggatcaaatactataattcgaaagtttcagattagtgctaagtaatgaacgtcatgcgtttgttcttctgtcgatttcttctttttcaccgcccgtctgagttttatgggcgtgatattttccttattgtggtcaaatcaggaatattcaacaatatttagcactcgctttacttggtgggacatgagaatcaatcgatgcatcgctgttttatttctttttctttgatgtttctatttctgttagaacaaagttttcatgattcttaaaagcccaaatttcatggcatcggaacaaagttttcatatatgatgacaactcaaaacaaaagagtaacggtaaaagcccaatacccataaaatgggcttaagaatccagatcggatctataacccgacccggttgttgacaccgagagagtccacgcaacgttcgccgaattcctaacgaatcggacaccgtttcgtcgctgtaaaattttgatgcgaaattttccaattcacagattttgtttttccattgttttggatttctagattctagttatatgttggtgatagatttttcctacatctcgtgattctcaaacgcttcttgagctcttcgtcgaatcgggactgtgatcgggacttggtggagaagaagcg

SEQ ID NO: 9575 - DNA, 3000 bp, Unknown
  misc_feature (1)..( 3000): cDNA_ID_2037218_gDNA_ID_1972155_Annot_ID_179450 3000 nt of promoter + ATG
tggttctctggcttagtggtggtcctggttagtgatgtttgaacctgcagtattacaccatcaatgacctcaaccactagctgatcaacctaactcatttcaagtcaacctggttttcatgagtaataatagacacttatttgacattgaaacaatcgcttaatttgtctaattgttcctttttaacaaagagactgactagttttactagttttctatacaagcaaatatgtagtagtactatgcaaaatgcacctactatacgatgtcgtttctggttcttatcaatgtactaagaattcgaatgttgttgtccacacatggaacacctaatccatgtgtcgttattacattttacagacaccgtacgcgttttgtatcttttttggtatttttatttattattttctctcttttttgttggtattattgtgatcttttcaaagtgttgtcatttatacaggcctatctagatcaacactttattctataatctaggaccccacggcaatttcaaattgctctgacgcgtcgcttactcatccaatcataatcttcttctatcaaatttgaaatttctctaatttggtagttagacgttctattttttctcccatatactttaccttaattttgggagagttaggcttttattaaagtgctaatgactcataccagagaaaagtctgagtagtgagaggcgataaatccggaaatataaacgcatgtcaagttaatgttttactttttgataactacacgtaatgttttttccttctgagtacttttggatccttctacaatatttccttctttttttgccaaatgagtagggattcattaaaagccaaaaactaagaattaccactgaagttatgtttctgctcagaaattaaagttacataaaagagaaaaaaacattcgaaaatgccaaagaaattgaattgagcttccaaacgaatttgatattaccaccaagaagggtcccttgtttatcttctagcaactttaaaggacatatacatgatacaacaacccaaaaaaatgaaaagataaaaagaatattattctttattcgaacaatagaggcatataatttaccttttgatggccgatttttttgcttgtgattaccttcgttacgaagttttatactattgaatctaggctgtttattgaatctaagtttttttgcttgtgattatcttcgttaagctttgtttcttttttccgacgtgagcctgatttttactaattaaatagagaataattacgctaggatatatgtatttctgtctcccattcaattattagaagaccttatcttcggttctttaatgcacatgtgacatttgacttaaaaacttatacagtaagaaagacttaaatccaactatacaaacaaatatatatggtattagtattactagttaacactaataaaaaaaagaagagagcaaagtttctctacactaagattttatttatttctgaaaatgtcaaaaaaataactaaaagagaagagttatttcaattattctcttatgaaaactagatgaatttttgtggaaaaaaaacaaaactagatgaattcttttcctttaacttgtttaaccagtcacacacgacacacatatagtaatctatttaccactgttttttatacagcaaaagtattcagagaatgaaatcttacaatccacaacaaaataaatccgctatttttgcacagattttttttgttaaggatctaaatgttaggataaatcctaaggtgtgttatatatacttccctttttgttatgatatagtaatataaggattagttgtgattagagtatattctaagatatgtataaatatatgtttgtgtatacgtttaatggaaatacaactttctccaagtttttctctgctttatatttttctttccaagacagtatgtaatcactaatcaattacaaccgaggattataaattacaataatcgaaattagataaagatctacgctgtgcagcgtgggaatattaaataaagtttttacaaattcaaattgtaaagatatgaaaaattcttgcaaatcaagtttagtacaaaatatatgaattttttttctaaattattgaatgtaaaatatagtgaaaataggttgcatatattttaattgatattgttttagaagatagtgtgaaatctttgatatcataaatttaaaactaaacaataattttatttcactaaataggtttttttaatataacaacaacggattttcgaatttatcatatatagatgctgaatatttaattttcacataaaactcaaatctttgccaaaaatatacaaaaattaatgtttaaatattaataatattaaaatatgtatagataactaaatgaggatggagtaatacaaattaaaaatgagaaatgttgatactcaggaaaattcataaattcatagaaactaataatagcaaatttagagaattaacaggaaacatgatatacatattatgtttgattatgaaatttaaatatatgaaaaatatgattttcgtcattttaaataaaagtagttaaatgctacctaattttttttaatgatatatcttgtaatatctcaataatatctgagattgtaatccaatatcttacaaagcttatcttacaccaaataatcgtttgtttctaattaaaatgtttttagggctcataaaaaaaatggcaccaagttgcttagccatgtggattgtgggacgacaaatacagatttcaaagtgaacacagagtcgctcgtgggtccagccaccgacactgacctttgttttcttctctcttattcgttttctcttaaatctctctctctctactctttttaatacgtgccgactcttctctacataaactctacacttaaatctgtgtcttagagttagagagagagagaccacgccagatatacctttcttgtttcaccggttttcatacacaaaaatg

SEQ ID NO: 9576 - DNA, 3000 bp, Unknown
  misc_feature (1)..( 3000): cDNA_ID_2183928_gDNA_ID_1972158_Annot_ID_179490 3000 nt of promoter + ATG
ctgattgacaaggttttctcttgatttatgtattgttgttttgtgttgttgaaatgaatgatatttgggattcagattcgtaaagctttaaatctttatgtgttcttttcttggtaatggatttatttattttttgtatcgttgtttcagaggctcttgagaatggaagcagaaacgtcttggaccaattatccgtacagctacattacatatgtccctgaagctgaatcataccgtgagcagagcgacgatgaagccaaagtcgaaaccttttcaatggattctcttctccctgacgatttattagaacgaatcctctcgtttctacccattgcaagcatcttcagagctggtactgtctgcaaaagatggaacgagattgtatcttctcggaggttcttatgtaatttctccaacaattcggtttcccaaaggccttggtacttcatgttcactaccacggatgatccatctggttatgcttatgaccccattatccgcaaatggtacagtttcgatctcccttgtatcgaaacatccaattggtttgttgcttcctcttgtggattggtttgcttcatggacaatgattgcagaaacaagatttatgtctcaaatccaattaccaaacaatggaggacgcttattgaacctcctggtcacaaatcgacagattacacggcaatgtctacctccgtaaaccgagcgaaccaagcagtaaaccgcgcaaaccggagttactcagtctcgatagtgaaatcgaagcaagttccagggaatttcttccaatgggatctctctattcatctctacagctctgaaacaatgacttggacaacattagtaaacgatgtcttatccggatggagaggagggaacgagagtgtgatctgcaacaatgttctttacttcatgatatactcaacgggaggctcagatcatcgccacggcttgatcgcttcgaatctatcctcgataggatcaccgtcaagcggaatcttgatgaggagtttcattccaatgccgtgttctttaacctgcgggagattgatgaatctaagagagaggcttgtgattgtcggaggaatcgggaaacatgatcgaccagaggttataaaagggatagggatttgggttttgaaagggaaggaatgggtagagatggcgaaaatgcctcaaagattcttccaaggttttggtgaattcgacgaggttttcgcgagtagtggcacggatgatttggtttacattcaaagctatggatctcccgcgcttctcacgttcgacatgaatctcaagtattggagatggtctcagaaatgtcctgttactaaaaagttccctcttcagctctttactgggttttgcttcgaaccaagactcgagattgctccttagttgcaatgaagaagcaaatgggtctgtgaaagtcttggtcttttggattgtttttgcacagagaaatcgccggcggctttatgaagatgatgatacggtaatgtttttaaattttagttactggaaatgtttttcaggaatattgttatttgcaatttggtactctgttaattataaatttataaaatgaggcccagatacttttatttgaacaaacgaacccttctctatctctcagtgaaatataagaacatttttcaacatgtggcccacaatatctcatgtaaatgggtcggattctgaaactggaggttgtcttgttgctgttcctggtggataaaaataatgattttgttccttttttttccacatatattcataatgatttttcatgttttattaattaattattgttgtaaattattttaaagaattatgtttctgtacttgtataaaattgggacctattttcgtgatgggatttgtcaggtttggcagtgttaggtttacgggtaatggacaacagctattttattgtgtattttatcattttctcaagggtcacttattttcaattttcatagctataataatttactaaattttaaaatataacaaaatgtcattcattagttataatcgtataaaagttgacgaagtgatatatagattctacatactaaaaacaaaattaatttgtgtcattatgccaaaatgtcaaaaggaaaagaaaatttagacaattactctgacacatcaaatcagctaaaacctaactaaatataccaaactagcaacacatatttttgttattaaaagcatttataatgataaatcatgatcagaatcatagtaagcagattcgaacactagtctctcaaatttcggtagtaaagttttcaaccattagaagacaaatacgattttaacatcattagtattgttttttcttttttaatttaagcgttggctttccaaaatgaaatagtaacaagcattaacgagttaagttgtcaatgggggaagttaaaactctttaaaaccaaaaaattgaccacacaacacatatagtgcccactagttctctcaaacgaatatggaatactttaaaacccacctctattctcaagaattaaagcccagaatttcaacgttctaaaaatagttttgaaagatttgtttttcacgggtttttcgtaaaataattatgaacaaaacaaataaattcaaactaatttttacacgtacaaatctgactcctagcctcctagatgaaattcaaaattttgtaccagcagctcaaagctactaggtaaaaaatgtcacgagagaaaaccggaggaatattggtggttcatcaatacgaatcaaaccgaaccaagtcataaaccggttcatagaaagataagaagacagacaatcagtcatcactttggtctcgttgagcctttcgtctatctctcacctgaaagaaagacgttcagctttctctttccaaaatcaaaagctctccgatcagtttctccggcttaggaaattaattgaaggaaggtgatgagaggtactactgagaatacggatctgttcgatcccaaaacccaa

SEQ ID NO: 9577 - DNA, 3000 bp, Unknown
  misc_feature (1)..( 3000): cDNA_ID_3016298_gDNA_ID_1972158_Annot_ID_179507 3000 nt of promoter + ATG
cagaaggagaagcatattggttagtccttgaattggatccatcatactctcttcttagtcatgttaagatgttgtacagatctttgactttgaagtacttcatttgctgatcacagcctcattttgatctcgttttgacactgtcattatagattggatgcggataggtgcctttgttcttgactctcgaacttcactcctgactgagagtttgagtggtcgtctgaaattcccaagggaaggaaccatagaacggatgttacaatccagtggttcatgtcttatcaacgacatcaaaagcggtatttggattgcaggtaagaacaatttctttagaaactttatctactgcagaaaaagaaaactataacatggcttatctcatgttccagatttacagcttgtacgttgccctgtttgtgacctcagtacctgtgatggtaaaagacactaatcaacttctagtctgtttctattgatgttagtctatgaaataactaaattgcaactaagagagtttctgttttactatgtataggaacaatgcaaactcttgatgctaggcacattgaactcttccttagtgaaggctacaaagatggaagctgggattacaatctgatcggatctcataagttgcagaaaaacgcaagtgcagcttgtggagccatatttgacctcaaacaccttaaagaatcttcatattcaggtaacttcaaatctacattacttttctgttcctttactcctcctctttagatcattctccttgggtctcatacattttcacatgaataataggtattctcaacctcaagtcttggaccggagagtcaaatgattcccaacctaaagcagttatcgcaccccacgctgttgctgttcacacaagactgcaagaaaacgaaggtacatgtccaaatcactttgcataatcaaccatctttatctagcaagtaagaaacacaattacaattcttttacaaatctaaattgcaggaatccttgtgaagtaccacacaatgaaagcaggaacagacggtgacattgtttccatcagaatctcccagcaacttctctgattccttcacagtgcattgtctcaaagtcacacaaagctttaagcatttctagtattcaaatccttttcctcttcagtaacatttatttgtccccagaatatgttgcaagaataatctgactgaatattgaacttatatacacaacacaaacccaatgaatatttaagaagctttagtgttggaccattctataacgaaattagactatttgctgtttggcaagatgatgacttgcgctttataatgaatgagatgtaggaaaaatgagctggtttgccatgcgtccatagcatcctctaagaaagaagactctgtttttgctctctcaattctatttactctgtttttgatctagctctgtttctcttattatcaaaatatcaaaaaagctgatgtaaaaagtatattttttcttttgagtataatttgacattttattcaaaaaaaaaaaaaatgagctggtttgatgttccggttcaataatgggaagacaaaaaagacgagaaaagccaattgttcaacaagccatggttgcaaccatggttcaggtttaaagagaaactctattaagaatagtcataataagaaaacagaacaaggatatcaatgacaatgcaccggttttaatggtggtttttaagcttccatcgggagctctccgcaggcatagattctgcaacctttctcctgggattcaagtgtcctcacaagcttcataccttcaatgacttgtccaaacacaatgcatgttatctaaccatggagtctgcacaaagagtaagaaaaccaaaataacaaagtttacagatgatgccaagggtgtatgaatcttttacctttacggtgaaaatgaaaagtagtcctttctagtattcaccacgggcgatgaaaagagccatcaactcatataaatatttgaatttgagccaaaatttagtctaagcacatattattagttagaacacttagtttatcactataaaagacattcgtcaaagcagttgcaacacctaacttttgttagtctaaatttacaaatctttgttttgtatgaacatttaattatggtttcaatataaccattttaattgttttgtatttaaatgcatcaatgccagtttatatattacaagttttgttcacattaattctagtttattatttgaattattttttctggtaagtttaggattctataaatgtgtttggcaattggtgttaaaataatcagaataggtaatatcaggaaatatatgtgtttggcaaaatttggtgagaataaatgtgggcttaccacattaggcctaaattaatgagcttcaaacaaaatctgaggcccacacaattgggcttgaaataatatgggcctcatatccatttatttctactatccttttttctcaacttctgctcattaatctactatgcatggttcagacactgttcaaaggttcttaccaaaatttcctcactcttcagttttctttggccaaaaagagttgaatccaattttttttgtttcagttgtggaaatccaatcagtattgtggcatctgcaagagtctctttgaccatgctcggtgaaatactgacctgagttataaactattacatctacaatatgtagctgacgtgatttgatgtattacgtgtgttgtgatgggcgtaacgtatgggttcatgctgggtgcgacatcattacgaatgagcgctttaaggtgcagttatacatctccgtgcttcttaacttttgattctaagtagttaggacaactgccgaatgactgacagttgtaatttggttatcgttttaaggaactggagcacaacaattactattgccctgattgtaaagtcctagagagtctcttcccagatacaacacgcagtggttgcacgcctctctggatccgtaatg

SEQ ID NO: 9578 - DNA, 3000 bp, Unknown
  misc_feature (1)..( 3000): cDNA_ID_2183987_gDNA_ID_1972158_Annot_ID_179513 3000 nt of promoter + ATG
atgaagataaatatgagaatctcactaaagaatggttagtgaatatttaacagtccctaagtattctaaatgtttggagatttcagatacttgaaggaaggggatacaaattaaggtatccttgggttggtgttgtaaaccggtctcaagctgacattaataaaagtgttgatatgattgctgctcgtcggcgtgaacgtgattacttccagactagcccagagtacagacatttaactgaaagaatgggttcagagtatttaggaaagatgctctctaaggtatataattgaggagcttggtatgtatgaagattttagcataaaagattttgtagttgctctaaaaccagctataacttttcagcatttggaagttgttatcaagtctagaatcccgggacttcagtctcttatcacaaagacaatttccgagttagagacagagctaagccgtcttgggaagcctgtagcagctgatgctggtgtaaggatcttctgtcttaaggaccttttagcctttcattcttcggtttcttgtctcatttcacatccctccttcgttaatactcattctcctgaatgcagggaaaactttatatgatcatggaaatttgccgtgcctttgatcaaacttttaaagaacacctggatggcacgtaagtcatccgcatgtttctggattgttgctaattcaattttctagctttataattgataaccactaacaaccttacaggcgttcaggtggtgaaaagataaattctgtgttcgacaatcaattcccagctgccattaaaagactgcaattcgacaaacatctctccatggacaatgtacggaaactgatcactgaagcagatggatatcaacctcatctcatagctcctgaacaaggttatcgccggctcatagaatcatgcttagtctccattagaggccctgctgaagcagctgttgatgcggttcattccattctcaaggatcttatccacaaatccatgggcgaaacatctgtaagaatatctctgctcaaagtcataaacccaacaacaacaataacacttatgagttttgaagcatgattatgtgttttcatcatgactacaggaactgaagcaatatccaacactcagagtagaagtatcaggtgcagccgtggattcattggatcgaatgagagacgaaagcaggaaagcaactctgttactagtggacatggagtctggttacttaacggtcgagttcttcaggaaactcccgcaagattctgaaaaaggtgggaatccgacacattcgatattcgacagatacaacgatgcttatctccgaagaatcggctcaaatgtgttgtcatatgtgaacatggtctgcgctggcttgagaaactccataccgaaatccattgtttactgtcaagtccgtgaagcaaaacgaagccttctagacatcttcttcaccgaacttggccagaaagaggtaacaataaagatatactaaaaaacctatatgagcaaattgacaattgtataagatacgagtaagaatgttaaaatggtttggtgttaaaaattatagatgagcaaattgtcgaaattgttggatgaggatcctgcggttcagcagcgaaggacttcgattgcgaagaggctggaattgtatagaagtgctcaaacggatattgaagcagttgcttggtccaagtagagagacgagaccctctcttcacactccattttttgtttctttaggatacgtttccttctacatttttttgtctcttttttttttccatttgtcattgtattcggtgttcgagttatcattgtttctgaataaaagtttttgtaagacgatggttggcgcagtagaatatggttgaccaaattatttttcaaaaaataaatagatttcatggactgaagaaacatatgacgtgatctcctctctgttttaaaccaccggaaagagagaacaaaaggagcaagcaaacagaagaagaagagcaaacagaagaagaagagcaaactaaaattaaaaaaatcaacaaaattggagatgcggggaatcgaaccccgtgcctctcgcatgcgaagcgagcgctctaccatatgagctacatccccatattggctaacttattatgttaatcccttttattatgttaaagttgaataattttgaattatgatatcgattacataaaacgcttagtcgttgactgataccgatcccgccatgcgtaatagtaatactgtttaaattgttttacattaccattttgcaattgcaacacaataccttttttctcatttgagtttgtgttttacaacgaacaaatgaaattgtttgtttgtgtgattggtactcatggaagctgtaaagctgtactcattggttaatttattattgtttactttgtttccaagttcccttccaatatctcctccaagaaaagaaaagatgatgttgatcgtggcactatcctgaccaaatatacctaatgagtaatgattcagactaagactgatccacttcccactatggtccagtttacgaccccactctctcgctcccatctctgtcttcttcttctttttttccctaaataagcaaagtaaaaaactccagattgtccatatcttaaaaatctattcgtaatttctcaacctcaaatagcaattgccaattgttttaactggcaaagaaaaagcaataatttcatagcatcttggtatttttctgtcggttcacgtgtcgatttagtgacagaggggacataaattgtccgatacttaaccagtgaaacatcaactccaagtatctttctcaaaatccaaccggagctgatttaaaacaatttgatgattatgattgatctccatctccaaccactttcaccaccaaactcaatcactcttcttcttcttcaagtaaccatcacccaaaaagcttccattgttcctcgctccttctcgtctctgtttcgattccaaccatg

SEQ ID NO: 9579 - DNA, 3000 bp, Unknown
  misc_feature (1)..( 3000): cDNA_ID_2183981_gDNA_ID_1972158_Annot_ID_179510 3000 nt of promoter + ATG
aaaaagcaataatttcatagcatcttggtatttttctgtcggttcacgtgtcgatttagtgacagaggggacataaattgtccgatacttaaccagtgaaacatcaactccaagtatctttctcaaaatccaaccggagctgatttaaaacaatttgatgattatgattgatctccatctccaaccactttcaccaccaaactcaatcactcttcttcttcttcaagtaaccatcacccaaaaagcttccattgttcctcgctccttctcgtctctgtttcgattccaaccatgaaaactttggtcggattttacatcctctgtttcttaatcggacaagatctgcctttcttagctgcagatgacgtcaatgtcataaacgattcgacccagaatctctgttttgcaaaccgattatccgatttcctccctccaccgtacagcaatatctccgataacatgccctgtactcctctttggaacacgttcgtcttacgggtaaaccgaaaaacataaaccaacttttcctaaaacccataattttgattttcaacgctgcttgctctgttttgcagtactcagaaaacagagacaatgtgatgacgattatagtatcggctttatacacaaccgggtgggttgggattggattctcgaaagaaggaagaatggttggatcaagcgcgatgatcggatggatttcgaaaaagggtcacgccaaaatcaaacaatactatctccaaggaacggagagagaccaagttgtgccggatcaaggagaattgcaactacaaaaagtcccgccggtggtggctcttcacggagcaatgatttacttagctttccaggtgaaattcgccgttagagttcctcggagagctgtcattctagcgtttagcactgcttatccttccaagctaggccgtttgactaagcatgatgataaaactacagtcatcgtcgatttttccaaaggtaatataatgtatatactagtctaatctatacatgttaaaaacaggggagagttcaatagttgtatgttcttggtcaatgcagctagtggagcaacctccataaagacgacaacttctacggagaagacaaaacatggagtaatggcgatactcggatggggtttcttacttcctgtaggggcaatcctagcaagatatctaagacataaagaccctctttggtactatcttcatatcggttttcagttcacgggctttatcttcggtttagccgcagttattcttgggattcagctttacaataggatccagccggatatacctgcgcatcgaggcattgggatctttcttctagtccttagcactcttcaggttttggctttctttgcacggccacagaaggagacaaagatgaggagatattggaattggtatcatcattggattgggaggatctctctcttttttggagcagtgaacattgttcttggaattcgaatggcggataatggaggagatggatggaaaattggatatggatttgttctgtcagtcacgttacttgcttttgttgttcttgaaatattcaggattcgtggcactatcggctcaccatcttctcgcagccctccctcttttgagacacatccaagttctagtactagtgtttgattcaagatcttctgttttttttttcttgtacataaaggtactttttttgttttccccataatcattggtcactgattttatagtccatatgtgttgtaattttttttttttttttttggttcggcaatatgattttcaagtggaaatcggtcttggtttagactttagagcaacatggtgatatttgtttttttaaggtttgtttctttttggatctcaatttgttgtcatgtaagttgagttttgaaggttgttgttcctggaaagtgaaatatacgtaattctttaattccttatgagtttgtaaatgtgcatagacgtccctagaccctaaggctaacattatggagcgattaacaaaaatatggtccttttgtatgcaaatgcaatctctcatctttcatataaatcatgaacgtataattggatgataagttttgagtcttatttgaaatgaaaaaaggatcatcttcctccattgtctggtaatgtcaaaatgttgttgcatgagaaacatacagtgttcatattgggcctaactcgaagttgtttcttttattaattgtcaaaatgttccacgagaaacatcgtaggcccaatatgtagcccaacaagcttcgatttttctaaataagttgtgtgacaagaagaaaaacgagagagttatttattgatgcgccacgtcagatttgatgaaaaggaagatttcgacttggcgctctcgtacgcctgaaaattcgcagtcttccctcgtccccaatccctggagccaaacactgttccattcaaccgccacgtcagcatattcgttttttttattttcgtttttattatttgtttaggcgaattaatttcagaattaaccataaaataataataaggagaaatatataaaccgacgacggacggtgtgtgtctccttcatcagaacacaaagatccttctcctcctcttttgttttcccttgccgtcgattttaaggttttatcttctccgtactgaaaccgactgataattttctccagggaatctacgaggaggatttgttgtttctccgtcgttttagagtttaacgatttctccgtcgtttgatttcttaattctatcctgttgagggaaacgagaatttggttttcgttttcgaatttagggttagagaagcggtttcgcattgggttcgttgactattgagccaatttgcgagaggaatttaaacgttacgagtttcttctttttccttccggaggtccgaagtgcgaaatctgttttgtttgatgaaattagggttttggaatcggaatttggatagtcgtttatgttgaataggcgaggattgcttaggtaggatatg

SEQ ID NO: 9580 - DNA, 3000 bp, Unknown
  misc_feature (1)..( 3000): cDNA_ID_3016285_gDNA_ID_1972158_Annot_ID_179524 3000 nt of promoter + ATG
tgcaatgataagtagtgtactgttgataaccataaccttatagtagaagataggaccatgttggtatttttccacaacttttccttctctttttacaattcataacaaatgaatactgtcgattagttcaatatataaatataagtaatacaaatattcctatattcttgtaaaatgacgtggtgactatgactaaacaggtgattaagtatattatcaaatatatcaatggaatataacagtgattaagaagaataaacaaaattaaaagattttgtggaatggattccactaaaccactacgcaatttaaaaataaaaatacttaactaatgtatagttatttattcccatccatgcgttcatattcactttgaatgatcatattcgtaatcctatttatttattttactatttgaaccttttgtgtgtataaataatttcaactagagagaatatccgcagcagctcgttaaattagtcattgaattaaaaaaagatattcaaattttcacccaagaaaaacgaacgcaactaaaatgacgttcaaatttggcatcatctttaggtgtatattattgtgagagatatgcaagcatgaaatctcatgcaggataagaatcattgttaaatttattttaattccgttatatttatggtaatatcatcctattaccttttctaaaattatgtttcactctttagttcaacctttggtgatgaaattcgattctttcatatctcgtctccgctttgcaaggatttgtccgtacaataatcatatgcactattttaattatttttttgttgggtgggattcaaaaaagttttttttacccctctatcagctagttagagaagtgagactatatatgattccaatcaataatacatcacatctatatttcgtcttgtaacgcggccacataatcttcatcaacgaagcttgaatgttgtaatagtgtttcactatcaacaacacacatttgtaggccttatgtaattagcgagagaactctacagtctacactataactttgagtggaaataaatactcgtatatggtaacataaaaatactatgaacttatgattatacaaacttgtaagtaaaaaagagtggtaaggctatgtaatatcgtcgacgttttctaggtaaatcttaagctataaaaaagattttgaaacccaaatagtatcgagtgatagcattagtctcatcgggtggttacaagccaacattgattcgtgttgcaaattttattaaatacaagggtgtacacaaatcaaaacgcaataatatttttggatcatagtctttcttcactatcattgggaaaaataaaataaaataagaaaaatagcgatagaatttcctctgtaaatgagcaaaattggtaggacaagtcagcatttgacacgtgtcggtcatgaatacgactaaacagcgtggcaatttctcttactctgacgtgtccatgtggggaccactttctcctccgacacttcggcatggctttctcaactttttatcactcttcttcaccattctcatttactaagcgcgtgtctcccacctctatccgatttaattttttaaatttgacgtttcaaaagttccttctataaaagcaattaacgataattatatgaaatccgtaaacatgaatttttcaaataatttcgatttttgatttgctaagattaaaagcgcgtgaaagaaaaaaaagaatacagcatgaacaccagcgactcagaactgactcggcacgtggtaacataaaactcacacgcttcccaagacgctcgtcccataaagagtcatggctgtgaccttgtgcgagtgtgggtgtagccatagcctttgtgggtcctaaataaaaaaaacgatcaatggcataatgtgtaattaactcacattccacagtgttaaataaaaattaaatctgtaacggaaaaaacaatctatctgatgttacacaaaaaaaaaaaataacggaaaaaagaaaatgtggccggggtttaatagagaagccgacacgtttgcctgccacgatccagacacaagacgatgtgggtaacggcaccgtcaagtgctaacggcaacggggtcatcagtaaaaagggcaatttagggatatagagtaaagtcataagcttatttattactatcgtcttgatcggacggctgagatttgccctctcctttaaatgcaccgtacgttttttttttacataataaaatgtaattagttcataagcaattcccaaaacgccgcgtgacccttcgtttgcctttgaatacaatttgttttattttagcgcatttaatatatttgagtttcctttttagcgatgacatgataaaacaaaaaacaacaattttagaaaacatttaattaaatgaatagaaaaatagggagattcaactgaagttactgtgggtggaaatgacaggtctccaggatctgaactaagagaaagtctctctatattttgatatatagagagagataaagaaggagagagtgtgaatatatgtatgtgcatgatactgtgagacttcttcagtaaaggaagcagctttggtttgctgcggatcgggataaaaacggcgagaagtttgtgattgttgaagcaaaacaacacggaatctgaaaggaaaggagaagacaaaaaaaaaaaaagattttaagaggaagagagagagagatcggtttcgtggctgacggaaaaaaaaaggggagagatttagttttatccaacagtgcctgaattacgttctgcaatcaatacggacataaccgtccgttgtgtcctgtttataaagttttgctttttttattttctccattgatgggtcttttctttcttctctctctcgtgtttctttcatggggttaagactagtgtttaccgcgtgaaggtttttttttctttctattttctttcatttcctctccttctacttcttcttctccagttctcatctgggttcttca

SEQ ID NO: 9581 - DNA, 3000 bp, Unknown
  misc_feature (1)..( 3000): cDNA_ID_2184029_gDNA_ID_1972158_Annot_ID_179518 3000 nt of promoter + ATG
ctttgacaggttcgatatctgacgcttttcataatcgacgagctattcatgagatcaaagctctttagaactttgataattgagaatcttgatcagcttttgagtttaagtattgggtttagaagcaatctgcctcttcctgcaccacctgctgttgccactacgttgcgttcaaaggctattgagttcttggagaagtggaatttgtcttttgggtttcattacaaggagcttagacttgggtttgattaccttaagaataccctcaagttaaagttccctgatttacaggctaatgctgcacggattcaacgagagagacaggagagggagatgaagacaaaagagattttgcggaacaagtttgattccttgagagttagttttggactcttcaagtatgagattgaggtaacgataaaggaaatcaaggagtgtatggaaattgttcagtggagaggggatgatggtgttccacttgcgatcttagatgaggaagattttgaggagatccgttgttctcatctgaggcaaattcgtcttgattcactgaaacaatcagaaaaggttgaagaaactggtgaaaacagaattgtatttgatgtgttgagggaacagtgcaagcttctagtgacaaagcatctgatctcggttcaagaagggatctctcttctcattagggttgacgtaagtgataacagaacgagagattccatgttgaaggacttgattgatatcaggaataacatattggcagctaaaaagaaatgggaagaagctggttttacaatgtcaagaatgactgatattcacggtaatgaagaaacaaacgaggaagaagaagatatctgggaggaggatgatggcaaggttaaaactgattcagtcaagaacgtggctcatgtgatgagaactcagcagagtgagaattcatctttaccatcatcaggtgaagcaaagaagtctacatcagaagctaggtccaataaagtgtcgaacactaaaaaagttggaagcagtggaaactctcttagagacaagctaatttctgaagcgcctgtgatgaattggggatcacagttgactaattgggaatcaactacggaagttcgagctaattaccggggtttagagatcgagagccactggggcagggtggatcaagatgctataattccagcagataaaatagcagaattgaatcttcaggcaaccgtgtatagagaagagagaacagagacacctccatgccgtgcttctctaaagaaaggtggtctttgccagagaagagatctcagagtctgtccgtttcacggacccattgtaccccgggatgatgaaggaaacaccataatccaggaatctccattagatgagagtgaaaaccaaacttcttcaacttcagggaccaaccaggatgtgtctatggatgaaacaacttcagattctgatcctaatcagttagctaggcaaatagcgaaagaggctctgaagaatatccgggagaaagacaaagaagtggtgaggaaaagagcaaagcttgttaaggttaaggttaaggaacacaatcatgaagttctgcgtggtgcggcaatagcctcaacttctagatcgaatgctatggatgatgagtttgatagagtttttgctgaaaagaaaaacaagaagcaaaccttttccacaaggcgtaagaaaacaacggctaaagatagaatatcccagagactgtttagtaatcgagtaaaaggtactaatccacagcagttggctcagggcaatgatgaaaagtgccgggatacatcggctaaccagtggtaacaaataactaaaatctttctagttttgatccagtagtgccttaaatttgattgtttgatgcaaataggagtaaaaagctaaagaatatttgatgaatgaataatcagatccgcttgtgatctcttgtagctgtgaaaacagttcttaagtcaagtcccagattctttgaagctttatatttttctcagacaaaagtcacaaaacccaacagaaagataatagtacaattgacatgttctgttaaaaagcaacgacagatcattgaagctggatggatcgttgttgttcgcttttttctttttcttttatgtggtgtgtttaaggatgatatcactcatgagaccgatcactgatgagaagcaattattaattgaataatttgcttttaagattgtgagagtttgcttgagatgaagaagagtaaaatgttcatttacattatcattggtctttgaagtgactttgaacccaagccacatcccattacttattattcctcttatgaatttcatattcttaaaccgtctaattttacctaaatacatctcttaaagtttttgttaaagtaaacagaaagatgagcatgtttttcatgaatctttgaatttagctgtcattttagaagttgaaaatcatttttcttgtacaaaggaaaagaaattgtttgaattaaaagtaaaaaaagaacacacaataatgatagacagaatcccactagagagaaaaacatctagaataaaaaaaaagaagcaatcatgtgcaccatgtacatatttaggcccatctctactggatcatggccctttaattaaaaacaaagaaatcattgagtgagagaggatatactgtacgtatattattagaatatgattatttttcccctatccagtaaattcttctgaatctcttataattcaatttgtttccaaataacattctctctttaacacagccgcctttgtgaccgtccgatcttaaatcagcgtttccggttcatttgacggcaactatctctctctctctctctagagaattgatgaagaagagcatctatcttttttgtttttgaaaattaacaacacttcacgagggttgacctgtttcggtggtgtttcttcaattccggattttgatctttcgtttcgatcgaagatcaatcaaagtctccacctttcttcaatg

SEQ ID NO: 9582 - DNA, 3000 bp, Unknown
  misc_feature (1)..( 3000): cDNA_ID_3016291_gDNA_ID_1972158_Annot_ID_179517 3000 nt of promoter + ATG
gaagctggatggatcgttgttgttcgcttttttctttttcttttatgtggtgtgtttaaggatgatatcactcatgagaccgatcactgatgagaagcaattattaattgaataatttgcttttaagattgtgagagtttgcttgagatgaagaagagtaaaatgttcatttacattatcattggtctttgaagtgactttgaacccaagccacatcccattacttattattcctcttatgaatttcatattcttaaaccgtctaattttacctaaatacatctcttaaagtttttgttaaagtaaacagaaagatgagcatgtttttcatgaatctttgaatttagctgtcattttagaagttgaaaatcatttttcttgtacaaaggaaaagaaattgtttgaattaaaagtaaaaaaagaacacacaataatgatagacagaatcccactagagagaaaaacatctagaataaaaaaaaagaagcaatcatgtgcaccatgtacatatttaggcccatctctactggatcatggccctttaattaaaaacaaagaaatcattgagtgagagaggatatactgtacgtatattattagaatatgattatttttcccctatccagtaaattcttctgaatctcttataattcaatttgtttccaaataacattctctctttaacacagccgcctttgtgaccgtccgatcttaaatcagcgtttccggttcatttgacggcaactatctctctctctctctctagagaattgatgaagaagagcatctatcttttttgtttttgaaaattaacaacacttcacgagggttgacctgtttcggtggtgtttcttcaattccggattttgatctttcgtttcgatcgaagatcaatcaaagtctccacctttcttcaatggatttggatagcatggactgtacatcaaccatggatgtgacagatgatgaagagatccaccaagatcgccattcctacgcttctgtttccaagcatcatcatactaataacaacaccaccaacgttaatgctgctgcttctgggcttctccctaccaccaccagtgttcatgagcttctcgaatgtcctgtctgcaccaattctatgtaccctcccattcatcaggtctttcttttcaatcccttgttctctgatttcgtttccccggatctttaatttgttgattttgtttagggttttgagttaatgatgtgaatcatggatgttgaagcagtggttgtgttgctcttgtaacttgaaatttagttttatccattcactaatggctacaattgaaacaattgtcactaaattttgtcaatagctttgatagtttctaagattcttcttattgtttctttagagaattatggaataacagatagacaattatttgatttccctacagtgtcacaatggacatacgttgtgttcaacctgtaaagccagggttcacaaccgctgcccaacttgtagacaagagctcggtgatatccgttgtttggcactggaaaaagtagccgaatcacttgaactaccttgtaaacacatgtcacttggatgtcctgaaatcttcccttattacagtaagctcaaacatgagactgtatgtaacttcagaccttatagctgcccttatgctggatccgagtgttctgttacgggcgatatccctttcttagttgctcatctgagggatgatcataaggtggatatgcattctgggtgtactttcaaccatcgttatgtcaagtctaatcctcgtgaagtcgaaaacgccacatggatgttaactgtaagtacatatgaatcgtgcttcatagtatacacttagataagttaggaggctttgtttaaagtaataggattatatttgtgataaaatttgatctgtctggtataaactgtaatgtgatcagctgagtcaaattttgcttttgttgcgagttagctttcctagagaaggtccagttatttatctaatctatggttgtgaattgtgaatcttccatctcgctatacatgttgacttgatatactttaatgcttatcaaggtttcctctgttttggttttgtttctggttcaaaaatgaaaatcaggtctttcactgcttcggtcaatacttctgtcttcactttgaggcattccagctcggaatggctccagtctacatggcgttcctgcgtttcatgggggacgagacagaagctcgaaactacaattacagtttagaagtgggaggttatggtcggaagctgatatgggaaggaacaccaagaagcgtaagagacagccacaggaaagttagagacagtcatgatggactaattatacaaagaaacatggctctcttcttctcaggtggagataggaaagagctgaaacttcgagtcactggaaggatatggaaagagcaacaacaaagtggtgaaggtggaggagcttgtatcccaaacttgtcttgaaaattaaaaaaaaaaaatcaaactgattttgaaaacctcaccgatttggccttgtctctgtaaccatggttatctgtaattagggttttctctgacgataaacttggggttgttcttatgtatctctctctgtctttctcatgtcatggaggtttttttattataaaatatatagttcattacaattctgctatatctggaggaaaaacgtaaaatgttgaaccttttacttttatcaactgtagtgttcataaatttatgtaatgcttgtgttgtgtccacgaaacgacgacgtttcatcattgttctgttaaacccagcttttggaacttggaagtgatgagctttatatctggaaaatgtaaaatgttgaaccttttttcaactgtagtgttgttcaaaggcgttagctttgtttaagaaacgacgacgtttcatcattgttctgttaaacccagcttttgggggttttctcactcggaagtgagctttatccctttggtttccatcaatg

SEQ ID NO: 9583 - DNA, 3000 bp, Unknown
  misc_feature (1)..( 3000): cDNA_ID_2183994_gDNA_ID_1972158_Annot_ID_179514 3000 nt of promoter + ATG
tccttttgcctcactaagctgtcctcttccggtttggtcaataggcttgtctccagctgataggcttgtccaaagccatagtgagcttggaatggttagtaacaaccctgatgggttttgatgctgtgctaagataacattgtactttgccgctttcatatcgtgatgatgcaatcttcttgtgagatgtctcccatgattagcatcacatttgatggtgcaggattgtcaaccgccccaaaataaagatctacgaaaatcttcttatctctcccatctttattgtctgaaaccatatatcatcaatcaacgcatagatcaagatctaacgcttcaaggagacggaagattacgaaacgaacacgataaactaattggagcagaatgatcaaggggtttaggatttattagatcttacgggagaacattccgagctaagaaactgctttttggccgttagatctcaagtatatctgtgctatcctctccactaaacacttcagttgcttgctctaatgacgtaaatcttagttattatggttaactttgtgtgtgtgtgtgtgtgtgtgtttctgcagcagtcactgaacatgtcatgcattgctttaaacgctttaaacaaaagaagctctcattgcattctcagggaatacaaaaactcaaaaaaataaaagccacaaggaagaagaaacaagagttttctctattgctgaacaaaacatatgatactacaacatgaatcttagccaaaatcaatgttaagcgatacttaaaacactctgtttttttaggctacccaaatcaaaaaccaaccagatcacttggaataaaagacatcttcttagactgagacgagatagccttggcaacaaaagcaagcaatcacaataccaaccaatgctccagcaagaacctgcgaaggagtgtgaccaagcagttccttaagctttctttgactgatgggatgtccttcgaacaagtccctaatgatcaagttcagaacctgacatcaacaaatacaaaacattgttaatcttatcttacaaagaacaacaaactagacttagactctgtacagaccctctttcaaaactcttaattctctgcaattttatcaagatcattctacaaccaacaacaactatcatcaatatgtggctaatatccataatttcgagaaacttgtattgtgctctcaacaatgcaaaaccatcatctaaaagatttaagaaccaagagcaaacatgacttagactctgtgtgaatcctctttcaaaactcttaattctctgcaattttatcaaggtcattctacaaccaataacagctatcatcaacatgtgcccaatgtccataatttcgagaaacttgtattacgctctcaacaatgcaaaaccatcatataaaagattcaagaaccaagaacagaaatcaacatctaactctccataattccaaatctagtgatgtacttcaattgtgcacacattgaaaactcaagcacgccaacttttacacataaaagcattcacaaaaattcaacaatgtagtgaaagtcgaatccatcaccagattctagtaatacattaaactatacacactcatcaacatggaaatagtaatacattaaactatacacactcatcaacatgaaaatctagtcaacttgtagaatagacaaagcatttaataagaccaaagtcaaactctgtaaaaatctccaaaactcaaaacttgaagcagatttggtttaactttttacctcagcttgcataccggcatggcgtctaacaccaattgcatcatacatgacaatcaagctaaaccctaaacaaacaggaaacaaggaatctgcaactccatgacaaagcgccacagaggtcgtcaaagccatacataaagctgagtgagacgaaggcatcccaccagaagcatagagaagacgaaaatcccatttcctctcaatgaagaaattgataaccattttactcgattgcgcaaagaaccacgcgactacagctgaaacgaaagttggattcgcagagagcgtcgcaacgaaagggctaatctttatcttagcagaagcagtaacgctcaaaagggcaatccctaatccaccgttatgcttcaaatctccagcgaaatcctcagaaaacgccgccgtgtcgtctctgtaagctcgaaaacgagacatccattgcctggattgagaagaaaccaaaccctttattgttcgaatgattggacgcaatacacataaagggtttaacttgatacgacgattgcaatctggtttaggattcgaagatgatttacagcagaataacgataaggtgttgttggaagcttccaacttttggatagaggttagctttacgaaggagaaacgagaagggtaatgagaaatggttttagagaaacaagcgaaggaaggatttgatgtaagagactccatgagagaattaagttgctgctactttgcgacatacagagagattagaacacaaagtgttgtgggagacttggcgaagaaagattggagattttcttcaacccaactgggcctaatcaacgaaaacaattagtttagctaaattaaacacacttttttggtaattaacatcgaaatcgtgtggttgtagagaaaagaagagacattgttttcgtaaattataacggaaataccattcgagtatcgtgactcgaatataccaaaaatgtgtccaaaagaggataactgggctcaaataaagtgggcctttgggcttgctacaaggtttgacttttcaataggggtactttgggtattatgaatctttagcttatatatttttattttctgagaaaaattcaacggtcgcccgaatgatagcaattctcgcggttataacgtttgcgttctcttctcctgctcatacggacccgtcggagaccaaatctcgccggaagattgattcatccgttgattaatcggagctccttagttttgattccgttatg

SEQ ID NO: 9584 - DNA, 3000 bp, Unknown
  misc_feature (1)..( 3000): cDNA_ID_2183969_gDNA_ID_1972158_Annot_ID_179506 3000 nt of promoter + ATG
ccatcaacaactctgttgtaaaccctagtgcccgcatatgttgccccgtcgtcgaaatcactctcgggaactacaaatcctctaccaaaaatctgccaatgggaccaaatatggattggaaccaagtctttgctttcgacaaatccaaaggtgatgtcttgtcggttactcttaaagacggtccgaccaataccgtaatcaacaagcgcaacttcaagctggcctcggaaattccgactagggttcctcccgatgcaagaatcgcaccgcagtggtactctatgcataataccgaaaccgacttttacatggagttgctgatgtcagtttggttcggtacacaagttgatgaggtttatccagaggcttggttttcagacgcctgtgaagtgtgtgcctctcgcgtgatcaacacgcgacctaaggtctacctagccccaaggctctgttatgttagggttacgattgtttcaggtcatgatttgatttccaaggataaaaacaagactccttcggtttatgtgacagctactctaggtaaagtcgctctaaaaacgaaagtttcttccggtacaaacccgtcatggaaccaagatctaatctttgttgcatcagagccgttagaaggaactgtctacattaggttaatcgacagagaagacgaacaacacgaaggatgcatagggacgttgaagaagaagctgacagagatgactccgctcaaagttccaagttccgcaccggctttgttctacgacattgaaatgccgactgaagtcaaaccggctggcgattcgaggaggttcgctagcagactcaagatgaaactagccactgatcaagcttatcacgtcgccgaggaatgcacccaatactcgagcgacaatagagcttttgtaaaagggttatggcccggtctgctcgggaaattagaaatcgggatcttgggagcaaccggtttaaagggaagcgacgagaaaaaacagactatcgacagttacgtagtggctaaatacgggaataaatgggccaggactcgaaccgtggttaatagtgtctcacccaagtggaacgagcagtattcgtgggatgtttacgagaagtgtacggtgttaacccttggaatctacgataatcgacaaatcttggaggacaagaataaggcgaacgatgttccgatcgggaaagtgaggattccattgaaccgggtacaaagtgactggatttacacttgctcgtatcctattctgaagttgggaagcagcggactgaagaagatgggagagcttcagctagcagttcgttttgtttatgttgcgcaagggtatgcacggtattcagctcctttccgttggatgttaccgaaagctcattacaaatctccattgtccatgtatcagatcgacaagttgagagcacaagctgttgagattaattgtgcgaatcttgcgagaacagagccggctttgagaagcgaagttgtgtcagatatgttgaaaccaaagagtaggaacttcagtataagaatatccaaagataattttgataggctttatacagtcgttaagatggtcttgtggtgtgtttcggtcattgcatcggtcagatccacgacagcctgtactccgaaattcattgcgcttggagtcagttttgtgtttcttttttgggagtactacatatattggttggtgacttcgtggctagttgcgtattgcattgtgctttgcattgtggttatacttttacgggaaatcctcaagtccccgaggcaaacatataactggttgttttatcggaacgtcactccgcctcctttgattctcgtcgatttgaagctacggaaacttgactcgatcaacctagacgagttagccgaagagtttgactcgtttccgtcgtcggagaacgatttgaacattcttaggatgaggtacgataggttgaggaagattatggagaacgtcatgttattaatgggggatgctgctacacaaggcgaacggttactagcggcttttacgttgcttgagcggccattcgttttgattatcttattggccctctgttattgctccatgctcgtcgtttgccttggttgggatctacatgttcgtaagtgtttgattttcgtatttatttgctactgggtgcaactaccgtggttccgcaataatttacccgatgggagcctcaacttcttccgaagattgccgagcaacgaagacctcatgttctgagacaattctctagctagggtttttgtttttttcttctttatttatttgttttgttttgcagctattatttctagaccgttgatttttgtttttttggacggctcatatctcttatatacattagtgtttaaaagcccattatttagtgatttgtttttaaaacgtaacgatgatttaattaaattatgaggtctgaggatatacaaacttgatttttatgaggtctcgaggatacaaacttgtttttcttttcttaatgttttgtgtgtgtaatataacaacaacaaaaattatcgtcaatctaatgaaacttgaatagtttacaaactaaactcgtttatgttttaatgtaatcgaagttcacgtgcattgtgaagttttgagcgatagaaaaatatttggaaggcaaaaataacaatgcaccagccgggaatcgaacccgggtctgtaccgtggcagggtactattctaccactagaccactggtgcttttgattaagacatgataattttagtttaaaactataaattccgtgtgagttttgtctacaaatctatcaaggtcttccttcttcttcagtttatcggatttctatctctgggagagaaatctaaaattaggcggtgaatgatttagattagtaacaagcatcacacacacagattgtttggtgtagacaaattcaaaccctaaccctagattgattgcgtacggagtttctctttggttaaaacccccacaaaaactgggagagcgatg

SEQ ID NO: 9585 - DNA, 3000 bp, Unknown
  misc_feature (1)..( 3000): cDNA_ID_3042543_gDNA_ID_1972158_Annot_ID_179497 3000 nt of promoter + ATG
aatggcagagaaaattaaaacaaagtaaagaaatgaaatggcaaacaaaaatataaagagagagaggaaatattcgtaaattaaaaggtcaaagacgacgaaacgttaaattaaagtggtccatgtgtatactttggtggagcccaatgccacaccaaacgacccaacccattcgaagcttcaccacattttctttctcgtgtgtgtttcttttgactgtttttctaactcttttttatgactttcactttaagaaattggatctttatcttactactaagtctaagtgttaaccacagaggaagaagaagcaatttaggtggatcattttacggatttgattttttactttgatcttaacaaaattgcttcttttggtaataaagtaattaaatttataaaactttaaaatgaaaatgtggagcccataaaagatctctgaagttgatggagaaccatagaaacgagagacttaactgctttttgagacaacaattggtaatggattatgcaattatagctattggtctatttcgcattcattttacactttcttgtgattttaattattgtgatttgttcctctcttttctttcttcagcagccttttgtactcttgatgatgtgaattggagtgtaatataacacccctcaatgttgttaatataagtgtttcaaaaatagtctacttatatgatataaactaaagtatatggaggaacaaattcgaagatgctcgttgttatcataagctttaatactttattgaggaagcattttatgttgtaacggctaaactatactcaacaagaaaaggtaaattctaacggaaacaatatagcctttaattctgttcaaagttatagagatgggccgttacagacttttattcaagaagcccatctgcgcatactcaacacttttttaaagagtaacaaattacacaaatttaccaagttcccaagacctaaatcattgactgagtcaagaatcatttgcaatttgcatgttagaatattgtcagaagaatcatgaaattttcaaattgcttcacatgttttgtcctttgttattcacttgaggattttctatgaagttcatatttttcttctgacaccccgatgaactgttagtaaaatggcaattgctaaacgactcctatatcattctatcgctatatatctcatattccccaatgtaaacgttgattgcatgttgatccacgtttcactctttgcctaaacgtttcagagacgtatgatgtgatggatattaaatccatgaaattcttcaacttaaactaattactctgcatttaatccataagtcaataaaatgtatttcccgtttcattacagtttattcgattaaattttcaaattaaaaaacatgagcaagtaatatacttaattattattttacgaaggatcaaacaaatactaaaaacagaaaaagaagatatgaaaatcacatcttcgaagaaccagatcttgttgtagaaatccttatcttagagaggatccgacaaaacatattcttcttcttgttgttgtaattatcgacgacagcttcggtgttttgctttctcttccaccatttggttccaaaagcaccgcacaacagtttaccagtcgtcgaatcagaggaacaacacagatcaacgacggtgttggccccacgattggccttttcttccagatcagacggtcttcgagagcagcaaacttttccggcgccagcaagagaaggtagagacatgaaatggcgttcaatgatgtgagtaagagaaacgagctcgtaggaatcatagagtggacttccacaatcccatagtatacgatcatcatcatcaaccatattcttcgttttctctgtggtctttttcatgaatgatgtttttggaaagtggaagtgtgtttctcgatgtagatttctgacagtgagtgcgtgtcttctattgaaagtgttttaaggtttttgttttcttcctctagtctttgtttttggtcgaatggacttataacagtcaagctggcgagatttgtttatgtttatttgacgattatttacctttaatggaggtttttttttttgttgttaattactcgttaatgaatccggaaattggagaatatagatacactacgaatttgataaagggaaatatgtgattatcattttaccattttagttggtttaaagaatgaactcttccaatttatcattttaccataaagggaaatatgtaatttaaatttttaattttatgttgaatttcaatttaatcataaattttcgttgactaagttggttaagacatgtcgttagaaattcttccaataaaaaatcttagatcttgaaaatagatttccaatttttttttctttttcttcggattcttgcttctttttttaatttaaagtaatttttcgtctctaagtcgacagatagcatcgaaaaagaagaatttgtatctcaattagcttactcaacgagaattcatgattaaattgaaaaacaacataaaattaaggatttaaatcaccatacccaaaattcatattttaaactaacgaaaatggtaaactaatgatttaaatgacatttttcccatttgataatcaaaaaactctaaaaattaatcttaaagttaaaagttattattccatcctttacatgcaaaattcttcctttttaagatttattgggctgaagaaatacaaaacgggcctataattggcccaatatgagtaagcagacgttagttagcttagctgagagagtgtggctttaattagagcatatggtttagtgttaatctatgcaaaaatttatcttctccgtccgcaaaaattctttaaagcattggatcgagttttaaaaaggtatccgcgccagagcttaatttaatcattttcatttcttcatcattcatcatcttcctcacagtctcgaaaccctagttttgtacccaataacaactttctgggtttagaaatg

SEQ ID NO: 9586 - DNA, 3000 bp, Unknown
  misc_feature (1)..( 3000): cDNA_ID_2183953_gDNA_ID_1972158_Annot_ID_179499 3000 nt of
tagaagacacgcactcactgtcagaaatctacatcgagaaacacacttccactttccaaaaacatcattcatgaaaaagaccacagagaaaacgaagaatatggttgatgatgatgatcgtatactatgggattgtggaagtccactctatgattcctacgagctcgtttctcttactcacatcattgaacgccatttcatgtctctaccttctcttgctggcgccggaaaagtttgctgctctcgaagaccgtctgatctggaagaaaaggccaatcgtggggccaacaccgtcgttgatctgtgttgttcctctgattcgacgactggtaaactgttgtgcggtgcttttggaaccaaatggtggaagagaaagcaaaacaccgaagctgtcgtcgataattacaacaacaagaagaagaatatgttttgtcggatcctctctaagataaggatttctacaacaagatctggttcttcgaagatgtgattttcatatcttctttttctgtttttagtatttgtttgatccttcgtaaaataataattaagtatattacttgctcatgttttttaatttgaaaatttaatcgaataaactgtaatgaaacgggaaatacattttattgacttatggattaaatgcagagtaattagtttaagttgaagaatttcatggatttaatatccatcacatcatacgtctctgaaacgtttaggcaaagagtgaaacgtggatcaacatgcaatcaacgtttacattggggaatatgagatatatagcgatagaatgatataggagtcgtttagcaattgccattttactaacagttcatcggggtgtcagaagaaaaatatgaacttcatagaaaatcctcaagtgaataacaaaggacaaaacatgtgaagcaatttgaaaatttcatgattcttctgacaatattctaacatgcaaattgcaaatgattcttgactcagtcaatgatttaggtcttgggaacttggtaaatttgtgtaatttgttactctttaaaaaagtgttgagtatgcgcagatgggcttcttgaataaaagtctgtaacggcccatctctataactttgaacagaattaaaggctatattgtttccgttagaatttaccttttcttgttgagtatagtttagccgttacaacataaaatgcttcctcaataaagtattaaagcttatgataacaacgagcatcttcgaatttgttcctccatatactttagtttatatcatataagtagactatttttgaaacacttatattaacaacattgaggggtgttatattacactccaattcacatcatcaagagtacaaaaggctgctgaagaaagaaaagagaggaacaaatcacaataattaaaatcacaagaaagtgtaaaatgaatgcgaaatagaccaatagctataattgcataatccattaccaattgttgtctcaaaaagcagttaagtctctcgtttctatggttctccatcaacttcagagatcttttatgggctccacattttcattttaaagttttataaatttaattactttattaccaaaagaagcaattttgttaagatcaaagtaaaaaatcaaatccgtaaaatgatccacctaaattgcttcttcttcctctgtggttaacacttagacttagtagtaagataaagatccaatttcttaaagtgaaagtcataaaaaagagttagaaaaacagtcaaaagaaacacacacgagaaagaaaatgtggtgaagcttcgaatgggttgggtcgtttggtgtggcattgggctccaccaaagtatacacatggaccactttaatttaacgtttcgtcgtctttgaccttttaatttacgaatatttcctctctctctttatatttttgtttgccatttcatttctttactttgttttaattttctctgccattttgatttcgtgtaattgatgaatgctataaatctttattctgtcacatcttttaacaaaggccaaaaccctgcttttctttttacctcagtggtcgctgacatagaagctataaagaaaagctattatgtatatggttgttataaataaagcaaaagcaaaattcccccaacttatttattttcttcataatccactaataagtttcaaaatgcatactgaaaaaagataaaaagtaaaaccaaccatttcgtattttacaacaataaaaaacaaaaaagagtgtgtgaaaatggaaaaagtacacatcagcataaacactactaataacggcgtagaagaagaagcagacggaactgagagtttcgccgttaggaagatacggaccattgtggtggttgcgtcacagctcagagaggaataatgaaaacaaataaccaccaagtaacttacagtaaaaacgctcactgtaaaaaacgccgtcgtttcaataaatgttggtagctgctaaaacgacgtcatttattttctgaaagagagagagagagatgttttatactacttcttactctgtgccgtgtggaaaggagcgaaatttgcagaagaaacaaagcataaccccccagagaaagagagagagtttctcccaacaagatcaaacttcgaactctacgagaactactattatccaaaacgcgaaatagagagacagagatttcataaatttcttactttttaaccccaaagttcttttccagacagcgttttcctctgtcctttgctctttgtgggtttactccttcttccggtttggatatcccgagctagtaaagaagggatccagtagcagaagctgaagctaataaacccaatcatagagaaagctctctgaacaaaaggttcagtttttctctctttcttcaaaactgaaatcttctttgtgtgattcattcactaataagtcgtcattctttcttctccttctgatttctgtgtactttttctctgtcagacattttctgggtttgttttaattaaaaagaa

SEQ ID NO: 9587 - DNA, 3000 bp, Unknown
  misc_feature (1)..( 3000): cDNA_ID_1017362_gDNA_ID_1972158_Annot_ID_179505 3000 nt of promoter + ATG
ttgattaaaaaagtatcgtagacctcagagtttcctcttgatttcactaaacaggggaaagtaacatcgatggttgctcaagtttagctgcaataaactcaagaacttagaagaatactgtacgatcacatcactagggtcttggaaatctaaagaaggcaaaaagttgtgaagccgtgaaaggagagacttgatagagctcagaccaatctggatatttctgttcaagtgtggtctggagagcagcaaagaaggaagccaagtcaaaggggaatcggtaagcgacccaagcctggattgttctttgtatgtacactacaatcaagccattaccgcccatgatcatcggtttaatcatcattttcacggagattgctgtttggttttgatagcccagatggatgaaaaaacgcaggaactctttctcagatctagttcggttaggtaacttttctctgttttttgtttcttttcgctttcccttagcattttatttccatagaaaatgtagccttttttgcccacatagaaactaatagaatccagggcttatcgtcaatcttgtttctaaaaattcaagaaagaatttctctactatttttagaaaaagaaaactgtagtacactttttagctgtacctgtagcttaattttggaaaattacggttatgaccagaagaagatgttgaatcatataacttcgtaagtctaaaaaaagtcaagtgtaaaaaaaaagaaaagggaaccataaattcatataagataaccgtttgtaggtattaaactatgaatgatgacgcttattcaggccaggcctaaatagtgtggcttatgttttgggccattaatgggctcgaaagtagtatgaaaatataagtaaaacagtatagcccatcattctttttgtgtagccatgacctgtgactgtgataaattgtacggagaaaatgccaaaactaacaataatttcatgtctcttaaacgtctgagttaatcaaaacgagctcatagttattgttttgttttagagtaataaacttagacgtaaaagagaaataaatgcattgttttggacctaataatagttgaccaaacattatagaatataataatttgagattcatatcatgatggatcttaggctttttctttgaaatatgatgagttgttttgtcacattgcaaattacatggttcttatgttgtttgataaactcggcgagtatggtattataaaagagaaaaataatcaggggaaaaagcaagcaagtcaacattgcgcggaactatatataatcagaagatcttgtttggtgcctattattgcctaatgacacaaaactattttgtagtgttttttttttttttataaagtgtaggaagtcggaccactcgtttatgagaaatcgaatttggtatcaattaatatagagagtaatttcacaaaaaaaaaaatggtggtcctgaagcaatggttgaatattacgtagaaaatggtattcccagaaagttccatagagcgagcaggccatgcccataccctgcctgcgtcttgtctcgtaacgcaacaatcaacaacttgatgaccattacggttatatggtttaattcgatttctttctcttggttcgctttgattttggttgggccaacggttaaatttaaatccaaggttacgtaatttaccattttactgcaaatattgtcttttacatatttactacagatgggatttttatttaataaaaaagggaaatataaaatagaaaagcgttttctttttttctttctttctacagtctactctcctgtttggtctctctctctctctcttttttttttactcttatctctgtgcaagcaacttcgtctctctcgataatggcgttccgatatcttctcgctgtctccgtcttcggagtttttgtttgaattcttcaaaggacagtcggatctttgttttacactatcttcataatctttgttggatttcatcagacttgtcatttattaatccatcgcgtttctcagtgtttctagttcgccaatttcggtttttatattggctattaacaattcgtcgacataactttgtgtgttttcgagtgtgtgagatttttagggttcgttcttcaaaggcttcagggtcgcgggaaggtgagattcgattggatcttttttgttgttgtttagtttgttcctctcctcattgtatatatatatatatatatatatatatatctaaacttttctgcttttttgattttattacaatattatttttcaaagtttctgttcatgtgggttttttttgttctttgttcttcttctgtttttatttttttaagaattatattactctctcttttattcatcaatctccggcaatttccctcaatctggagttgatgaactcactcaaactctgttccacgttctttacaatcaatgatttcaaattctgaaaatcaaagcttgttttgttgtttcataaatggcaaaaagattctggaattaggtttcacacatactgcagtttgttctttatctgggatttttgtttaggttttggttttgtgtttaacttttttcttatgaaatagtttttttttaattagatagattctgtagagtgcttacttgggatctgaaaccttattaaacaatgtttgagagactcacttttcatgattttttgattaattaaactaatcactgtggaaaatgctttcactttatactactactattctcttctttttagcttcctaatatattttattgctttgattgtttgttgacttgtgctactactagtactgtagaaaaactaactatggccatcggctaactggttttcttttgttattcaggtttatgtttgcttgaaaattttgatacaaattgaccaatatgttgaactctatggactgcattgttgtttttggtgctaaagagaacacttctgattgaaggatgttttcactttacattcagcagta

SEQ ID NO: 9588 - DNA, 3000 bp, Unknown
  misc_feature (1)..( 3000): cDNA_ID_3042532_gDNA_ID_1972158_Annot_ID_179502 3000 nt of promoter + ATG
gatacttagagagaaactagagcaagatccaacacatgtccctgttattacatccccggatttagaatccgagaagcagtctcaacgatcagcttcatcttctgcttctgcttacaagattgctgcttcagctgcgtcttacattcactcttgcaaagagtatgatctttcagaaccaatttataaatcagctgctgctgctcaggctgcagcgtctaccatgaccgcggtggttgctgcgggtgaggaggagaagctagaagcggcaagggagttacagtcgctacaatcatctccttgtgagtggtttgtttgtgatgatccaaacacatacactaggtgctttgtgattcaggtaatatgtgttcaaagttactactttcaagcaaatcctctgtttcctcacatcatgatccttgaatctgctagctaattagtgttatgtcgttgcagggatctgattctttagcttcttggaaagcaaaccttttcttcgagccaactaagtttgaggtaaagatcttgatcttggctagggatgtacatttggtttttgattcggttatttaactcggtttatccaatcgcttaggttacattacaattattttggtttgtgtttatcctagagaccttaagatattgatatgaatgtcgcaggacacagatgtattagtccacagaggaatctacgaggcagcaaaaggaatatacgaacagttcttaccagaaataacagagcatttgtctagacatggagatagagctaagtttcagttcacgggtcattctcttggaggcagtctctcattaatagtgaatttgatgcttatctctagaggactcgttagctctgaagctatgaaatccgttgtcacgttcggttcaccgtttgtgttttgtggtggtgagaagattctagcggagcttggtcttgacgagagtcatgttcactgtgtgatgatgcatagagatatcgtcccacgagccttttcgtgtaattatcctgaccatgttgctctcgttctcaagcgtttgaatggctccttccgtacacatccttgtctcaacaaaaatgtaagtcttactataatttcctttttggcttaacgttttgaacatcttaaattaaaaatacggatgttgaagttttttggttgtgtttttgcgttttgacagaaactgttgtattcaccgatggggaaagtatatattctacagccgagtgagagcgtctcgccgacgcacccatggcttccaccgggaaacgctctgtacattttagaaaatagcaacgaaggttactctcctacggcgttacgagcatttttaaaccgccctcacccgctcgaaacgctgagtcaacgcgcagcttatggctcggaaggttcagtcttgagggaccacgactccaagaactacgttaaggccgtgaacggagttctcaggcagcacacgaagctcatagttaggaaagccaggatacaaaggaggagtgtttggcccgtgctgacatcagcaggacgtggattaaacgagagcctgacgacggccgaggagatcatgacacgtgtctaatgaaggaaaatgtacggttgtatataagtggaatcacttctgattatgcgtttatttacatttcttgtgggtgagccgaaacaagcgaataaaatattgtaaagaataaattattctaaacttctaaaatattgtaagcaaattatggttggtggagattggaaaatttggttttctccaactccatggatcactcactcccattcgatgcacaccgttttacaaaaatgggcatatattagcaagaaataattaggcccaataataggcttatgcaatttgaaatcttcttttcgatagtaaggcccactaattaaaccaggcgtatttattaaaaaagaaagaaaagaaccatcctttaattttgttttttttaaaaaaagggttttctttttagttttatcaatgtctcatatatattcattaatccataaatacaacattcgtataggagatttggtttgaagaggcgattctcatatatatacgtacacatcaaaattaaatcaacgaatgacttcaatgtcgtttatggaatggtttcattttgggccatgagaaattagtaaggcacgtggaaaatttgcgtactcaaaatagaaaacacgtacattttatcattttaattggttttattattgataaaaacagaatatatcattattgcgttgtttgtgtgtgtgactttacaattattttgtaaggcatagttttaattaaatgtcaataagctatttaaattatgatacaatgacgaaaacgcccatggagaagctgagattcaccgggattgcctatcctcgtcaccaaacactcccactttttcctcttcctcccagaaagaaagaacgaaagaaaaagaataatatcatcaacaacagaagaagaagatattaaaaaaaaaaaaaaaaacctaatcaaaatatatagatgttcatttttggtcatgtcttcttcatcatcttcttccgcacgatttcagtccgccagtggtaaccttgatcaatctcgcatttgcctctcgattcgtcgatactgctagattttctctcgatttatcctctagggttcttattgatttccgccacccactctctgtttttagaatctaactcccgtctccttcgtttcctcctcctagggtttccttcttcttcaattcgatttccccttctccgatttcgatttgattctttacaaatttgtctgtttggggttattggattagccagatagatccaaggttctttaggctcgtagctatttgatttgttttccccatttccggtgactttgaagctacgattcatcagggaggttgcttattagcaaccgttgaagaaaacgtaacggttggtttaaggtctttgtttggattagaggggtaagctttcgtcggtgactgtcacggcagagatttgc

SEQ ID NO: 9589 - DNA, 3000 bp, Unknown
  misc_feature (1)..( 3000): cDNA_ID_1379239_gDNA_ID_1972158_Annot_ID_179496 3000 nt of promoter + ATG
cagacaaaaaatatcatggtttcgtcttatgctagaaacaaagaagctagtcaggcaaagtatatatcaatattgaatataattcaaggagaagtcgatcccactcaggtacttttacctagctgttttttgatcggacacattgaggatgaattggttattctttcttgctgatgtaatctgctctgttatttcgctacttgatactaggtgcatgagagtttgcagaggatacgagaaagaaagcttgttaatttcattgagtggggacctgcaagcatacaggttctaacctaattgtgtctgcaaattagttattgcttttggcttcaccatggacttgaatcataattttttccatatcttactctcaacaggttgctctttccaagaagtccccatatgttcaaactgcccatagggtaatcttatatcactctatatctatctgtcatactgagagttgccgctccttacagttaatgtcttaggctgctagttcctgctttagaagattcaacaaagactcttattttatggtgtatttgatatttcaggtcagtggtcttatgttagcaagccacactagtatcaggcacctattcagcaaatgtttgagccaatatgataagttgaggaagaagcaagcttttctagacaattaccggaagtttcccatgtttgctgtaagttgactgctcaagtataatggctttgtttggctgatgtttagtgcaacaaacccagctttgacagttacatgttgatatgaacaggacaatgatctttcagagtttgacgaatcaagggacataattgagagtttggtagatgaatacaaggcctgtgagtctccagattacatcaaatggggaatggaggtatataagcttttcccatcaataatcttacttatggatgaactcgaaatgataactgtatctgtgtctgtctcaggaccctgaacagcttatgactggtgaaggcaatgcttcaggagttgttgatccgaagttggcgttctgattattatataaaaacaaaaaccagagtaagtcgcatgaagtttcacttttaactgagatatttcaggtgatcataggattacttaaaaatgggttttggtaggagcagtagtaagtgttggcacgtaaaaccttggaatagtggtatgatgtggatgagttttttagtctgttagatgaatgtgtgtttcctgggattgagagcacacaaagttgcatctcctcactcctcaggagaaggaatctagaattgtaatatttatgggtgttttagctcatgtctctgtgatcggagtatcatgttctccatgtgtggttaaaagactcgaaaactctagaaagcaagaagcatgttgtgttgatgaaggaattgggtttaatggattctattttctttgtatatatgctgtgatctaaacttttactagtgccgtgttgatcatagtaaattctatcggtcaactctcctttgagtttctttttgcatacgacgccgttctggaagcaaatcaaacttaaccaacaatataaaatcatatttataaaaaaaaacctttgcaagttgaattgaatttacttactatataagaatttaaatttcgtggacctcatattttataatataatgggattaggtaacaaattacactaatgattttccaagaagtcgttttagacgcgagtatttgtaaattagtaagcaaataataaaaagagatgttgacaaaacgataaacaatccgacatcaactgcgatttatttggccttatgatgaatagattttactttttagatatcgaaagtgtatgttactttgtttgttagctaagtccttatctttcttcttattttgaaactaagcataatcttacgagtaaaaaccaaaatctgactaaagacctataacaacacttacttactagccgttacatatgtttcactcaaagcataaatttttataataacaatttgtttttattctcgtatcaataattttttttaaaaaaaaggggaacagcttggcgaattattccatttttttaatttaaaagtaaagaactgaaaaagggggaatctcaacatcatcacatcacatggcctctttcttactattatgtaactcaattattccctctgcaatgtttttctggtccctaactataaacatcttttgtgatgtttggtactaaatgatattttatttatttacaaatagataattatgctagtagtagtaccatactagaatttaaagaaatatatgtggaggctggagagagaattacaatttggttttgcataattatgtagaaaggtttagaaaatatctagtaaggtgaagttttattgtcaaaatattagtatgagttttggaacaaaaactagttgatctcttgtgtaattaaagcgtgttgtagtaatagtaatagtagcaaaagaaaagagatttcaaatgggagatgcacatatggacacggattcgtacaaaggttagaagaaacacatgttaaggtttcaaagaataaaatccacccctgtttaatgctcctatacacgaaagagctctcaacgcgtaatatctgtcaaattttaattcagaggacgtgttaaattagccataactttagtttaaagctaaatttgataataattacaataaattccaattccatttgttgagggaatagaaagaaattaaacgaaccaactaggaacggtcatttagccagaaaatgacacatgtcagttaactcctttgaacaattgacagaaaagttctagagtggattaccggctatacccggtaaacagtcaattactataaaaacgcgttatagccatatatatgatccaaaggggtttttggttgtccgtgtcgttcgtcgtctctctcgccggacttgttcattcagatttcgtctctctctctctcgtactcttcttcaattttgtcctccgtaaaatcttgagatg

SEQ ID NO: 9590 - DNA, 115 bp, Unknown
  misc_feature (1)..( 115): cDNA_ID_3042610_gDNA_ID_1972159_Annot_ID_179533 3000 nt of promoter + ATG
tctcaatttcggaagcttgttgtgatacttccgtctgggtttccatttctagggtttatggggtttagtttctaaattagggtaaaatttggggaagaagaagacaacaaagatg

SEQ ID NO: 9591 - DNA, 3000 bp, Unknown
  misc_feature (1)..( 3000): cDNA_ID_2184068_gDNA_ID_1972159_Annot_ID_179543 3000 nt of promoter + ATG
caagtagacgagcacgtcccaagaggtcaacaacgcagccatagtgatgtaaatttggctttatcttaaattcaccactcctcattctatcgaaaaacatcattccttcagcgaccagcccggaatggctacaggcagacaataaaccagtgagtgtctgttcctctggagagattccaaacttcaacatttcgttgaaagcttcaatggcttcttttccaaacccattcatagctaaacccgagatcagagccgtccacgagactacgtttctttcacgcattccataaaatacttggtaagccttatccatagacccgcaacgtgagtacattgaaaccagagtgttactcaaattcaaagcaccactgagtccattttcatcgataaagtcatgaacttgtttaccaaaatccaacgcccccaagttagcacaagcttgtaaagctaacaaacatgttacaccatctggttttacacaaccatcgacatcgttcttcatcttatcaaacaaaactaaaacatctctcgtacgtttattccgcagataacacgaaaacagcacattccaagaaacagtatctctcttgggaatttcgtcgaacactttacatgcatcagtactgttttcgcaagtggagtaaagatccatcagagtcgtcataagaagactatccgagagaaacccatcactgaaaatcttgccgtgaatctgcaaaccaccgagtaagtcacctgatttgatacaacacttgagagcaaaagaagacgagagcggattagcaggaagagagctgtttcgtcgaagagatcgaaacaagcgaaacccttcgcatggagtttggctgagagagaaagctctgatcatggtgttgcagtgagagagagttgggttcaatctctgggagaaaactcggcatgagtaattgatgtctcgaggaatcagagagagagcgagacgagagaggaaatggtggaaaacgtcagagtttctgattaaggaagtgcggagtaagagggcgtgaatctgccggagatggagttttccggtggaagatacgatcagagaaagaagatgatcgtcgccgctgctgctgcttatggacttcaacatagtcttctggtgaaaagaaagtatactaagctttgatttaaaaggttttactaattttatttcgttttaagtattaaaacttgaagttttgatatatgcaagcacatgatgtaaaacagttttatttttggttttgaataaatattacattcaattcaaaaaaacattatgagcaaaaaattcaaaagattatttctaattgattatatgtcacaactttaggaaagtaaatgaggtttacataaataatacaaatagaataaaaaagagttgaaacatattcaatcatctgtattaccttttattcaaaaaatcgctagatgctaatattttattaattatatgtatttttgtataaaatcaaataaattagaaataagaacaaataaatagaaaagaaaaattatatatttatatttaatataagtaaaaagagtttagaaaattaactattaaataaatatagttcaataaaaaaataaattatattaagaatataaatttaagacaatgagattatatgtcacaactttaggaaagtaaatgagattttatagggactaaaaactaaataatatttattttagagatttttgcctcataaactttacaaaaaaatatatagatggaaaaaagacttccaaaaaacttatttcccattcacagcgttacattttgatttgttgtcttttttctatgcccattttgttattttctatttggttttcagttcctaaaagacggaagttatattatttttatttatttttagtatcattccgcaagtaattaaatctatacatgttttagattttaatataaattctgattgaaaaacatactaattttctctgaacgaaagttcattaaacaatgttggtgaaaaagaaagttgataaaaacaatgcattgtttgatgttaccatactaacagtacaacggcggcgccaaagtcttttccaatatactagtttcttttgacatcaagtgattttattaatagatggtaccataagaggttacaacccaaatttgtatcaactaccaactaaacctatttaaagagtaatgccgctttactctcaaacatatagaaataaaagtaaaaacttagcccaaagtttggtgaaagaagctcaacttaaagagcttaggaaagatcctacaaatgatattctatcataaaaggataaatccccgatgtactatttgaatcgactaaactacttttaaaaccagttaagaaactagaaactaaccctagaagaacctcagtcaagcttccttgttcattactgtaggataggcccatagtttaatctctttttaggtaggatcgacagaaataaaaaacagatgggcaaccatgcatggtaattctcgaccctgtctccgagggacagttgaatgaacgactcatgaatactgtcggcacggacgagccaataattcgaacgagtttagtctattttgaattttctagctaccttataaataaaaagctaaatgacatgtaacttcatttaaaagaaaacttatagaagaagacaaacaaacaaagaaaatatatataataaaaagaaagataaaggttgccaccacgtaacaaccacttccactactactctttcgtcgtaatgaagaaagctgaccgtgccggagtttcatcttcaccggatcaccaaattagtcttctttatatagccgatgaaaataccacgtgactccaacgaccaaaataccaaagtccattagtataaagaaaaacatttatttacaaaaaaaaaacgatggatatctcaaaaataaaatgaccaaactacccaaccattatccctatatgtataacacacagcctcttctttttcacccacaaacaacataac

SEQ ID NO: 9592 - DNA, 3000 bp, Unknown
  misc_feature (1)..( 3000): cDNA_ID_3042602_gDNA_ID_1972159_Annot_ID_179546 3000 nt of promoter + ATG
acttccattaggcatgaactcatagatgagagctctaaattcatttccttgaaaatcaatactcgaacaagctgtcaatagtttcacaagattacgatgtcttatgtccttcaaggattcacattctgccataaagctcttcatcgctccacgtctctgcatgtttaaaactttcactgcaacaacctttttctccgtcaggagcaatgccttatatacggtaccaaaactgccagacccgaccatattgctcgaagagaagccattcgtcgcattacgaagatctccataacttatcttctcatgcaagacttccaaagtagaaggagttggattattggtttctttgttcttctttctctttctcaaccaaatcaaagtaactgaagccatgaacaacaacaaaagcaaagttatgcctacgctaactccaatcacaactttctttaaacgagatgaatgcttcttcaccacagatggtgcttgcgaaaggcatggctttagttgaaaccccataatacctccacataaatcattgttcccaactatggaaactgtagtagcattctcaaatattcctttcactggcacctttccctcaagattgttaaaagatagattgagatactccaacttggaaaagcttgcaaagtattcaggtatacttccagagagatcattgttagacaaatcaacttctttaacacccaccaacccttttaaatctggaatatctccataaaacaaatttccttccaaaaaaagactttccattgtaagacagtttcccaaagtttgtggaagtttccctgataatttattatccccaagtgatagtgtaccaagattttgtagcgctccgatatcctgcgggagagagccgatcaaagaatttcctgacatgtctaggcgaagaagctgctgaattttcataatttccagaggtatagtcccattcaacttattatccccaatccacaattctagtaggtgactacagttgccaagacttgtaggaacaataccttcaaaaccattgttggacaaatcaagtgtttctaacatagtcatgttgcctataaaagctggtatacctcctgataatctatttgaaaatagacttaaatacctcaaattcaaaagctttccaagagaggttgggagtggtccactcaacatattttgatctaaaataagcttttgtaggtttatgagatttccaatgtcataaggaatgcttccggaaatgagggttcctccaaggtctagagttacgagttttgcggataggttcgcaatagatataggcaagtcacccccaagcctatttctgccaatccctaaggtctctagttgggtgcagtttgtcaaagaagtgaggaattcaagatctctagaagaatcacttcctaaagaattggtatgaagaaataacaattttaaatttggaacatttccgaatgtaggaatacttcctgtcagattgttctcattcatacccaatctttcaagagtagagatattggaaagagttgttggaatggaccctgtgaaataattccctcccatattaaacgatagaagatttggtagtagaatacctaagtcaggtctaaggcgacccgagaaatgattataaccgatacctagaagcttaagtgaggacaagttgtagagagcgggaggaaaaacaccggagaaattgttggctactaattgaagactccatatttgagtcagttgagctacatcactcggaatttctccttccagattgttatgcgacaatgcaagttgttctagtaacgtcaagtttcctagtgatgtagggagctttcctctcatattgtttccataaagatttaactgaacaaggttcgtcaatgatcctagctctgaaggaacacttcccccaagacgatttgaatctaaacgaaggttcaacaatctagagcaattgtatagacctaatggaatcggtcccctaagataatttatgcccatatccaagtattcgagtctagacaactgtcccacctcttgaggaatagtaccaccaaaaaagttttcatagagatcaagtgatacaagaaacgatagattaccaatggatggtgatatcactccgcctagttgcaatcttccgagttccagatgagtaactcttttgtttttacggccacatgtaacgcccttccaattgcagagtgggaatgagtggttccatgaggacaagacaactcttttgtcttcagaaacttgagacttgaactgaagcaaagcttgcctatcagtttcatcggtaaaaccatgtgtttcaagtagcatgagagcattgaaagcaagtaaaagaaacagtctcatgctttccaaaaaaacaaatggtggttaaaaagcttttgatgcttctcatgttttgcaggaaaatgaacatataagaggcgaagcaattgcaaattaaaatgcctgtagtgataatgcaacttgaaataaaaaatagggatattaaactgccacttttcgaaaatttaagtcaagtcgtcaacaaagacacgttttatgggatcccattatctaaaaaggaacaaaaaaacaaagacattttacgaatctttatgacttttcttcagacatcaagcggtggctacaggatgaaatattttggcacttttgtagcaactagcaaatgaactattttatttataaacatgtaacaggagtcaggagatgatgtagaaattgaccaattattcatttacatttactagatggtaggtttgattggtaaaaactaagtttttttaaacactagaaaaaagagagaaaaaataatgagtgacaaagaaaattaaatagaaatcatatatatatatatataaattccaaaatatgatcaatgagagatcatgtggttgtcccacattatctttctcaacgcacgccttaccattaaggagacccaaatttcctgcaacaaacaaagtaaaaaagttgagaatg

SEQ ID NO: 9593 - DNA, 3000 bp, Unknown
  misc_feature (1)..( 3000): cDNA_ID_3042594_gDNA_ID_1972159_Annot_ID_179548 3000 nt of promoter + ATG
ggagatcttcgtaatgcgacgaatggcttctcttcgagcaatatggtcgggtctggcagttttggtaccgtatataaggcattgctcctgacggagaaaaaggttgttgcagtgaaagttttaaacatgcagagacgtggagcgatgaagagctttatggcagaatgtgaatccttgaaggacataagacatcgtaatcttgtgaaactattgacagcttgttcgagtattgattttcaaggaaatgaatttagagctctcatctatgagttcatgcctaatggaagtttagatatgtggctgcacccagaggaagtggaagagattcataggccctcaagaactttgacccttcttgaaaggcttaacattgccatagacgtggcttctgttttggattatctccatgttcattgtcatgaacctatagctcattgcgatcttaagccaagcaacgtccttctagacgatgatctaaccgcccatgttagtgactttggtctagctcgtcttctcctcaaattcgacgaggagtccttcttcaaccaactaagctcagccggtgttagaggaaccatcggctatgccgcaccaggtatactatcacacatctgtagcattatatgaagaaaattagtatctatcctttctttttatcattacagtcttcttaacattgtttctatgaaatatggtgcagagtatggagtgggaggacagccatctataaatggtgatgtatatagttttgggattctccttttagaaatgttcactggaaaaagaccaaccaatgagctatttggaggaaactttaccctgaacagctacactaagtcggcattgccggaaagaatattggacattgtagacgaatcaattcttcacattggtctcagagtcggtttccctgttgttgagtgcttgacaatggtttttgaggtgggccttaggtgttgtgaagaatctccgatgaaccggttggcaacgagtatagtcgtcaaggagttgatctcaatcagagagaggttctttaaagccagtagaacgacttggcgttgaagtgtttggttttgtctacaaactttgcaacccaataaaaaggcttataatatcttatttcataaattggggttttgtctaagaatgcttgtagaatattgctaatgaaatgcttgtgttaattaataaaaatgtatgaatgttgtggtaccaattttatatggagacaacgtagctttatagttgcaaatccacattgttcccaattttatttggattctctttgttttggtaatgtaaagttctgaacatggagcaatagatcgatgttcaacgataagtaagtaagccttgtcgtcttggtaattgcgtttactaaaagtcccacaagtgggatatggagaaaatacatctaatgccggtcagatcatgaaatgagatcgacgtcaacatttctagcataaaattgacttttgttggcacagtgatcacgacattacgatacgttttagcttacaaaaaatcgttaaccggattatagggtatgttacccataacaaaacaaaattgtgagcaactattcgtaacactggtggatattacaagaataatcttcgtttactgtacttttaatttttctctttgaaattttactattttgttgcaactagatgttaatttaggtatgcaaaccctatttaattaatgggtatgtgtaagagaaattgatccatttaatttcattaagaaaaaaagttaaatggggttaaataggttagcccaactaaacatatttattaaatgtagttttacaactaaacatatggggtatccaattaaacctatttatttttcttttatattatttattcttattgaaaatggtaatatgtttatacattaaaattaaattaataaattattctatttaacttcactttttggtttaaatatttgtttttaaactgcaaagctccattttccactaaaaccgtaaaccaatgttttcccgtcaaaatcgtaataccacgttttcccgtcaaaaccacaaaaagtgttttccgcaaaaattgaaaatcatgttttcccgccaaaaccgtaaaccgacgtttttctaccaaaaccgtaaaaccacgttttcccgccaaaaccgtaaaactacgtttcctaccaaaatcaccaaaaatgtttttctgcaaaaatcacaaaaagtgttttcaaccaaaactgaaaatcatgttttcccgccaaaatcgtatgccgacgtttttccgccataccgtaaaaccacgttttctccccaaaatcacaaaaaatgttttcctgccaaaattacaaaaagtgttttccgacaaaattgaaaatcgtattttcccgccaaaaccgtaaaccgatgttttctcaccaaaaactgtaaaccaatattttctcgcaaaaaccttaaacccgtattttctagctaaatttttctttgccaaaagaatattcacccataaaaatctgtaaaataattattgattatattatatagatatagatctaaatgggtttaaatagattaatgataatttaaatagaaaagataaatgaaatataaaattaaaaagagttaaatgatttagagtaaataggatagattttaaatgggatgggttaacccctattaacatttgcgactaaactattttggctttgcaataataacaaatgaaacctgtcgtcagttggtggatttcttaaacccaaggtgcgtgaaaataaatatacaagtgacataagttgtaaacagtaatgactagtgtcatcttttaacaaagttgatttgttgacttagacggcaataatacgtgtcgtattctgtgtggttgtgagccaatttattatcaccacaatacgtaatgaaaggatttgcaattgcttcgtccccttttaaatcagtttcctgcaaagttgataagcacaaaaacattcaaaatataaaaataaactttgagaagg

SEQ ID NO: 9594 - DNA, 3000 bp, Unknown
  misc_feature (1)..( 3000): cDNA_ID_3042580_gDNA_ID_1972159_Annot_ID_179555 3000 nt of promoter + ATG
aatccccataaataaaaataaaaggttccataatctatttccaagaattgtctccttaagaatcacctttcatctgcagtagcatttgcttcatcagacgatgtagaaggagttttcgataccatctttgcttttattacagaacaagattctctgtcaagtcacctaaaatttagacataagatgattaatcaaaaagaacagtgatcttaatgaatctaacaaatcattcatctttataatcaatcaatcactcctaatgtcaaataaacacaaacgcaccaagaaacataggagcagaaaaaaaaaaaaaactttcgtgtgatttttgattcctcaaaaactgaagcaagtgttttagattctgtctttattacccatattcttgtcaaatcaaatagtgaagaataattctcaaaaattacggctaagttctcaacacaacagattcagagaaaagaactacctttctttctccggtgagaatctcgtcggaaactgtagacgattaggattcgaaacgagtagaagaaataataagagaatctgagaaaatgaagagtgaaattgttttttttggaggaagaaggtccgaagttgaggagggcgtgtggaggcgcgtggagagcacagaagaaggtggtgcgtttaagtggacacgtgagttcgacatgtgcctttctcttttttacttttgtcttcttctcttacgttgcgtgccactaaagctcatctctcatggacacgtcatcgtatctttaattaataaaataataatattaatcgagtggaagagtggtttaaatcgggtaaagttctattaatggaaatgtttgttgagtgtaaataacattgtattttctacagattaatcgggtaaaaagttgtactatctgtttaagaattttatcgagtagatgaaaagtaacattttcacaaaaatataccgtagaacaccaaaaaaaaaaaacaggggcatgtggggtcaacgtgaaggataataaaggcatggaaacgcgccgtcgagagctgatgacgtgtctgtcgtgtgtttcccacaaactctatttattgacggtatgatgattagtatacacatttttaatggcatagtcaaattcagtgggtgaggaaaaattgaagataggaaattaaaaagaaataacgaaattatattaatctgcctattcctcttctccttcattttgaattcaaaaaccgaaatactatatatagttttgcggttcgaatgatgactgtattttgtgatacggaaaaagtatgggacggttcaaataataacaaaaatacatagatatatatgtatatatagagattttttatactgttacagttacggtacggttttgggggcggtctatgtcaccattcatacactgtgattaagaaacatacaaaaggcgttttcttgtttttttattaaaactacaatacagttaccaatcaatacttttaacaaatttgcgtttttcgaaaaaaaaaagaaaaaagtttgcaattttgtcctaaaaacaatacactggaatgcttttcaaaagaagaaaaatcatttacctagtgtttttgctcaaaaccgcattccaacaaaaaaatcgttcattactccattacttaagcaaattgttatgtcctacgtcccaaccaaaagtttctcagcctttgcctcttccatacacacatccctcgtttattactccattacttaagcaaattttaattttttttccattagcttccccatttaaatatatgtacaaaaaaagagagtatatgtgtgcatcagaatcactagttacctagtgcataaaagaaaaaaatatacgtaggacataacaatttgcttaactaatggactttaatatatatatatatatatatatatatatatatatatatatgcaataattatagttttattctttttatttaattaaaatctaagaaaatgtaattacaagaaatagaaatatcataatacttatagaaattttgacaattattatccactataagcttatataagttctataatcaatttactagtaaaaaattatgatttttttttcaattttttatgatgaaactattcaacgaatttaataatatgtatgttaaactttaaaaatgtatattttgatttatttatgtattaataatttataaatatatgttattgcttatttattaacacaaaaataataattaattattaatatatatatatatatataatttataatccgcaccgcaaataattttttcatcaatcaaacattattctgtaccgcttattttgtacaaaccatatttgtcccgcaaatatatttttctcgcacgtaccgtaattgaactgtactgcaatgttataccacttttctcacatattaaaaaccgaggttaccattcggaccataatatattttttcatcaattgtttgcattataaaaagaaaaaaaaaaagaagaacaaatcggagggttcagatttcagaaacaaaataccgaaccgctaggtcgttggttttgccggttcgtttgcaccgggattttagagctagacagggaccaaataattaagcggatcgtgggtattaccggtccgggtccggaaaaacatctgttagaaactaatctcgtttggcccaaacccaaaaaagctagcttcacggcgtttgttgttcttcctcgctcttcgccgccttcactcgcagtcgcaggtaagcttcttcaattcccctcttaaatcaactaacgcttcctaattcctcctctggcttcgttcctctccttttttccaaggtttgtgtcaatctgaaatcaaaatgatcaaatgatcatgaacttaattgtagaaactttaattagattactcgaaatcaaatttgaccaatctatcagaagcaacctttttattacgtttcttcatctgaataggtctgcccagttgaatacattacaagggttatttttgtctgaatg

SEQ ID NO: 9595 - DNA, 3000 bp, Unknown
  misc_feature (1)..( 3000): cDNA_ID_3042578_gDNA_ID_1972159_Annot_ID_179557 3000 nt of promoter + ATG
aaacactaggtaaatgatttttcttcttttgaaaagcattccagtgtattgtttttaggacaaaattgcaaacttttttcttttttttttcgaaaaacgcaaatttgttaaaagtattgattggtaactgtattgtagttttaataaaaaaacaagaaaacgccttttgtatgtttcttaatcacagtgtatgaatggtgacatagaccgcccccaaaaccgtaccgtaactgtaacagtataaaaaatctctatatatacatatatatctatgtatttttgttattatttgaaccgtcccatactttttccgtatcacaaaatacagtcatcattcgaaccgcaaaactatatatagtatttcggtttttgaattcaaaatgaaggagaagaggaataggcagattaatataatttcgttatttctttttaatttcctatcttcaatttttcctcacccactgaatttgactatgccattaaaaatgtgtatactaatcatcataccgtcaataaatagagtttgtgggaaacacacgacagacacgtcatcagctctcgacggcgcgtttccatgcctttattatccttcacgttgaccccacatgcccctgttttttttttttggtgttctacggtatatttttgtgaaaatgttacttttcatctactcgataaaattcttaaacagatagtacaactttttacccgattaatctgtagaaaatacaatgttatttacactcaacaaacatttccattaatagaactttacccgatttaaaccactcttccactcgattaatattattattttattaattaaagatacgatgacgtgtccatgagagatgagctttagtggcacgcaacgtaagagaagaagacaaaagtaaaaaagagaaaggcacatgtcgaactcacgtgtccacttaaacgcaccaccttcttctgtgctctccacgcgcctccacacgccctcctcaacttcggaccttcttcctccaaaaaaaacaatttcactcttcattttctcagattctcttattatttcttctactcgtttcgaatcctaatcgtctacagtttccgacgagattctcaccggagaaagaaaggtagttcttttctctgaatctgttgtgttgagaacttagccgtaatttttgagaattattcttcactatttgatttgacaagaatatgggtaataaagacagaatctaaaacacttgcttcagtttttgaggaatcaaaaatcacacgaaagttttttttttttttctgctcctatgtttcttggtgcgtttgtgtttatttgacattaggagtgattgattgattataaagatgaatgatttgttagattcattaagatcactgttctttttgattaatcatcttatgtctaaattttaggtgacttgacagagaatcttgttctgtaataaaagcaaagatggtatcgaaaactccttctacatcgtctgatgaagcaaatgctactgcagatgaaaggtgattcttaaggagacaattcttggaaatagattatggaaccttttatttttatttatggggattgattatgtttggtgtataaaacagatgtagaaaaggtaaagtaccgaaaaggatcaacaaggccgttcgtgagaggcttaagcgtgagcatttgaatgagcttttcattgaattagccgatactcttggtaaatttctcatctttccgtagatttgaatgaacaattgctcgagtgtgttgtgatattttgaatgtgattgtgatatctaactgtgaacatgtttctttgttgcagaactgaatcaacagaacagtgggaaagcttctatactatgcgaagctactcgattcttgaaggacgtgtttggtcaaattgagtctcttagaaaggagcatgcttctctcctatctgaatctagctatgtaagtcaatttctatatgcacattgattgtgtttatgtattctgtgacgtgaatcaacaactaagacgaatgttgcttcaagaagttacttcatctttgtatttttctaaatggtcttgttgatggaaactggtgttgtgtgtaggtaaccacagagaagaatgagctcaaggaagaaacatcagtgcttgagactgagatttcgaaactacaaaacgagattgaagctagagcgaatcagtcgaaacctgacttgaacacctctcctgcacccgagtaccatcatcatcattatcaacaacaacatcctgaacgtgtatctcagttcccaggacttcccattttccaaggccccggctttcaacaatctgctacaactcttcatcctcctgcaacagttcttgtccttccaatacaacctgatccccagacacaagatatctcagaaatgactcaagcgcagcagcctttgatgtttaatagctcaaatgtgagtaagccatgtccaaggtatgctagcgcggctgactcgtggtcttctcggctacttggagagcggctgaaagccagtgaatgaggtcttgaacggctccacatggagtagcaacgcaagttataagacatggcaacttatgaaggactctggttttgtattttttaatacatcgttctgatgtccttgtgggtttggccttggctatttcttgtttttgatggttgttcataggatcaggaagttatggccttgatgggtcgtttgagataaataagtaaattagctctaaccattgtcattttcttttgtcttaagattctaaaaacacagaaacagaacaaaaaaaatcaaatttctttttaagaaaaaagctttctaatggaaactaaaatgtgaaattgggtttaaaagacaaaaccggttaataggttttggtttggattggataaagaatatgatggtattttggtaaaataggcacttgagaaaaagagaagtgagaggagccatcttatctttgctatcgagtgggtaagaagaatcagaaaacagaaa

SEQ ID NO: 9596 - DNA, 3000 bp, Unknown
  misc_feature (1)..( 3000): cDNA_ID_2184111_gDNA_ID_1972159_Annot_ID_179556 3000 nt of promoter + ATG
aagataaaaaaaaaaaagaccttatcttggttatttgggtgcaatgttgaaccataaacacaacagaaatccacaggaggaagaacacttaagaagctcgaaagctcatctttttgagtagtttccattcagacaaaaataacccttgtaatgtattcaactgggcagacctattcagatgaagaaacgtaataaaaaggttgcttctgatagattggtcaaatttgatttcgagtaatctaattaaagtttctacaattaagttcatgatcatttgatcattttgatttcagattgacacaaaccttggaaaaaaggagaggaacgaagccagaggaggaattaggaagcgttagttgatttaagaggggaattgaagaagcttacctgcgactgcgagtgaaggcggcgaagagcgaggaagaacaacaaacgccgtgaagctagcttttttgggtttgggccaaacgagattagtttctaacagatgtttttccggacccggaccggtaatacccacgatccgcttaattatttggtccctgtctagctctaaaatcccggtgcaaacgaaccggcaaaaccaacgacctagcggttcggtattttgtttctgaaatctgaaccctccgatttgttcttctttttttttttctttttataatgcaaacaattgatgaaaaaatatattatggtccgaatggtaacctcggtttttaatatgtgagaaaagtggtataacattgcagtacagttcaattacggtacgtgcgagaaaaatatatttgcgggacaaatatggtttgtacaaaataagcggtacagaataatgtttgattgatgaaaaaattatttgcggtgcggattataaattatatatatatatatatattaataattaattattatttttgtgttaataaataagcaataacatatatttataaattattaatacataaataaatcaaaatatacatttttaaagtttaacatacatattattaaattcgttgaatagtttcatcataaaaaattgaaaaaaaaatcataattttttactagtaaattgattatagaacttatataagcttatagtggataataattgtcaaaatttctataagtattatgatatttctatttcttgtaattacattttcttagattttaattaaataaaaagaataaaactataattattgcatatatatatatatatatatatatatatatatatatatattaaagtccattagttaagcaaattgttatgtcctacgtatatttttttcttttatgcactaggtaactagtgattctgatgcacacatatactctctttttttgtacatatatttaaatggggaagctaatggaaaaaaaattaaaatttgcttaagtaatggagtaataaacgagggatgtgtgtatggaagaggcaaaggctgagaaacttttggttgggacgtaggacataacaatttgcttaagtaatggagtaatgaacgatttttttgttggaatgcggttttgagcaaaaacactaggtaaatgatttttcttcttttgaaaagcattccagtgtattgtttttaggacaaaattgcaaacttttttcttttttttttcgaaaaacgcaaatttgttaaaagtattgattggtaactgtattgtagttttaataaaaaaacaagaaaacgccttttgtatgtttcttaatcacagtgtatgaatggtgacatagaccgcccccaaaaccgtaccgtaactgtaacagtataaaaaatctctatatatacatatatatctatgtatttttgttattatttgaaccgtcccatactttttccgtatcacaaaatacagtcatcattcgaaccgcaaaactatatatagtatttcggtttttgaattcaaaatgaaggagaagaggaataggcagattaatataatttcgttatttctttttaatttcctatcttcaatttttcctcacccactgaatttgactatgccattaaaaatgtgtatactaatcatcataccgtcaataaatagagtttgtgggaaacacacgacagacacgtcatcagctctcgacggcgcgtttccatgcctttattatccttcacgttgaccccacatgcccctgttttttttttttggtgttctacggtatatttttgtgaaaatgttacttttcatctactcgataaaattcttaaacagatagtacaactttttacccgattaatctgtagaaaatacaatgttatttacactcaacaaacatttccattaatagaactttacccgatttaaaccactcttccactcgattaatattattattttattaattaaagatacgatgacgtgtccatgagagatgagctttagtggcacgcaacgtaagagaagaagacaaaagtaaaaaagagaaaggcacatgtcgaactcacgtgtccacttaaacgcaccaccttcttctgtgctctccacgcgcctccacacgccctcctcaacttcggaccttcttcctccaaaaaaaacaatttcactcttcattttctcagattctcttattatttcttctactcgtttcgaatcctaatcgtctacagtttccgacgagattctcaccggagaaagaaaggtagttcttttctctgaatctgttgtgttgagaacttagccgtaatttttgagaattattcttcactatttgatttgacaagaatatgggtaataaagacagaatctaaaacacttgcttcagtttttgaggaatcaaaaatcacacgaaagttttttttttttttctgctcctatgtttcttggtgcgtttgtgtttatttgacattaggagtgattgattgattataaagatgaatgatttgttagattcattaagatcactgttctttttgattaatcatcttatgtctaaattttaggtgacttgacagagaatcttgttctgtaataaaagcaaag

SEQ ID NO: 9597 - DNA, 3000 bp, Unknown; identical to SEQ ID NO: 4569
  misc_feature (1)..( 3000): cDNA_ID_2184119_gDNA_ID_1972159_Annot_ID_179562 3000 nt of promoter + ATG

SEQ ID NO: 9598 - DNA, 3000 bp, Unknown
  misc_feature (1)..( 3000): cDNA_ID_3042574_gDNA_ID_1972159_Annot_ID_179558 3000 nt of promoter + ATG
tccgtagatttgaatgaacaattgctcgagtgtgttgtgatattttgaatgtgattgtgatatctaactgtgaacatgtttctttgttgcagaactgaatcaacagaacagtgggaaagcttctatactatgcgaagctactcgattcttgaaggacgtgtttggtcaaattgagtctcttagaaaggagcatgcttctctcctatctgaatctagctatgtaagtcaatttctatatgcacattgattgtgtttatgtattctgtgacgtgaatcaacaactaagacgaatgttgcttcaagaagttacttcatctttgtatttttctaaatggtcttgttgatggaaactggtgttgtgtgtaggtaaccacagagaagaatgagctcaaggaagaaacatcagtgcttgagactgagatttcgaaactacaaaacgagattgaagctagagcgaatcagtcgaaacctgacttgaacacctctcctgcacccgagtaccatcatcatcattatcaacaacaacatcctgaacgtgtatctcagttcccaggacttcccattttccaaggccccggctttcaacaatctgctacaactcttcatcctcctgcaacagttcttgtccttccaatacaacctgatccccagacacaagatatctcagaaatgactcaagcgcagcagcctttgatgtttaatagctcaaatgtgagtaagccatgtccaaggtatgctagcgcggctgactcgtggtcttctcggctacttggagagcggctgaaagccagtgaatgaggtcttgaacggctccacatggagtagcaacgcaagttataagacatggcaacttatgaaggactctggttttgtattttttaatacatcgttctgatgtccttgtgggtttggccttggctatttcttgtttttgatggttgttcataggatcaggaagttatggccttgatgggtcgtttgagataaataagtaaattagctctaaccattgtcattttcttttgtcttaagattctaaaaacacagaaacagaacaaaaaaaatcaaatttctttttaagaaaaaagctttctaatggaaactaaaatgtgaaattgggtttaaaagacaaaaccggttaataggttttggtttggattggataaagaatatgatggtattttggtaaaataggcacttgagaaaaagagaagtgagaggagccatcttatctttgctatcgagtgggtaagaagaatcagaaaacagaaaatggcgaattcactatgcttcttctcttctcctcctaccttttgcttccaatctccaagcaaaaaccctaaaccttctcacttcttctcaactaatgataacacctcttccttggtacagaagagagaactgcttcagacttcaagatcccaaagttttgaagttaaggttagaattttcccaaactcttctcttctctataaaatttgcttacttcattgaccatttcgttaatgcaaaatctcattctgtggtatcaataggccgcaaacaataatcctcagggcactaaaccaaacagtttagtttgtgcaaattgtgaaggggaaggtaagttcttacctgttttataattctcttagttttctactcctgaattggttagtaatttgataaagatgttttttcaaaggttgtgtggcatgttctcaatgcaaaggaggtggtgtgaatttgattgatcatttcaatggtcagtttaaagctggtgcactctgttggctttgcaggtttgctacatcttatattctttcttctaattcttccttctccacaacacatacataaactcattacttaatatatatttttacatttcttgtgggcagaggtaaaaaggaggtgttgtgtggggactgcaatggagctggtttcattggtgggttcttgagcaccttcgatgagtagtagaaataagcttcttccaagaagactggatttgattacatggactcaaaaaacactcttttataaaccttagaagaagtaaatctttctctctatcaatgctcttctttaccaaaaacatgtattactatttgttattgcacaccaaacttttgttgtatttttgtttttcagattcttctctctctctctctcgttttttgtcttctacaaattgctaaaagtctatagcacctctatggtagtcttgttgatggcttgaaatgttgaatggtttagagaagaattaatcaaagttttgttctattcatttacattgaaagagaatgttttatatcatcctagtatctatctatatgatattagaatttttattttattttgatatatttgataaaataagatggataaaactgaaaaaacattgcacctgaaaaaaggagaagaaatggaaacaactgtaaataacagataaacgcatctgagaccaacaaaaggagaagacacagaccttttttctcttatctgttgttgttgttgtcgtcgtcgctgggtcagaatcttgttgttatgtttttctttattctctcgctccacgtttcaaatccaacacaaagatctgtctgattctcgggagagtcaagtcagaaacctaacgagggatattagttcgtctaaattgctccaagctcaacatatgtttgttccgtaatttcaataggattcgatttgttccacaaaaatatattttcgcattgtggcgtgcggaacaaggaactaggtgcgtttctctatgatttttgatcatcaatcctgttttgtgtaatccgcattgtagatgatttggttatttctatatttcaagggaaaaatgatgaatgcaaatgcgattccataggagaaagcagaagtagttattagacgtcttgatgaggttttcgattcgaaagcttaggtaaagaacctctttggatatcaaaggcaaaaggggttttattatatggggcgagcattgggattatctggtgctcaaaacttgga

SEQ ID NO: 9599 - DNA, 3000 bp, Unknown
  misc_feature (1)..( 3000): cDNA_ID_2109463_gDNA_ID_1972159_Annot_ID_179550 3000 nt of promoter + ATG
tgttctagaaactattaggaaacatcggagaactttcaagatcttgatccagagaaacaaacgaaagtcgaaaccctagctagctagaccttaaagattcagagatattatatatattacaccactcgacaatttagtcaaaatagtatttgtgatagatgacagtaaatagtatttactgctataatttatcaaagctatgggtgacttttttttttccttttcttgcatcttgaaaatttgtgtacattaggcattagccattaaggtaattactgttaaaagttaaaactacggtaaatatttttgaacttacgtgtactattactgtactctatttatttcacaaaaatgtgattttatatatttaatttttttttgtttaaatgtcatcttaaggtttacaaatgaatttattccaaaacaaatatgaagctaagaaaatttgaattttctatacttgtccaaaatttggtttgagtctatataagcacagtttagttaattgtatactgacgccaaaaggaaattaattgtaaaaagatgtatacaattttgtttttagctaaggattctctcttcttggtttattcacgttgttacccaaaagttctgacttagtttctatgcctttctttaccctctaaaaaatgcaaagcaatcaatattactcatcggaatattactaaggagttttttgggttaaccaacccctacaaagattttgggtgaacatggacatatattggctgagagtaaaattgcttccctaatcttgtaactaaacgaaacgttggtttaaaactcgcatactaataacttttagttgccaattcacttgatgaatgagtgcactcaattgcttatatcgaagcatatatactatattaatacaattttttttttctttttgctaagaatatcattattttataaaaaatgtacttaggtctacaataattgaaatgtagacctaaaatgttgaaaatattttcttatcttcaaataccttaattcttatataaaaagaaatcgacgcatagcatgatactcagcctcggtaaaattaaaagcataatcttaaccttaagaaccagacaagaagttttctgttgaattctaatcaatattataaacgataccaacaacgtaaaataatttcgaaatatacaattcaatttctgatattcagtattacaatataactagttatactttaacaacaaataaatataactagttagaggtgtctatgtgacgattttagtcaaaattattaataccatcatcctcgggacatgggttacgtaatacaaaaagacgtggcgtatggggtttcaacctattttgttcaatgaagtctctacggtccgttgaatttgtatctattgtacgtagtatcttcagacgattttttcatattgtattatataatatttatgttaattatttagatacgtataatattatttcctatccaatttaaaagctcaatacacaacgacgacgcgctttgcaacattcctctcgtttcttgtaaagtttttgaaatccttaaactgatttttaaaccaattcttagtgtatgagattacaatcattattgttttacaaaaaaaaagtttatcgatctaaatataccaacaagtccaacatcaccaaaagatctatatgtgtggacattttccttattgggaatgtggggatatgtgtttcgattatcttttatcaaccgttcaattcaattacctacaaaagctcacaagtcacacctgacaccactaattaacatttttacatgttcgactaaattcgcatcaattcaaatttaacttcttttttttcttcttttaaataataaattttgctacttattctgtgttttgttgatgtctatatttgattgttcatgagaatttgacgggattgaaaccaaaatatttggtttgattttagttaagttcactcaattttgatatatgctaagtcgacttattaagtggttactagttttatatattttgagatcatgtaatagttttcatatgatatgtataccaatttgatcacaacataactcacaaaatatcaatatttttagagagacagataattagtttaaattccggttggttctcaataacgcaggaaggacattgtaaaatcatgccacatatatgcatgcaagtggaaaatccaaatttacaaattcatattatgaaaatccttttattgtttaattcatgtatgcttttccaaatgtataattagaaggtttaattacataaatagaagttatatactcatttcactctcattgtggacccatgcataaatgcaatcaaagtctttgaagtctaaacccaatcaaattgatgaacacctaataaaatgatacatgcacatatgttctcgtgtggagacaaaattaagggtttatttgcgataatatgaaatgactaattacaaagagaaaatagtaggctaattttagagagagaaagcatggagtaatggtggagagagagagagaggaggctgactttggagagcaagagagtaaatgcatttggctgtccatgttgactctttgatagcaaaaccccactcttcattattgttacttttaactctattattattgctactaattcactcttcagcttaaacctctctctctctctctctctctctctctctctctctctctctctctctctctctctctctctctctctctctctctctttggctgtataaatatacacaagctctctctccacatcttcagacaaaaccaaccaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatg

SEQ ID NO: 9600 - DNA, 3000 bp, Unknown
  misc_feature (1)..( 3000): cDNA_ID_3042598_gDNA_ID_1972159_Annot_ID_179547 3000 nt of
tgaccgacccgcgcattctggcaatggcggctgcagaacgtcatttcttggaagcagactatgatgaatattctgagaataactcaagcggagctgccttttgtcgctctgctgctctcatcgtaagctctcagttgagaagatgttttcttaccatgatttaatactaaatgcctgcactctaacttctgtaatggcagctaatggcacttttactgttacgagatgcgctaaatctcacaacgaacccagacgacgaggacgatccaactgccttcttctctgtatgttcatctttacttactttcactacttctttataccgtcactgactacacttgtttgtttcaatagctattccttcttcgtgctgctggttttctcctcccatgttacatcatggcatgggccatcggtatactacaacgtcgaagacaaagacaggtgtgtacacggaaaaaactctctgtatcaaactctgttatattgtaagatactcaatctaacagatgagacaatgtactgcttttgtttgtaatcaggaagcagcggctctagctgccgcagaagttactttcatgatacacggtggtgggcctcaacgcagaggactgcactttgctgtagcaccgcagccgccgatatccaatgtcccaacaccagtttgatccttaccggcaatgattctccgttaaggctattagataaaaccttgaacttggttataagaactctacctacttatgcttcttcaaatgttattatcttcctcttatgtttgtgttatctgaatctgttaaatgtctacttcggctctcaaatgttttacaaagagctctcacggtatactatgtacagtcttattattatcatatgattatataagtattatatttttatttaccttttataaatttatttggtcaaccaaacataaataaatgtccaatgcaatattggagggtcaattacaagtcttgtcgtttttttcttcacaatgactctttatgaactccataaccgttaaaaccaattgactttgataattggtataacaatgatcagctccttccacaatctgtagctcgtggttcggtattatctttgcaaactcctttgcatcttccactggtactgtctcgtcacccgatccatggaccgtcaagaccctaccattacatcaatccgggcttgtttataatgtatctcaaacaaacgatatgagttggtgaacttattgaatctcacctgcattctttgtcaatcttgaggcaagcttcatgcatatctgtgtttaaccggtccatcaaactctcctcggtaacacggtaaccagaatctcctgtaacaaaccagtacattgatagtaacactaaagttctgataacggtgcatgaaaagcgaagagcgataacaataccatctttaacatcgatgtatccttgttgcttaattctttccaaaaaatcttcaccaagacgttctcctatgcctttcttcagatcataacgtcccgagagattgatcacattggggatatcgtgatacttggaggcatagaggaggaccacatcacctcctatgcaatgtcaaagtataagttgagtttcttgcaatgtaagattcaccccttttgaaaatccgttgctcgaagcagaaagatcggtactacttacctttactgtgaccgagaattatagtaacaacacggttcaagttagagaagtattggataacagaatgtagatcatcagcttcgtaattgtagttaccataatagaaactgccttcactctctctgaaagaatgaaagcaccacaaccccagagtcaaaacaaagaccaacttattcaagataatgcaagaaagaaaaacatacccattcccggagaaatcaaaacggaaagcactaatcccttctctctctatagcaacagccacatttttcataatttcgaagttctggatacattcataggccaaagacaaaacaaagttaatgcatgcaataactcctaccaacatctgcaaccctactatgtcatgaggactccactttctttgtgtacaaaataaatattcccaaacaacgaagaagcagagctactaatgggaaaacattataatcactataaaaaaagtgaactaaaattatgcacaaatctttggtaagatgttggattgagaaatggacattcaagtaagtgagaaaaaagcagaaccgaaactaaccttgtttgatcgaaagccatgacacaagactacaatttctgtagaaccagtttcatgaagcagacccaccaggttctcattgtggctgttcagaatcacaatcttctgttgtgtacttccctgcgatgaatccattctcaacttttttactttgtttgttgcaggaaatttgggtctccttaatggtaaggcgtgcgttgagaaagataatgtgggacaaccacatgatctctcattgatcatattttggaatttatatatatatatatatgatttctatttaattttctttgtcactcattattttttctctcttttttctagtgtttaaaaaaacttagtttttaccaatcaaacctaccatctagtaaatgtaaatgaataattggtcaatttctacatcatctcctgactcctgttacatgtttataaataaaatagttcatttgctagttgctacaaaagtgccaaaatatttcatcctgtagccaccgcttgatgtctgaagaaaagtcataaagattcgtaaaatgtctttgtttttttgttcctttttagataatgggatcccataaaacgtgtctttgttgacgacttgacttaaattttcgaaaagtggcagtttaatatccctattttttatttcaagttgcattatcactacaggcattttaatttgcaattgcttcgcctcttatatgttcattttcctgcaaaacatgagaagcatcaaaagctttttaaccaccatttgtttttttggaaagc

SEQ ID NO: 9601 - DNA, 3000 bp, Unknown
  misc_feature (1)..( 3000): cDNA_ID_2184073_gDNA_ID_1972159_Annot_ID_179545 3000 nt of promoter + ATG
aaattagtcttctttatatagccgatgaaaataccacgtgactccaacgaccaaaataccaaagtccattagtataaagaaaaacatttatttacaaaaaaaaaacgatggatatctcaaaaataaaatgaccaaactacccaaccattatccctatatgtataacacacagcctcttctttttcacccacaaacaacataacatggcttccaccaaaatttccttagtctttttcctttgcctcgtaggtccttgtataggcgctggaaccacaagcgctgccgaatcagtcagtagcattgtgacacaaggtttctttaacaacattatcaaccaagccggtaatggctgcacgagaaaaagattcaacacccgcgactctttcattgacgctgctaataattttccaaactttgcaagttccgttacaagacgtgaaattgcaagcatgtttgctcatgtcactcacgagaccggacgtaagatttttttttccttttctctatgtttttatatattattaaaaacttattagttttgtttgtacatctactctagtcatgagtaaattattctcaaaacttttctctattttaaagtaaaaaatagagatttacattggagattgtctaagggttgaggtgtttcattattatttgagattatcaaatggtgattataatagttttattagagcacgttaagattaaacctgtaaaactgaacatttgacttaagctgattaaaaatcataacctttttttccatgtgatctctatgtcgtatagacttctgctacatagaagaaataaagaaaaggtcacgtggtaggtgcgacgagaacgtagagcagagaccatgtccatcacagagtaaaggtcactccggtcgtggtcatcagagtctcggtctcgaccttctacgccagcctgagcttgtgggtagcaacccaactgtagctttcaggaagggtttgtcgttttggattaatagcgtaaggccggtgctgaaccaaggatttggagccactataagagccatcaatgggatggaatgtaacggtgggaattcaggtgcggtcaaggcaaggattgggtactatagagactattgtagacagcttggtgtggatcctggtcataaccttagttgctaaaacgttttacaaacgcatacacgtgacgtgtcacgtgataatgcggaataagaagttacatttcaaacagggcaaggattcagaatcgcaagtacatgaattaacattctgtaactgttaattgtatcaagttgtgttaatatataagagctaggagaattggtctttcttatgtctagctagtaaccatctatgtttgtagctaggagctacttgttgtttctagttgtttgtctatctaagccaatcatacaaaatctatgcttattcacaaacatggagatcgatgttgcaaaattcatcatttcgattttcacaaacaattaaaatcacgctaccatggctcgcatgcactccatccgccgttggcatctccctccgagcagatcttgttgtcgttctcgtttcccttcaatagaggacttgattcctcatggtcttcgcggctatcttctcccgctatagattaaatacattctcatggtaggctaatgtatttgattgttggtcttccttatgtttattagtaacgttttgacgcctcctctaatcgtcttctcgggcatggggatgaccctttttggccaaatctagtagcactcgtctcaataaaaaaattgcacaaacaatcaaatacattagcctacccgagattctttcagatgcttagaaaccgatttgaatagtcatgttctaaccaaaacaaaaacatattatctttgacaaatcctaaaagtataaatggttcattcccacggtatttcaactcctctaaaccagtattagaaccatatgaatcaaatcgtataatcaagtatccacgaaacatcataatactaagctacatatataccttgatttatcagagttactattgtcattttgcaagtttcagatttgtctttgagaaaattgtcttactttgttgatattgagattatataaaccggataagcgaccttgattttacatgattttgctgttttaaaaaaaaacctaaccggtttcatttaattccgcatgttattaaaaaagagggaaaagtcaaagagtcaaacttattaggaacgtctagaattttccaacttggtccattttgcctactctattggaaaaaggaaacaaatatgtatattattatatgtcacataaattcttttccaacgaaacttcaataatttaccatatggaccaattttaattaattcctgtatcagatttaggtgaaacaatcttaataaacatttaaactcaaaaccaaaaaactgtaacacatttttccgtcaaaattgacgagaagaacaagcggctttctctactagccgttaaacagacgttatcttaccaaactccaaagctctggttcgtacaaacccgaacctcatccaatgcttatacacgtatgtatgtatacatttcttttagatattttataaaaacacgctcccaaaaatatttaatagagttgaattatgtttatctgattattattcagaccgaacacgaagaaacaaaaattcaacaaaaacaaagacaaagtttcgttttagcttaaaggttccagatttcgaaaaagctctctttttttttctccttcgtgttacacaaccatttctaggtaatgttttgatttcgaaagagctctctttataatgattttcatttgtgattctggaaatcaaatcgttctattgaaattggggattttttttcgattagggtttgtttggttcctgttaaattatcaaacgttcctgcatttaattgatttttggtcttctaatattttggagcttcttcttgttgttacagatatcattttggtgattaagttatttaagaa

SEQ ID NO: 9602 - DNA, 3000 bp, Unknown
  misc_feature (1)..( 3000): cDNA_ID_3042605_gDNA_ID_1972159_Annot_ID_179540 3000 nt of promoter + ATG
aaaaaaacaaaaacaaaaatataagtgtatcttcgaatttatttattaaagtaagaaagattttacatacatacaaattgtttctctttattggttgtattactgtaagatatatttttctgttaaatatttgatttcatgaaatccagaatccatatcaccagatggtggatgaatttcaatctatagtgtaccatgttatcaaaaaagaaaaagaaaaaaacagtatatgttccacaaattaggcattttataattgccatagttgatattcctaacattagtgaacaaatatgattagtcaattgaaaattgaacaaagcaaattaaacgtgaattctaaagcactagacacaaagcttcgtttgagtcgacccatttgttagtgtaatgactaactataaaatagacacgcgtaattaagtgatcatgcccattggctcccacaattccaccactttaaacagcatccataatctacaagtttttcttattgatcatttacatatgcaaatgattcatacttcaaggaagagaacattctactaaagcaatctccactgactttcaacattgactataatcttatcttttcttttaaaacaatatatagtatgtttaatgtacaaacactaaaaaccctacggataaattaggattttgcttatgtatgatggagtatacacacattttttcatattgtaattataattagtatcatatattatatcgaacaataaacgtggaaaagtgaaaccgcgtcgattacttggtgcttcgtatatgttcttttaaagtttagacattttggtgggctgatacaaaatactatagcagtccaaatcagattaaaaaaacattccatgtttaatttagtgatgaaagccccaccacgacaatattttaaaatgcgcaaataggaagaaaagaactataaaggaaaccaccacaaagacaaaactcaaaacaagttggaggaaaaagagagacaaaactcacaacaacatcaaggttttaactaaatttaattttgtcataactattcatatatagtcaaatggctaacaaagctctcattcatctcctcgtcatcttcttcttggctctatcacacatcttcttcttcccttcccatgcttcgagtaaaatcttcatctctcttaaaatcgtattttatgtatttacatcatatgttttaacttatatcatctatattttgtacgtatacaggacttgggagtttgatggagaagccaaaaattgttcgacctcaacaagatacactaatggttagttatttagctatttatctgtgttcttgagaggttaaaattaggttattaaagattttaatttggttttgttttacataatcaatgctattaggatgtgaagaaggaggtcgaagaaaggatggtgatggagttaaacgactatccaggttcgggtgcaaacaatcgccatttgccacgacaacgaggctgcgtcgttgattgctgatcgatatataaaatgacgaaaaacgaattaatatgattatagctagtatcgataaattgatgtataagtaagatacgtctaattatttttcagaatatgaattgagttagtttaacattggagtctatagacgattagactatatacttgtctactctacggagaaaagcatagttttatttatgtagttcagttggtaaatcaatagatgctattgttaataaaccatatatatggatgatatgtacaagcctttaatttcaatttggtgataggacataattggtttactgccaactaatagacattagactgacgtaaagtttttcaaaataaagataagtcactactctccttttcacttatatttaccaaaaattgagttagttaacttcttattcaaatttatattttgctgatatatcttatatactcgtcatgttttacgccacggatcaatataaaataaagatttaaaactaaaaactgatgtggaaaaagagtggtttaataaagtaaaacaacaacataattgaagttttatgcaacaccctaagtgtggactagataggaacatagaggacaggcaaaaaaagaagaggtaattaacatacctaccttggagtacatgccactatgccagttgggtttgatttttaccctcgaaatattagtatgttaccgttcatctccgagtaggtgttgtgattttatagacgagcaaaaaacaaaagtggttcatgagttttgtcgggctctctccaaagagacaagattgggaaagaatactctatcttctcattcttgttacattgattttgttttattttgcataggcgatgcagtaaaactattaaatatatactcaaggtttcaattatcataactggtgtgattgttagagggttaaatttaagatttatataagatgtgattacataactcttgtattaaaagtgtttactgtatttgtatcactcacatgtaatcattcaaaaaaatactaagatgaagatatggtaaaacatttcaacatagaaaaagacacaatcgataacaaaatagaacagtacacttgacctaaaccaatgcggtaaacacacacacacttatatacatattgttaataattttgaagttatgctatacaacttattattttgtatatcaatacatattcaaatagcttaatatttaaagcgctatgatgtcaatttcaaatactgaaattattttcaaaactttgtcacttatattatcacttataaccattctatatatcttcccaccgcgaaatttataaccacacttttacaaactaaatttcatacattttccaaatagtattgtaataaacaaaatagtttaaaaataatgtaatttacaaaacaataaatttttaatataaaacatattgatcagcaaaaatgctggttgatgcataaaaaagactcaactacagaagaaatattcagcacacgatatcacaagaagaactcg

SEQ ID NO: 9603 - DNA, 3000 bp, Unknown
  misc_feature (1)..( 3000): cDNA_ID_1023528_gDNA_ID_1972159_Annot_ID_179534 3000 nt of promoter + ATG
taataaatgttttttatttgaatcaaaaactgatcatgggtttgaaactgaactaccacgaagagtctcaatatttctacatatcaaatattccaaagggtacttgggtcggtgaaagcaacaagataataaatttaaaggaaaacgttacaaggaaattgcatggaaatttccatgaattggaatccaagacaatgaaagatgctctcactcaattttcaactctattgtcttgtgttcttggatatgatgagaagttgattacatttattattcaactatcaaaatatatataaacatttgtttttttcttatatgacaagattaacttccatgtctccatttggttcagtccaaaaatttcaatttgattttgagatatatatatatatatatatatatatatatatatatatatatatatatactccacctattacttgaaaagccaaacattttcaagaacatatattaattttgaaatgaaaatacagattaattattaataacaagcattaagtttttattagtatgatcatcattaatgaaagcttgagtcgatggtagtttcttaggttttctcggtaggtataaaagtatgaatataatactttcaattgaattgcggtgagttttaaagtagcatttttctttcctttggtaagtttctcaacaatttacatggagactctttccgcagactttgtgagtaagatatgttttggtcttcgtatacttaactaggaattataaaataggaccaactcaacacacttattatccaacctttgaaaccaaagaagacaaataaaagcttcatagaaattttgtttatggtattccacacacataaatttagatcaatatggaggattcgtctcttcttagcccaatctctctcctcaccattgtcatcttcttattcattctcaatctcatgatgataattcaagacttctcttcttcttttccctttcgtttccatctcttcttctctaatgcctacattctcttcacctcaataagaaacaataagcaaaataccgagctcccaatcataaagaaagttgttgtcccaaatcgagcagatatcaaaacgtccgtggaagaagtcaaggcgataatcgatgactcggaagctttatacgaatgtttgattgaagaaggagaagagtacttgcttgagaagaatgagatgatgggtaaggagatagttaaagaggcgtttaggttatttgatgagaatcaggatgggtttatagatgaaaatgagttaaaacatgtgttgagtttgttaggatacgatgagtgtacaaagatggagtgtaggaagatggttaaggtttatgatgagaatagagatggaaaaattgatttttatgagtttgtgaagcttatagagaagagcttttcgtgaagtagattggaataataataatagttatgttgttggctaattatacgacttgtctaatatatttcttcttctttagtgggtcgtcctctaatgaactttattttcctctgacaaacttatttacgttgatatattcatgcttctctgaatttccaagaaagtgataatatatgacaacgtaaacttaaatttgtgatgaattttgcatggtgatttccagttaggtttggatatcgtctttatctataatattgaagggaaaaaagtatggaccataatcgaacaaataaacttaattttcaaaaaactacagttaaaaatagttttttgaattcacaagttctctctagtagactttgataagagtttttaatggatagaatttgtatttactttcacacttataataataaaagtgatcatacataatgtttatatagagcttgagactgctacatctagctagtttcctaatacactttttcaataataaaaagagaagagattaatttgttttttttttaaaaaggtcaagataatagtcaatctcatcatttgctccaaaattttagtgttaatcaaatgtgggattatataacagactacaatgtaaatagtaggattctacaaactcaaaaatatttgtaacagttttttcttttaaaatggctttcaaattttgaggccgaatcgatggcttatgtatcttgttttctggggtctggctagatcatctgttagcacactaaattttgtaatttcctacaaaatgcatgaagaatattcccaaaatatcttataaggatcttcagtatcttctaatccattataagatttgagttaacagtttaaaaggtaatctcaaatgtcactgtaactctgtaagattttgaaagatgaacatgatcttgaaaaagagagattaaagaaaaagatggatttaagttcttcaacactctctttcttcttttcttcttgggcctaaaacaacccaatatctcactcttcaaacgagcccgagattctcaaccttgacaagcccaaagtgaagatagttttttagataaatccaaattggttttatgttttacaagttacatacactcccctatcttgatgattaggaaaatcagactttagatttttggtttcccatatgccaattcagttccatttgattggttgacgagaatcctcactccactctaatatttttaaatccatttaattgacacgtgtaacaacaatggacccgacactatcttattccgaccaatctcaaacaacattaaaatcctcttaagatacgcttcgaagataaaccgataagcctgtatctcctctcaaaccaatctcctccgtcaaatcaaccacgtcatctaatccaacggtagatactcagtcatcaaaccacagccacaaaactcgtttcaagaaacgaataaacttacaaaatcccctccaagtcttatttcttcacaaccatctctgaactcatctttcaatctctcttgattccaatccattcttcttcaagtgccgggttctcgggtcggatcttctaagtctagctagggataatg

SEQ ID NO: 9604 - DNA, 3000 bp, Unknown
  misc_feature (1)..( 3000): cDNA_ID_2184050_gDNA_ID_1972159_Annot_ID_179536 3000 nt of promoter + ATG
ggctcgtttgaagagtgagatattgggttgttttaggcccaagaagaaaagaagaaagagagtgttgaagaacttaaatccatctttttctttaatctctctttttcaagatcatgttcatctttcaaaatcttacagagttacagtgacatttgagattaccttttaaactgttaactcaaatcttataatggattagaagatactgaagatccttataagatattttgggaatattcttcatgcattttgtaggaaattacaaaatttagtgtgctaacagatgatctagccagaccccagaaaacaagatacataagccatcgattcggcctcaaaatttgaaagccattttaaaagaaaaaactgttacaaatatttttgagtttgtagaatcctactatttacattgtagtctgttatataatcccacatttgattaacactaaaattttggagcaaatgatgagattgactattatcttgacctttttaaaaaaaaaacaaattaatctcttctctttttattattgaaaaagtgtattaggaaactagctagatgtagcagtctcaagctctatataaacattatgtatgatcacttttattattataagtgtgaaagtaaatacaaattctatccattaaaaactcttatcaaagtctactagagagaacttgtgaattcaaaaaactatttttaactgtagttttttgaaaattaagtttatttgttcgattatggtccatacttttttcccttcaatattatagataaagacgatatccaaacctaactggaaatcaccatgcaaaattcatcacaaatttaagtttacgttgtcatatattatcactttcttggaaattcagagaagcatgaatatatcaacgtaaataagtttgtcagaggaaaataaagttcattagaggacgacccactaaagaagaagaaatatattagacaagtcgtataattagccaacaacataactattattattattccaatctacttcacgaaaagctcttctctataagcttcacaaactcataaaaatcaatttttccatctctattctcatcataaaccttaaccatcttcctacactccatctttgtacactcatcgtatcctaacaaactcaacacatgttttaactcattttcatctataaacccatcctgattctcatcaaataacctaaacgcctctttaactatctccttacccatcatctcattcttctcaagcaagtactcttctccttcttcaatcaaacattcgtataaagcttccgagtcatcgattatcgccttgacttcttccacggacgttttgatatctgctcgatttgggacaacaactttctttatgattgggagctcggtattttgcttattgtttcttattgaggtgaagagaatgtaggcattagagaagaagagatggaaacgaaagggaaaagaagaagagaagtcttgaattatcatcatgagattgagaatgaataagaagatgacaatggtgaggagagagattgggctaagaagagacgaatcctccatattgatctaaatttatgtgtgtggaataccataaacaaaatttctatgaagcttttatttgtcttctttggtttcaaaggttggataataagtgtgttgagttggtcctattttataattcctagttaagtatacgaagaccaaaacatatcttactcacaaagtctgcggaaagagtctccatgtaaattgttgagaaacttaccaaaggaaagaaaaatgctactttaaaactcaccgcaattcaattgaaagtattatattcatacttttatacctaccgagaaaacctaagaaactaccatcgactcaagctttcattaatgatgatcatactaataaaaacttaatgcttgttattaataattaatctgtattttcatttcaaaattaatatatgttcttgaaaatgtttggcttttcaagtaataggtggagtatatatatatatatatatatatatatatatatatatatatatatatatctcaaaatcaaattgaaatttttggactgaaccaaatggagacatggaagttaatcttgtcatataagaaaaaaacaaatgtttatatatattttgatagttgaataataaatgtaatcaacttctcatcatatccaagaacacaagacaatagagttgaaaattgagtgagagcatctttcattgtcttggattccaattcatggaaatttccatgcaatttccttgtaacgttttcctttaaatttattatcttgttgctttcaccgacccaagtaccctttggaatatttgatatgtagaaatattgagactcttcgtggtagttcagtttcaaacccatgatcagtttttgattcaaataaaaaacatttattattatagttgaatgatttgaaaacctcggaatctaaagttcacgtggtaattttcttaatcgtttttttatggagtataataggcttaaaaaattattaactaaataataatgtaataggcgctagactaattcaatttggttactattgaatcaaaatataaatagaaggctagcaaattaaattgaattaaatataaataagtttgaaaatattgaaatctacatctagccatctaaaacatagatgagaagtttcagttgcgataggttttagtacattaaattaaattcgaactaaccttataatttgttctattatatagttttgactggttacgaatatcgaaatggtttaaacaagaacatttggaagaaaaaaaaacatgagttgtaaaatatattaatcccaagagcaatgacaaagttttgtacttttcatgtctacttcttatctttgtagatagaaaattacgaatatcgaaataaccatcttgaatatacacgtatgagtaacgagcccatatatttatgttcgtatgtttatgggcctaatgagattaagaga

SEQ ID NO: 9605 - DNA, 3000 bp, Unknown
  misc_feature (1)..( 3000): cDNA_ID_3042902_gDNA_ID_1972160_Annot_ID_179577 3000 nt of promoter + ATG
agttatgagtcttcccactttgaccaactaaaccgttactaatatttccgttattagtaacggttccgttactattattaacatcgacactaaccggtttccggtgacttgttttgtgtccacctaacgcttggtaagacgggaaagatttgccacagacggaacacttgtaatctttctgatgatcggacagtggagaaagagagtgatgatccgacggtggagagtgatgatcggaggagccacgagcgagcataaggaggcaaagagcgagatactcttcttcagaaggaggagggtttggttgatctatacggtgacgttttgtacgttttcttttggtccatgattcgaggttttcgggctcggtttcgtcgaggcaacggaggaaaggaggaggagcggtggttgtggtggtggaggtgggagaattgagagtgtcgagagccatatggtggtgatctttgattagaagatgattgagaattgagagagatgattataaaaaaaagaaaaaaaaagagaaagagagagtgaagtgagctggtgagggagtgagatgagatgtgagcacgtctttgttttaattttttttgggtgattaagagtgggaacgtgggctctaagtgatcaagtggtgcttcttctcttatttctccatatccattaatatctcatcctattttcatcttttatatatttttctttaacataaatttatttatataattgaactaaattctttccaaatttccaatatatcaaaaatgaacgaaaaaagaatattagagtttgatgcagtcgatgtagaatcaatgaaatagagatgaattttgaatgatcaataatgataaatttgtgaaaatattataaaaaaataaagtaaatcaaagaaaaactatcttttcagtggcaccttgtccaataatgcgtaatctaagaatgcctattttaaaaattatgtgttgtgggggaagtcatgtaactataaatgtattagagtctaacatcaaactttattggaaagccgaaaaaagtaacacattcacaaagatggaaaactaaagtacttatcaaagttgtgctaattttgtcgataggtagcagtccaaatcatgagctgatcagcttattcaatatcttcttcttcctctttttttctattggcaacaatttattatccgaattgtcaatttcaatacactttattcaaaaataaacatatatccacacataattttacattagaccttttttttttggttataataatgattgtaaaagtaaaaggaacttttacatttgtagtgtagtctatagtattaatgtattattattatattgagaggataatttagtttactattaaaagcaagaaactaaaaaaacaacaaggcataaaatgcgacaggtgttgatgaagatttgagttgccatatcttcggagttagtttaaaggttaggccaggttagcgaatcttttcatggcgttgggtcataactgagttgtcaatttttcattggttggaagcaggttagattctttcgttggggacacgtggttagttatgtatggtggaaatggtacgatttggtggagacttaaaaaagacggtacgagacactttcttaaggctcaggcgacatggttgtgagtgacaccacccacttcataagcaactaattttatttattttcttttgtattttagtttacaaccatcaagtttaggatctcatagtttagttgcttaaaaaaacttcgtcttatatacttgacattacttgcttatttatttccttcaagtttttatatacagatcatgatttattatagatttttataagaaaaacaaaatctgaggagattaagagatgatatatgaataatggaggaatttaggtcctatatacaagaagttagttaagttttctttgcacaacaaaattaaaactcaaagtcaaatgagcttattaagatagaaataaactaacaacttgcatagctcatgaagagctttattgtgcaaagaaagtaaaaaaaaaaaggactttagattgtcaccaagattagtaatactttgattcaatcataaaatagggaagaaggagagctgcctctttaacaactctcttggttatatatcttaagagtcattacacatccttatatgaaaacataatcttgattgcaaaaccctacttacataggctttcagagtttagactagtaatggtactattgggctttgtagcttgctttaataataatagcatagagcataataacgagcaatgttattcatctttgaagttttatttgtcttgcatcataaaatacgttgacatatgcctagcaatcttttataaaatattgaaaatatattcccaaacatataaaatcctaaattcaaaagagcaacgtacatgtgagcaaagtatcgagttgttatgtagattcgaaaaacatagtttatatcattaatgaatacacaaactattccatcaatcatgcttcagtatttattcaatcatctcatctttttgttgggggcacaattcaatcatctcatcaaataatatttcacggcttcataatctgcatcgagaacttccaaatccacattaaaactaaccataagacacaaagaaaatggaaataacgcataatcaagaataattagtacaaagtgaaataaccacgtttgttgttaaagacttatcgatttaaataatgtaagcttaatggactcctgacattccaagcgtaatgttcttttacaaagtaaaaaaaaaaaattaaaagaagaaatggcttcgcccgggttcgaaccggagaccttcagtgtgttagactgacgtgataaccaactacaccacgaaaccttttgttgttacacgtccgttaatcattgattttaactattattgacttggacaattttactgccgtcactatctctatttggtttcctctctctcaaattctccgatcaccatg

SEQ ID NO: 9606 - DNA, 3000 bp, Unknown
  misc_feature (1)..( 3000): cDNA_ID_2184154_gDNA_ID_1972160_Annot_ID_179586 3000 nt of promoter + ATG
tgggtcatatcgtactatgattttggtgtaaaccaccaatttatctacactaaactgatacgattatcttttatgaaaatcaacaaaataataaacaaaagtttgctttatacaaatgtttagagttgtcttcttttttttagaaaaaaaagataaaaacatatggaataattgtttgcaggaattaaggtggattggccagaattaaatggagtaaagggacttgaagctaagagaataatcgaacatgacaatccaaaagtggtggttgttatcattcccgatgatgttgctgtactagccgtcaattgttgtaaccgtgtcattgtccgtgttcccgtcaacaactgtcccaatggtcctgtcagtaattttcctcacatcggatgagaaaactataatattcctcatgtcggataagaaaactatgttgttcttttacctagctatttcagttatatctttcgtttcaataatttccgataagtatttttattctctcagattaaaaaacttgtttgattatatcgtaatttatattatgaatgataaattgcttctaagttaacaacatttgcattttttatgcaactattcgaagtgtatcaagaaaacaaaaacgaaatatgatgcttattgaacaaattaagccgaaatatttttcaaaaaaattcttagatgaaaaatttggaaaatgcaccacttgttgcttgttgtgtttgaatatgttctcaaagataatgaaatgtgcaaagggctcatgcttgttgcttaatcatcctaccatcttactctaataacaaaatttagttatgtaatgtaactgagtaaaatgaaacaaaaacgagagaattcatgatagatagagaaatatggtgagaattcatgtaacccttgagcatcatccaaaagacttgaatcgtcaagacttgaagtctgtttttcctctgcgatcacaaggtacttgtgatttttactgtttttgaagtttccaaacacaagctgcttctggttatggaatctagatactctgaagaacacaaaagaccaatctaataaattcacttattactgaattagaaaggtgttttattttttaaaattatatggttattgggctacttcacccaaaatcaatttaatacaatataacgtataattaaacaagattaataatggatttagttaagaaaatgaggtcatatttgttattgcaaataattctcttagagtgtcaaaaatctgaaaacatacattcttaagaaacggagagagtaataaaacttctcatatatagaaatccataatttaaagtaatttcgacattgtaaaagaaatccatgtatgtaactatgtatatgaaaatgtattagtaaacaacaaaagagcacactggagacaccgaaacaaaattgaccgagacatctctatcgaatcatcattctgctgctttgacttgagctaaatagggatgagcttgtcatcaattcataaaaccatcacaatttagcagactatgagaaagaacccttgtttgagttacgttatatgatacttaccattgcttcttttgcagttaatctgtctttgtttattaaaatagtactcatcaacaactggtcattgtttaattgtttgtatatatagaacgttgatatttacgagttaaagtgggacacaaaaaaaatattaaatagagcaacgaatatttacaaaagaaaaagaaaaagttgatgttacgacttacgagtaagacagtctggagataggttcgagggagaaaaatgacagtaatttaatacgatttggccgaaaccaacgtcaaaagagtgtaagttggtcattttctaacagaaataaaccgtatgttggtctttcttttttcgataatcaagttggtcattctttaactagataatttttagttgtgtaagcatcttattctataaaacttttcactttaaagttaataatttatatgattgtggtatttatcaaaattgatacatgtatctatcaaatatacttatcaaatttctactgcttcatttcccatcaaactccttccagtctcatatacaaatttaactaactatatatttggaagaaatatataggatattttttcctattttctatatcaactgtttttcatagaaaagtcgtagggtatatatggttggacaaaattcctaccaatttcttctaagaactgtttttcgtagaaaagtcataagtatataatgaaaaactttttttactaaaagttttgtagaaaaattgctaagattttaccattttttcttgtagtatatatatatttatatgtctaaatagttttattttattttcttcataaaatatggaaaattaaataaaaatatttttacatatactaatttatatgtgtatatgtaaatttcttattgacttgttatccttactcaaaatagaaaactaacaatatatatatatatatatatatatatatatatatatatatatattgtgacattttaatataaatttttcagctcttaaccattgagataaaatgcacaaaactaaaaaatataatttattatgatgagatagatagttaaattgttttgtaagattgaatagttcaaaaccggtttataaagaaaaacttgtgtgcatgttaccatttacaattgaataaaacttaacatgtatttcttatacaggtgtatttagataggtcctaatctagttgttaatatatagaaaagttaatagctggtaattcttttatacaaatacaaaaaattggtacttgtttatatatatgtttgttttcgttgcctacttgccagtatttttaaatttcactctcccactaggcatcaaaagtcaaagctattgttttgtttatgaagaaaatatgaaagttgcataagccgaccttacattcatcctcaaaaatctctcatattaacaaaacttttactcaaagagcctctctcggcaaacactatg

SEQ ID NO: 9607 - DNA, 3000 bp, Unknown
  misc_feature (1)..( 3000): cDNA_ID_3042645_gDNA_ID_1972160_Annot_ID_179588 3000 nt of promoter + ATG
tgtgaataatccccacggtaagagtttgtggagaagatctcaagcgttcgatttaaaaggatcgacgagagagagcttgatggattgtttagcgttcgttgatcatcgagtcaagcattcaaatacacagaggattccctactatgcggcgcagatgataagaaaacagatgagcgccacgtgtattttctctggggttgtgtcgaatagtcgatgatctgacggttcaaaatcaaagttcgaaggaaggtgttgatgtgttaggcattaattgttgttaacaattcgttaattgtcttcaagttgagtgatgaattattaatttattagcgatagattgatgaaattgtgttgttttctttaatcaaaaactgatttggcgaaatcgtttttattttttcttctttttaatcgtcatttggatcgacaaaacatgatccataaccaaattcttacaatgagggtaatacgattatttggagtcgaactactcgactattggtacttcctagtagttggttatatcatttgttttgaacttttgattaaaaagttttagatattaattcgttaatttggttgtaccgtttttttcttttttgaatactaaaagttaataacttattatttcatggtgataagccaataatttacttggtacgattcaacaacagatcagattctgttataatcttattttatgggctgcttatttaaactgggcctaagccccataacaatattatttcttagattaacaacacttaaatcttattttatgggctcgttacaatgcgcctctatgtgtacgcgccttcgcctccacctagtgactggttgatcgtgactgcaaacgaagggtagttaaggtctgaggttctgtaatatatcagggccttgaggcaattgcctttttcgttagcttatagtcacggctctgggtgaaggcttgacatctacgatgattcatttgaatataactttcgctgttgaatttctattaagatataatttttaatattgtcacccgattttttatcgacgaacacggatggtaaaaaagtgtaccgagtagaggtaatggtgtgttagacaaaccactgctgggtttgaacaatgatgagacgacatcaaacttttttccgtttcctaaggttattgtagttggaaaaagacgatctacgatgtcagcgcctacactgatatacttcaaaaaaaccaataaaaacttaagctaacttaacaaaaataaataaaaactcaaaaaaattcatcaaagtaaataaaaatccttaaaatctagtcaaattaaaatttaaatcaaaaacaaaacaaacttcttttatcacatggtttaccaactctgtttagtatttaaagttcaaatcatcttgaaaacattaccacaaaatatttgacatttcttccacattttgtttttgagataatgttcttgataatgagataattaagcatgtacaaaaaatttttgaagcgggatttcaaactttatattactgggtttgtaatgaagtttggtaccagatgtcatttcataattttaccatttcattttttttttttcaatttttcaattcaaatatttatttctatgtttatgcaaataatttccttatgttttgcttatattttgcttatgtttctctttgtttttctcaacttgtttttctcctttcttatttcagcatttacaataagtcaaataactataacatcgttggagttgttattaaaaaaaaaaaaatcactaaattctttgaaaacttaatacgatgtttcaaaaagatattctacatatataggtaactcgttcagtaaataaaaaaagggtaatattagaaactaactatagaattgaaaagaatcaagtaactaaccattgtcagtttttctatggataaataactatatgacggcataagaaaatacaaaactatccttgcaagttgaaccaaaagcaagcttatgtagatatatttgatattttttagcaaatcgcatgaaacatgttaaaatagcacgatatttataaaaacgatgatattttataacgtacattttacacaaatagcatgttatataaacaaatatcgtttcatttgaaaagttgaaccatgagcaagcttacacgaagataaaataatagatttgagaaagttttaacatttaaatcatgtttttagaagaaattacatgtgattttaataaataatgtgttatatgaaaaagtagcatgtcgagagagagagatttctagttatcacgtgtaattcgaaaaagtagcgtggtataaaagaaaataacatacaatttaaaaaaaaaacataacgacggagattccaagaaataatcaaaatcgaataaaaaaatgacaaatcttctgcaaattgaaggagagatgatctatcaatataaataacgtttggcagcctagatttatcgaaaaagagatcaggtggttgtgatggtggaagatgtggtagttgtggtggtggaagaaagaaagatgagatgattctaagtgttttatatgattttgaaaaatagcatgtaatatatatataatacgaaaatgggtaaaaaggtaattgcaagtgaagaaagagagtgtgctctgacaccatggctattttgttagttcttttacaatccatagtcatctagtgcatattctcataaaaaaatgtgtccgagtgatacatataaaagcatctccaactctttcctttattttattctaaaatgaagtaactctattctagatttgtatttttattcagcctaaaaccatgagttgaatgattgtatgtgtaaacgatctccgccgagtttgagagggatcgaacgttggctttgtaccattcagatttgtctttgaagctgattggcatctcctgagccatatgaacgataaatgtcattcgttttgcgtagcttactggaagagaacaaaaagaaataagaacaagatgaaacatg

SEQ ID NO: 9608 - DNA, 3000 bp, Unknown
  misc_feature (1)..( 3000): cDNA_ID_2184190_gDNA_ID_1972160_Annot_ID_179598 3000 nt of promoter + ATG
agaagccaaaaaaaccaatggttttgtcaattatcaaattaatatcattattgggcctttatggcccattagtgaatattccggtacattaatactgagcactacaatggaagaaaatgaccatggctatgttgaaggtcaaactcaaggaaagcaacgaattagtggaataaagcccattgggccaaacgtatgagaaaaaatggtggcctcgaaggtgagagttgttgactacagtccgcagaaaaaacattaaaaacgaaagatactgaaaaaaaaaaaaaaactcacgagtcgtgtgtgactcggtgactcgcgactcaaccgaaccttacccaatactcaaccacacaacaatgggccaagctccgtcgtctccggcggaaccaaacgtacgcgatacttctttatgtctatggtcaccggaatttctcgattgcgaatcgattggtttcgaagacggagattacgatttcacggcaaatctaccagacgattgcctcgctcatatctttcaatttctcagtgccggagatcggaaacgatgctctcttgtatccaaacggtggctattagtcgacggacagaatcgtcaccgtttatcacttgacgctaaatctgagattctccctttcttaccatgtatcttcaatcgattcgattccgtaacaaagctcgctcttcgttgtgatcggagatcttttagcttaagcgatgaagctttattcatagtctcgattcgttgctcgaatctgattcgagtcaagcttcgtggttgtcgagagataacagatctaggtatggaatcgttcgctagaaactgtaagagcttgaggaaattatcatgtggctcttgtactttcggtgcgaagggaataaacgcgatgcttgagcattgtaaggttcttgaggagttatctctgaagagaatcagaggacttcatgaattggctgagccaataaagctgagtttgtctgcttcacttagatctgtgtttttgaaggagcttgttaatggtcaggtgtttggatctttggttgctactagaactttgaagaaagttaaaatcattcgttgtttaggtaattgggatagagtttttgaaatgaatggaaatgggaatagttctttaactgagattcgtctagagaggcttcaagtgactgatattggactgtttggtatatctaaatgttcgaatttagagactttgcatatagtgaaaactcctgattgctcgaatttaggtttagctagtgttgttgagagatgtaagttactgagaaagcttcatattgatggttggagggttaagaggattggtgatcaaggtttgatgtctgtagctaagcactgtttgaatttgcaagagcttgtacttatcggtgttgatgcgacgtatatgagcttgtctgctattgcttcaaactgtaagaagcttgaacggttagctctttgtgggagtggtacgattggggatgcggagattggttgtatcgcggagaaatgtgtgacgttgaggaaattctgtatcaagggatgtttgatttcagatgtaggggtccaggcgttggctttaggctgtcctaagttggtgaaactgaaggtgaagaaatgtagtttggttacaggtgaagttagggaatggttgcgtgaacggaggatgacattggtggtgagtatggatgatgatgaaaccaatggtgtgggtttggtggatggtggtgatcagagagttcttgagacggttgttgaggaggaggctccgccagtgattgatggtgatggtggtttgggagttgcaggtggtggtaggctagggttagctatcttgaagacaaagttagggttacttgcaggaaggaacttggtggcttgcacgttgagaagatggtctcaaagtgaagctactagttccatttgattgcacttttttttttaaacaagggtctttgactcgttgtgcattcagaacaaaacccacttctgtattattatttcttgtttgtttattttatcttcacaattcattttcaaaatatttcatggcataagattattactattactaacttttattttattaatatttcatgtaatcataaaatagttgatctttaaatttgtatagtgaaatggaaaaacttagtaagtagtaataatagttgatctctaattctttttcttataacaataaattcttagaattaagctttaaaaaccaagaccttgatcattcaatttcaagttaaggaacgcacactactcaaaatattgaaaagtgttatttttatttttccacaatactgctaattatgtagtacattttgttatcgtgaaactaaaaagcaatatatatatataaatgtttaaattctgatatttattatgtctaggtaatacaaaccaaaatggttgaccgaccaaaatacaagttcgttttgtttttctaaaattttttttattttattttttggaaatcgcagcataattgacaattgatgttcatacttttagaaaaagaagacttgatatatttgtttactaaaagatctccaaaatattctctgataacaaaattatatatgctgataacttgttactttcttataaaatgtcacattactatcatttttacatagtataagaaaacatatgtgatttgttactgctgcgtctgtatcaaccttatttttagaaaacaaatagtatatgatttacgatatttatctcttctttttttggttaaaggatgtttcttatcaaaccgtgctgtttcccaattttcattgaaaatcaaaattcacacatttacattcttaaattaatttacatacacttcagtgaggtcaacaatgaacaattaagtggagtattcaaacagtttcgaagccaccaaactctatatatatcaacatcatcacgtaaagttcctatagaatcttaaaacacatacacttgaaaaagccaactcaaaaaaaaaaaaattgattggtccc

SEQ ID NO: 9609 - DNA, 3000 bp, Unknown
  misc_feature (1)..( 3000): cDNA_ID_3042636_gDNA_ID_1972160_Annot_ID_179600 3000 nt of promoter + ATG
agttccatattaccttcaagaaaacgacaacaaatcgtatttccctcagacagtctcgcttggtccgtaccatcatggtaagaaacggctccggtctatggaccgtcacaaatggcgtgctgtcaatagagtcttgaaacgtacgaaccaaggcattaaaatgtatatcgacgccatgagagagctagaggaaaaggctcgagcttgttacgaaggtcccttaagtttgagtagtaacgaatttatcgaaatgctagttcttgatggttgttttgtgcttgagctctttagaggagccgttgaaggattcactgaactcgggtaagcctgattttttcaatatctggttatttccggttctctcaaataattgttaaaccggtcacaataatgttttgtgtagatatgcacgtaacgatccagttttcgcgatgagaggatcgatgcattcgattcaacgtgacatggtaatgcttgaaaatcaacttcctttatttgttctaaaccggttattagagttacagcttggtacacggaaccaaaccggtttggtggcacaattagcaattcggttctttgatccactaatgccaacggacgagccgttgactaaatctggccagtcaaaactcgagaactcactggcaagagataaatcctttgacccattcgctgatatgggtgaactgcattgtctagatgttttccgtcgtagtttgttacggtctagtcctaaaccggagccgaggttaacaagaaagagatggtctcgaaacacgcgtgtggcggacaagcgccggcaacaattgatacattgtgtgacggaactaaaagaggctggtataaaattcagaagaaggaaaaccgaccggttttgggatatgcaattcaaaaacggttatctagaaataccgaggctacttatccatgacggtacgttcacgtttttcacatttttcttctttttaacacatgccccatatgtttacaatttatttttcttttgtttgagtaaaatgttacagtttttttttcttatccatcacctttttaattcatcaaatccatataaattgatattttctcgtttgtattggtttatatggattgacaaagaatatattagtaggaatcatgatgtattgatgtggtatgttgcataaaaatgctactttggaatataagaaatgtcatcaattgactaattcagaatgatctaagcaatggaaaagagtatgtgttttcagattggcaaaaagtttagataatgaaacaaatacattttctcaacaaaacaactaaatgtttataataagtaaagccatcctcgtatgtttttttgtaggtaccaaatctctttttctgaatcttatagcttttgagcagtgtcatatcgattcgagcaatgatataacatcctacataatcttcatggacaatctaatagattctcacgaagatgttagctacttacactactgtggtatcatcgaacattggctagggagcgattctgaagtcgcggatttgttcaaccgtttatgtcaagaagttgtattcgacaccgaagatagctatttatctaggttatcgattgaggttaatcgttactacgatcataagtggaatgcttggagggctacgttgaaacataagtacttcaataatccatgggcaattgtttctttctgtgctgcggttattctactagtcctcactttctctcaaagtttttacgctgtttacgcttattataagccaccttcttaaccttataacttgtttttcaaagcatttttttgtgtgttatattatacatatgtactagattttaacttgtggtataccgcgggacgatttatttttaaaagtaatatatattaaaacttgtaaattttattaaaataataaattaaagatttaatccatattgaaattaaattaaattaattaaaatttagatatcaaatcttatatgttgattttgattggctattatttttgaaaattaataatgtatttcgttttttaattaatttaattaattaaattagtatttgactttttaatccttaaatacataaattaatttactctttaaaattttatttctaatggcatccctatgtaattacttacaaaaattaagattacatttaaaatgtatttcccaaattatatagtaggatatgtagatcgtttgtgattacattgacacgtcacgcacttacgcccactggattaccaaaactgggccttttcgatatctataaggcccagaccaactaggattcaacataatgtgaccatataggcccaatgaacgaaacacaaaattctgaccggcaagagcgggggatgataaaacgggaattgatcgttaatctccgcacgttcatcggaaatttcgtacgctgctgctctgaatcagaatcagctccaatcttcttcctcctccattgaatctcttttcgctacggaaaaaaactcgaagcttatcgtcctgcattctccggtaatcaatgtctactctctcgttttttttctttttctttcgcggccgatgctttgtcgaatttggaagccttgtttcatttttgatctgcctctgctagatgatgcacttgattttctgatttgagagatctagttccattgaatttggcgttgagagagatgtggaaatgaatgcgacctttggattatagcaatgtgcactagtacggtcttagattccttatcctccgaagcaattttgcgtattcagtgctattttcagatgattatagaagcgaatttagccaaaacctttagctggatattgcttatgtataatgtgggaatttggagtcgtttctgtatattctgctaagtgtttgattaaatgagaaactggactcaatactcaaacgtgaaattgactttttttttttttaggttttcgttttctcgtaaagtaaggctcatcgttgtctgagctagcgttggattgctaaaatg

SEQ ID NO: 9610 - DNA, 3000 bp, Unknown
  misc_feature (1)..( 3000): cDNA_ID_2183608_gDNA_ID_1972160_Annot_ID_179607 3000 nt of promoter + ATG
cgtcgtggcggacaagcgccaacaaaaattgctacattgcgtgacagaactaagagaagccggtataaaattcaaaagaagaaaatccgaccggttatgggatattcaattcaaaaacggttgtctagagataccgaaactacttatccatgacggtaagttcacattttcgtttttattagttttaaatcatattttgcttatattgttgtcgcctaagaatcaaacgtgatacctatctgcatgttaatgattttgtacaaaaccaaatagagcgacatgtattggttttgttcagatttttcccacaagtcgctaaagtaaatagactgacatcaattgttgcctatttcaccaattcggaatgattagccatttaggcgtatacattatttttcctagagaaccccatgatggtaagttagaacttttattttattttctttcctactcttttattccttcctttcccacatatgttctctttaaaaccaaaaatttatctacagaaccatcacattattaaaattaaacatacgaacctctttcatatttattgtaggtaccaagtctctcttgtcaaatcttatagcttttgagcaatgccatatcgactcaaccaaacagataacatcctacataattttcgtggagaatctaataaattctaacgaagatgttagatacttgcaatattgtggtatcatcgagcattggcttgagagtgactctgaagttgtggatttgttccacaaattatgtcaagacgtggttttcgatcccattgatagttatctatatccactttgtcttggtgtagaccgtttttacagtcgtaagtggagtctgtttagtgcagtcatattacacaagtaccagctcaaccttagaagtccttgggcatatttttccttttttggtgcagttattttgctacttctcacattttgtgagagtttctttactgtttatgcttattttgagccaaacacttaacttttgtcctttttcattcaatttggaatgtttgcattttcttgtttttcaacatttcctattttcttctatccaaaattggttttggaataatattttgttgttaaaaacaagtttaagaaggttaatttcggtggctaagcaataatggacatggttttttattagggggcacaaacagagtaacctaatcgaactcaaactatatccctatgtactctctgtctctcaatctctcttgattctctgtttcaagcactcacatctctctatctctttgttttggttgaaagaaagtgagaattttaacgcattctcttgaacatggccggtcctgaacctcatcaaaaaacatgtttttgaaattgtttttgaaattcttctgaaaatttgtttacaaaacggtctcaattttgtttatttttttctagttggcctcaatttttaaaatcttttgaaataaccttaaatatttttgggtgcatttggcacccaaaattccaggggaagccctgctcttgaatacccttttgaaaaaccttttggaatcataaaatgcagatactttcacacggagtatacaaatccacacttcatagaatgatcaataactctcatcaatactgtgtttgtgttgcatccttctatgaggtttaaaacttttaacactctggtgtgtttttccactgttggatttggaatcatgttttaatttgaatgaacagactaatttcgacgcggtagtggagccattgggtatatgtaaacagaagtaccctggagggagaagaggatgccaagttttcaaaagagctgtctatggagagcatctcgtgagtaaagtccagaccaactttggtatgtgatggaagacagatatctctcaccttctctgtacacaatccaccaacttcagcttcaagtttaattcgttagtaatgtgcttctcctcttctgtattattaatcgatacatatcgatttgtttaaagaaaaaaagggtgtgtttgtttgtaatattagtttcatagttgattcttcgaatgtctgagaaatcatatataaaactcacatctataatttataaaataaaattgttatacaataacttttaaaaaaaagatttgcatttaatattctggatgtacagtttgttttgttttgtttcgtctcctaataattgttagttttacatgaaaaatgaaatcagttaatagttgaactttggtaacattttttttctcatgactttgttttattttatgtagttattgaatatatatatatatactacaagctatatatgagagtcgacaaatttattaagagtacatagtttttccttttttaatgagagttttggagttgaaatgcagaaaaagaataaattaattaatcaaattcaaatctcacacgttggatatagtataaactagaagcatttattagagtctttttataagagttttgtagatttcaaaataagcaaacacatggccagttcacagctttaagattagttacagcgttgctttgacatttcccaatttacgtctcgctctcaatctctggaaaaagcttttaaccagcaaaaacaagggaacccccaaaacattggttttaatttatgctcatacagttttcatcaacaaagaaatgttgacttcgtaattgcaattaaaattggttttagacaattagtatacacttgcaatatttttataccttgagaaaatataatgtttttgtaagtataagagggatattattttactagtgtataacaagaatttatcaggattttttttaacgaagtttgactttttcaatctcactcgttaaatataaagtatgacaacatttatggtgagtctttttataaaagagttaaaagattgaagctttctatatatatctacatatattttagctttctttatttgttacttcgtttactcgaattcattactcatttcctcttggtatagcttcaaccaacaaaatg

SEQ ID NO: 9611 - DNA, 3000 bp, Unknown
  misc_feature (1)..( 3000): cDNA_ID_3094226_gDNA_ID_1972160_Annot_ID_179605 3000 nt of promoter + ATG
ataagagtacgaagtctttttataagagttatgtggattggaaaataaataaatgtatggccaaatcacagctttaaattagttacagcgtttgcacttaacatttcgaaattacagcttttgctctcaatctcctgaaaaaagcttcaaccagcaaaaccaatggttttagttaatgttcattccgatggacaaccaattatcatcaacaaagacatgttaacttggtacttgctcagcctcaagctcagacaaaaatttcaaaccaaaaaccaacactcggaaccggttcaagatccgaatctccacggtttaccggaagttaccagaccgaatcaagaccaaaacgtgcagaaccacaagcagtctcattccgagtcaggtaaggaggtggtagaagagaggccagaagagaccacaggagacagttgggtgatctcaataagagacaagctcgagcaagcagatagagacgacgacacaacaatttggggaaagctctgcatctacagagttccacattacctacaagagaacgacaagaagtcctatttccctcagactgtttcgcttggtccgtaccaccatggtaaaaagcgtcttcggcctatggagcgccacaagtggcgtgcgctcaataaggtcctgaaacgtttaaagcagcgcattgaaatgtatactaatgccatgagagagcttgaagagaaggctcgtgcttgctatgaaggtcccattagtttgagcaggaatgagttcacagaaatgcttgttcttgatggctgttttgttctcgagctcttcaggggaaccgttgaaggatttaccgagatagggtaagcgtgaataaattttctggttttttccggttatctactatacttgctaaaccggtcttattttggcctgtatctgaaaagttgatttttttttactgtgatgactgatgagtagatatgcacgtaacgacccggttttcgcgatgcgaggattgatgcattcaattcaacgtgatatgataatgctggaaaatcaacttcccctgtttgttcttgaccggttattagagttacagctcggtacacaaaaccaaaccggtatagtggcacacgtagccgttaagttctttgacccgctaatgccaacgggagaggcgttgaccaaaccggaccagtcaaaactcatgaactggctggaaaaatcattggacacacttggtgacaagggcgagttgcactgtttggatgttttccgtcgaagtctactccagtctagtcctacaccgaacacaagatctctcctaaagagattgactaggaatacgcgagtggtggataagcgacaacaacaactggtacattgcgtgacagaactaagggaagctggtgtgaagttcaggaaaaggaaaaccgaccggttttgggatattgaattcaaaaatggttatctagaaatacccaaactactaatccatgatggtaagctcaaaggttctcttttaattcctttcctactttttattccttacacatatatatgtttgtataaaaacgatatttacctataaaatccttaaattccataaacttacaaatcctctcatgttttttctgtaggtactaagtctctcttctcaaatcttatagcatttgagcagtgtcatatcgagtcgagcaaccacataacatcctacattatttttatggataatctaataaactctagcgaagatgttagctacttgcattattgtggtatcatcgagcattggcttgggagtgattcggaagttgcggatttgttcaaccggctatgtcaagaagtggttttcgatcccaaagatagtcatctatctcgactgtctggtgatgtaaaccgttattacaatcgtaagtggaatgttttgaaggctaccttgacacacaagtacttcaataatccttgggcatatttttctttttctgctgcagttattttgctacttctcacattatgtcagagtttttatgctgtttatgcttattataagcccaattctaaactctagttgggggtttttcccatcaatttggaatgtttgtattttcttgtttttcaacattttctatgtacttgaccaagattttgcattgtaataattgggttttggaataattatgttgttgcaaagcaattttaagaagtttgattttattaggggtgcaaaatttgtaaactaaccaacccaataaaaagctaacctaataacctaacccattaatggtctcttttgtttttttttcgctggtcatgaaatggattaatccatgtaaaaggattgcaataaatttatcacgaaaaataatttatccaaaatgtatatggaataacgcattttttttacttaatacacacatactaatttttcaaaagtgttatttattttaaaaaatctaaacatggcaaaaacaaatgttcatagtagacttatgatattaaattaaatgaggggacacattttggaccacccataagaagaatattggaaaatgcagttatcttattctccataggagtattttttaaggagtggagaattagtcaatctcattcgttgaatatatcacgagagcttattaatctttttcctatggagaattagtcaatctcattagtcttcttataagagtacgtactatacgttctatttgatggtagttagtatgtttccgtcccacttgtttatatatatacatactattatgatattttctatactagtttgaatgtttcaatcccactcgacgatgcatggattaaaacatccaaactacttgtattatgtacaataccctattgacaagacttcttttatattttgtatttataagagttttgtatagttagaaataaacatagcgtggccagattacttcaactcagttacatcgttgctttgagatttgacaactgcgctatttctctctctctcgatctcctgaggttcaacctacagaaattatg

SEQ ID NO: 9612 - DNA, 3000 bp, Unknown
  misc_feature (1)..( 3000): cDNA_ID_2184194_gDNA_ID_1972160_Annot_ID_179599 3000 nt of promoter + ATG
aaaaaaaaattgattggtcccatggattatttgcaagtaagtgaagatatgttacacaatgtcacttataactttattgtagtgattaatgagttttggttatttttatttttttgtttttttatgctaaggctatgcgtctccgcgaagccaatcgtctcatgattgcaaagttcaagaaagaatctccggctaatgactctcctgaacaggtgtgttggaaatctatcaaaacatgtttttgaggaatatgtttgtataatttgtaccgtaatatgtttgaaaatgttgttggttgtacagaggctagttcgattgaccaatgagaatccgcaatacaatgtcgactttttgtttcattcatactccaaggtttcttaaacaatagtcttttgatgtttaatagtatatccaagttttgtatatttcatgcgcttttttttaagacttcttaaattgctaaacaggactggtttgtatccgatgttggaatgaaaatgtcaaatgtgatgattccaaaccaaatgctagctcttgactgtgaaatggttctatgtgaagatgggacagagggtgtggttagagttggcgctgttgaccgcaatttaaaggtattgcgtatagatactttgagattttgaatcttgatttctttattggtgtcttttattggatccttgatgactcgggtgatcaaatttttatgtctttaggtgatccttgacgaatttgtgaaaccacacaaacctgtggtcgactataggacagctattactggagttactgctgaagatgtccaaaaagccactctctctctggtggatattcaggtaaatctatatatagaatcttcttctttattttattatttcaagagacaacacttcaagatgttatgtttattgtgcaggaaaaattgaggccgtttctttctgctggtgcaattttggtaggtcacagtttgaaccatgacttggataggtaaataaaacttttctagtagagtccttgttaattttaatttggaattttgtctaaaatcatgagtattttgttaccagtgttgaagatagatcatcccatagtgattgatacttcactagtatttaagtatcctaattcacgaaagctaagaagaccttctcttaataccctttgcatggtaagtctatatctactcttgaggtattcacataaaaatgttaacattcttaatatatactttctaaaaataaataaatttccagtctgtgttgggatacgaagtccaaaaggccggtgtttctcatcactgcgtacacgatgcagccgctgcgatgaaacttgcacttgctgttataaagaaaagagttgacacaacaatcacattaactaaagaggtgacaacaaatatttacctagctaacttgtttatgataaattacaattacaatgtttacaagttttttgaatagatggtggaggccgagaaatcaagactctttctacatcgaatccctcaccatctgtcatctgaagagctgaagaaagatcttgctctaaagttttttcccaaaaactttacaattgatgttaaggttgagtttaaaccatatatctatttcttttctctaaatcttaactttttttttttgatatacggtttttttttttttggcagccagcaaaaacacagggaggttattattgtgcagttgttatctttggaagctcagtagaagcaaatcaagcatttgagaacgttaatggatacaaagagacggtattatagaatcttttgatttgttttgaaatggtccaataataattaaaagtgatgaaataacttttttttttttttttttttttgtgtttggttttcaggattcatcggggctgccacagaaactcatttcttgttcaatatctacattttatgtccgttaaatggcttaagatgggtgggtttggttgaaggcttgaaatcttcttttaaatttgctttttaataatgttggcatttctgaatctgtttaaacattgattaataaatctaagctaagtttttttttttctatccttaatttttggtattttgtttgacatttgtttttgatacaaatcattggcaaaatatacacaattacagtattagaacacaaatcgaataaaaaaaatctttgtgaacatcatcatttaaatgtaattgaaacagagtcaataaaggttctctcaatagaggtagcaaacagagtcaactatgctataagaagttgttgcgttatgttttgcttttctgcaggattcatttgggctgtcacagaaacacattgtcttttggcgtctaagttatgaagtttatttttaagtccataaaatggtttacgatgatgatgtaacctcttttttttccatggatctatattttcaaattctatgtttgtaacctaaactgttttaattatctataaaatatttacaatttagcgaaagaaaaaaatgacgatggaacctcagatcaggtttaatacaacaatatgactaaaattaaatttctatttccactacatttttattcgctccaatccatctccctttctaacttagagatcttaatattttttcttcatatttggagatttcttttttcaaatttacactaaaatttgaaatctccagtttgttgggaaaaaactcaactccataactccatattgaaaataaaaaatgtttatgaagaaatgggagagatgttctaagcaaattttaaataattcctcttaaaataatggtaaagatgttactacattgaagtcaaagatgtcacaatttaagcatacaatatagttaaaattatatataaaaaaacccctaagaataaaatataatccagttaattatatattttgagaatataaccctaaactctgtttcttcttccccaaacagtttatgccaaattcactcccagctaataaaataaaatagaaaaactcgttgagccgccattgtttccgtact

SEQ ID NO: 9613 - DNA, 3000 bp, Unknown
  misc_feature (1)..( 3000): cDNA_ID_2184182_gDNA_ID_1972160_Annot_ID_179593 3000 nt of promoter + ATG
ttttctcgtttcaaattaaatgtcgttttgcatattaatttttgtgtcatattaaacgtcgttttatattctatgcagattttatgtataaactttattggtcaaaagcgttacgaatatcgtttcaagttcaacgaatcaaaacatattttataaaaacatctaatacgttttccgtttcaaattagatgtcgttttgcattttaatttttgtgtcagtctaatgtcgttttatattttctacacatttatattttcaaaaatttcagttttatttttattgtttaaatatatcatccaatttgaaaataatacaatacaataacaaaaataacatttaaattaaacaaaaatatttttagaacactgtgatcaaattttatcctccaatatttcccgacccataaactttaaaccttatgtaacttcaaaaaaaaattcaaattagtcgttttgtattctacaaaataaaataaaaggaaaaaagtttcagagaaaagggtaaatttgcataacaaggaatacaggctggcgtgtccagtcaaaaaagtcagaaatctgcataaaaaactgtctttacccaaactgccaaacctaaccgttatcgtctcagatattattattatttttcaaataaacattcaaaacagctttctaatttttcacctcagattgtgcgaataatatcagagctctttccttgtaggtttccgtgattttgtcgctttaacttcccttcttttcccactctcttctcacgcgcgcgtgcttcccctttctctctttcgactgtatcacacgctccataaactaataaacagacgcaccgagatcacgacacgtgtacacctacagctgtatcccaaaactttcaaaaccgcttgcgtggaagaagcggtgcatgactttctccaccgtctctaccggttaccggttattatccatcctcctctctatctctctctctgttataaataccttttttctcctctcttcagtttcctccaccttcttcttcttcttcttcttctctacaacaaacaaacaaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgattctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatctataacaagtctaaatctaaaaattgaaccttgattagtgagacattatcatacaaagagacatactgagttagtcaacaaaatgtaggataactacattcttacatattgtatagatgaatttcatgttaatcctttcatagagctatacagtaaccatgattagtgagaccttgtaacatgtagtatcaaaatcaacaaaggtatagatttaacatctatttgaaaacattcgaaccttttatttgaaaatcttttgcttgttgtaagagatttactctatagtctatagatagtaattaaaccttttctataggtttggtagattacttcacttttatataaaattaattactgtcaaatcggatttttgttaacataattatttttcgacaatttagaaattatcgtaaaaattagatcaatctttctacattcttacaaaaaataaatacattgtctagaaaatcagtttttttttttcgttttaaatctataaaaaaactgacaacaacaaaacaatacatactttttaattactatagagtaaaatctcttacaacatgccaaagatttcaaataaattgtaggaagatttttatgttatttaaccattctacagtataaataaacactggtacagcgatgttaaaaagtagaggttaaaaaaatgcgttaaaaacacaaaagctacgtcgtttcaataactgggttttgtctcaaagaaagctgcttttggttcccgtagatctaaagttacgttcgagtctcccctcttctctccactcactcagctcttttgattcccctccaattttctccgacggtacggtcgaaaaatccaaccggagatcaaatg

SEQ ID NO: 9614 - DNA, 3000 bp, Unknown
  misc_feature (1)..( 3000): cDNA_ID_3042621_gDNA_ID_1972160_Annot_ID_179579 3000 nt of promoter + ATG
gcttaaattatttttataattctgtattatttcgttttcacgagttttacgagtcttttaataattaattaattgtataatttgttacgataaatatcttacacgtcttaatcgatcccagttcttatgtatcttctaagaaaaagagtagttatacattccgagaaaaatatggatattgggtattttctgaattaaatgccgggaaaatattgtttttttggtggcacaaaaaattgacttataattattctttataactatattgtagtatctgatggttaagaatttttggaattattttaagatttgtttttttcttgtcaaccgatttttatttagagttcagaaaactcatcccttaaaaatgttgtttatatatgtgatattatgcggttcggtataaacttttcgtcaaattaagatttggctttgaaaagacaaaagcaaaaattttaaatctaaaatggtgtgggaaaaaataataataataccttgctaaataagacggaaaatatgtcgtgcagcttactgcttatacttacatcttacattacctattaggctataacctaatgcttgtgttataagtctgtaagatttggtcattcattctctttgtactattgtcttcttatattgctagaaacttagaaactaaagaatttcaccaatttttgtgggcatagtatatagcttattagcttgtaataaggcctaataaggccctcgagcgttacaataacatccaaattagttttggcatggtaccgttaaagtggtgttaaactattaatttaccaaagactcattgtttggactttggaccatacgaaaaatgcagtagagcccatagtgacatagtgtaccggctcttatagctgagaaattatatcccaattaacagcccagtatttaatcatttagaactcaacgtgaaagaggacatgttaaagcccaacacaagtccatagactcatgaaatacaagtccacaaacccaccttatctaaccatgtaattaggttttatagcataatataatgaacatcaatgaatgtaagtaggaatgcaatttgtgcaacctctatttgacaatttctttcatttcttctcaatagtttacaagtctcatacattgtttttgttctgttttcaaagaaatagttttggtttttctattgtatgcaatatgacttcccactgtacatcataaacattgaagtatatataatattttttctattgtgttctgccgtacgtctaacttataatctattttataacattgattttactaaatatataaaggtaaaatctatcttgttgcattcacttcagaaaataaatttttggaagaagggccacaaaacaatactaattttcaaaaattgagattgaaattatgttataagattgatatttaaaataggaataccgttgtaaaaataagtagttgatttatcgaacatctaagcatctgtttaacaccaattttatgtcgttgttgatcaaaactgtcgcgttcaagtgtcttgtgtcgactaattaagcaaatgaactttaggtaccagaagttcaacgaaacaataatgcatttttaaattactaatggactgaagtaattgggaataaagaaatataaagagacggcggcattcagtggaaaatttgcctaattggagtgtaggtaagcacaccacgtaagccatgaacggcgccgtttcaccgcattgctataggaaagtagaagaagacactttgacttattaatatcattttgttgtagatcttctgttcatcatatatttgattttgttactagctaatgtaaaggagaaaagaaatgtttgatttggtcacacacgtgagacagcatcgtaggcaaaaaaacgcctctatctttcttctaaaacatttttcatattaaattatcaaaacccttaaggttgatttaagggtcaggtagtggatttgtttcgttgaagggtcagcttagccttaaccctaaacaaaacaatctcattggtttcataaataaattgtttacaaagtatacgtactgcatgaacgaatgaaccatatctatatttataaaactcatagagaccaatagtttaagagaggcacttatatagctcaacaaataatagcgaactagagagaatatgatctaattagttataaatctcaattttgaaattgaagtgcgttatttcatttgagaatctatgtgttttttttgttgttgttagatgagaagctaggtttttttcttttctttacaccgataatcgataatatatgttaatcacactgatttttgtttgagacatgaagattcgaaaaatttgtcaacgaataaacactggatagatagaattgagatctgccatcaaataatcgagatcgttcatgcatgacgcaaacatttatatagaaatgaagcaagtaaagaatatgaaaaagaatagaaatgagaaatttataaagaaagaaaaaaagaaccaatggttgaggaggcaactattcgcggggacacggagccgttcgcacccatcaccttggaatctctctttcttcctctctcctcatcaccaactagtcaacaaccacacaccatttttaactttcataattaaacctaacataacatttttttttgtataaactatagcataaattaaattcagttaatgataaaataaatatattttgtagcaatcattctattttgtaatttggtagggctctttaaactttgattattatccaatttttattaaaatataataaaatctcaaagccatgacccattccttcactcaagtatcaatgtctattgtctataaatattacataactcttcttcttcaaccaaacattgaaacactttgtcccactctctctctttctctttcttgtaccaaaagctttttgaatctccaagattatagcaaaaccaaagataaaatactaacttaaaagatttctgaaaata

SEQ ID NO: 9615 - DNA, 3000 bp, Unknown
  misc_feature (1)..( 3000): cDNA_ID_2184150_gDNA_ID_1972160_Annot_ID_179585 3000 nt of promoter + ATG
ttacaaggtttttatttcctgttatttctccaaatgattcatatatgtaattaatgtcagtaaaacattattatgccaagacaaatgtcactatgaagaacttgctcggttgctccacgacattactttggtgtttgatctcatcatcaatcttatttgttacccatatctctttctttgatgtatgtgtacgctttaataatcaacaccgaaagtttctcttctctaacgactcataaagagatagtttcataacaaccacgctgatagggaagacgtaaacgttcaaatctctctgttgtataatcaaaactgagtaagaatataccgagctgttcctatttatcttcatcataagcaaaccagtaagtgtttcccttcaaaagataggcggtagtcagaatttatgaagtggcagtccagagtgtgacatcatgattcctccatgaattagagttcatatcatcgatttggaattcttggtcgtcacagttttagttcttatagctaaaatatcttgtagctcttattgccagatttgttgtcttggtactccgttggtagtatccaagaacaaaggttaaattctgatttgagtcgactctgttctcatcactttctcgaaattagactagtaaaagtaataaataatattcaaaagtccacatccaaaacaagattcaagattttcaaatcttgatgaaaaagaaaaaacaaacagcaaatattacacgaaatggctggaaaaactggttttaaacagtctgagaattgttttgttttaccttagtcatattattttagaggtctcgacgatggaccagaggtagcaacagctctttgagcacgctgcgtttcaccgcaatacagcatctttgtctgtttcttaattatccttgcttctcgcttttcggcttttacagcatttttccgctctttcttctcttctttcgactcttgaccatgagtcttcctcttgatcggttcagcttttgggatttccgctttgacatcggtttgttcagctctcctaccaggtaaaaactcgacaggaatcctctctctcccttggagattaatgattcttccatttgaactcaatgcgttagctaatgtttcactcagcttcttctgcctagctgactctgcagcaaggattttaccagggaggttatcgagattcgagtatgttgagactatggtttcacaatcatgcttctcgctttcatcgctgctttcttcagtcagctctacaaattcatcttcattcccgttatcaaaattttcaccatattctacagttcggcggataacatgagcagcagtgtccacttcctctttatctctgacagagtcactgttcttcagtatatccgcagggttcatatatttttcttcaagctcataatcttttgccttcccatgaataagattctgaacttcttgagccatgaagtcttcttcttcttcttcttctccatcttcagctatgtaaccatcaccgtcactatcacttccatattcattgagttcgagctgatcaaatagctcatcaatttgacgaggaactctcgggttttcagccacaggttcatcactttctctttctctaacctcacgtcttacagaaaactcgagctctccattgctcacaccagaagattcacccttttgagtaagattagcttgaacaacaaaatcttcttccaaatcctcaacatcagaaccaaactcagacccatcactgttttcaagcaacgcagcaacttcaggatcaatagctttctgcaccttgacgttaacagtcttggacgcaacactatacatcaacttattatcattaccttcttcattcaccataccagagatcttcacacgagacgcatcataagccttaacatcacgaggtaactgagcaacctcatacttaggattcacatagaaattagaaccaccaccagtattcttaatctctctcaaatgctccaagtaattataaccatcatcaggataccctaactctaaaatctccttcctcacatgagcaggtaaagaactactcgaatccccaaaactagagtaaccataatccatctcttcaggagcatcatcaaaccgtgagctgtctccttcttcttcttcatcttcttcaatgaaaccattgatgttaacagggttttgatcaactcgtaagaagatcttatcaccacctggtgcatcactgtatcttgggtctgacgtatcacgaggacacaactcgaaagtcgccgcctttttcttatcaataaacttcttcttccccattacttactaattcacaccttcttaagggttttgcaaactgtaaaacaattacgaagatataagatgtctaacttctaagtcacagcaatcaactagactatgtttcaatcctgactaataaaatgtaaatttttatcatcaatcaacacgaaaacatcgaaaagggagaaactttaagtctagaaacgattcaaaaacactaatttaatgaaattgaagaagcttacctgaagagtttgagagagagaggcggagaacaatgcagatgaagaacaaaaacgctgttgaagatttttagttttagggtagagccacccaaaacgcatcattttagggtttaaccaaaacgctgcgtttttgtgttaagcaagccaaaacgcgtcgtttttggcaacaagtcaaattaaatatttgttttatttccataactcagtgtatgccactaaaagaaataatccaccgcgggagagtgcaccgaatggttacatgcacctaatcttcttcttctcctactttcttcgacggtacctgttgttattgtgcgccatcttgatcttacgtgcgccgttggcgcattctcttataccaccattaacgtgcgtcaacaccggaaccgttgaatcagacgttactggtatcaggttcgatcgttgcctcgataccgattctctcgccaagatctctctttccaccgtc

SEQ ID NO: 9616 - DNA, 3000 bp, Unknown
  misc_feature (1)..( 3000): cDNA_ID_2184267_gDNA_ID_1972163_Annot_ID_179621 3000 nt of promoter + ATG
aaacgaaactcttaaagcttatcacgcgggaaaggagacgaggtcgttaaaaaaagcggttgactgttagacataaccgtcaaaacatactaaaagttgacgacatcaaacctgaagaaagaacgcctgaaatttatctttagttacatctgaaatttcgatctcactttcgtaatgttgacatttctcttgacaatgacagagaccatcactttgagattctttggtcggctctcaatattgaaagtcagaggcttatccattattatctgattatgcttctgcggtaaggcttttaaggaacacggtttcgtgattagatacgtgtttgtcttataattgaaaccttttcctcttatccctatatatactatatacttggctcatcaaatactctgttagatcaaatcttaatttatcgcaaaaagtattctgttcttttttatatggaccggagtcacaatgacattaaagattccgatccaagagatggtgaaaatggttggctctttaagatctcatggcatcgatatccctgaatcaatggaaatcaacaaaaaagagaagatctatgtagcagtgacagagaaagatctagaaagcaagtctagtctcgtttgggcgatacagaacagtggaggcaaagagttttgcatcgtccatgttcatcaacctatccgtaagtaattaaacatccacaagaatctttttatgcagaggttaaggattatttggttaaatttggagtatcttgtgttcttgatttcaagcgggggagatgtttcacgagcagaaattgcgtctctacagaaaagagaaggacaaagcacataagaattcggagaagtaccttcaaatatgcaggcaaatgcaggtatctatatccttacttcttatccatgtgttttgatggtagaagagatgtttggttttaaatttccagtcaaattgtgaattaggtcactgcagagatcatatatattgaaacggattcggtagagaaaggtatcctccaattgatatctcagcgcggagtcaccaaactcgttatgggagcagcagctgatagacactattcaatgtaagtggctaattagtgtagactactaagactttttgtgatctaatatatagattaaaaaacgttgattttgcaggagaatgagagacttaaagtccaagaaagctatttacattcacagagaagcgcctgccacttgtcttatatggtttacgtgcaacggttacctaatttgttcaaggtttggctaattaagtcaattcttcatcttcttttgtgttagctgaacatactagtcactgttaaggactggtctttgagttttacttgtctcacaagtcacactacaatgcagggaagctagaagagcaaataacttgtatctagaatgtgcatcgtcaaattctttgagtcaatccgacataactagaggaactgaaagtatagttaaagatgatgatcatctgatcaaattagctgtcacagaagctgaggcttcgaaaaggaaagcacgctttgaggcatgtaagcgcgaagaagctgaaaaaactgcagttgatgcactcaaaaaggtatgtaagttccttttaacatgtttttttagcttagaagtatcaaacttttctaactcttatctataacaaaaacaattgtaggctaaacaatgggaaaatgtgtattttgaggagttgaagcagaggaaagaaacagagaaggcactgaggaaaagaaatgacgaacttgaaaagatgagatcagaatccgagacccaaataaccgaatcttatactgtgattagaaagcttcaagaaaagaacaacttatcaatggaaacgtttagaggaatcagagaagaacaagaagagttgaagataaagcttagagaagtatcaaagctgaagggtaagcgcgaggaagaggaagcttctacctctaaccaccgtgaaccgccacaatactttatttgtcccattacacacgtgaggaaacgttacaagatcaatgaaaactaaatgatcaaaatgttataattttaagaaaagaaaaaaaagaccaacagttttgttatttgtaggatataatggaggatccacatgtagcagctgatggatttacatatgaaggagaagccataagccgttggtttgagagaggacatgagacttctccaatgataaacaaaaggcttcctcacacgagcttggttccaaatcttgctcttcgatccgcaattcaagaatggcttcaacttcgtgaattattgaacagaccctctgcttgcagagagatataagtgattcgccttaatcagagtgacaaatttatcataaatcaaaacattttcaaattttgtcaattcaactttctctaattaatgtttatattattatatcaatgcacagtgcgttacaacacatatgcttcttagttaataggagttgttactctatcactagtattattggtttggtcactcttttttggggtggttacgcacgtatatactaaatatagactatgatctacttagattttaatatttgtgatgaattgtgaactataagaatatagtggttatgactgaattttttcatagatttaataaatcttccctcatggcataatattagttagttaatatatagtggtatagtggtcactattttatttgttaaatttggtttgatgcattggtggtcattataacaagcataaaaaaacactaaagctagtattggattcatccacgtttttgtaattttgttatttgatggaataataataataaatttagcctgaatcttgcatagatttagttctcttaattaatcttccctcatgacgtttaatataacggaaatatggtggtttggttgcccactacacactatatattcctttgatgccgtgatagtcattataacaagcacaaggaaaaacactaaatcgtagaagaagaaaagaaaaacaaacaagca

SEQ ID NO: 9617 - DNA, 3000 bp, Unknown
  misc_feature (1)..( 3000): cDNA_ID_3042712_gDNA_ID_1972163_Annot_ID_179629 3000 nt of promoter + ATG
gagtgtggttttgtccgtgaaatactcttgctctcccgccgtgtaccatgacggagtgttgaggattccgatcttcgttaggaactctgggatgaatatcccggcggctcctagcatagcccatcggcagtggactatctcggcttgtacgttccattttagactgtccgggtccgatgctgacatgtgtctaaattttgtcagaaaattataaatatagtctaattttgtttataaaacttgttaaaaagcatgcaaggaggaacaaaaaaaatatactcacaaagaccaagaggatcaaatccgaagtcaccagggaggctaccgtctagccactctggaggagtgcttcccgggaaccagattggtctatctggatcagctgcgacggcgcgcaccgacgcatcttgcctggacacagctggaacagtcaacttcttcttcagcctcagtttcttaccacccaagaaactgcacatatatcatagccctaaaaatttagtcacaacttcaataacaccaaccatgcataaattcatattattacatagggcagatcggtgtttggatcacacaaacaatagtcgcacaacgtttaatctaaatggatgatggatcactaattttacaaccgcacacacattctcggatactagatcataaatcccaatcaatggatcactatcatagtcatgttaacgaaactaattaagtacaactgtacaaggatcttagtctcattcctacatagcaagtgatgataactgataagaagagagaaaaagatgagcttaccttggagaagaaatggcagcgatggcagaagaagcacaaagagatgatgccattattctcgacgttgttgaccttcaagactcagagtgtgttagaagaagaaagaaacgaacgtgtgttgtgtaatctataaaagcactctggtgacaaaatcagattctgcttatctgattatccctacggataacgcactgagtttcctcattggtcaactcattggcacgtggcaacttcgtcccaccacatcttagattttctctctatttgaacataactattaactgagttttaaagaaagaaaatataagctagtattccaagtgactgggcttataaagaataccaaagcccatatgtttttgggctttttttaatcttcagctgatagcattaggccttcaagaaaataactacggctttaacatttgccggagcgggacctcatttatgtaccttctacaaattaattgcaatttttctatatccaatttgataataaaaacatggagtggtaccaagcaaaaagaaacatgaagtggtaccatgtgacgtgtaggagaaagacaagacgacgagatctaagactgtatactcactagcaaaatgattaaatatctataaacatcgttgttaatcgatcatatattattatagcgaatgattgtatacgtttatctctttctatctagaaaaccacccctgctttgtaggaaacaaaattgcgaatcacatctataaaatcttatgattagcaaaacactgattagccatgttttatgtgacctataaattatgagattcataaagacatcagtaggaataggaatcataaagatagagaataagctaattatatctttatcgtataatatcaacaacaaaaggttcctaagaccctaacagagactgaatacatgaactccaatctttttatttgaaaaacaattatagtgtaataaaaaaatctgtattgtcgtgactttttcagtatcatctaaaattttatttaattacaaatgaagcaatgattgaacctcatattccaccgaaacatcatcttaaatctaagatcaatattggatcaaatagggtttaaagtagggtatatagttatgaaacaaacaagaaacagtcaatcaagtatattcgtatcgatgcatcatgggaccagagaacgagatggtgcgagtattcaaaaattaaacagtgacatgacaaagagaagtgtgggagaggtaggagatgagatgatatgcatacaagcaatagggccatgtggctgtctcggcctcattataacatttccaaatcaacacaccattctccatacttatttcgttcctcttatcgttttagagggtttttttttttggatcgatggtaattgacaaattgcatgtttttttgtcgtataacatacacattgactagttgagcatcatgaattttctcattgaagtttggtttgaattttgtgacattaattgattacaaaattctactacaatacatgtattcttgtactaccatcgtgtataactaataaaataatttataaatgtataggtgtattaatgcgttattatggtaccaatacgtcttgtcaaaataactttgaatgattttgactataacaacaaaatgagctcaaacgttgatggtttacgagtttttgatacttttgtgggtttttgtgaccgttctactaggctatatagattttcttattgttatttttttttttttttgaatgcgttttctaattataaggtttcagaattcagcgtgtgattataaataaggcccatacttcataaatattaccaaaaaacatcaattttattatttatctctggttatttttgagtgagtcaactatatataggctatagaaccaaataaattcctactaagtttgaatatatcatcgtaagtaagttgtacatcttatgaaaaaatttccacatgactataagtattagagtatatatatacgaccacttgattttaaaatacgattatagataacaaaacatatatgttcattgcaaaaacgacatttctccgatcatagttgagccatgaaccattgccggttggtggaaggatcattgccaccgacgacttgtctcctatacctctctccggtccaccactcagttaaacaatagacttttttctacttttatataattattaattatg

SEQ ID NO: 9618 - DNA, 3000 bp, Unknown
  misc_feature (1)..( 3000): cDNA_ID_3042705_gDNA_ID_1972163_Annot_ID_179632 3000 nt of promoter + ATG
actagcttttgtgtgtgtgttttttttacaggctttcacacccaagtgagacaacgaaaaagggttatggggaggtgaatgcgtttgtgtgtgatcatgtttgtacaaatatcattttgaacttaaaattattatgtactttatataaattgtggtcgaatgcaaattaaggttccccgtaacactcttttcctaactcaatgatcataagatgcttttacattgtcattcggagcataaaagagtccatcttaattgtttttcgttattgttgatatctaagcttatgttcttcttctatctctctctcttacctttctctctttccgaatatctctttctcacctttctctctctctcttgcttacctttttctaaatctctctttctcacctatcttcttttctctctctctcaatataacatgacaaatttaaatattgaaaatcaactgaaaatttgttattgtctaatgcatattcactaaagttaaatctaagatagtagttatacgttaattatgaacatgatttagcaattatacaacttccaaatagataaggtggaaaaaagtgaacacatgagtaaattgaagtttaacttgtaaatattttgtacagagaaagaacctctatcaattaacactcgataaattagtaatcactataaattacttattttttcagtctcgagttagatcaatgtaatatttaacatcatttgataaaataataacttgtttgaaaatctaatgtaactaaatagtctagtaatatcgtaaattaataatcattatcataaattaatataaacttatcaaacatcaaaattccgattacaaaaagaataaaagtttagttatgttattaattattaaaaatttagacgaaggtatactagttttgtaatcccattattaatagtctatagaatggtaacgggctaacggcgatggtgataaacggaagagaagagagagagctagggttggagaaagagacaaaagagagggactacggaatgcagaggaaagcttcggcggtgttcatagggtcgtagaaaggagaaaaaaaacagagagaaacgacggaaggcagaggaaagcttcggcggtgctcataagaaacccatggagaagtctagagtcggagatgttgtcggagaaaggagaaaaaaacagagagagaagacggaatgcagaggaaagcttcggcggtgctcagctcataagaaccatggagaaatctagcgtcggagagaaatacaaacacacaacagagagagagagaaagagagagcttacattgtgagatcagagcgagagcttccatccagagagagagagtgagagcttatatagatggttttccgaatatatagtgtgtgagaacgaagaaccatcttttgtttttttgtttttttcttaagtacttttatataaaaacacgagagagagagagagagcacggagaagagggagagagacagagaaagcaatggtaatgatcggaatatggtgcacggcggtgatgatcgggaaatggtgcacggaggagagagagagagctaaaaaaaacttacatagtagtacatgaaatttaattgtttattttttggggtttctatgaaatcgtagaaatattattttattaaatatgaaacttacaataaatattattttctttaacctagagaaatagtagagatacaagtggatattggatataaatacctctttatcaaagacattttatacaacacacatatcaatattaataatacaacggttgattaaagtcaaaaacaaaaaatcccaacccaaatttttttaagttcacatatgtgtagtttgtttagcgtttcagaattcttttcaaaccaagtaatccgactttatttttaactgactcgtttttttaattatgttttggtgtcaaaactaatcaacccatggaaagtatcaacccacatatgtggtttagctttttcataaatatacattttaatcatttcttgtttagttagtgacaagacatgttacttgtttgatgacaaatatttgtatctccaatttctaaatcttttagccaaatgaaattatatatttgaccaaaaaaataaaactaagaaaagtgaaagagtatgggggcatcagaatctctgtcatgtgagtactattttttgaacaagctaagtaacgtcttgtatctatttgatttttttttagtatcatatagcacgagtgtcttaatgaaatcgttattagcttcaataatactaaataaaatgtttactttcacaatatgtaaccgattaaattcgtaaatattttgtacgaagaaaggatctcactcgataaattagtaattactataaattaattatttttttaatctcgagtgagatcaatgtagtatttaacataatttaataaaataataatttggttggaaatataatgtaattatatagtctagtaatattataaattaataatcattatcataaattaatataaacttatcaaacatcggaaattcagattaaaaaagaacaaaagtttagttgtattattaattattaaaaatttagacgaaggtatactagttttgtaattctattattattactctatagaattaaattaatagtctatagaatggtttgagtaaaccgagaaatgagagagagttctccttgaaccaaggataatcaataattgattcccggtttattcgtaaaattagattcgtatcaccgaaaccaattatattcgcaaaattaaaatccgatcaacataaaccggtcgggcaattccaattttgatgctccgtttattgagcgtttattgatctgcgactgcgagatccatcttcttcttcttctccttcttcttcttccaacgaatgttcctatgatctctgtgtatgaacagaatctgtaatcagatccattgtagagagagatagccatttcaattcgaggtagccaaagatgtat

SEQ ID NO: 9619 - DNA, 3000 bp, Unknown
  misc_feature (1)..( 3000): cDNA_ID_2184314_gDNA_ID_1972163_Annot_ID_179635 3000 nt of promoter + ATG
tcgataagaggtggaaactacaactctgattgtagtttttgattttctagagtgatacaactgtcttctgatcaagatttatttgtaaaacgtgaccctaaatgtagctcctcgttcaaagagcaaagtcctcatgttgcttctgtaaagagcatacttgaaagtcatgccagttacttgatgtctggtaaagaactttcaaagcttgttgcattcgtcaaaggcacccagtttgatattgtggtacgtatacaatttgtaccattcaccttttcatgcttggaaccaataaggtatatagtcattcactaacaataccaaaattccaggattttcttcaacgagaaagatatggttgtgcgcagctgcagaattttgctgcagggcttgaactgattgggcaaaaggttagaatcaacccccttgtggtttctttgatgttcaaaactcgttatttttccctctcattctgctgcttgaaacaatttgataactaaaacatagatccctatcgcatcgtaaaagtctgcatatttgagtaaacttatcttacatcgaagtctaactattgaaatccctcagctgcaaatgagtgagctacagaaccggttagatgcagagtttctattggctcagatgtgctccgtcaaattcaaagaatggatagttgttcttgccactcttttacaacggtctgaggtaaaaatcttttagatttccaccgtaatcacgactttaaagcattcacagtgatataaccagattgtttcattattttgtcacaacacaggttctttatgatattttccggtatgatctacggttgtggaaagcatatagcgtgacattagaggtaacaaactcttgtttccataacaatcgatatcgatttcatcacgtgcgggtctcctctttaaaacatgttctttgtttcagtctcacttggctttcgctcagtaccatgacttacttcagattttagaggcaaaactctcagcgacctcacgagaagaaagcaatagaggttccatctcttgataaatcattttatttttgaagctttttcacatcaaacattttctgcctgagttttcacgttcgtgtagataaacataatttgagaagaaataagaaatacatcacctcacatacttttactatttattttggtcacaatagaaaggaaaagaaatgtagaagtcatatcatgtttggcctaaataatcgaattgttacagcctgaaatcgaaaataaattgaaaaaaacactctgcattttgtgtaatgtgcgtgtatataaaaccattgttttgtccaacataaaaagataaatgtatatgtattttgatttactattcagtataacatgtttttattcaaatcaatgaagcttggaacaaaagtatatgagtgctgactaggtgtaatgttctggtcgttattattacaaatagtagattagaggtattaaaaaaacaatcggagaaagaaaaagagagttgtattaaaataaaactgaaaagtaagataagcgtaagcacccgtgaccgtgagtaagtatggaggcggcagaagtgggtcggcagaagtggggatgagtggagtgaaagtgggacaaccccaaagttcacaagaggctaattagaaaaccaaaaaaacaacaataacaaaattggagatgctcttttatgcaaaaaaaaaaaaaaaaaaaagcaacaataatgaaaattaacatggtttaacacattctcattcctatatatgttacatgcgtaactggagatgctcttgtatgccccccaaatttgcatagtccatgttacttcacttaaagatagttttatttctaactttttctttataaaaactaactgccgtaagtagtaactaccgagtagtataagatggtaatgtaaaatttagtagccacgtcgaaagtgacaaacaagtgatgtatctatactctactctcataagtcacaagtcacatagagacaatcacccattcttgtatcatatccttttcagatgcaaaaataacctcacacattaaaacccgtgagtaaacaaacgaagtaaaggaattgacgttgtactcacctcacattctctccctagtttaaacaaattatgattgttatatgtttggaaagatacatgcaacacattttaaataatatgttgtgattgagccgaatgcttatatgattttctattatacgtatagcaatgaacacgattatgaattcgatttagagtgatgatacaaccttaataccttaatccattcaggctagagaccataataagttaacttaatctcctcatcctagtcactactcgaatgccatctttacgtttaaaacaattatggccacactaacgatatacctatgtttgtttgctagtataataaggatatgtctctatttgctatcacttcagccttttctgaagacaatgttaccgctatatcttccaatcaattgataccactaaatgataaaatcattgctaatcttataagatcaccaaacactcagacaaaaagtttgaatcttgcttcttcgtttctccactctttatccgcttataaatactcttattctctcctcttaacatcctcatcaaaccatttagcctctccacactcacaaagggctcacaagtctcaagtaattctctttctctctctcaagcacaaacacacacaaatgtataaacaaacccaccatttttgctttcaaatgttagttgttcactatgtctcatttacattaaactctctttttctttttcccaaaagttgttcaccaaaaccaattgattagctctcattctcataaaaaaaacaaaactttacaacaattactaacctttcacatgcacccatttatttaccaaactacgaaaaaagatacaaccttttatatctctctctttaactaacttaaggaactaaccattctctcttcctttttttttttcagatacaaaaca

SEQ ID NO: 9620 - DNA, 3000 bp, Unknown
  misc_feature (1)..( 3000): cDNA_ID_3042695_gDNA_ID_1972163_Annot_ID_179641 3000 nt of promoter + ATG
cttttcttctgtcaaaagccttcccttccaaacctcgtgtaacacaatatccgctgtgattctattaggaggaaaaacagattctttctgaagcatttcgtcgagcaccttgaaggcatcatccacaagtccatttcttagcaagacgtctaccacaacattacgaacctgcgagtttttcatattcgaatcgagtctttcgtatacaagaaccgactgattcaccatacccatacgcccaaaccatcggatcagaagattagtggcaacgacagtaagaggaatgttcttctctttggcgatctcgtagagacggagaagtttatcacgcgggtccggttcactaccggcgaattcaatgaccgactgaagcgccaaggagagagattcttcacggcgtttcagagactgagacttcgcatccaggtactcgaagaacgagattgctagagaatacgatcctagccgccgcgtgatttgcgagaatactaaaggagaagcagaagaagaagatacgacaagcgcacttagcgactcgctcgacgcccaatcatgttgcggggttttttgaagagttttcacaaatttgactactacaaattcctggctctccaatttgatttccggccgtgggtcaacatcatatgaaaaacgacggaggaatcgagaatggttgagcagaatataagagttccggcgccgggaaattgatagcatgatactcatcgtctaaggttttgaaaaagacggccaccgggaaaagtgagacgacgaactctgttcggcgaattcaacgaacaagaagttgggcccattttaaataatgggcttacacatatttagcccaaataaacctttacaatattacacaatgggtacaaaaatttattttttctcataaaactgaacgtgagctttttattatgctgactgattacattatatttataacaaaatgaggacgaatctttatttttctcatataattatcctctttgttttattaatcaagccaccaccctgaactctgaaatagctcctatggattacactagttttacccgctaataactatcctattaaaggatttttatttcttcaacctactcaaaatgaagagctacgagaattgcaacagctttgtcactgagaagatggtgaatctgaatgatccatcttttcagctgatgctgctgcatcagaagcagctttatctaatcccaatttctgtaactcgcttaagaatccgtccaggtcgcttgaggagatcttgtaagggctgtgagaaggacctggaaacaagtgtttggatacttcttccttatactccaagagggctttgttgatcacttctcctacttgagcgtactgtttgcaaaactttggagtaacctgaaatgaaaaaatatagggatgcaacacagcggaaactatcagataatgaatcataaatacaggaagaagcatgatgatatatgaatggtccaggattttaccttagcgtgatgtggatgctgcatcattcccagaagatcatggtagactaaaacctgaatccacaagaaaaatgtgacatacttgatcagaaatgtagataactcactctttttgtgctgatcttactctttaatcatgcaaaaaggccaataactgagaatatggtttattcaatcaaaccatgtataagcacatgaaaccgaaagaagcctattgctctcgttaagacaatgtaaagagtatcaaaacgaacctgaccactgcagaaagggccagctcctatgccaatggttggaatattaagagcagaggttgcagcagcagccacaggaggtggaacacattctaaaacaaccgaaaaacatccagcttcttgcaaagccatagcagtttccacaacctaatccaccaaataagagaaaaataattttatcacacacccctttaaaaaataacctcttaaggattacatacacatgcctgaaccattacattcaaaccttaacagcactagcaatgtttttgccctgtggcctgaaaccaccaagaacactgatagcttgaggagtcaacccaacatgtcccataacggcaatccctgcttccacaatggattttgcagcagtgatccttgaaggtgatcctccttcaagtttaatagcatccattcctccttctttcaacaccctaactgcagtatcaaccgcctgaacatcattcaaactaaaacttaatcaaccaaatcgatgctttgctcgaacaataacaaacttgatatcaaagcgattaactgaaacataggataggatcctttgggttgtgaatttgaaacaaagtatccaactttcgagattattcacctgattggtgctagattcataagtaccaaacggcaaatcgccgacaagaagtggtcttttggctccgcgagcaacggcgcgacagtgaacaagcatctcctctaaggagataggaagagtggtgtcatagccatggacaaccatggcagctgaatctccgacgagacaaacatcgattccagctgtatcgatgtgaacggcagaagggtaatcgtaggcggtgaccatagttatcggctcacctttccgatgcttctgtctcaattgcgtcaaagtcactctctgattcgagttctgcggtttcggtcctccgtaaaccgtgtcctccggtacgttgctcataaaccggacggtggtgatggctctcgaagcacgagagcaacaactcctgacgagcgaagcagccattgttgttgctgatgaaagcgattttggaattagttataaatttaaagacttttggataaatatttttcttttaagaataaaaacgatgttggcgactcacgcgctggtgactccgattccaaagttgactgctttcgtactctctctatctactactccatcaagattgtctggttctgttccgggtttgattgatttctaccgtcgccggagattttgtcgtgtaatcacctcc

SEQ ID NO: 9621 - DNA, 3000 bp, Unknown
  misc_feature (1)..( 3000): cDNA_ID_2993443_gDNA_ID_1972163_Annot_ID_179640 3000 nt of promoter + ATG
attgaatacaatgtttggcaaaatattaatagctttgcatttattaggttttcttgttatacgttttgtgaatagtgacttcacttagtagtgtggcccaagggaggtcaagtttttctagtcttatttagtttaaatgcttgagccgtatgacattgacatgtgtgatattttgttgttgtttacctctagctattttcgtttcatcattcaacattttattgagcaatgagcagatagtaacagtatctcacgacttctaagttcattctattttacagtttccggaaataaaaaaacagaaagcaaaaaaagactccgttgccgggactcgaacccgggtctctcgggtgagagccgagtatcctgaccagctagactacaacggattttgctaaaccagcatcgtatattgtataagtagtatctagaatttacattatctcactgtctctcgcccaactgtctgcatgaacactaaatggaaaggaaagtcaaaacttgaaagactttcttttattcattctctttcttttttactcatttaattctcaaagaaagtgtataacgaagaaaaccacaagtcacaaagtactgactagtacaaggaatcaaaagagaggctttttcccattgatcattcccaacaaatgatcaataatttgtcttccagcatcacgaagacccgaatgcataaactcattcgttacccaaagtctgatacccgatatatgagaagctgtttccgtcaccagcttgaagtttacatacatatcttcgtagtaaaccgctgcagcaacaggcacctacaaaaagaaatcatgtgaaacagagtaaaattatttgatccatatgaaagaacgatcaagattctgaaacagaccttgttattctgcaatctaggaacatcatataatggaggccaatcctctttcttggccaaaagatcggcggcagctttaaatggcttcaaggcatgaatttcatcaaacatccatggaaatatcatctatacaaatccaaattctattttagttaagcaatgtggaccaatcatccaagctatgagccatacaattagaaatactcaaaacctgtacctctcctgtgaagagtacaggctgactttctttgactgccttcattgcgtcgaatttgtactcatatttatcccgtaatctatgagcagaccatcctgatgaagcaccctgaaaaagtttccatttaaacataaacgataacaagaagaagtaattgtctgaaatagaaaaaaagatgagaaatttgaagagactatacctcacagtatatggcctcgtggagaagagcatatagtggatttgtatcaaaagaatgccaactctcaaactgcagcaacgataaaatgtctcagactattgaattccttatttgagctgagaacagaaaacaacaaatttttgtgggtctcttacagcgtttaagaagaactgactaatacactttggagctccagtaactaaaataggatcccatactctctccaacctatgatcaattaagaaggccagatttaacacagaacatgtgaggtggttgataaaaattaagctaaactcttacatataatgcaggcgctcaaaaccagtacttgatcctaaaccagaaagaccaagagtttgaagacccttaggagtaagaatgcctcctgatgggagaggtacctaaagacaaagaaacagagacaagtaaggaactaaactaaactggtcagtggattgagcaaatgttgtaatccctcaccccgccaccttcagattcagccaagtaatttacgagttcacgaacaatctcaatgtcttgagggaatctcttgtagtatttttcattttggcgagcaacttgttcaaaaccggcttcatatacatcatctgctgtacatgctttaccaattggtggaattcctccagttattagcacttgtttgagtccttcgggtgcaaaactcagatatgtaagtgcacaaaagccaccgaaactctgtagatttgaagaaaaaaagatgaatacaaaatcaaatgacaagaactgaagcaagatgaccaatagacaatacaaagacaaattacctgacccaaaattgtccaaggatcagccttaggaacaagacgaactctaataaactcagcatctttaactatattatcagctcgaaagtgaaccaaataatcagctaattcctttgctgatttgaattgaagcatagaggaacatgttaaaggagtggacaagcctgttcctcgctgcaggacaaacaaaattagaacaacacaaagactaaaaaaactgtccagagaagagtataaaactatgaaagcatcatacttgatcgagtaagaccactcgaaactcttcacaagctctttgaatccatccactagcttcactaggccttggaccttcaaatcctggaccaccttgcaaatacaataaatacggcattgcttgctcctctttcccaactacaaaaaacaaaagacacaaacttttagcttcgtaatcacagaaagagctctgaatcaaaaagctccaaatttcaagttacccgcaacgatctctcgagcaaagacggtaattttgggagaacttttggaataatcaagaggaactatgaaccggtggtcacgcagtcggagctccggcaccgaaaaccacttcccagtaacatgctccgacttcgattccccagctacatcgacgtaaaccgatcccgcttcagccatggaggtgattacacgacaaaatctccggcgacggtagaaatcaatcaaacccggaacagaaccagacaatcttgatggagtagtagatagagagagtacgaaagcagtcaactttggaatcggagtcaccagcgcgtgagtcgccaacatcgtttttattcttaaaagaaaaatatttatccaaaagtctttaaatttataactaattccaaaatcgctttcatcagcaacaacaatg

SEQ ID NO: 9622 - DNA, 3000 bp, Unknown; identical to SEQ ID NO: 9576
  misc_feature (1)..( 3000): cDNA_ID_2183928_gDNA_ID_1972163_Annot_ID_179648 3000 nt of promoter + ATG

SEQ ID NO: 9623 - DNA, 3000 bp, Unknown
  misc_feature (1)..( 3000): cDNA_ID_3042687_gDNA_ID_1972163_Annot_ID_179644 3000 nt of promoter + ATG
ggcgacgaaggctagagtgtagagagtaacgtgacctttgttttcgaagagaccgagtttacgaaactcggcagccatacgacggtaatcgcgtgagacttcggagacttggaaatctctgatgtggtaaccggtgaagagatggtcgagatggtgccaagcggttccgggatgaaatgcgatgaaagcatcggtgacgtcttgaccaacgagattgagaatcaccgtgtcgcctccgggatgagttttaatccaatcggagacgttgtagaccttgccttgaatcgcgatccatagatctccagatttgttgtgttttttaagatcttcgttcgtaatgtactttttctccgtctcttccgccattgacgacgaaccaaaagctccgagatccgatgaacgcacagagagaagatgaatctcttcccacgatttgctttttccgaatttgaaaaaagctttgagattagagaaacaccaacctttgtttgcccaggaatggatctggaatcggatttttgaatctctctctgtctctctctctctctccgcttatcttcgactccttccttatcctccttatattatgggtttgttttatatttagtgaattttcgcggattaatattgaatttttggagaccgaaattacgtggctaaagcgtgccgacgtcagtcgttctcacgtgtgggactttaaatattgggtttgatgttaattttgggtggtatatcagaattggtaaagagggaccattattgggcaattaagaaaatggttagttatggtaattagaaaggaggaaacttagtgctgtccctcgtaagtaatcatgaaatgcaagacagaccacgtgttaccttagatattttctgtatgttctgtcattggttggtgtccgtcaattttttttctacgctccaaaaaagttagtaatgtcaacattaagaaaataaataagagtatcaccaaatgccaaaaccgaaaaagaaaagtatcctctaattgtggtcaataaagccttattcttttacagaaaaaaacaaaaatacaggttttacctttaaaaatttcatttttactataaattacccgaatattagcatatgtgttgagtcatgagtgatatggaaacataaactaacctaaagtttatgaaatgtaaaatttataaatagaagcatatggtttttacgatatattgatgacttttggcatattccgttttatgtatagaaagatttttgaatgcaaccagcaccgtccatgttgtctaactgcttctcaagacttggtctcaaagatacacagctgttctcttccatatctttttctgatttatggttaactcttccaagatattttcttcctcaagtgggatatctttattttatccatggaggagaataaaagtcagataaacacattgataatattactaaaagaacaaattaaatagcaaaagggagggaaattgctcaactgggaaataagaagactttttttttttgtttggtgtaaggaatacaaagaagacttgggaaagcagtgggaagatggttggttattcatttttataatataggagatactatttctgatgtcacttttgtttataagtaaaattataaaatgcatacgattcgaagcctacaacgtgtgacaaatgaaaattggtgcatatattttgttttgttttcaagaagataattacgaatgccaattttgtagaagaagatattttgaagttttgatgttcagtcaaatgaaatttatttgggcctacacaacgggttggaaaaggggtcttgatctgaaatcttaatttgaaaatgggccttattctggaaactcaaatccaaaagggccgcgatgaaacctacatagtatatacattacatatatagataattggatatatggaaatgatttcctaaattcctaatagttcagaaccgttgatttagaaaaaattaagaacatgtacggccttaaataggacggtctattacaaatttataccgtatatgtgaattttcccttttctaaaattatgttaatgttaaattttactttcttttttttttccgtttttttctcttacgtcctatatgaacattgaacgggtagtgcctgaataaaaaactttaaagagcacattcaaatttgataagtcgtcattctatatttttctctgtaatttctcgtataaaaaaatatgactagcgcagataatgagattttgaggttgaggcacgaaaggttgatgaagatgtcggagaaattgttgtacatgatggattatgctgactcacaagtggaaaggttcaagtcgatattgacatcgcgtgacgatccactggcttcgttttgtgcggtggtcgtttgtcttgtcgtttgcttggttccattacagatttggttttaagttttgaatgcccagttggcctatttcccagtttcttcgcagtgacataccaagtcgaatctacaacttcttcaaaagtttgccgctgaccaaggcagagctagactttccaagtgaaatcaacaacttcttcacaatgcctccgaccatcgaagagcacatgtcctgacagattttgcaacgacggctgttgtgtttgtgtttttttgtctaaagatttattttgacgtctcatatttatctattgggcctttgtttttaaaagcccattaataataataacttgctacgagtagcgatttgttttaaaacgtaacgataagagttaattaattaatgaatacgctaattcaatatgatctaaacatttatttcaattccaaatctcttctctctgaccgggaaaagaacacgaaattcatttctgcttattgtttatctgcgctcaattccgacgaagattcattgtctctttgatagacaagtgatctgtgtttttgtggggtttttgagcctttgaggctgcagtaggtgttgagatagagctatgtggagttcaattgagaatatg

SEQ ID NO: 9624 - DNA, 3000 bp, Unknown
  misc_feature (1)..( 3000): cDNA_ID_3042699_gDNA_ID_1972163_Annot_ID_179634 3000 nt of promoter + ATG
aaactatgcttttgggactctccgatggatctttatatagtatttcctggaaaggagaggtaatgtacatctgcttcatctgcattgtttgttcttggggtttttgaattctttgtgcaagattcctgatttctcatgttttgtttgtctttgtagtttggtggagctttcagtattggctcccacccttctgctagcaacgatgatagactcttgtcctacactcttggtaatgggctagtctctggagtagcttcaccaacacttgcatctgatgataaattctctacaaaaccggctattgttcagctggaactttgcactcgttccaagttattgtttgtgttaaattcggatgggcagctagtagtatgctctgtgaataagaaaggtttaaagtacactgagagtattagagctgagaagaagttgggtggtgatgctgtttgtgcatcagtggcttcagagcaacaaattcttgctgtgggtacaagaaaagggatggtggagttatatgatctgtcacactcgatctctctcttgcgaacagtttctttgcatgactgggggtaagcaacttgttactatgaaaagggatggtggaattttgtgatgaacctttattttttaatatttgttttgaaaggtttgagtattactattcatctgagtagtttttattgtggtgttgtgtaaagaccataatatcatacttgtcatactacaactggaagtttatacgcctttggtagttttcaagttgtcttactgtgatttatttcatgcccttgatattttggctgcatcgttaataaaactgttttaaaacttgcagttattcagcggattacactgggcctgtaaataacattgcatggacgcctgataattctgcttttgcagttgggtggaagtcgagaggacttgcagtttggtctgtttctggatgtagattaatgtcaactgtccgccaaattggactgacttctacatcttcccctaaaattaatccaaaacaagactgtaaatacgaaccactgatgagtggtacttcagccatccagtgggatgaatatggatatagactatttgctacagaggaggcatcatgtgatagaattcttgcattttcttttgggaaatgttgcttaaatagaggagtttcaggaaaaacttatgttcgtcaggtaatgtatggtgatgatagactactcatggttcaggcggaggacactgacgagcttaagcttttacatctaaaacttccagttgagtatcatcatatccgttatccccttttgctcattcatcgtatcactttgaaataaatttcttatatatattttcttggtccaggtttcttatattagccaaaattggcctgttcaacacgtggcagctagcgaggatgggaaatacttggcggttgctggtttacatggcctgattttgtatgacgttaggtttaagaagtggagggtatttggagatgtcagtcaagaacaacagattcattgcaagggtttgttatggttggggaagattgtcgtaatctgtaacttcattgaagcttctgagacgtaagtcccgatctatattattagtttctaatcatggttcactggctatatttattaatgtttacaaggaagagaaagtgccttttaatagaaatgtgtttgctactcttccagacttttttacattaatgtgataaacgtttctgagcattttgtctttgaatgttgtttaatttcacgtgtatgttcgctaattattgcagatatgagctgcttttctatccaagatatcaccttgatcagagctctttactttgtcgtaaagtgctgcttggcaaaccaatggtgatggatgtttaccaggattatatacttgtatcttatcttccgtttatcatccacgtctaccatgtgaagatatatggtgaattgacaccttcaagcaaagcagatctacaggtagttagttattccggttcatttcttctctgcatcattttcagtaaattatactttttaacttccaaatgtgaacgcttgagttgcttttcatgcaccttaaagtgattaaatgacaaacagctttccacagtaagagagttgtccatcatgactgcaaagagccatccagcagcaatgcgatttgttcctgatcagcacccgagagaaggcgaattggatgaagataatttgtcttctgatttgtcagaaagggaaccctcaaggtaatcatcaatagagtagaatatcctttcagtttatgctgtcattctaattgcctttgtggtctccatagatgtcttatactgagaggaaatggggagctttcacttcttgatttggttgatggacgagagagggaacttacagactcagttgaactattttgggtgacatgtggtcaatcggaagagaagacaaatcttgtcgaggaagtatcttggctagattatggacaccgaggaatgcaggtaattcctctgcttcaaagctgcttgttatgctcacttttcttcttcttcttttttttttttttttttttcttttttctttttctcgttatagggttgccctgcccctaagtgtctgacagtaactctctgtttgatccctgtcttttgtaactttttttgatttgtttaacgctgagattctatattataggtttggtatccttctctaggggatgatccttttatgcaagaggatttcctgcaggtatgcatgctagtagagtccattttcaccgccattggtggcttatctttttgttctgatttttattgtctgtaacattattgtttgacgacattgacattcaaacacatccctcttataaatttctaattttttcattgtttcaaatgcatttttattatgttccattcttcagctggatccagagttggaatttgatcgtgaggtgtatcccttgggacttttaccaaacgtgggcgtcgttgttggagtttctcagaga

SEQ ID NO: 9625 - DNA, 3000 bp, Unknown
  misc_feature (1)..( 3000): cDNA_ID_3042709_gDNA_ID_1972163_Annot_ID_179631 3000 nt of promoter + ATG
aggcagtagataaatagggttacgttctcggtattaggacattttcataagaacaaacaaaaaatagagcactaattatcattattttaaaagacattagtatatgaaaattttatcaagatcgttaactaatcttgtagtaaagtaagatcaaatggctgagcttcattccgtaaatcacacgtcaaagaggtctcatgcgttgtctctattagcatttatactggttataggaaaacaacaaatgtatttgaaaagtataaaattcttttgtaattacatatgataagctaagtagctaactactgtattaggttcttttctttatttaacaagtttagatatttgttttgtgattctatgttggcatcagtggaggtgtatatatcaaataatgcgagggatcacctaaaatattactatttctataaaccagttcattgcttttgtctttcttttttttttttggtaagctgcttttgtctttcttatatatataggaaactatgctctaatttgcactacggtttggattagtttcttattttgactacagtaatatagttaggattgcttctagttttgaaaaagatgataatatgttttgagatcggtacaatgtttaattgaaatatatatatttgatgatcaaattaaaggcatattaggttgagtaaaaacattacaaaagcaaaagttcaaaaaaaaaaaatgaagaaagcaaagagaaacgagagaagggtgtgtgtgggtcaaggaggctttaaagagatgattaataaagaagaggaatcaaccttatctatacccctcaccctcaatttcgaaaatgatagattatatatatacataattaataattatataaaagtagaaaaaagtctattgtttaactgagtggtggaccggagagaggtataggagacaagtcgtcggtggcaatgatccttccaccaaccggcaatggttcatggctcaactatgatcggagaaatgtcgtttttgcaatgaacatatatgttttgttatctataatcgtattttaaaatcaagtggtcgtatatatatactctaatacttatagtcatgtggaaattttttcataagatgtacaacttacttacgatgatatattcaaacttagtaggaatttatttggttctatagcctatatatagttgactcactcaaaaataaccagagataaataataaaattgatgttttttggtaatatttatgaagtatgggccttatttataatcacacgctgaattctgaaaccttataattagaaaacgcattcaaaaaaaaaaaaaaataacaataagaaaatctatatagcctagtagaacggtcacaaaaacccacaaaagtatcaaaaactcgtaaaccatcaacgtttgagctcattttgttgttatagtcaaaatcattcaaagttattttgacaagacgtattggtaccataataacgcattaatacacctatacatttataaattattttattagttatacacgatggtagtacaagaatacatgtattgtagtagaattttgtaatcaattaatgtcacaaaattcaaaccaaacttcaatgagaaaattcatgatgctcaactagtcaatgtgtatgttatacgacaaaaaaacatgcaatttgtcaattaccatcgatccaaaaaaaaaaaccctctaaaacgataagaggaacgaaataagtatggagaatggtgtgttgatttggaaatgttataatgaggccgagacagccacatggccctattgcttgtatgcatatcatctcatctcctacctctcccacacttctctttgtcatgtcactgtttaatttttgaatactcgcaccatctcgttctctggtcccatgatgcatcgatacgaatatacttgattgactgtttcttgtttgtttcataactatataccctactttaaaccctatttgatccaatattgatcttagatttaagatgatgtttcggtggaatatgaggttcaatcattgcttcatttgtaattaaataaaattttagatgatactgaaaaagtcacgacaatacagatttttttattacactataattgtttttcaaataaaaagattggagttcatgtattcagtctctgttagggtcttaggaaccttttgttgttgatattatacgataaagatataattagcttattctctatctttatgattcctattcctactgatgtctttatgaatctcataatttataggtcacataaaacatggctaatcagtgttttgctaatcataagattttatagatgtgattcgcaattttgtttcctacaaagcaggggtggttttctagatagaaagagataaacgtatacaatcattcgctataataatatatgatcgattaacaacgatgtttatagatatttaatcattttgctagtgagtatacagtcttagatctcgtcgtcttgtctttctcctacacgtcacatggtaccacttcatgtttctttttgcttggtaccactccatgtttttattatcaaattggatatagaaaaattgcaattaatttgtagaaggtacataaatgaggtcccgctccggcaaatgttaaagccgtagttattttcttgaaggcctaatgctatcagctgaagattaaaaaaagcccaaaaacatatgggctttggtattctttataagcccagtcacttggaatactagcttatattttctttctttaaaactcagttaatagttatgttcaaatagagagaaaatctaagatgtggtgggacgaagttgccacgtgccaatgagttgaccaatgaggaaactcagtgcgttatccgtagggataatcagataagcagaatctgattttgtcaccagagtgcttttatagattacacaacacacgttcgtttctttcttcttctaacacactctgagtcttgaaggtcaacaacgtcgagaata

SEQ ID NO: 9626 - DNA, 3000 bp, Unknown
  misc_feature (1)..( 3000): cDNA_ID_3042716_gDNA_ID_1972163_Annot_ID_179627 3000 nt of promoter + ATG
gtcttttctatttggcaattagtacactacttacgttttgtggtaggaacaaataatttgtaatcttggcacaaaccagtgctttgtaactttgatgatagaaaaaatttattcactagttcgataacgattatcaatcatcataaataaaaaaagttagtttagacgatcatgaagagagaaaaaacagaattattggtactatctcttaatttcccaactctgtaggtacactcattaatcattatggagaatgtcatagtcatggtacataatgaatgtgcatggtgcttatggtacagatgttcttaacttcttatcctggctggcaaacgccagatcatctcaactggaggatcatgttttgttcgtaacagttagtaactaaccaaattagtgacaatcatgagggattattaaaaacagacattgatctatttttgattagaaaacattactgataaaactacaaaaatagctggaatggagcattcaaaactctgtccaaagtccaaacggttaaattatcactgacccaatccaataattagatttatttagtaagtatgattactacgaagataacattaacaaaattttatgttattgtcaatttgtcatcatcgtctttattttttatttctcaactttctttgcattacatcttccaactatataattaaccactctactttctcaaatcccacactcagagaagaagaagaagaaaaaaaacagagctttacaatttctctctacagagatcgaagatatggaaggcaaggaagaagacgttagagttggagctaacaagttcccggagagacaaccaatcggaacatcagctcagagtgacaaggactacaaggaaccaccaccagctccgtttttcgaacctggtgagctttcttcatggtctttttggagagctgggatcgctgagttcatcgctacttttctctttctctacatcactgtcttgactgttatgggagtgaaaaggtcaccgaacatgtgtgcttccgtcggaatccaaggaatcgcttgggctttcggtggtatgatatttgccttagtctactgtaccgctggtatctccggtaagtcactctacttctccaagtatacgcctttttactgtaattaggtttccgagtgtttgggttgtgaaagaagacgataaagctataatcttgagaaaattgtgtttagatttatagcttcttagcctgaacttgttccatttgtatctgattcaagaaatctcagaaagctacaatcttggtggaatttgcagttttctaatatgaattgtgtcctttagcctaatcttggaatgtattttttttatatgtaactctcaggtggacacatcaacccagcggttacttttggtctgttcttagcccggaagctgtcgcttactagagctctgtactacatagtgatgcagtgcttgggagctatctgtggtgctggagtggttaaagggttccagcctaagcaataccaggctctaggaggaggagctaacactgtggctcatggttacaccaagggaagtggtcttggagctgagatcattggcacattcgttcttgtatacacagtcttctcagcaactgacgccaagagaaatgctcgtgactctcatgtccctgtaagttaccactccttgtaacatatctgctaatagcttcttgaaacaattgaaatgagtgaacttttaagctgcctttagtgtgactctcatgtccccgtaagtaaccagtccatgtaacaattgctagaaacaattgaaatgagtgaacttgaagctgccattagtgtgcactaaagactgattctcaatattggatttgttgcttaccggcttgagttttgtaataattgtgcagattcttgcaccactcccaatcgggtttgcggttttcttggttcacttggcaaccatcccaatcactggcacaggcatcaacccagctagaagccttggagctgcaatcatctacaacaaagaccattcctgggatgaccacgtgagtttccacacactatataccaaatcgcattccaaactcggtttcgagcatttttccctgacaatttcgtttttttttgtcgtcattccagtgggtgttttgggttggccccttcattggagctgcacttgctgctctttaccatgtggttgtcatcagagccatccccttcaagtccagaagctaagtaaaaacaagacatcaagtcctctggtttctggccttgtccttagttgcttctatagttctattgttgatctactacatgtatgtgtgcaatgtgtttatctatgtgccctcttaatgcaatatttgtaaacaaggaagaagttccaaaggagaattatttgcaaattatgatgtttaacatgtttattacagatcaaagatgtttaacatggatattggtaaacgagaacctatataaacccaaattaagatggtctatcaccgcttaaccggttaggtattgtaatggtattttaaacgtgtcagtgtcaccaacctcgcctaaatcctaatggaattgagacacagccaccaaaaaccatcagaaaaatggttccatttgtcaaatacttttcaacaaagcacgaagattccttgaccgatagaaaaaagtaaactgtataagaaaagaagttaaaaatttactagaaacaggtgtaagaagttgactgtaagtttgatcattccacgagtacgaataaaactctgacaagaacacttcacttaccacaaatccacaattacttttctcacatagttccaacaagcaacttgtattattatattcttaacaccaatggtaatggatgatgatgcaatgtatttgtctcgttttctcatccatttatatgattgctttcttctccacctcaccaatcactcctcctctaaacttttcttcactctcttgtctcttcaaacttcggttactccgttttagtcgacaaca

SEQ ID NO: 9627 - DNA, 3000 bp, Unknown
  misc_feature (1)..( 3000): cDNA_ID_2184271_gDNA_ID_1972163_Annot_ID_179622 3000 nt of promoter + ATG
agccgttggtttgagagaggacatgagacttctccaatgataaacaaaaggcttcctcacacgagcttggttccaaatcttgctcttcgatccgcaattcaagaatggcttcaacttcgtgaattattgaacagaccctctgcttgcagagagatataagtgattcgccttaatcagagtgacaaatttatcataaatcaaaacattttcaaattttgtcaattcaactttctctaattaatgtttatattattatatcaatgcacagtgcgttacaacacatatgcttcttagttaataggagttgttactctatcactagtattattggtttggtcactcttttttggggtggttacgcacgtatatactaaatatagactatgatctacttagattttaatatttgtgatgaattgtgaactataagaatatagtggttatgactgaattttttcatagatttaataaatcttccctcatggcataatattagttagttaatatatagtggtatagtggtcactattttatttgttaaatttggtttgatgcattggtggtcattataacaagcataaaaaaacactaaagctagtattggattcatccacgtttttgtaattttgttatttgatggaataataataataaatttagcctgaatcttgcatagatttagttctcttaattaatcttccctcatgacgtttaatataacggaaatatggtggtttggttgcccactacacactatatattcctttgatgccgtgatagtcattataacaagcacaaggaaaaacactaaatcgtagaagaagaaaagaaaaacaaacaagcaatggattcaacagccaccgttgcaagtgatcgtcttagtcaactaaactctttcgaggagactatgacaggcgtgaaaggccttgttgattccggaatcaaagaggttccagctatgttccgtgagcctccagctattttagcaagccgaaaaccaccactagctttgcagttcacgatcccaaccatcgatctgaacggaggagtagtgtactacaagaatcaagattcagttacacggagaagcatggttgagaagataggagatgcagcggagaaatggggtttcttccaggtggttaaccacgggatcccgctcgacgtgctggagaaggtgaaagaagggattcgcgcgtttcacgagcaggatgctgaattgaagaaacggttctactctcgtgatcacactcgaaaaatggtttactatagtaacttggatctcttcaccgctatgaaagcgagttggagagataccatgtgtgcctatatggccccggatcctcccacatcggaggacttgcccgaggtttgtgggtaaggtttccatatatatatgagcttaattatttatagctaataacatttttagaaaggtttttaaaaaaaattttgtattattttttaaaaagtgaattatagaatttttaaagtaaatccatttgtatttttcatgaatctgaattgatgttttgatatgtggcagggagattatgatggagtatgcaaaggaaataatgaatttaggtgaattgatctttgagcttctatcagaggctctagggttgaataattctaatcacctcaaagacatggattgcagcaagtctttggtcttgttcggccagtactatccaccttgtccgcagcctgaccatactttaggcttaagcaagcacaccgatttttcttttctcaccattgttcttcaggggaatctcggtgggcttcaagttctccatgataaacaatattggatcgatattcctcccgtccctggggctcttgtcgttaacctcggagatcttctccaggttaaagaagtgactttttagctttgtaacattttagctctatctttgttaggaatatcatatatgaaataatatggaatttaaagtagtaagtaaaagatataggctagttatgatttgaatggagatgtgagttgattttttatttgaatttgtgcagcttataagcaatggcaagttcataagcgtggagcacagggtgatagcaaatagagcggctgaaccgcggatttcagtgccatgtttcttcagcaccgtgatgagggagagccatcgagtatatggacccataaaagagcttctgtcagaacaaaaccctcccaagtatagggacaccaccatctccgagttcgcaagcatgtacgcgtctaaagagatcaatacctctgcgttactccgtttagagatctgatacatcgaccaaagaaaatgtctttgtattaaataatgttcgtatgcgtttactcaatttcaagatttgagacatcgagcaaataaactgtacctttgtaacgtaatgtgtgtatgtgtgtcactccatgcacggatatgtcgacgtaaaacatccgtaaaatgtacccttgtaacataatgtatgtatgtgtgtcactctatgttaggatatgagacattgaccaaataaaatgtctttgaaaacacacaccgtttggcccattgacccactcttcttttttgtttttacatcaagtagtcattttttgtttatatggtgctagttataataacccattgctacctaatcttttaatacacacgcacatttgttttaagtatattttaatgatataatcgacattgattacttccttgagtttgattaggtcgttgacactcaaagggcttaaaagtaaaaccgcacaagaaaataatacatatacatgacattccagaacgaatattcgaaagaacagagtaacacaagaaagggatgacacatgccttaatcggatcttttctttcttaattccatattattaaaaacattttccggagaagaagacaaaaccaaagcttcttgtctgaaacgaaccagccattctaaagatttttacaaacaactttttcccgagaaaatctcaagtttgaggaagcgagaaagagcaac

SEQ ID NO: 9628 - DNA, 3000 bp, Unknown
  misc_feature (1)..( 3000): cDNA_ID_2184283_gDNA_ID_1972163_Annot_ID_179625 3000 nt of promoter + ATG
ccggtaagcaacaaatccaatattgagaatcagtctttagtgcacactaatggcagcttcaagttcactcatttcaattgtttctagcaattgttacatggactggttacttacggggacatgagagtcacactaaaggcagcttaaaagttcactcatttcaattgtttcaagaagctattagcagatatgttacaaggagtggtaacttacagggacatgagagtcacgagcatttctcttggcgtcagttgctgagaagactgtgtatacaagaacgaatgtgccaatgatctcagctccaagaccacttcccttggtgtaaccatgagccacagtgttagctcctcctcctagagcctggtattgcttaggctggaaccctttaaccactccagcaccacagatagctcccaagcactgcatcactatgtagtacagagctctagtaagcgacagcttccgggctaagaacagaccaaaagtaaccgctgggttgatgtgtccacctgagagttacatataaaaaaaatacattccaagattaggctaaaggacacaattcatattagaaaactgcaaattccaccaagattgtagctttctgagatttcttgaatcagatacaaatggaacaagttcaggctaagaagctataaatctaaacacaattttctcaagattatagctttatcgtcttctttcacaacccaaacactcggaaacctaattacagtaaaaaggcgtatacttggagaagtagagtgacttaccggagataccagcggtacagtagactaaggcaaatatcataccaccgaaagcccaagcgattccttggattccgacggaagcacacatgttcggtgaccttttcactcccataacagtcaagacagtgatgtagagaaagagaaaagtagcgatgaactcagcgatcccagctctccaaaaagaccatgaagaaagctcaccaggttcgaaaaacggagctggtggtggttccttgtagtccttgtcactctgagctgatgttccgattggttgtctctccgggaacttgttagctccaactctaacgtcttcttccttgccttccatatcttcgatctctgtagagagaaattgtaaagctctgttttttttcttcttcttcttctctgagtgtgggatttgagaaagtagagtggttaattatatagttggaagatgtaatgcaaagaaagttgagaaataaaaaataaagacgatgatgacaaattgacaataacataaaattttgttaatgttatcttcgtagtaatcatacttactaaataaatctaattattggattgggtcagtgataatttaaccgtttggactttggacagagttttgaatgctccattccagctatttttgtagttttatcagtaatgttttctaatcaaaaatagatcaatgtctgtttttaataatccctcatgattgtcactaatttggttagttactaactgttacgaacaaaacatgatcctccagttgagatgatctggcgtttgccagccaggataagaagttaagaacatctgtaccataagcaccatgcacattcattatgtaccatgactatgacattctccataatgattaatgagtgtacctacagagttgggaaattaagagatagtaccaataattctgttttttctctcttcatgatcgtctaaactaactttttttatttatgatgattgataatcgttatcgaactagtgaataaattttttctatcatcaaagttacaaagcactggtttgtgccaagattacaaattatttgttcctaccacaaaacgtaagtagtgtactaattgccaaatagaaaagacaatgttaaagaaaacaaaaacatgcttagtggttgctatattgttctggaatgggccctatggccctacgctcttgtagcatccaagggccatcttgattaccacctagtattttccaactccttatcaatcattttgacactgtaattaagtaattaatgataaaaaaggctcatgtgagatactttctcaaactaaaaatccacatttacacgatttgaggaccttcaatctttaaattattatttttatatgtatatttaagctgcaaaatagaaacacttaaaaccaaaatgttgaaacatcagctaaaatcactagccactaaaaaaaaagaccgacccattaagcctcatgacatgataaaagaatgtgtgaagtgtgattttggaatttttatgttggagactgattatttaatagccgtccaatgcatcgacgataagatacgtggagtcataccacctaatgccggcgccttacatatccaaaaccgaccatttatcttatgacatatgtactcgatcaatttattaattttattgtggctgctattcatgattgcatttgccccacctagccacccccatttgcgtcacggctccataaaaaaaaaaaatattcattgaccaaacacaaaaaaacaagcgaaaattaccaatgtcctcctaacatgaaattaataagacaaatgttatcgtctgcctataataaactaaaaaaaaacaataaaaaaaagttgcgacttttagctcgagacaataaatgggccatacatatacgggcttaagctaacaacactactattgatcgcaggcccggttaaacaaggctcgtacacgtggctcttgagactcatcaacttcgggtgtgaactgttgaaccatctcaagacatgagctatcacggctcgtacacgtggttctaaccacctcattatctctcgaacttaaaattaacaaaattcccaaattatttagctatttttgtctgatctgccgacgctagccgttctcctccgccagattcaaatatttcctccgccgtcgacactccttacctcctccggctcacaaacttaatccaccaattttaccatgctttagaaccttgggcatatatcaatg

SEQ ID NO: 9629 - DNA, 3000 bp, Unknown
  misc_feature (1)..( 3000): cDNA_ID_2184275_gDNA_ID_1972163_Annot_ID_179623 3000 nt of promoter + ATG
ctgttgatgatgaaagatggtgcgtaaatcctcgtaccttctcttgtttggaatcaggaccctcgtgattactttgaatctcaacaaggaaacatcctcagtgaacccagaggagcaaaggcgtcaaaaagaaatgtccatgaagcttatggattactaaaagaatccattttggtgattagaatgacgggattaagtgatccgttgattaaacctgaagtttcctttgaggtgctattctatctcaatataaaatgcatgctgcctaaagaaaccatggcttattgctttgttccctgagctaaatattgctaaaccctatccaggttttcagttcgttgacccgaactatctcaactgccaaaaatattctcgggaagaacccgcaagagagctttctggacagattaccaaagtccactaaggatgaagttatacatgtaagtctgacatcctccaatgtcccaagtaacaagcagctcaatatatactgattactgtaatttggttaataatgcctatggatattgttgtcccctcaaatgcatcaatactttttccttttttctctcatatacagcactggacatcaatacaagaattagtgagacatttttggtcatcttacccaataacaacgacatatcttagtaccaaggtaatgttgttgccacttcacattcttccaatcatagagtttgctatgtacatagattcttcaggatcaaattgaaatttatttacactgagaggaaattcttatactaggatgttatattttatcatgcaggttggtaaactgaaggatgcaatgtccaatacttattcactactcgatgtaagctatggaattcttcttcaaatctttttctcggagtaatgcgttagaaaagtagttcattatatcttcatacgaatgcatttacacaaacatgaaatttgggtaaaatgaataggtgcagagttgtagtcgaaacttacagcatatggtctagtgtttatggtttccgtaatattataccgaatgtaaaccaggcaatgaaacagtcggtgcagtctgatctccggcatcaagtttccttactagttcgtccaatgcaacaggttagcttccttccaattcatagatagttttattacatcatgtcttggtgaagtcttattttttccactcgcattgtatcgatccaatttaaccagcaaaaccagacattgcgttgtaatccagtttatgaattgaaatctgagtgatattaacccgttttctccaccaggctcttgatgctgcgttccaacactacgaatcggacttgcagagaagaaccgctaagattacatagagaacgttttgtacttggaaagaaagagatttccttcgacaaaaaattaaacattggactgaacatttagattttgtagtgtaatagataagattcttaaagaacttgagtgagaagcatcattagcgggatttggccaagaatgttgcttgtgctacaaggaacctctcaataccccaattgttttttttttgggtggcaaaacagttggttaagaacttgattgagaagcattagcggggtttggttaagaatgttgcttgagctatgtagtcactgaatcggtcattaaactctcataaacagaaatcgatgatgctaatactattgtttagttaaaggttagatatgttgctaatgaatttgtttagttttgtaagagcatagtgataattgagaaattggataatatatagagaagacgatgggaagtgtataggggtattcgggtttaattaacctagcatttgttttgagaatgtttgtaataaatttgtttaccataaaaaaaccttatagaaattaaattaacctaacctaaaaaaaaataaaaaaatgaaaaatgagaataagaaagaaagaaagtgaagacagaaaggttcacagaaatagccatctagaagagcctcaccgacttcatcagccaccaacgaaccctgagattctattttcatcatctcgagccatgagccatcgcggctcgtacacgtggcaattataacccactccattttctctcttgtcttttttttttttttgcgcgagaaaaacttaattattaaaaagaaatcccaaaatattattaagcccttctttctctctcttatccgctcctgtctctctctctctcttggtctgtttctgccgccgccgtcgccgttatcccccgccagattcaaatctttcttccaccatcgtcactcattgcttctcctccggtcgtaaggtacgacacgcttgtattcttcttatctattgctttctcatcgtcgtgtttctccattatatgtatctctctatgcgtgtgctacttgttcgattgtatcgtttgatcatttgaatgttatctatgtctctctctctcgctgttggtattcactctattcctcttttaatttcagtctccattgtatcaatttaagtttcggcacctctgtcttttgtttcatttttggtatttagcacctctctcttcatttctgggcttagggttttacgaattcatgattgaggtgcctcttcacattcgagagaaacttactttccatcaaaaagagaaaaagttgaatcgattctgaacttactaatctagactctcttagtttgtgtggacctggttgatgcatttttgattagatgccagattcaatctcgagctttctgagtgtttaccaagtttgatttcaaatttatgatcaatacattgtttcttctcttgtacccagtttagtgttaagtttccggaaattgattgagattgatgtctcgatgctcatagacctgaaataatcctccttctgtgcagtatttggaaccttgaagacttaaaaataacaactttttatagtgggcgctgtccaatatattggagagcttgacagtgtaataagatatatactctacaagcgttatacccgaagactgggtctataaatcaatg

SEQ ID NO: 9630 - DNA, 1197 bp, Unknown
  misc_feature (1)..( 1197): cDNA_ID_2105187_gDNA_ID_1972164_Annot_ID_179664 3000 nt of promoter + ATG
gaattcattcctgagaggttttccaacacctctataaactacaagggtcagcatttcgagctcttgccctttggagctggtcgtaggagctgtcccggaatgtccttgggaatcaccattcttgagctaggccttcttaaccttctttatttctttgattggcgtttgcccaatggaatgaccattgctgacattgacatggaagaagttggagctttaaacatagctaagaaagtacctcttgagctcgtaccaactcttcatcattcgtgaacaaatgcattaatatataagatcaaaatttgtaggtttgccctcatatatatagtttaatcagtttggtttttcattacattttggctttccttttatcctgtctggcttatgtattgtgaatcaagtatattcatgtttttatcttcaatagaaatattaatctatgtatgttttttttccaatgaagtggtctttaaataaactaaaccatgtttcaagttgacataacattaaaagtaaatcgttaagaggcattgaatcaaaaacttcttacaaaattcaatataattcctaagtttaattcaatcactaatcctgtttacgatcaaataaggtttgacgatcgcttcaatctagccttaagccacgtggaaccttacttttttttttttttccaaaacctaagtggccaaattagctcagaatttgtagaccgtagtgagtttatctcattagccctaaactcaatggccaatactagggtaccaccacatgcgggcatagttattttttcttcctatctgcatatttcatatttcccaatatattataactaacattatcaaacctaattagtttgtggtcacaggaatcagttccataaaacatggttagatatgttgattggcaccgtattgttgtcggtttggtttagagggagagagctttatatttaacgtgtctttttttagtggtattctccttctccatcaattaaacacagaaaatgatgtgcctcgacagagttgccttaattaattcaaattctctgatatattacacaaaaactttgatttattacaagaacctaaccacaagcataatgcctatatatatcctctctcgagaacaaaacgctcttcactctcctcatacaaagaaaaagaaagagttagcaacaaaaaaaaaacaataattatg

SEQ ID NO: 9631 - DNA, 3000 bp, Unknown
  misc_feature (1)..( 3000): cDNA_ID_2184561_gDNA_ID_1972164_Annot_ID_179669 3000 nt of promoter + ATG
tcacgagagactgttttctggttaccattagccattttactagtttcagaagctcgtgatgactctgatgaatagtcactgatcgaaccagcagttggtacactggaggaaagcttgggcttggatgtcttattggtttgttggggtgggattcttggctggcccataatacctctagatgtagatcgatttgccaatggctgggaagataatctggaacttgaatcattcttcttctttatcgaatctatagaaggtttgtgagaagcgctagatgaagcactggcacagctctctagtgaagaacatgaagaggtcatttcattctttgaggcatctgaagaacgtgaagaagacttaaaaggcacaccaggttttggtaagacgggtttagcacgtcgcgacatggatattcttggacccagaggctctttacctgtactattcaaggtcatacaatatatttcaattttaaaaaaacaagtgtaaacttctttaagaacaagttctgactaacccgcaggtaatttggaattcttttcttgttgcgttttgcttatatctaatgatgacctgttcgtcgatgttgttgacaagggcctgactttgctgagtccgttgggtggcttggaaatggatgtactgagacctcttgtagcaacaggctgcagaaaatattttatttttttacaatatccaatatattcattatgtggttcactatagggtaagctattaaaagtgatgacacgcttctgattcatagattcaacagagccaattcaattttattagtccagctcattaccaatggaaacctaggaaaaaaccattattctagttatgaaagactaagaaacaagcccatttaataaatatgcacctgagaaactgaatgaagatactatacctgtttggttgccttccctggtccttgtactctactcggatttctgggactgcctttagatttagtctgggaaataaaaaaattaaagagaaaattagccaaggagagagtaaaaagagatatccacagggtgcatttgttagtacttatcggatttacctttccctgagtggcagtgacgtccactgtacttgaagctggagttagacaaagaatgcataagatggtcaacttggaaacaaatcacaagaattaactattgctgcaaatgtgtatggtctagtgagaacagcttgaaacagttcttccaatgccacaaaattaaaacacagtggcgggacactcttcatgaaatatgatagaaaactctacgattagctcacattagaatactagctctttcagaagccataaaaagaaaaaggcacaggaacagcttcattatttaacggttaagtaaagcacaacacacaaaactaaaaaaagtaaatccttaatccttattagagagacattcaaagatacacatgccaaggtgtggtaaaggcatataacgatagaaagaataaagaagactcacttgggctaattgctacgtctgttgctctcaacacattacttttcccgggtgttgcaacatcagatgttttagcagacctttgaatagatgctctaacatcctcaaacaaaacaaactcctgactgttctccacagtgcagtcactttgaaatgtagaaatggattctgtagatctattaatatcctctagaatggtcggtaaagctttcttcccactcttatgattgctttccatcatgctggacagttcttccggttccaaaacacctgatgtttaacaatatatctcagcaaaagtaaagtaatacatacaaatcgaggtacttcgttcgaaatgaacttaccagcgctagtgaagaactcattgtcccaagcaagacttttacgcaaattatactttcctttcttcataactttctcaggctcaggcgactcgtgaggttgaagcacctcttccttctcttcaacagaagaagcaagtatctcatcatcacaatactgtgtatccctcatgaagtttagatctttatcctccttcaaacatttatcatccttatctgtctctgaaatgtaatacaaaaggcaaacaaattccaactttaaactcaattacaatggatctaagttcaagtatcaatcaaatgaagcaaaatcaaaatcctctactaatcaagtagattcagagaaattaacaaaaatacccagaacccataaatccaaaattgaaggagaataagcagagatattgtaattcaccggaaaactcggagaagagaaggctatcgtcttcaacagcgacatcaatcaaaccaaggccatcgacctcaacttcgcttttcttgctctctttatcttccattgaacagagagatcgaaatgttgagtttgctcaaagatcccaaagactgaggaagaagataaaattttgaattgaagattagattcgatttgttcccactctttgagaaatcaagggtttttgagttagtgagcgcggttgttcactaatgaatcgtgtaatgtctttgatcgactctcgaccgttggatttgttccatttttatttttgtttcttacttttaaaaactaatctcgttgaagcctaataaagcccataaaaaaaaaagcaaacttgacctcatatgggccttaatgcgtaaaacccaatatccaaacatatagccgtcgaccgaaatacgatgaactaactaatagagaattctaagattttgtaattgtataaaataaaacaagataagatttttcattacattaggaaaaaagttttgaattttatttgtatataaagaaaaagaggataaattaaacgaaatcctaagaagacaaggattatgatttgggatggttaatctctatataaacagagcaaatacgtgacttatttttcacaaacacattcataaactctactccaaatacttttcctgatccaacgagtttagagatctcatcatctttcttttttttcttcttcttatacgatcaaaac

SEQ ID NO: 9632 - DNA, 3000 bp, Unknown
  misc_feature (1)..( 3000): cDNA_ID_2184563_gDNA_ID_1972164_Annot_ID_179670 3000 nt of promoter + ATG
taaaatttaaagtgcaatgtaacaagtaacaacatacaaaataatttaaattaacagaacttcccaccaatgatatcaatgaagattatatattttgtatagtttcatcattcatcaaatctcgtaggttatatattatctttatccatgtaatttatttctatattacctcatttgccaacaaatgcatcaaaagacgaattattatggtcactataaaacttaagaaacgaaatatagtgtaaatttagcatgataagtaaaagataaacattctttcaattactatgattagtaaaatgagttataagttactgtttagtacataagattaataataaatcaaatgtgtacaaataggaataatgtttgtatattaaactataaactaaatgaaagagacgaaaattaaagaagtagccacacattaaaataaaaagtgaatatattaagcaggaccaaccaagaaatatcatatggatccaataaacatttggctatatatgtttatcatttggttgagtactcactgttggtatttttcattgaaaaactaaaataattttaaagattaatatgaattttagcaacttgacttaaatattttataaacaacattggtcaacttcaaaacatgaagaataagtagaaaatgaaggtaaaagataccttgtttctcatgtaaaagtgagaaggtaccttagacatttttcatcaagtcatttctaaaggaaatccacctttcacatattcacttatgcatatactctaaaatttgactcaacctctttatttcaaaacctacgaaagtcacataaaattttgtttttaaagatatttagttaaatatatatatatatatatatatatatatatatgtatatccattaatactatgtttatatcctctattaaaatatcggacatgttcataaaatagcaggttgaagacaccgggttcccatgtcgaaccactaaagtgaagctaaaggcctttgacaccatttactaaactttgaaactttgactatggttgtgactcgaatagttaaaacacaaatagctggagaaaaaattagaaccatgacattaataattaaataaaatatacatcacagatgagcatcgagcaagacatatatgatttgcttacctattaccttcatcatgaacagaaattctcagtgtaatgattgctaagaaattcttagtgtaataatttttaagccactttgtatctaccattgcacctataaaaggatgtattagcaaaaacacatgaaacatgttataaagaagagaagtaacaaagtgtgaatcagtatcaccacatttggacgatacaaaagctacacaaaacaaatattaaaattataaaaatgagagagagaaacttgattttagttcatttctttagtgaaaatgagaaaaataaaaaacaacgtaatacagaggacgaagcaaacctttgagattaccattctttggtttctccaatccgtcatactcatatggttcgtgctttgtctttttttctctttactttcaatttaattatgtggaaagacttagcagaccacaaaatattatttcgatgtttaaacaatcccgaaagcaacacagaatgatagaagtttaaaaggagttgtaagaaacaaaccttgaggaaccgatgttaatgttgttcctatgaagaatcctaccaggagcaacgtcaccaccatcgatcaactctctaagcccccaattctccacctcctcttctttcacctccttcttcttctccttctccacatggcggttattaggaagcttcacaggcaacctctcgaagtaattcccgaaacttaccatgcacgtttttattatcttcgtatagaaagaatgaagcttcaacctcaagcgttaacaaatgcagagaaaccaacttaaaaaaaactgacatgcagcgtcttgcattttataaggtgaagggttacactaaaaatgatattaaatatgatactaaatattgaaatcatggtcataattacataaatgataattatgttagtgtaacgtaactgctttgatttatgaaatagaacagtttagttgactaaaaaaaaaacagcaatagttagacataataaataaaagaaaacgtgatatcacatgtgtcattaaatagaatattaattaaactcaaagaatatggaaaatagtatatttaaatttaagaagaatgacacatgtcgaatgaataaagcgccacttgtaagatttttagagcacaagtttgaggaaaccttactttattatataagatactaggttttattacaaaactaatactattttgattccaaacaaatatatatttgcttaaatgacagaataaaaactgaataaaacaataaagataacaagaaaaacagtaaaccacttaaataattaaattagacaattaaataagtagaaattacatgtcactgagaaaaaccacttatcataacaactatttagataaattaaatccacttacataaatacaatgtatataaaaaagaaatcatgtttttttactatagtttacatgatagaagaaaaaaattcactacattgaaataaatcttatatattttatttcacctaattactaaaaaaagcagaacaaagaaacattgttgaggaaaaaacaaaagagttttttttgtttgtttggttttgtcaaattaacaaaaaaaaaatgaacggtgtcgataaaaaaataaaaaagccctaaatcgttgaatcgcatacaagctcctatcttctccagcgtcggatcagatcagatcaaatctctctctccatctccgtctcctcctccaatcatcatttctctctccgtctcccgctctttttcgaattctccttcttcttcaggtattctaatcacttcttcgcgctttctgggtttggttcctcgattctcccgatttcccaatctctacctgattatctagggtttctgagatg

SEQ ID NO: 9633 - DNA, 3000 bp, Unknown
  misc_feature (1)..( 3000): cDNA_ID_2184581_gDNA_ID_1972164_Annot_ID_179674 3000 nt of promoter + ATG
tactagtgcaacgactgttacaaagcaacaaactttattttaaacttagagaaggcaagagtcatgacgccaaaattgattcatgtttcaacttaacctacttaaaaacgaactcctctaaggaaacatactgttctgttataatttaactaatctactgtcactgagagtttcctagaacacaatctattacaatgacagaaacttatataaatttgttacgctgacataaatactagcacaagcacaaacgaagaacacatagagatccttagacaaagtaaatgtgaagtattgtgaaccagtggaatcaattcttcaagtttcactagctcaatccaagacatgaaagcggaatcacttgaaccagtggaatcaattcttcaagtttcactaacaaataatagtaaaggaaaaagatggaaggaaaattaaagatacacggaaaaagataaactcttgcctgttattcacagaaccgtccttgttataatgcagagcaccaactagcttcttagagacgtcctgtaactgctgtctcagtgatactgtgtacactacaataacacatcataacaaaataaatccatgagacaaggcatctagatcagcggtgaaaacggtaagctcaaatttctacattaccatccccagaattcagcccaataagtaagtcatgcccatccttagcatccggatcaaaagcatgacacatagggtttgaattactgaaatggatagactttactggatcctacatcaaagaagtttcctaaaccattacttccaaaacaaaacaaaaaacagaacattacagccaaatcactaaaaggaaaacaaagaaaagaagaaattaccttttcttgtgagttcaagtcacagataaaaatagcatcactcacattgaagaccaagtaagttcctttcccatcaaaattcgtatttgtcatcgaagtattagaattagaagcagcgaaggagccactaattcttgaacttgtactcacacttttaccgccaccattacctccaacaaaactaagcgcacggctcccatttccagttcctagcaacctcgctgttgctgaacgaaacccgctactagcactataacccgacgaagtaccagttggagtcgaaggagcagctctttccttaagctgagctatagttacctgaaaacgaaaatttccaaattccatcattggaaagcaatgctattcaaatcgattgatcagctaaccaactagtgcatcaaaatgcaaaatttcactaacaaaaatttaaccatcgatactaattctctgaaattgccgatttgaatgattagaaatcctaatgacgaatcaaactattaaacccaaatataaaaatttgatctttacctgagtaacagttttgccatgtgcgtaatgaaggagaccagaggaatgcgttttctcgtagtgaagcttatacttcccttcaggcgtcttgaaataagtcttaattcccggcgactgaggattcgccgccggtgaagacgacgaagatggcgctgatatcattccattagaagtgttcatcatagtgtttgcttgctactcttcttcgtcttctctaatcgtcgactcaaaaagcatatatgtgatcacgatttacacaacacctagggtttgttatctctcacccaaaatcgaaacccagaaatttttcactttttcttcttcttcttcctctcttcttcgatgcaaaatcgagtaaagtctcgacgaagaatcaaaaacttctcttcttctgaggtctctaatggcttaccgaatcaaaaggggttattatgatgcaactacttgtttctcgcaacatattatgattatcaaagctttgactcggaagcttttaaaaagtcattgcaatcaacggtgaagattctcgtaagaaagattttaacggatggtgatcagatgggtcgggttggttatttcggtttcgggttttttaataatcaagatacacgcatagatcacgtgggttgacgtcatagaccaattcaggcccactttcaagcccattatgtatcaattgatgaccaatgaagtaacggcctttcagcttagaaactaaagtagttttcttcataataggcctagcattcaagtttttttttggattatttttgtgaaagcaggccttaaatcaaattatccaaatatggaattggttttggttcagtgtacatgacataaatgtattttctttaatgtgatttgattctagaagacgagttattaccggtcgaaaagaaaaagaaaaaaaacagacgagttattaccgttttagttaaaataaaacttggtatagttcacttagaagaaattcagttttgtttggttaacatcagttttaattcgaaccccatcccatccataatttgatttgatgaggttttattctcacccctaattgatgtcttggaaactctagagaatccagtgacgatgatttgtgttaatgttcttggtacgacaattagccaaaaagttttggatacttttttctggtgcgtcttttacctttcaaccaacgaccacgaccacgacaagaataaataaagaaagatgataagtgctacgaccgttacatgcatgtagttatttgttagacgtgagaaaatcagaacaacaaaagtcacttcgatacatcataacattttctccatagaaaaaaaaaactttcagacaaaaagacatatagccgttggaaaaacccacgtggcgttacacatctctctatccacttgtctgacttcattcgttgtcgctttggattctcttttgctctctccatattattctttgtctcttcctctgctttactttactccaagcaaagtattgccccaatacactacccgtgactttcatcaaatctctctttctcaatctctcaaattaagattctttcttcttcttctccaatggcccttctctgaaaaaacatttcttcaactgatcattaatg

SEQ ID NO: 9634 - DNA, 3000 bp, Unknown
  misc_feature (1)..( 3000): cDNA_ID_2184702_gDNA_ID_1972164_Annot_ID_179680 3000 nt of promoter + ATG
acaaattgattaggacaagagcttttatacgtaactcgaccaaaaacattgtaggtgagacatcagtgtacacccaaaaaggcacattactgtcgactgagcttgtcaggccgctaaatttgaccaacgagcaccccatcaacaaaataaacgttgagaaattatactagtaacttcttgttcgtgtgctaaacaactattaataatgtctacctccttatttaaacaaaacaaaacataaaatatatatacttaatagtagtatcttatcttttttttcaaactatgcgataaattttggtcggatctacgatgttctcatagttaaacctgttttaattacgttttaaaaatctaccatagtgaaataaaaaactaacatactttatatccgcagttcaaatacgtatggaggactagaagagatttgaaatatggaggactagaagagattcaatagaacatgactttatatgaatttatttgtcctttccggtacaataaaatttggacttcatatgacttttatattttactcatttaagtaatcggaaattacaatatagaaatttttgatctgtaaatatcatgtaaagtatatatccaattgattatcatttgaatgcatattaaattattaattatgaagacagataaatcaatatatgtttgttgatcttgctgtagtacattctggactaattctttcaattggagtgactaaaaaggacaaaatttatgcataacgacgtcatactatatgtaactcgatttgtctagaatatttagataaggttaagactagttttctatgaatagaagaaagtgtaaaatatataaataaacatactaataacaattaacaacagaaccagaaccagaaaattcacatttctgtgcttttattatctaaaattcacttcgaaaaacatgagaaaaaagagttggctgacgtggaatattcgtctaatagtagccgaccaacgtagccaaaacgataaggtttgccacatggcaaaacgataaccatggaactgcatctcctgtcttttgtttggttgtcacaatttgtcatttttattgggatttattgttttgttatattttcgttttcagtctaattgtcagcaattttcgcaaaagatatgaaattttggatatgaagagaaaatgcaaatgattggtggggacaacaaacgtggcattatgtgagtggttgagcgaacaaacggctatatgctgagatggattggacggtgacgatacgtttgtcggagggatcgggtcggttagtcacgcgcgccacccattcacgtgtcaccttttgccaacacagaccatatgattttaacctcagtggaatctcgacccaccccacaaaacggcaccataactttacaccctggttttagagagtgatataccaacacaacaattatgaaaaagggttcgtttaggctttggttactttatgttagtaatatcaacttaaatgctaatttgagttatgtgtgataagatatacgacgaatcaatttacttatcgtcaattaagtttgaaatgaaagtttgtgaacgaaatagtttatgcttctttaatattgtgtcataattttgagttccggctctaacatcttcaagtagggttttgttttatgacacctcaaacatacttaataacatatgttggtgatagaaaactagaccttctagactacaaaaatgtttataatgtaagagaatgaccatatatctatctattttgaaaacaaagtgttttgactttggtgaacaagaaaaatgttctctatatatacaatgagacactcgaatataaccatgcatgattagttggatttggagtgaagaaacttagccatgcttcgttggagcaaaataaggttttggagttttgttatgtgttttcaagaatgtaaatgctgattcgataaaaaaaaaaagtggacgtaagttattttaaaatgatttggcatacaaaaactgtggctttttaaatctgaaaaatcgacaggctatgatattatacgacaaaaagaagagagcaccatattgatgatatagtatattgggtcggtcctaaagaaaatgacatttaggtgatgggggcggcgaggctaagttaaagtaaacaaaaaaaacctccattatttaccagaaaaacatataaaaatttgattgacataaaaactaataaattatttcaaagttgtggttctgatagctctccaccatcaccactgattgatacttcctattgctacgagagataaaactatgcaagtttatatgagtggatataaagtcttgttttatgatatcataagctagctaatcccatatcattatcatgtatttatagacgcatgttcaatagatttggatcaatctttttgtcatggacttggtgcaaactataacgttaaatagaataaactattctaatttaggatctaaaataaactcgaatcaaattttaaagaaatttactggctaacttatttgaatttttcaaatttcaacgattgaaaaactctaagtctgaaattaaactagggttcttgtctttacgtattagtaactatgtatgatattgatatatcaagcaatcattaaatagaattggttcaaaatttatttcaggacagctagttcataatcattttgtcaaagctacttccctcataataataataatcataactcactcgtatacttttatatccaattttttcattgaaaatacaaactttcattccaaaaaaaaacctcaatacacaaaaaaccaaaaaaacatataacgttggcaaaaatactaaaaatattttttaaaagataaagcaataaaaaagtatacaaacaaattaacaagaaggagagctctcactataaaacagagcacatgttcttctcactaaccactccaacagagaagcaaaagaaaaaaaagctattgtttgaaagaagaagaagttaactatg

SEQ ID NO: 9635 - DNA, 3000 bp, Unknown
  misc_feature (1)..( 3000): cDNA_ID_3042806_gDNA_ID_1972164_Annot_ID_179685 3000 nt of promoter + ATG
cacaggcctccctcagctaaacctccaacttcgccgattttattgaattcattaatgtctccatcatgttctgtacggcaattttaacgctctacttctctctcgggaatcaagacattgattgagattcaacttacgatcgaagcattattataaagtaaaaaaatcacgttgactataagacaaataattaagttggttaacgtctaagaaatgcaattttgtttaataactaaggttacatacttacatgagaaatcgcggcgggcagttttgttaggcctggatgaataaatactggtcttataaacatctaagatactgtattattgttttccctaattattgaaagaataatgcacaacatttactatgtttttattttttattttttttctattttgtaagaagacactttcaatgtaacttcatgcatgtgatattccttaattttaacttcttagaatgacttgaaattgaaactagaaaaatgttttcaagtcattttttgttaccacttttttagaattattcgtgaatatatagctttattatatctttatttatattttaaaataaattgtaattgataataaagaaaacaaaattcacaatttatatgtttgcctatataaagacttctgagagcacggttttcttattcaacaacgaccaaaacaagttttaactttggttcttgtacaatcaatattcttttggtcaggttcaccaaaaaaaatgagttaaaatgtttcacatttgaaatccgctcaaccaagaacgtgtaaccaagtggtttgtttgagtgtgtagaggatcaagtctagagattgagttctaccatctacgaaaaccgtttatcattcatttttaactactgtaaacattttcaacggcaaaaaaatacacgaatttctataaacttcaggggattaatcttgatttcggctcatgatctatctcggttattacaaaaacaaaaagggctctattatactgcgtttttatttgcttgactgtagaaactgcgatcttattatttggcaaaagtagtaatgcatataaacagtagaaacaacagattcagaatctgatctaaatgaaagatgaatgagattattatcacttgacaggagcaagaatggtgtagagaaggaggaatgagacaatgacgatggctccaacaagtgtgaaccttggacttgtccagagcatgagattggatctctctgttctttttataggatcgacttcttccgacaaatcaaactccgatctgggaggattccaagtcacgtacttgtccacgttgaattgcgagaacaatgacttcttgctctgcttcttgaaattcttccacgccttgtcccagtccgtcgacgctttatcaccaccaccacctgctataaaccaaataaaaccgaatttaaccgattataatctaccaacgaacataagcttcgagatcagactctcaccgttggactcgtttccctttcgaggaggttcgttgttggagcaacggaatctagaggaagatgagaatctaggggttatccggattagattggaggattttaagccggagattcgaacagtaatgtccattttccgatttcggtacggacaaaataagaagaaaaagtatctgactgttgtgttcttcttctcttcttcgattctccgccggacaatgttccttagccattttcaatctcttcttacgtcttcgctagcgacacgtggctatcaatgggacccattcttattatgaatctgaaccgggatggttattaaacggttaaattcgggtttgggaaatacccgatcccagactagacatctccagcttaaccggctctaataagtaactctttgctaattttattcattatccaaacctaaacctcagcaatggagagctagggtttatctctcggatccattgtctcctgaatacagacgtgaaccggagaggaggctttgggacagaattgatgatttggttcgagaagatggcatcttctggtagtattgactattgagcctaatgctacaacagttagtcagttacatactcttccttaacttaagccggaacacactatatttggaatcttaattgaaaatttgtgcaaggcttactcatgactataaattcatttttgttgcctattatttttacctttgattttcatttccaacaaaaaggaaaaaaacaaacaaacaaaaaaaatctggaaaacaagtgaaactgtatcaatattacataaacctcaaaattatggtatcagtggttacttaatagttaagaacgagttgaagatccatactggagcctcagtgtacagtctctctagttgcattttttcctttggcttttagtaatggccttatcttctcactagacccactctcttattccttctctttaatctacaccgtccatccaatttggacgcaccagatcttatcacacataccattcacttcattgaaaaattactatataacagaaaaaaaaaactcaattggtttgagtaactcttcttttaagctcctcaagcttactgtaaaaaaaaaagtatatttgaaatttctaaattttcaatataattatttattaatctgttttcatttcattagtaaacagtaaacacaacatttatatttgtgttgtcatattttcgtacttaatgaatcaaacaataagatcaatgctatttttatattttatgtaacaaagtaacttttatttttaccaactcttttgactgacacagattttagtaggtaaaaaaaaaatccaagtgggagatatttcaagtggataaagatttttattttttgcaaagaaaaaacgaaaagttccattttttttgccaataaatatcaaaaactggacttgttatctcgcagaacccttaaaccttatctcttcaccaccagcttctcaaagctttagcctcgagagcaaaattctctcaagctttagccatg

SEQ ID NO: 9636 - DNA, 3000 bp, Unknown
  misc_feature (1)..( 3000): cDNA_ID_3042802_gDNA_ID_1972164_Annot_ID_179687 3000 nt of promoter + ATG
agcattaggctcaatagtcaatactaccagaagatgccatcttctcgaaccaaatcatcaattctgtcccaaagcctcctctccggttcacgtctgtattcaggagacaatggatccgagagataaaccctagctctccattgctgaggtttaggtttggataatgaataaaattagcaaagagttacttattagagccggttaagctggagatgtctagtctgggatcgggtatttcccaaacccgaatttaaccgtttaataaccatcccggttcagattcataataagaatgggtcccattgatagccacgtgtcgctagcgaagacgtaagaagagattgaaaatggctaaggaacattgtccggcggagaatcgaagaagagaagaagaacacaacagtcagatactttttcttcttattttgtccgtaccgaaatcggaaaatggacattactgttcgaatctccggcttaaaatcctccaatctaatccggataacccctagattctcatcttcctctagattccgttgctccaacaacgaacctcctcgaaagggaaacgagtccaacggtgagagtctgatctcgaagcttatgttcgttggtagattataatcggttaaattcggttttatttggtttatagcaggtggtggtggtgataaagcgtcgacggactgggacaaggcgtggaagaatttcaagaagcagagcaagaagtcattgttctcgcaattcaacgtggacaagtacgtgacttggaatcctcccagatcggagtttgatttgtcggaagaagtcgatcctataaaaagaacagagagatccaatctcatgctctggacaagtccaaggttcacacttgttggagccatcgtcattgtctcattcctccttctctacaccattcttgctcctgtcaagtgataataatctcattcatctttcatttagatcagattctgaatctgttgtttctactgtttatatgcattactacttttgccaaataataagatcgcagtttctacagtcaagcaaataaaaacgcagtataatagagccctttttgtttttgtaataaccgagatagatcatgagccgaaatcaagattaatcccctgaagtttatagaaattcgtgtatttttttgccgttgaaaatgtttacagtagttaaaaatgaatgataaacggttttcgtagatggtagaactcaatctctagacttgatcctctacacactcaaacaaaccacttggttacacgttcttggttgagcggatttcaaatgtgaaacattttaactcattttttttggtgaacctgaccaaaagaatattgattgtacaagaaccaaagttaaaacttgttttggtcgttgttgaataagaaaaccgtgctctcagaagtctttatataggcaaacatataaattgtgaattttgttttctttattatcaattacaatttattttaaaatataaataaagatataataaagctatatattcacgaataattctaaaaaagtggtaacaaaaaatgacttgaaaacatttttctagtttcaatttcaagtcattctaagaagttaaaattaaggaatatcacatgcatgaagttacattgaaagtgtcttcttacaaaatagaaaaaaaataaaaaataaaaacatagtaaatgttgtgcattattctttcaataattagggaaaacaataatacagtatcttagatgtttataagaccagtatttattcatccaggcctaacaaaactgcccgccgcgatttctcatgtaagtatgtaaccttagttattaaacaaaattgcatttcttagacgttaaccaacttaattatttgtcttatagtcaacgtgatttttttactttataataatgcttcgatcgtaagttgaatctcaatcaatgtcttgattcccgagagagaagtagagcgttaaaattgccgtacagaacatgatggagacattaatgaattcaataaaatcggcgaagttggaggtttagctgagggaggcctgtgtcatgctgattcgtttagttaccaactcttctttcaaacatctttagtatgttactgctttcatcctctttatttgatctactgattatatatatatatattttttttttactacattcgacattcgttgctaagagaatagaaaacaattttctttttcaaaattatccttagtttgatattggtatgagagatttacatgtaatttcgactcttgaaaatagataaatgtatgttgagtattgttgactataagaaactagatgaatgcatcaaatagaagtgtctttttgctttatgtacttccccacttgaaaacatgacgattctatgaacgatttcattcgtcataacgatagaattagtttgtcctacgaaaacaaatgtaaaactactataattttcttgacgtaatattggtgggtttcatgctgcggctgttggttgggaaacgtccaatataaacatttctaattatgtatatacctgaaaatttgtaaaagctaatctaaattgtgaaacatacataacaaatactttaagaagaaaaagtcatcaagcaaacaagaagacatgacctagaaccatttccgagacattatattaatataaaattgatattcaaatcctccacgatcttacagctttcaactttgagtatttcaacgttttctctgattacacataaactaaaatttgtttttttgtttttttaatagttgatagcatgtgttaattattagtttatatcatacaatgaccttagaatccgcagatcatttcaagaactcagaacaaaagctgatgtattcacttacatcattgaattgtgtcagtttgagtaacccataatataaatatacgcaagtcaaaatgcattgagcttatctctcatttagactttaaatttctgatttcagagaggtcaactctttaagccaagcc

SEQ ID NO: 9637 - DNA, 3000 bp, Unknown
  misc_feature (1)..( 3000): cDNA_ID_3042799_gDNA_ID_1972164_Annot_ID_179689 3000 nt of promoter + ATG
tatattatctccggccaaacgggtcaatggcgatggcctccctctgttttacaatatccacaagtcagtggagcttcagagatgtcacagagacactgcgcgggtgtctgtcacacttgcagaacttctcatgagtgtggaagatgagggggatgaccagagtcgggctatggatattgcggttgcgtccaatttctggtcctcggttccgtcttctcgtgtgccttcttcttctccgtttgttctttccttcaaagacttgacttacagcgtgaagatcaagaagaagtttaagccctttccttgttgtgggaattcaccttttgatggtaatgatatggagatgaatactaaggtgctcctgaatggtatttctggtgaagcccgggaaggagagatgatggctgttcttggagcgagcgggtcagggaaatcaacgcttatcgatgcattagccaatcggatttcaaaagagagcctacgcggtgatattactttaaatggggaagttcttgaatctagcctgcataaagtcatatcagcttatgtgatgcaagatgatcttctcttcccgatgctcaccgtggaagagacgttgatgttttctgctgagttcaggcttccaagctcgctttctaagaagaaaaagaaggcacgggttcaagctctgattgatcagctcggcctgaggaacgcagcaaaaaccgtgatcggtgatgagggacacagaggtgtgtctggaggagaaaggagaagggtctcaattggaaccgatataatccatgacccgattattctctttctcgatgagccaacttctggtcttgactctaccagtgcatacatggttgtcaaagtgcttcagagaatcgcacaaagcggcagcatagttatcatgtccatccatcagccgagttacagaatcttgggattactcgataagttaatcttcctatctaggggaaacaccgtttacagcggctccccgacacacctccctcagttcttctcagaattcggtcacccaattcctgaaaacgagaacaagccggagtttgcactcgatcttatccgtgagctggaagattcgccagaaggaacgaaatccttagtcgagttccacaagcaatggcgagcaaagcaaacctcaagccagagcagaagaaacaccaatgtatctctcaaagatgcaatcagcgcaagtatctcgagaggtaagcttgtctccggagcaacaaacctaagatcatcatttcaaacctttgcaaacccattctggactgaaatgctcgtaattggtaaacgatctatactaaactcaagaagacaaccagagctattcggaatccgcctaggagctgtactagtcaccggaatgatcctagccacaatattctggaaactagacaattcaccaagaggtatacaagaacgcttagggttcttcgcattcgcaatgtccacaacattctacacatgtgcagaagcaataccagtctttctacaggaacgttacatattcatgagagaaacagcttacaacgcttaccggcgatcatcatacgtcctcgctcacacaataatctccatccctgctctcataatcttatccgccgcattcgccgcctcaacattctcggccgtaggactcgccggaggctccgagggattcctcttcttcttcttcacaatcctcaccgcgttttgggccggaagttccttcgtgacgttcttatccggcgtagtctcacacgtgatgatcggattcacggtggttgtagcaatcctcgcttatttcctcctcttctccggattcttcatctctagagatcgaatcccactctactggatctggttccattacctctccctagtgaaatacccttacgaaggtgttctacagaacgaattcgaagatccgacgaaatgcttcgtcagagggatccagatgttcgacaattcgccgctgggacaagttccaaccgccgtgaaaatcagcctcctgaagagcatgagcggcgttttggggatcaacgtgacggcggagacttgcgtaacgacgggaatcgatatactgaaacagcaaggaatcacggagataagcaaatggaattgcttgtggatcactgtagcttggggattcttctttagggttctcttctacttcacactcttgatcggaagcaagaacaagcgtcgctgatttacaaaacagaaaattattagagtaacttgaccaatgattatgatgtacttaatacttatgattaatacgaaattgcatatgtttgctaaatctttaatgggctttagagttgatataaggcccaataaaagtactaaattggaaagtgtgcaattttctattttctatatcggtaatatcgacgtttatctcgccgtgaaatctaaaccgttgattgaaacaaatcgctaccgttgaatctcgtcggtttccaagttataagataggggttgaagactaatcgcagtatcatccgcggttcacttccttcgtttcgaaattattagggttactgcgtatttgcactctccttcttcgtctctccaggtacgaggaagaatctttgtaattggatctgtttagggttacgattttattgttcttcgctctctagattagggatttcaattggtttctcgtttcctcgccgtagatttcctttataggtttccttctgtctaatctgattagagatttatattctcccctcacgaaattttcttcttttcgcctctgaatgtgttattcagtttggtttctttgtttttggatttgtgttctgctgaaaaatcatagatattcacatgggttctatgtttaggtctgaggtagtgttttaactctctggtctttttcttgtttatataatttgaagaggatactgttattctttttcttgtgattggcatatatatatatatatatacatatgtgcctaatagcttatgttaaaaatattttgcagcttgacaatg

SEQ ID NO: 9638 - DNA, 3000 bp, Unknown
  misc_feature (1)..( 3000): cDNA_ID_2184618_gDNA_ID_1972164_Annot_ID_179688 3000 nt of promoter + ATG
agatcgatgccacaacaaaaaccgtaaacctctgttttctctcttctcttctcttccattactcgaaatcaaaagcttaagtaacgaaacgttgaaaattgtacagaaattcgtgaagcaagtgcttgagacgatcgaattagatgagattaaagattcattggtgggagtcaccggagttagtggattatcgacggagcaaaggaagagattgacgattgcggtggagttggtggcgaatccgtcgattatatttatggatgagccaacgacggggctagacgcaagagcagctgccattgttatgagagctgtgaagaacgtcgctgatactggacgaaccatcgtctgtactattcatcagcctagtatcgacatttttgaagccttcgacgaggtaaattgcataattggctcaataaactgaattgttatattttgaccccaaactgttttatcttataaaccaagtccaaacttgaatttgcagctggtgcttcttaaaagaggtggtcgcatgatctacacaggaccattaggccaacattcacgtcacattatcgagtattttgaggtaaatttgcataaattttacttttagtctatgattgtttttacaaagatatgttaacttcttttatttattggattgaaaaacagagtgttcctgaaattcctaaaataaaagacaaccacaatccagcaacatggatgcttgatgttagttcacagtcggtagaaattgaacttggtgtcgatttcgcaaaaatctaccatgactctgctctttacaagtgagtaaaagcttttaaactatgcattaataactgttattgttctaagaatgtggttgtaatgaaaacatgtgtgattgttataggcgaaactcagagcttgtgaaacagttgagccagccagattcaggatcaagtgatatacagtttaagagaacctttgcacaaagctggtggggacaattcaaatctattctatggaaaatgaacttgtcttattggagaagcccttcttataacctaatgcgtatgatgcacactttagtctcttctttgatcttcggcgcacttttctggaaacaaggccaaaatctgtaagtggagagtgaacatacctcttatatgacactttagatcccagtttgctaacattttgagttgtgttttgtcatttgtagagatactcaacagagtatgttcacagtatttggagcgatctacggtttggtactcttcttagggataaacaattgtgcatcagctcttcaatatttcgaaacagagagaaatgttatgtaccgggaaagattcgcagggatgtactcagcgactgcttatgcattgggtcaagtggtgactgagataccttatatattcatacaagctgccgagtttgtgatcgtaacatatccaatgatcggtttctatccttcagcctacaaagtcttttggtcactctactctatgttttgctcactactcactttcaactaccttgcgatgttcctcgtctccatcacgccaaacttcatggttgccgcgattcttcaatcgctcttttatgttggtttcaaccttttttcggggtttttgatcccccaaacggtaagatcacccatcctttagtttcttgaacaagaatctttaccaagaagaaaatgttttgtaatgtattcttttggtttgtgaaaattgcagcaagtaccagggtggtggatttggttatattatctaacaccaacgtcttggacactcaacgggtttatctcgtcccaatacggcgatattcatgaagagatcaatgtctttggacaatccacgacggttgcaagattcttgaaagactattttggatttcatcatgaccttttggcggttaccgcggttgttcaaatcgcttttcccattgccttagcttctatgtttgcattcttcgtgggcaaactcaacttccaacgaagatgatcatgccaattagtcttcatcaatcatcattttagaataaaataataaaataatggtttttatttttgtttgtgaaaataaacatataacatataacttttctttttggtatgtatatgattttgaggaaagtaaacaaagcattgtctatgcaaaacaaataaccaaatcttgcaagtatcaaaactatattacttattacttgtcttgacaaagacgagtacttgtttttccaagtcgaatacaggataagtaacggatacgggacaaataccatgtatttatgcccacccatatcgacagacagtcagtaatcaaaatttaccttcaaatcaagaaaaatgggcaatagttaacttgagtgacaagtaacaaactaaaatgaataatcatgcataaattataaagataacattaaaccattttccattttatataatttgtacaaataacttttaagttatataaaggaattatttagaaatatgcttgggtaattgtgttctcttctaatttcttattatatatctctagaaactttttttctcaaaagagatttctaaactgatattacatattttttttttagtttttttttgttgttgtaaattttagacatctatttttagacatctatattaaacgattaaatatttcattatcattataaaatcataatgtatttatgtataaaaattcaaaatatactactttttgtttaaaattttaatattacttctgtttggcaaattaaataaaatctttcgaatagttgacatagtataaattagagaatataaataagaaaaccaaagcggtcaacacaagaggatcggtttgttcctttcttcctcctcgtatacgaatcaatacgcatttctccaactccatagccaaaagctcgacgagatccaacagcacctcctgatctgcatcgttttcaacttagcttctcctgtcaatcgaaatccctaattatacattgatcggattcaatcgagcgattcgagagagaatcgcg

SEQ ID NO: 9639 - DNA, 3000 bp, Unknown
  misc_feature (1)..( 3000): cDNA_ID_2184686_gDNA_ID_1972164_Annot_ID_179709 3000 nt of promoter + ATG
atggtagaagaaggaggagttagattgagagagaaggaatgatgagttagggttacagcttgagagatagaaaatggatagaatttgagacatgaagagaaagccatagttttcagtttccagagaagatgatgagagtgaagcaacaaaatgggtttaaggattacaattttttgctaaccgaccggttcgttcgtgaaccggacaattattaaaaattcgatttaggttttttagcagtaagccaaaaagtgagacgctttggaaaatggaaagtgattcaatgcaaaagagcaaaaagtagtaagtgattcataaaccctaattctgattgtggacgaaacctaattagaatcatttttgaaatggcgacacagtcagttaacgcagtgatcgttgatcttcccggagatgtaaacgacgacggcgataattccgattgtttcatcttctccactcctcctctctctgcacgtggttccacaaagcgtgatgctatttccgttgagaattacgatcgtgatcggaaacttcaacgtctctgggtctaccctcctcacaaaaccgtaatcaagtcagaatctccaatttacatagatcttgatctttacgatgatgaagacgatgatatcagaatcctctgtttcgcaccaccaatccacagagaaaagggtcagtcttcttcgtcaaagacggcgactttcgactgtgagatatgtgttgattcaaaatccataattgagtcgtttcgtatcggtggatgctctcacttctactgcaacgactgtgtttcgaaatatatagcagctaaattacaagacaacattctctcaatcgaatgtcctgtctctggttgttctggtcggctcgagccagatcagtgtcgtcagattttgcctaaagaggtttttgatcggtggggtgatgctttgtgtgaagcagtagtgatgcgttcgaagaaattctactgtccttacaaggattgctctgctttggttttcttagaagagagtgaagtaaagatgaaagattcggagtgtcctcattgtcatagaatggtgtgtgtggagtgtgggactcagtggcatccggagatgacttgcgaggagtttcagaagctagcggcgaacgagagaggaagagatgatattttgcttgcgacgatggcaaagcaaaagaaatggaaaagatgtccttcttgcaaattctatattgagaaatctcagggttgcttatacatgaagtgcaggtatatatatgtatcttcttcttcttaacaagagtgtttttaaaaaacattgtttttatatatctttttaaacacattttggcaggtgtgggttggctttttgctacaactgtggaactccatcgagggaccatactcattattgttataattgtaagcgttgatatttagcatcagcatttcttattatataggtctctaatctaaagctaagcttaagctttaaggatatggatttctatttggtcttgatgctttgtacctattttcgctatttaggtaaaaaggtaatatcaatcatatggacaataatttatcgtgttaacaatgtaagatcctagaaacaaaaattccttttcaacttctagcaccttaactctgttttaccgtatagaatgcaacctttgtcttatttctttacataggtcttgttcctctctttgaccatccaaacttcatggactatatcaggctttaaacttcttcttaggtctaatctcttttgtttcctcttgtaacatctcttaggattttctcgtttgagatcatcatacctaccatatccacataggattctacattctctgatacctctaattcttactatcatcaaaaatatgcattgaagaagggtgagaaagggttcattattaaataaaaacctttatacattaatctacatagatatgtacctttggtcttcatagctaataccagattccgttacatttgccaacgaatctacttaattccagccacagagagaacaattccagtcactctaaagtgactttgctactacgttgtctacatattctctgaaaacatgatattatctcaagttacattaaccaatatgaatggaaaaaatgactgttaatgataacttattattttaaacagagccgatccttttaaattttgaaggctaaaaaagccaataaaaaaaaacaaacagaaaaattaggacagttgttttgtaaatttaagatttttttaaaagaatgtgtgatgtagagagtcgaactcgtcacctcaatccaacgcaacacgttacactagaaacgaaaatttcagttctcccgctaaataaatttcccaccaataagatattttaaaaatctgtaatattatccatcaaaatctgttttattaatttaaaatagttggtcatcttctctctcatttaaaagttaaatgtggaccgctaaacaaagcattacttccttctggttcgttgccgcgttacacgttccctctattttctctcttttccctctcttatctcacttccggaaaccctaaccctaattcgtttcctcttctcttaccttgttcggatttctttcgaaatcgatttctctaatcgttttctgcaaatcttagatccacaaagttctcttcccaactttcgattctggtcgagcttagggtttccaccccgttttgttcttaccactatctctgtgaatatttcgactttaatcatctccatatgtaaattttagggttactagatcggtacatttctccatttcgatttcttctgagggaaaaaaataaaaatcctcaaacacaagagagtttcttctccgatttggattgggaccatcaaacgtgttttacggatcgggtttgcaatatcagtgtaccccaaaacttggaattcgaattgtttcttaagccttacaaatctcagagataatctcagtcacagtacaagtgctaatttcttgagaaattttacaatg

SEQ ID NO: 9640 - DNA, 3000 bp, Unknown
  misc_feature (1)..( 3000): cDNA_ID_2184672_gDNA_ID_1972164_Annot_ID_179704 3000 nt of promoter + ATG
caaactccattaaagagaaaatctttgctcgtttctcttaaggcccattgctttttatctgaagatgatttcaagagagtgccctgtttttttgtataaataaaattttgatcttttgctcgctttatacacatgtgggaacggttttgtcggtggagacatttatggattcgtgaactgctgcaaaaattatgcgtttcttggacgtttctgtaactttctctttattagattttgtatcttgtgtctctgtgtccaccattgcgttgtgtgtattcaattgatttccccaggtgttgaagattgttatttatatatttaacttattttatgcacagagatctttagtataattcatgaaaatatggttttatcttccatgatctaggggaactaaaacatttgtaaagtttgagcccatattttgtgtttgttgcttttcagagatgcatatattatggttgttgttctgtttatgaattgttatgtgcattgttttgcagcaatggcgccaccgattgaggtttctaccaaaagctacgttgagaaacatgtttcacttcctactcttaatgagaggatactttcgtccatgagtcacagatcagtagctgcacacccatggcatgatctcgagataggtaagctatacgtaaaggtttctttttcttttttttggctctaagatcatttcattgttttttagtaataactcttataccttttttgcttcgcattcctttgtttacaggacctgaagccccaattatcttcaattgtgtaagtgttttgctaaagctctaaggattgaaaatatttaattatattgtcacaaaactgccattatgcgtattcggagatgctgcagttgtttactatttctacagaatttacatatttgtagcattcactcaaagaaaattaaaacattcattggctatatatcttgaaacctgaattgagtctgctgtagcatatgaaatgatgttcatcgcctgattaggaaaccattttatgggtttaatctttgagatattgttgtgggaatcattaaccaagcatacggaggcattattacaggtggttgagataggaaaagggagcaaggtgaaatatgaactcgacaaaactacgggtctcattaaggtataaatttgattgcattaactttcttcgctgtccctttcattattagaggtacgattgtctaaactttacacatattctcaggtcgaccgtattctttactcatctgtcgtatacccacacaactatgggttcattccgcgtaccctttgtgaggacagtgaccctattgatgttcttgtcattatgcaggtaacatattttttcatacaattttgagaacctgcataattcattacataatgtttcttgttctattttgatttgtgcatctgataagctttgaagaagttcaagcgctcaactcttagctatagactctactttataactgtgtagcttaggaatgaatgtagcagatgagaaatgttgccagtcagttatcgagcagttagtggctgctaggcttataaaggtgtctcagcatattgtttagagtgtggattttctagtgtttactctggaatttaaaacctcttattaatcaatcaagtctataagcatcatcagcatctcagtctgtcttatttgactggtagaaaacacatctcatgtgaatcttgttgaatattttctacaggaaccggtgatcccaggatgctttcttcgggccaaagctattggtctgatgccaatgattgatcaggttagatattcaacgtacttgtcatattagtacttataaaagtaacagagattgaaactagaagctctttctgcttgaatagggtgagaaagacgacaagatcattgctgtctgcgctgacgatccagagtatcgccattacaacgacatcagtgagcttccgcctcatcgtatggctgagatccgccgtttctttgaagactgtgagtgttcttttcttacaaacttttggttggttaaggatgatatgaggctcatactcttgtaatcttgttgcagataagaaaaacgagaacaaggaagtagccgttaacgacttccttccggcaactgcagcctacgacgcagttcagcattccatgtaagtagccttcatgaaacttactgttatttacttcatatattatgaccttgtaaatagccgcaatttgtttatatcaaagaataactaactaatcaaattgggacaactcttttgtgtcatgtagggatctctatgcagactacgtcgtggagaacctaagacgttgaatcaccacctcaagcaatggaatgaaagctcacaactgcattattcacaaatataaatatacatataaatgtcaggcttctcaaaggatatatttgttgtgtatgtcctctgatgaatccggtagatgatgccgataattcttttttttttttgtcgtatgaaaccgataatcaaagactaaaacagggatttttctcatttgtggtcatcactttttaaattttggtgtcatttctcatcttaatcaatttgtttttgagttttattcttctattagatcttttatacatcaaagaatagatgaagattcctccctaaaaccttatagtatgtcatttattcacaatatgttatacgtgttaattttctctcttttagtatactctttttttttctttcagattccatcccaagttgcttaaattttgttaaaaccaactaaattccatagttcaatttacaaatctgtgatcagatgctatctaaatgaatattaccattttagcccttaccttttctgaaatttaccacgtttacctcaatgaaccgtcatcgcaaaaccaaaaaccctttcctatccctaaaacccgagagagcatcttcttctcctcttagggtagaagaaggacgaaaatcggaggaggaagaagaagatcgattcgatttgtgatcaacg

SEQ ID NO: 9641 - DNA, 3000 bp, Unknown
  misc_feature (1)..( 3000): cDNA_ID_3610085_gDNA_ID_1972164_Annot_ID_179698 3000 nt of promoter + ATG
caggccagtctaacttcgcacctcgtctgaagtatttctcagagcgccggctgcaagaaccgttttggttttgatataagaaatgacagttcaagttattttctgctggtatctgatgctgcaaataggatgatattattgttcttactcggctctgagcaccatatgaggtggtaaaggtcctaggaccctttccatcatggccaaatgttccaagttttcatgcgtttggaaaagcgcctctccctgcaaggtttaatccagagaaaacgttgatggagacatggtgagatgaatagggtggtgtaccggaagatatgcaaacataaagttactcaccgaacaaagttcaacaagtatgcaaccaatactccacagatcacatggatagttccatccaacccctgcaataaacgttccaaactcttaaataccatgactacacaaaaaaataatcatctacgtagatgtgtcagagtcataaacgtttacctaggataacttctggtgcgcggtaatgtcttgtggatacaatgtagttatggtcttgatgttcaaatgttgtacttccgaaatcaatgagcttgatggcacttgacttgggcagattcttgaagtatgacccatcttttgtgggtcgggatagaaactagattttcatgaccacacataggaaaagggtcaagagttatacaagttccttcatggatggatatcatattagccatgaaaataaatgagtccagcttggagatgattgattgctcaccttataatcaggtattttgatatattcagacgataccaaaagaatgttctccggcttcaaatccgtgtggatcagccgtaaatcatgcatatctgtcagaatggaatgagcaaagtctgagtacactagtcaacaaaagtctccagaaataactgtctgagcaatatggattccatggaaattgcattatcgaaagaacattaagtaataactattaacgcctaagtcttgtatcaaaaagttaagaaaaatgatttgtggcactaatggactactatatagaagaatgggtcaagaatattccacacacatgcaacagactccaaaagttgtctgccaagctcccgaacaagatcaatgggaaatgaacggtagctgtttttgcggagaaaatcatataagcttggtccaagcttctcaaatacctgttgaaaccatttaaacccatgcgcaagttcttttaactcacataacatttgggcgtgaagaaattgcattttcccctcaaacttgtcaaataaaggtaacagcacttacaatacaaatatgattacgatagtcaaaccaattccgtatttgcacacaactgcaaggaattgaaaagcttataccaaatgtaataaaattaaaactagcgaagaaatagtaagaggaaagaaatattcttaccgagaaccaccgacatcatgccttgtaagcctctgcagcacgtcaatttcgatcatggcagcttcacgatacttgtttatggaccgtataactttgattgccacgacttctttgtttttattatcaaagcattccaatacttgtccaaatgtacctgccaaaatacaatccaattgattaagataactggcgaccaaataaacatatttctcctacactttgaaaaacagaataatctaatcataatgattatataaacattttcgcaagagatgactaaccttcacccattttgctgagaatttgatctgcacgcacaatagaagaggcatgtcaatgtaaacctccatgataaagtctgtgaaacgtaacagataagatgtcgaaagactctgtaacataagactcacatcgtggagtcaaagtatccccaacaacaaagacataatggccgtctttatcatctggtctccagggaggagagccctgacgaggaaggccattatagaacatgtttgggtaaacaaaattgggaactaaaccactcgcaaactccggaccatagtacaacggaggttgaaatacctgaaagaaaaaaacacatcagctgaaacttagctcaagcacacaaataaaaatcttaatttcttactagttaacacaattcgcagtatcttatgaaaacaacaaaagaacagtccattgataccaatacaatatgtggacaattcgttaccgtgggtggaggaggaggaggaagaagaggcggagcagcatcccaagtcaatcggggacgtttcctgggacgcttatcaacgatccgatgagggaattcaacattcctctgagtttctaagatcatcgcgatcgagctagctttatcacgatacacactgctttgcataaaggattagaaaaatgcaaatccagagctgaaattcagaaacccagattatgaacagcgagagaattgcgattgaatttcgaatctaattagagggataataagattccgaaattcgaaaccctagttatcttcaatttgggggggatctatctccagaagataactaaaaaaggtgggaaaagtaacagaaaaatatattaaaaaaagtggaagtaatgtagctaataaactaaccgcaaatttctctcacacagagtaatttaaaacgttgaattagtcgctgtcgtaatttgatcgccggaattcagatcggagaaacaataaaaatgctcactgaattggaattgaagaaaaaaatctcaggagaaaatatttaacagcgaaagagactgaaatgagagagagagagagaacctgaggaagagaacagcgaaggagcgacagaggctctggaagttcttaatgggcttttttagtcaggcctttattaaatatatgttgactaaagaaacgacatgatgttattactgttgaggataaaaacgacgtggagttcagttatttaatatcagaacaatggggtgttttctccaaagtcttttaatatggaggagacgggagagtcgttgaacaagaaaaataatctgaagcagcc

SEQ ID NO: 9642 - DNA, 3000 bp, Unknown
  misc_feature (1)..( 3000): cDNA_ID_2990072_gDNA_ID_1972164_Annot_ID_179697 3000 nt of promoter + ATG
ctatattccgaggaaaagaagatttaaattatgaacatagatgcagcaacaaatcaaaaggtttggatactctgaaaacaataaaagtacataaacaaaatccatgaaacacaatctagcaggacaggtaagagcttcacacgtttgaattagaacacacagaccccaaaagaacaacaacagagagaggagaagtcatcgactgtgaaggcccattagagcagcgctgatccatagaaaacagcttctgcaggacccgtcatgtagatatggttgtcttcctgtttccactctatctccaatggtccgcccggtagatccaccgtgcatttctgttccaccataaaccaatacatatatgaggaactcaaggtcaccacatgcagctaatctcagctcatgacaatctttaagctccaatgaatatccaagaaacatttgtgtgagagtgaagaaccaaaaaaaacgaatacaagattctcccacaagagacgaagcgaacgaaaagtacttagtaaaatcataatctcatcaatcgtctaccaatcaaatcatccaaccattcaatgcaacattcaggtttcataaaaaatgcttaaaaactgctaatccagtgtaccattttgcaaactgttatctagttttttaagttctgaaattccaaacttaccctgtcggctcgaccttcaaggactgctgcaacaaccagagcacaagctccagttccacaggccaaagttgctcctgcagttttaagtatgcgtaagcattaagcatataaggatacagagactgtttataatcaactgagaattatattcgaagattggggggaatttgcggacctgctccgcgctcccacacacgcattttcaaatgagaacgtgataagacctcaacaaattctgcggatacacagaaagaactgtaagacaactaaagggatataaatccaaatataagcgagaagtcttgctgtatcagtcaatggaaatctggatacatctgccgatgaatctccactaacctgtgttagttcgagctgggaacatttcatgatgctcgaactttggaccaatctctggtaagttcaaatcatcaactttcagattctggttgacacaaaccaaaattacaaatgataagaaattcacgtgtagacaaataatatgattagaagtctagtaacgaaacacgcaccggtccaccctttttaccaaatgtgatacagtgaggattgcccatactaacacacgtcacattccagcttactccatcaacaactagctctgcctcaacaacagcttcacctttgttccctgacaatttcgtgggcacatcttgtgctttaagaatcggtgtccccatgtcaaccttaacctgtaccaatatcaatcacaaaaaataaaaatccaaactttaccttacccatcatcatgaatacgactaaacctaatatgagacatcaatccaaatgatctacctgtccgtcatcttgaatttctggaacaatcaacccggcaccggtatgtattgtaaaactacaaaaacaaataaatagacacttaaggttacatcaagcttgactaaactcggaactctcaagtctaaacagatatttctcaatacagatagagatacctatgttttccctgcaaattctcaagctcagcaatgaacctagcaaagcatcgaactccattgccacacatctacaagaacaaaatcaaaagccaatgacttcgagcgcaacaacatatcaccagacattatcatcgaaaagccccacctctggttcactaccatctgaattgaaaatccgcattgcgtaatcagtaccattgactcctggcattgcaaaaatcactccatcggcaccaacaccgaagtttcgatcacacagcttcgccgcctgttcttgagtaatcttaggttccgatgagtctctgttatcgacctacaaaatccaattccaaagacgaaaaatttgaaaacatttgtaagaattcgatacatttcgggttaaattaccaaattgagaattcaacggtgaacaaaagtaccaaaatgaagtcattgccgaggccatggtatttcacaaagtgaagaactccggtttcttttttgtctagaaaactcgccggagaaaatttctcagctgtgacggcgtccatggaagctgctgcagacacacgaaggctagggctcttaaagcaatattctttctcaaagaaaccaaacgaaagagaagatacggatcctagattcctggagaacgcattcgacactctgcgcgattgtggcgcgacggagacagtgctaacggcggctatctccatggctgcttcagattatttttcttgttcaacgactctcccgtctcctccatattaaaagactttggagaaaacaccccattgttctgatattaaataactgaactccacgtcgtttttatcctcaacagtaataacatcatgtcgtttctttagtcaacatatatttaataaaggcctgactaaaaaagcccattaagaacttccagagcctctgtcgctccttcgctgttctcttcctcaggttctctctctctctctcatttcagtctctttcgctgttaaatattttctcctgagatttttttcttcaattccaattcagtgagcatttttattgtttctccgatctgaattccggcgatcaaattacgacagcgactaattcaacgttttaaattactctgtgtgagagaaatttgcggttagtttattagctacattacttccactttttttaatatatttttctgttacttttcccaccttttttagttatcttctggagatagatcccccccaaattgaagataactagggtttcgaatttcggaatcttattatccctctaattagattcgaaattcaatcgcaattctctcgctgttcataatctgggtttctgaatttcagctctggatttgcatttttctaatcctttatg

SEQ ID NO: 9643 - DNA, 3000 bp, Unknown
  misc_feature (1)..( 3000): cDNA_ID_2184640_gDNA_ID_1972164_Annot_ID_179693 3000 nt of promoter + ATG
ggatgcatgcatcctaatccttgaactattatcataacaagatgaaataaatcgcatttgattattttttgtcagttactcaatattttattataacatcttacaaattatattacgactctttacggtagatagatatactatattatgtaattatatagaatatgatactacagcaaatgactgaaacttatagcatattgataaaatataaattttataaattctatctaatttttttttaaccacagttcaggaaattattttttgcttacaaattttttttcagatataatatttttactacttttgggtagaactttcatatatctctctatgattttaaccactgatatttggatgttatgaataagttttttttgtcatatactaaccacacttaaaagagctagagtatatgatcaataagattttaaatttgttcatatacgagtaacaacacttaagtagtgtccaatataaataaaagatcatttttgtgaattgatatatcacaatttcacatatattgctaatttagcctcatgccttgaagtcctgtgtgaagatttttgcataagatacacacaacaaaatctaacaagattgtgagtgtttgtaaatagtagattatgttcgaccagttatttcatggagaaggagacgtttgacatatcaacaagacaacaagccaaagacaaaatctgtgaacatggacaaaacaaaaaataataatattctttatatacatatattaaattaatttacggtggtataaatatttacgtaaatactatggaattttaggtcaatctcattgtttctctttttattatttttcttaaaacaattacggtaagagttttagggttatagatctattttcttacatctacataggccataatgaatcaaacgcataaccgtttcatgagcatcgactacataggtcaaggaatctgctttaccttttttttatttgtcttttgttactgtttttttcgtattttttctacgcctgataacttttcccaattaaatactacaacttgcatgtttatttatttagctttaatatggttattaattggtactttattgacttacgagtagtcacgaagacgaatcttagcttgtccatgcagctgtacttaactctaaacattggtttttgtcaacaacgtttttcggttttacaaattgttcattcatataataatcaaatgttagctaaagctgctaatcgaagaaaatagtatttgtgctatacacgcatgtccgaataatactttttctttcgtttaataaaccgaaataataccaattcttcaatatataatcctttcctgtagatgtagttttggaaacgttccaaatttagtccagtggtactttataatacaaaagttggaaaaacgtttaggttttgtgacctcggtggtctagctattacaaaaaaaaaccaagaaattgaatttatttcgaaccatcatattcagttttgtttcactgattgtaaaaagaacaacaatcataaaagtaatgatatgtgtgtaggcgtctaggtgatctatcatctatggatgcatcaacgtctaaaaaacctccataaatcaaggaagacatgaaaaattgaaagttaaagatttatttgcttttatattttgttcttttctattcgattttttttttccttttgattttttttttttgtttgtcttgcggcgaataaattttgaaactacactctacacacatttgtgcatatatgatctttatcttatgttcttctctaggagataaataaagagactatatagtcaattcatgatagttagtaaatgcaattaatgcgtgcatatagtatgtgattaattagcaaaacattatgcattaaaattataatctaaccgtaaatttaatacgaagtaacttcaagtaagttagcggtttgtgtttggaaaaatgtttcatagtcgtcattaaacctgttttttttgagcaatgtgtcagattaattatcttgaaagcgaaggctgtaagaatttctgtcattttctacttatagtcatatttggtgagctcacgaactaaccctttattagggacttgaaaggttctactatttgtcactgttagtatacatttcgaattttttatgagcataaatttttgtttttctgttttttcgagtaattagcatagatttaagaggataaaggaccatatagttgaatagatttcaagtcttgcttaacctaatcttctctaggaagagacttgtagacaagagacttcagtcagaggttaatataaaatatagatgacttagaaacattcttaaatctgagataagggtaaaatatttttaaaattttattttaactcactttttagaggaaacaaaaaacaggaatagaaaacttaagccataattctattaagttaagattatatgtcggtttgtatttataaaagaatggttagtgttagattttataattaattcaatttaagaggtttcaatgaattatttttatttatttagataatattaattattttagttagattagatagtaaaatttaattggctaattaaaagaaaaacttaaggttattaatttttttgttaatgtgttcttaatttattttgttttttgtttttaatatttagtttctatttaagtgttgtataacatgacataataattaatttaaactaaaaaaggtgaatacaaatgttcactcctagattgaacctaaaaattgtcccgaaagaaaatatcgtttgctatatagatagaagaagaacataatacagaaaacttggttatttattctaaacttggttataaatcttgataaataattccaactttgttgaagtttgtttttacggtaccaatttgttggttattgattgtatactgtagtactatttctttattttttagaaaagaaatccgacggtacgacaaaagaagaagaaggaaaatg

SEQ ID NO: 9644 - DNA, 3000 bp, Unknown
  misc_feature (1)..( 3000): cDNA_ID_2724591_gDNA_ID_1972164_Annot_ID_179691 3000 nt of promoter + ATG
attctctgaagcactttgacaaccatgtatgcactggtagagtcaagaccagaagttggctcatcgagaaagagaataatcgggtcatggattatatcggttccaattgagacccttctcctttctcctccagacacacctctgtgtccctcatcaccgatcacggtttttgctgcgttcctcaggccgagctgatcaatcagagcttgaacccgtgccttctttttcttcttagaaagcgagcttggaagcctgaactcagcagaaaacatcaacgtctcttccacggtgagcatcgggaagagaagatcatcttgcatcacataagctgatatgactttatgcaggctagattcaagaacttccccatttaaagtaatatcaccgcgtaggctctcttttgaaatccgattggctaatgcatcgataagcgttgatttccctgacccgctcgctccaagaacagccatcatctctccttcccgggcttcaccagaaataccattcaggagcaccttagtattcatctccatatcattaccatcaaaaggtgaattcccacaacaaggaaagggcttaaacttcttcttgatcttcacgctgtaagtcaagtctttgaaggaaagaacaaacggagaagaagaaggcacacgagaagacggaaccgaggaccagaaattggacgcaaccgcaatatccatagcccgactctggtcatccccctcatcttccacactcatgagaagttctgcaagtgtgacagacacccgcgcagtgtctctgtgacatctctgaagctccactgacttgtggatattgtaaaacagagggaggccatcgccattgacccgtttggccggagataatataccgaacaaaccagacatcacgtgaattattgtctggttaatgttttggcctcaggtaatgtgtctaaaggtcttacccacagaacaattttgatcgactttataggatatttggatgggagaatgagggagaaacttgtcaattagtttggtgatctctaagtatctaactttgagttgttctgggttttgtagcttttcatatttacatgtacatagcttttgtttatattttcgtatgtatataaattgtaagttacgagtaggtgaggagttgggcaaatccatccacatttttccgttattgtatgtattttttcttggggcttaaggtactctgtaaaaaaatcctattttaggtggtttttgtttacaaagtggaaaagtttactccatggaattacgtgtttatttcatctgtatataatgtatccggagtttatggaattgcaataagtatagcttatgtaacatgtcaggaatagaatttctccttgcacatgtatgtatgtcacgaatttcttaatctccttttgtttattatagtcacgacccgcgagttttctataatcacttacaagctctaagacttgttttttggtgcgtgagacaataattgactaggggttaattggatttccaactattttgaatcagtgaatatcttcgtacagtaactaaagcacgctacgaatatactgtttgttgtatcaaaatcaaatcatccaacattttgaacatttatttagcggttactaattaacttttgcaattagttaatatcaaacacataagatattctcataattaggatttggcatggtactatactaagattgtacaaaggcatgccattatgcataatgaagctaatggcgtgttatctttcaattgtttgtttaatcatgcacaccattttcgtcatataaaaaagcgtaagtgaagcctatttcatttcaaaaaaaaaaaaaaaaaattataaggatcattgatttgtacttttgtagttggtgaaacaaaaaggaaatgaatgtgaaaattatggcagaaaaacgtgcagatgttcggctttgatgttgtagagctacacacgaaaacacaacaaaaattgtcattaggaatatgtaatggaaactttatataacgtgatgagttagatttaggcatatggaagtttggtgtagctgttatatctgttttcttgattattttacttttgataacccatttttacaagagttgtcaagaaataatagaaaactatatacttagtatcatcagcttgtctctatcaagttgaactaatgatttatccaatgaaatacataacatttcttatggaatgtacactttcacacagagaatgagtttatattattctggttaagtttagtaagactttctttatgtaaagattgttttgaaattttgtgtttggtagaggatattttgctaagtttcccaacataattttgttaacactttgagatttatcaggtaggactagatcaaggaattgaatccctcaggtttgagatttcgttcaatgctaatatttgttaaatcgtacgagaaatttttactctcgtctgttgagtaacagcatgagagagttttcattcaaaaaaaaaaaaaatagcataagagcatatctctaggcataacattttgtgggctattaaggggccaaacttgggcatccaattgttaaaagcccatattttgtaagcctcgaggagttttttttgtttgtttccacatttgcctaaagttttgtatatgttcattgaataatatacaaatcaaacgcaaatcacattaatgatcccctcaagaatatatatataaaaaattgcatatattattaaacaattagtgaaattacttaattagattatctgataatcacatatagattttagaagcgaaacatatatatttgctctataactaaaacaaaataaaaataaaaaagagagcgaaggattgcatcaagtaatcgccgtgtaactaactacttttgcattcaccatcgctcttacgtttgaatctatccagatccaaagctcttcttcttcccggcaattctgagatctcattttcaccggcgacgagctttaatcggagaacg

SEQ ID NO: 9645 - DNA, 3000 bp, Unknown
  misc_feature (1)..( 3000): cDNA_ID_2184612_gDNA_ID_1972164_Annot_ID_179686 3000 nt of promoter + ATG
agtaacacatgagttagatatttgatatttacagtaagaagtaccaatcgaataaattattatgcaaagaagagaagtgatgatacttactgctccattcaaggaattgatcgccttctgaacctcttgggaagagctaagtgtcacaaatccaaaacccttggatctaccgctgtccctgtcgtagataaccctagcttcaactacctttccttgctcgttaaacaagttctcaagtgccatgtcatcaacaccccaagaaaggttgcccacgtagagacggtttcctgaacctgagcccgaaccggaccctgaccccgaaccataactggaacgttgagaccctccgtaaccaccaccactacgttgagaaccgtatccaccaccacgctcggaaccataaccaccaccacgctcggaaccataaccaccaccacgctcggaaccgtaacctccaccacgctcagaaccgtaacctccacttcttggtcctctggagaaggattcctctcttttaggtggaggagggccagcattgactctcaaaggtctgccttcaaattcctgaaatgttaaaaatcaacaggattaatgaaaacagccagtgtagtaatgtaagaaatccaaaagacaagcttgaaggtatgaacaacaagacaatgtgacaaaaacaaatgtacaaatctaaatcggctacttatatcccaaatgagaaacacgaacaacctagaagaagatgcatcttatcagcagaatataaaacaacatcaaccacgaagtctccacaaaccaaacagaagataaacaacactatttctctatctcaaacgttcatacaatccaattcatggaattccacattacacacaagccaagaacaagaaacaatacaagcaactcaataaacaaacaagtccacacaaaactcttatcaacaagtaaagacacagtagcgaacacaagtatctgcttacatagccattgaactgttgagctgctgcttcaacttccgctgcggttgacattgtcacaaatccgaaacccctgctccggccagtcactttgtcatagataacctacaatatcaaactcatttcatcacaaatgaaaacaatctcaaacctttagctatgttctcactttaactctactcaaaacgattcaaacccaattaagaaagataattaatccaaatctgaaaacagaaacctaaatttatcttacctcaaccatctcaacatttccagcgctctcaaagagctgagcaagctgagcgctatcaacgttaaaagaaaggttaccaacaaagagcttaaggtcaggagagaaggagttacgctccacaggcgctgaatcgtcaccgtcagcgaacatatcatcttcctccacctcaaaatccgaagatacagcaacgtttctaacgaaacgcgacgggtactcggcgggggatgagcatttgagggcggaggaagcgaagatagagacgaggtggtcggagtgaagtttgaaggagagggaaggaggtaagacggagacggaagcgggtctggagacgcagagaggaagggatttaggattgaaagcagagagggaagaagcagaggcagacatggctaaagcttgagagaattttgctctcgaggctaaagctttgagaagctggtggtgaagagataaggtttaagggttctgcgagataacaagtccagtttttgatatttattggcaaaaaaaatggaacttttcgttttttctttgcaaaaaataaaaatctttatccacttgaaatatctcccacttggattttttttttacctactaaaatctgtgtcagtcaaaagagttggtaaaaataaaagttactttgttacataaaatataaaaatagcattgatcttattgtttgattcattaagtacgaaaatatgacaacacaaatataaatgttgtgtttactgtttactaatgaaatgaaaacagattaataaataattatattgaaaatttagaaatttcaaatatacttttttttttacagtaagcttgaggagcttaaaagaagagttactcaaaccaattgagttttttttttctgttatatagtaatttttcaatgaagtgaatggtatgtgtgataagatctggtgcgtccaaattggatggacggtgtagattaaagagaaggaataagagagtgggtctagtgagaagataaggccattactaaaagccaaaggaaaaaatgcaactagagagactgtacactgaggctccagtatggatcttcaactcgttcttaactattaagtaaccactgataccataattttgaggtttatgtaatattgatacagtttcacttgttttccagattttttttgtttgtttgtttttttcctttttgttggaaatgaaaatcaaaggtaaaaataataggcaacaaaaatgaatttatagtcatgagtaagccttgcacaaattttcaattaagattccaaatatagtgtgttccggcttaagttaaggaagagtatgtaactgactaactgttgtagcattaggctcaatagtcaatactaccagaagatgccatcttctcgaaccaaatcatcaattctgtcccaaagcctcctctccggttcacgtctgtattcaggagacaatggatccgagagataaaccctagctctccattgctgaggtttaggtttggataatgaataaaattagcaaagagttacttattagagccggttaagctggagatgtctagtctgggatcgggtatttcccaaacccgaatttaaccgtttaataaccatcccggttcagattcataataagaatgggtcccattgatagccacgtgtcgctagcgaagacgtaagaagagattgaaaatggctaaggaacattgtccggcggagaatcgaagaagagaagaagaacacaacagtcagatactttttcttcttattttgtccgtaccgaaatcggaaa

SEQ ID NO: 9646 - DNA, 3000 bp, Unknown
  misc_feature (1)..( 3000): cDNA_ID_2184601_gDNA_ID_1972164_Annot_ID_179683 3000 nt of promoter + ATG
gggcccttgttagtactacagctgcagttgatatggtcgtcatttggctcgttcattaacatcaaattaaatatgatttgttgggaatcaaaaatttctaaccaaaaaacaattaaaataaagttatctgtctgatagaattagaaagcgaggagccttttcatcactgctcttctgcttcatctgtattcggcgcacacacatccataaatgcatctatcaaatggatatataacttatttaatcacatataatatacataaaattgaattatattaggagttttttaccttttattgtttcaattttaatttactcttaaaaataacatacacatgttaaatttgttaacaaacctgaatttaggtccgtttaacagtatcgtgaatataaataacttttaaccgaataatataattctcttgcatctaaagagaattattgttataagatcaaaagcaaacgaggtttacttttggttatccattgttggtatatatataaccacaagtcataaccatttgagatctttgaaaaatgaatgttgaatatatcaagaatgaactaattagtatgtggttttattagcatcatagtcgaatataataatattataaaataggtttgaaagttagaaacccaagaggaatgtggagtggagtaaaaaaacaaaacaaaagagttaaatgcgcatgcaagcatgcagatacaaatacacattggtttcaagaagtaattatttgtttataatctctaaattaacccaaaatatatacttaaatctgatagggcagcttgcactgagttcttgggattgcaattttctagtttaatttcacacacacttattatatatttgtccaattaagtatgagagtatggggtgactgtctaatgtccatatggaagaaagtaatttcgtagcatacggtatacggagtaaaaacagctagctgcagttccatactaatacagtaccataagataatttaataacttaatagcatgtggagtctacaatttcataatcaaattttcctatgtaatagaatgcttgtgtcttgtggagtgaattcgtctcataacgaggtgcatcagtatgcaaatatatcaaattattcatcaaagtccaaagggaaaaaaatggcctccttcctcgccaatttacatgtactaacgatgaaaaaaataaatcatgaaaccctaaatttgcttattcttttccttttatatattgaacatgacttgtgtacttgttttcacgtgctcatggaaaacgatgtcaatatggcttcatgtttctatctcatcatttgaacgaacttgctactagctaaagataattcaaattcattgcttccaagccaagcaaaatcaaccttttacatacattgactacattgaagtaccctcatttgttgtcacattggatccttatagtctatcattgtgttggattattcgtaatagatgtaatcatattcttttacgttaacaacaactatgtatgaataaatttttactaaaacaaacggccatgagtaagatatccattatccaaatgcacagggatatgggtaaagcgagagcttttaatatctctacaaaaacattattataaaagcaccaaacaaaaagtaaagtaagtggagtaaatattcaaaataaatgattttggtatatgcttagaacaagataggaggagggttgtcttcatagggagtgtaaatgatactagtacattgataataaaagccataactactcatcttgtgttccttatttcaatcatcaatggcacattgctccataacccagacatcatcatttataagtataaatttttatatgaatatggtacatgtctgtgtatctcatcactaatttgatcacactttcatttaaatattacagaatagagagaggtaaaagtaaattatgtttggacccatcttatatgttcagatatatgttgacaatgaaatgtttttatttgcattgtcgaaaatgaaatttttgttctgttcttcaaaaagggaatcaaaaagcgaggtagctttatatctaaatcaatttctttaatctaaagatgttttctttgtcacttcccattatctttcgcacgacatatattaaaatcattatgaaacattttttagggatatttcattttcaatatgtaatcttctttaaaatattatgattattaatgtatatggttatatccaataaatttagtaaaaagaaaaggagtttgattcaatatcatcaatctctaattttcgtcaagttggagttgtaaaaatcttgaaattcataatatagaaatttcgtcaatattatgattatttaggttatttatctatgtcaagaaagcttgaatctttcttgttctgagattgcttacactaatttcccataaactctcaattaaacatccataccattttgaattttatttttaggttccaaagtctttggagttagtaagtagaaaatagaaagttatagaaatacattcataagtgtatagttcaatatagaaaaataaacgaaaatgtggaagcacaaagaagacaaatagaggaaaacacaaagaagtggtccacgcgtgccaacatgaagtgtatgtgcgggtggctgcgacgcgcatgcttcaatctctcacgtgtgaaaaatcccaaaaatgaaatttttttccaagagcatgacgagaaaacgcactctctaactatatattaatacaacaatccccaactctcgaaagcattttagtaggcaaagaaaagtttcgagctttttcttttggtttaacttcttcttcttctttgacacttgtacgttttgtacctgtcgtttatgttctttaaggaagcaaaacccaattgagagatttcattaccaaaaatacaaaggaccaaagcttcttgttttgttttgttttttttcgggtaaaaagtttagattttttcatagcttgagctctcatcgtaaccaatg

SEQ ID NO: 9647 - DNA, 3000 bp, Unknown
  misc_feature (1)..( 3000): cDNA_ID_3042814_gDNA_ID_1972164_Annot_ID_179677 3000 nt of promoter + ATG
tacaagattcagtccgatactgatgccggtggcgtagattgcggcggagttggaatcctcggtatcgcttgggcctttggtggtatgatcttcatcctcgtctactgcaccgccggtatctctggtatgatccttctttaatcttgattttggtttggtttagattaagattatacactttttgagtattagaattacaattaaaccgaataagctgaataagttttacttatgtaagtacaacttgcaaactcaaaatttagacaagtaaaaattatatggtatggttttggtttgtttattcgaaattaattattttgcaaggaaaaatattgcttggttgacattactatttaatcggtttaaaatcttaggtttaaaagacgaaaatgatttgtttataaaacatttaataagggtcatgatcaaatcggttcttatccgaatgatatatatctaatctaagcctagtaattattttaagcaactgactaaccctgtcttaaccagaattgaaaccggttaattaattgcttgttgtaccttaattctcaagtactggtaacattgtcaactctttttgtttccttaggtggtcacattaacccagcggtgacatttgggctattcttggcacgtaaagtgtcgttacctagggccctattgtacataatcgctcagtgtttgggtgcgatttgtggagttggttttgtcaaagccttccaaagctcttactacacccgttacggaggtggagccaactctctagccgatggctacagcacagggaccggtctagccgcagagatcattggtactttcgttcttgtctacaccgtcttctctgccactgaccccaaacgtagtgccagagactcccacgttccggtgagtcacatatgtagtgctattaatcttcaatatggttaaccgactcaaaaccggaaccaaagcaaaccaaaccaacatttgatttcaatcatactaataaatttgaattttgatgaaataaaaggtgttggcgccacttccaatcggatttgccgtgttcatggtacatttggctaccattcccattaccggaaccggaattaacccggcaaggagtttcggagctgccgtaatctacaacaagagcaagccatgggatgaccacgtaagacctcaacgtttctccattacattcaactatatttttcatttttacaagggaataatgttttgaaattttggtgattacaaacagtggatattttgggttggaccattcattggagctgcgatagctgcattctaccaccaattcgttctgagagcttcaggttctaagtctcttggatcattcagaagtgctgccaacgtctaaacacatcaaaccagatttctcaagaataaatgaagttgtgatctctctgtacaaatctaaatcagtcacttgcagttttcatttccctttcttatatttgtgttttccacttgctcttttgtgaattttccttcggtgtaattgttttttctttcgcttttaaacgagtgattggaattataatcaatgaaatcaaagaggttcttatgcgttgtgtttacattaatactagtactaaagttagtttccttagagaataacaacaccatggggccatgttcttggtcttgtttacgtcctcctcaagatgctcagtgaataagcaggattttggagaaacacatgtctctgctttaacgcaatcattatctttctagaaaagaccattcctttatgtcttcatacatctcaggcggataaagcctagcgtgcaccagcagtaagttttagttactctctgaaaccgccattgtccattaaccccatatgcctcaaaggctcacagaaactgttacattcaagattcaacatacttagtcgtttgttacttgacaattatgaatcatataggaaatgctcgaacttggctgaggattgagagtcttacccttcagaatctgcattttttatgagaacgtgaagaggtgtggccgctcaaaattggcctcttggtggcctagcctcagcctctgagactgcctaccatccaaatcctttaattacgaaagtaaaacatgtgttagatgtttgatcatttactgtaagaagtactaatcgaataaattgttatgcgaagaagagaaatgatgatactactgcaccattcaaagaattgatggagttttgaacctctcgggaagagctgagtgtcacaaacccagtagatcagatttgatatcgagaaagtttctaaagggacctcatacagtagtaagaaaatgacgaatgtagtgatacaataggctgggatgcttacgaacgatttatgttgtttactctggagatgcttggcggacaattcaaagatttggcaaacaacatcgcataatgtacaagaaaaggcatattcaccccatctaatacacgtctcccgaagcttcctctgttcattaaccgtagacgagaccttcctgaacccgttgcatctgtgtgggaaacaaaaagaagaaggagaaaaacttgttgtgctggtaaattatttcacctgtgagtgagaggacaaaacacaccttctcgtaagtcttctggccagagccaccgtgctggaaattttggaggaaatggacatgcctgaaaagttgtgtctcccctccgacgtttgtcccacattacaaacgtttgatcaggtaaatccgaccttgtttattatcgaacctgtaacacaagagagaagctttagagaaagatggagctatcagcggagagaggagatcaacagaatcttcgagcgcaagtaatcgttttgagttgaaataaatatagggtaaaactggtattttatatgggccgatacgtgtggccctgtatcttagcccacaaagttagttgacctgcttttctgatcatcttcctcccactctctttcatctttttgtaatcgatttgcaatttcaatttcgcaaagttggatcatg

SEQ ID NO: 9648 - DNA, 3000 bp, Unknown
  misc_feature (1)..( 3000): cDNA_ID_2184569_gDNA_ID_1972164_Annot_ID_179672 3000 nt of promoter + ATG
ctgactgttgctgacggaaactctagctcccaaccgtaacattgtcgccatttcagttaaccttttttaatccaaacgagttcttcctagcaaaagaaggttcagcgagaaagacatgtcactaaacgaagcatccaactaaccaaacaaagaattctttatcttcgtcgagaatgaaggcaatataatccattatatcaaacttcttcaaaacagatacaactgaatattcttgtgcaaactcatatgtagatgaacaagttggatatcaggacgggcctgtttcaaggggagacaaaaaaaagtaatcaaataccttgtatatatatacatcattcaaattatattaaaactcaggatcaagccagttaatttcacagcataaatgctttagcaacaaagtggttagtttcacagacattttatcgagcaggtggtgtgcacaatgtaaaacaaagaaaaacagaaacctttgacgtaagattttgattatttttccgacaatgtctgagtaaatgagaatggtggaatctggctccaatttcaatgattcaaattgagggacaaggacgaagaaagaaccgcgttatggttttagactttttagtggtgtggtgaaatttacgtcgagttttgaacgatacatatggatacgagttacggtttcaagtatggttcaaccgacgcgaattagatcgaaccgaaaatttgatcgaaaaatgaaatcgttgtccgccagaaccggataaaaccggaaattgggaggcggatgaaattagtttttgactttttgtacataaccaacccatcatcagtcgatcactcactctcggtcactgaaaattaaaaaaagaaacaacactagctaatttcaaaatgttttatgatcaatggtttataataatttctaacatttttgcataatcatcatcgcatggtggtgtttaattatttaattactagccagacagtgtagtgaatttattgttgaaatactttctttttattcgtcaaaagaaaaatttgattagtagttcagaagtcactagttaatactctaataatctagtactagtgaatataatgtttttacaaaccattaatgtaatcaagctaatcgatcgttagcataaatttcaacgatattttctcccaatttttgttttccgcccaaatatatagttaaagttgtgtggaaataatatgttaagtaaattagcaagcgtgtatgataaatgaagatagtgatgattgattttgcattgtttcttttaggagatgtgtatgtcgtatttatcatgcatcggttttctatgaggtggtgtgaaagtgaaacgttacatgcttcaatatatagcactttcaaatgtatgtagattgaacacggaaggttaatgtgtttttgtgaaaaattgtgacaattttatgaaaattttccatttataaagtatatagatatgctaggttagtgtcctttgtgtgtgagtgacttatggttgcgtgaccgttcgttgttcataagtagcaatatgaggccaaacaatagcacgtgactcgggcgcgtctacaaggcgcgtagttaaaaaaacgccccctccacgttcttctactttcggtccattctatcaattaatttcaaaatagcccctgatatttattgatctatttcattaccaaccccacaagtttttttgattatccaaaattttaattttaatttttcggaataaccaaaaggaatccaacgtaaaaggattataaaaataactaagtactgaaaattgaggtggaaacagcacaatcattacttcaggggttacttttgataaatattgcagtttagttgaaaataaatgtttcttcagtgggaaaaaacgactcgcgagtccagtgagaaaaaaagaataacaatccgacgagaaagaggaaagatcaaatcatctaagtgctggtgccttgattctgcagttctccattttaatccaacaaaaaaagaagctgaatcgacggtataggtgaatacttcttcacgactttttcaaacactcagaaacttctcttcctttcacattgatttattcctaattttagtgcgattttttccttttttttctcagaagtttatcaatcttgttaggtagatatttactactagtttgttttttctactaatttgctgaagaaagtgttaatctttggttggtttaaggtataaatttgcttacatctactcaaatcagctaacttttattttggtttggtagcttaaagattcagtcaaaaaaaactttaatctttgttttcctgcaaaaagcaaaagtgtttctgtaataaaacacctttttgcagagaatgttaaaagattctctagttttaggctttatgtaaaaacgatttttttgctgggtgttctgtttttggatctgtgtttcttttttgggaagatccacccaatgaaaccaaatctcacattacaaaatgacaagaaattgtctcttcttcccaataattccaaaactttgatttagtaaaaaataaaataaaataactgggtgacttaacaaccagaaagattatgtgtaagatattggtgctttctttgcttgtaatagggtttatctttggtgatttgatgaatcacattgacggcaacttcttttctaattacacttctaaatattttatatatttggaattgttccaaatcattacaatattcatttgttgtctctttgctttcgtttggtggtaataggagtctctttgaagctaaatgtgtaaatattattcttatgtttttttcgtacacttgcttaagctttctttcttccctgagtttggttgtctatatgcttatgataagttttttttttccctctgttgcttctttctcacactttccattggtcttcatgtactatttgtcagattcttcaaagaagcaatcataacgcaattgattatatccccaaaagaaaaggtttttaaactccaaaaatg

SEQ ID NO: 9649 - DNA, 3000 bp, Unknown
  misc_feature (1)..( 3000): cDNA_ID_3042826_gDNA_ID_1972164_Annot_ID_179666 3000 nt of promoter + ATG
ttacaagacatcctagagtgatgaagaaacttcaagaagaaattcgagcaacactcggaccaaacaaagagagaatcacagaagaagatctagagaaagttgagtacttgaatctggtgatcaaagaatcattcagactacatccaccagctcctctcttgctcccaagagaaacaatgtccgacatcgagattcaaggctaccacattcccaagaacgcccatgtaaagatcaacacttatgcgataggacgtgatcctaaacgttggactaaccctgaagaattcaatcctgagaggtttttgaatacctcaatcaactacaagggtcagcattacgagctcttgccctttggagccggtcgtaggaactgtccaggtatgaccttgggaatcaccattcttgagctaggtcttcttaacattctctactacttcgattggagtttacccagtggaatgaccattaaagacattgacatggaagaagacggcgctttgaacatcgccaagaaagtccctctgcagctcgtaccaactcttccataatcactcgtgaataatagtattaaataagatgatcaagatttgtatgtttgcctctatcatactacatttggtttttctttcctttttttcgtgttgccatattaatatatatccatgttttataatgtttcttatcttcaataaaaaaaaagtcatattattaagatttcaaagttctttcaaattttcattgaagtggtctttatcaaggaaaacggcagcgttttgtatagtcactactatgattgtgacctaggcactatgatccgattgatgaaatctccaagtaagtaagtactagtagtataatcctgacctgtcatcgtctactagagactggatcatacagttcttcatagactctgctttagcactgtttgcatcaaaagcaaaccacttctttttttttccacaagcaaaccacttcacaaggaagaaataaacttaataatttttcactccccccaaactttcattattggtataaaaagattattttgtttgttttttcgtgatgatacacagaagggccagacccaaacaataggtgaatactgaaaaataaagaaacttgaaaaagcccaaactccatgaagggggaaaccaggcccaatacgagcaaaacagaggcaaaacaatccgatgtccaagatcgtcgaatccgggcccatatccggaaatccccacaacagttgaccaaataaccaagtcaccttgaagaagcgccggagttatcaacaagttcgttcatgaattcatacctgagttcacagttttctgatattggaaggtaaaattaaagtcattaaaccaaatgattcatgttttttatttctttttttgttaaatgaatgagttccacaaaaaatgtttagatttttagattaccaaattagttatggttacacgaatcagttccacaaaaatatgtttagatttgtaaacaaccacattatgttgcagcttggttagagagaccactaaatctaatcttatgtttttttggggcttctctccattaaacaccttaactaaatcaatcctctgcaaaagcaaaccatttactacaaaagcctaaccacatgcattgcgcgcctatatatcgtctccggtctctcgagaacaaaacgctcttcactccaaatacaaagaaaaaaacaaaaccaagctaaggcaaaataaaagacaagaataatgtctatcttcctcctatgtatcctcttccttttccctctctttcagatcatttttaaaaagcttttaccttcgaaaagtaagcttcctccgggacctacaggtcttccgatcataggaaacttgcaccagcttggaagatcgcttcacagtgtttttcacaagctctctttataatatggaccagtgatgcttctccgttttggagttgtccctgtggtcgtgttctcttccaaggaagcagctaaagaagttctcaaaactcatgacttagatacttgcacccgacctaagctagtcgcgaatgggttgttttctcgcaacttcaaagacattggtttcactcagtacggtgaagactggcgagagatgaaaaagctggtggggcttgagctctttagtccgaaaaagcataagtctttcaggtatatcagagaggaagaaggtgacttgctggtcaagaaaatatcaaattccgctcaaacacagaccctaatagatttgagaaaagcctctttctccttcaccgccggtacaatcttcagactagcctttggacagaacttccaccagtgcgatttcatggatatggacagacttgaagagctggtgctagaggcggaaaccaacggatgcatcttggcactcacagacttcttacccacgggtcttggttggcttgtagaccggatatctggtcggcattcgaggatgaataaagccttttcaaaactcaccaatttatttcaacatgtgatccatgagcaattaaagattggacaactccaagatcattccaacctcgttagtgccatgttggatatgatcattaggccctctaaattcagttctttcaatatcacttccaaccatctcatagcaatgatgtcggtaagtgctaaatagtaacttaattattaataccaatctttaaaattttatgttacgaagctaatgttatagcttggagagcaagttaactcgtgataggcaaacatttcctttttatggtccattcttctttgttattctgtctgaaaatcaaaatcctaaactattacgtatgttataattattcaatcaggatgtggttttggcgggagtgaatgcgggaacaatcacaatggtatggatagtgacagaactaattagacatcctagggttatgagaaaactccaagaagagattcgagcaacacttggatccaacaaagagagaatcacataagaagatctacaaaaagtcgagtacttgaat

SEQ ID NO: 9650 - DNA, 3000 bp, Unknown
  misc_feature (1)..( 3000): cDNA_ID_3042822_gDNA_ID_1972164_Annot_ID_179668 3000 nt of promoter + ATG
tctaattaggattgtctgctaccctttgctattgttatctgtctgatagggtgacactaaaggatcaggaaaaggcggggaatcgagtgcaaagagagatggtcaaccaagccaagtgtctcaggtaatgactcggtcttctccagttgatatggtcgtttacctaagcattagcttctccagctaatttattgtttccctgtctttactttctgaacagttctcgcaggttcctcaacaaggctcattctcacagggtccttatggaaactctcaagtaagtgttttccgacaaaagaaatgttgatacttataaatgaattcattctctacatagagcagagccggggtataaagagagaatattattaacaattaaaggatttaaggactttaatagactcgataaaaccgtcatatatgcattatccactttttgaaatctagacataggttctcatatgttccagtctctgaggttcggcaatagcatcgagcatcttgaagtgttaatggtatttgtaatctatcaatatgcagataattgattaaactcgtttgtgaatgtagggttcgaatatgatggttcaaatgccgggcacagagtagtactaggacactattcatcacaatcttccgagactcgactatgcctgttgtgtctgagaatctgagtgatccactttccatagatatggattgtggtatctcagtttttgggagagagaagatttgtatatgattgtgttgtagggagaagagtttggtttgcttatgataagaattgaaaagcaccttttttttcttttgactgttatgtttcttaggttttggtcttaagcagaagctatttatcaccacttcattggcctgttgattctttcatgcaagtgagcccgtaacttttataaaacaacatcatgatttataattatctctttgattttttggtcctaaattcgagtttcatttgacatcatccattgataaaaagaaacgaaacttgatattgaatcgttgtggtgtggtaaaattcacgatctaagtttgtgataacactccgtttatctgttggtgtatattgataaggctttctgttactgctcagaatctaacacatgggacatgtgaatgtcatatggaacatgttcatgtttatgggcctaatcttgatcaaacaaaaataaaaactttgaaatttaagaaaaactgaataacagaatctaaatgaaacaatagtaagaataaaaagaccaaaaactctttaaaagagcaaaaccaaaacctaaaactcttgaactaaactcaatgcttagtgatgaggtctgaaagggtaactaccatctgttgacggtaggtgacaacttcttcttgggaacattcgggaaagtaacagcttcggttgatggttgcaccgtgactcgaagcttaatcccagcctgacaaagaccggtctttaagcttacaaaataatgcactcctggtttagtgagcttaatgagatcgtgtcccgttttgtacacagctacagtagaagtcgattcgcaagatctgaactcaagttcatcggtgatttccctaacgtcgttgagttccttgttgtattggaaaaagagagtatcttcaacatgaaactgtttaccctcactccacttgtaatagtagtaactgtaataaacgctccatcctccgtagtcaccaactctgtagatcttaccaaaaggaaggatcttgctcggtggtggtggtgaaggagtaatgcgacgtgagggttcatgggtcttgctcggtggtggtggtggtggaggagtattcggacgtgacggttcatgggtcttgcttggtggtggtggtgaaggagtaatgggtcgtgaccgttcatgggtcttgcttggtggtggtggtgaaggagtaatggctaatgggtcgtgaccgttcatgggtcttgcttcgtggtggtggagggatcggacgtgacttttcatggacgacaaaaacgtctagttccagtccattgacgcattgaatatgatttgagctgatgaagtagtgaattcctggttccttgagggttacgacatcatgtcctgtattgtaaacggctttaggagaagaggagttgcatgactcgtactttaaagcatcggagagttgagtgacgtcgttaacgttctgatggtattggaagatcaaagaatccccgacgtggaattccttacgctcagcccaagagttcgtcttcccactccaccctctagaacctccaactttgtagattttcgccgagcagcaactcaagagaatcgtgatcgcgagcacaaagccaaagatcttctttgtgatcatgttttgatcgtataagaagaagaaaaaaaagaaagatgatgagatctctaaactcgttggatcaggaaaagtatttggagtagagtttatgaatgtgtttgtgaaaaataagtcacgtatttgctctgtttatatagagattaaccatcccaaatcataatccttgtcttcttaggatttcgtttaatttatcctctttttctttatatacaaataaaattcaaaacttttttcctaatgtaatgaaaaatcttatcttgttttattttatacaattacaaaatcttagaattctctattagttagttcatcgtatttcggtcgacggctatatgtttggatattgggttttacgcattaaggcccatatgaggtcaagtttgcttttttttttatgggctttattaggcttcaacgagattagtttttaaaagtaagaaacaaaaataaaaatggaacaaatccaacggtcgagagtcgatcaaagacattacacgattcattagtgaacaaccgcgctcactaactcaaaaacccttgatttctcaaagagtgggaacaaatcgaatctaatcttcaattcaaaattttatcttcttcctcagtctttgggatctttgagcaaactcaacatttcgatctctctgttcaatg

SEQ ID NO: 9651 - DNA, 3000 bp, Unknown
  misc_feature (1)..( 3000): cDNA_ID_3083090_gDNA_ID_1972165_Annot_ID_179728 3000 nt of promoter + ATG
cttgttcaacaatgaaactcattggtgcacactcatacaacagcctaagttttccatttttgctctttgcgtcacgagggtacccgtaaatcccaccatacaataaagtcctgtgaaaatctccaaccaaacttccaatgtaccttgcggagtaaggcttcccagttggaccagggtccttaagatcatcaatgtacttctttagtttatcgtcccacatctggtaattcccttcgttgaaagagtagattctcccggctttggggatctcaatgttttcttgcgtgaggacaaactcaccgtacattggatcgagcgtgaaggagaaaacgcctttgcctagagtaagaacgaagatgaccgagctcgagtacatacagtagccggctgctaacaagttgttccctggctggcacacgtttactatacacctttgttcttctgacccaagctgcaacaacattataagccaaaaggtcacctaatttacattgtaggatctctatctcctaaagatatatggaagtggaaggaagagtagtatacagctgagatatcgtcggagtcgtcgacaatgcattcgtcattggggctatagataccgaagatagaaccagtagagacggcagcgtcaatgttggaggaaccatcaagagggtcaaacacgacgacgtagttgccggagtaactctcctccaccgcaactggcacgtcctcttcctccgaggctatgattcccgttcttccacttgatctcaaacagttggaaaacacctgcactcaccaccactcaatctttattatacatccacccattcccatgaatcaactatgtggtctacactaatttatcacaaattcaaccaacaaaagcagagcatgtgtaaaaagaatgagacctcattagagatgacgtcaagcttcttctgatcctctccctgaatattaacggcgccttgaactccggtcaggttagagattccggcacgttgaacaagtgaagcgatctgcttacaagccaatgatatactcgacatcactatcgtcagctctgcatctatctctcctttcatctcttgtctcagcaaccagcccgtcaacgtttgaagttcgtatccactcttcttcctcgccgccgttttcgtctcagcagcatccgccgctacggccatacacctcactccactcgcatactgatggttcctcactccagttggtgctcgtttcccgttgttggagaagagagatctcggtgaaaggattgaaggctgggatgatgatgccacgtgacgtgagcttgagagaagaaggtgagacgacgtcgttgttgcggcggttgctgccattttttctgtgttgttttgaaaaaaactttggaaggtttggttttggaggagggagagaggatcggatattcggattgtgaggtggacgaaggattcgattcatgtgggttccacttatcttgtgttatgacacgtggctttgctcttacggacctaaacaaaaagataagcattaagccattaagcataggccagttttgttttgttaatggcaggtcaaagataataaagagttgggcctgatgtaaatttttgttttaagcaaacccaaaggaaattggccatataaagtataaaccaaactaaaccgaagaaattgaccagcttcctacaagtaggtgttggataagtttcttgctctagaattaaaaacaagtacattgtagaattgatgaatgcaatcctagaaaaaagtcaaagaatgttggcttttgatcgatgaaatgcatgtactacaccactaggaaatttattattctggctgatgtgctctgcatcaaaacattagttattcgtttacgttagaagttagataaccagctagtggcagatgttaatctgactttttttatttattactgatttataattagacttgtcagatataatgtatttaggatgaatttcttgagtttccaagttactagttcaaccgaaactataccaatttgtataattttgaagtacaacaagtcatagagctcgtgtgtaaaaacaataatagtaacgcgttgagacaaatacggacgtgaagacatgtattgtaagcacgtcgctttgtttccaagtaacaccctcacccgaaaagtctaataatataatgaaaaagataatccaactaaatcttttacaatatatctaaaacttttgattacgtttgaccaaacattaaaagattaattaagtagtatcatgtagacgatttcaaagaatctgagcaaaagtctcctgtgaccaaaatactaataagctctgaatagtaaaaaaaagtaaataaaaaaaagtttgaaaatacataatgactcatgttaatatcatttaaagtattttaatctggattaaaaagctctagttcattgaatcgttgattaaccatagcagcaactcgacaatatataaatcatctttcgtatgcaaatttttgtcaacctttgaacacactagaattaggtttattttattaacaaaatgagaattttttggaatcccacgtccaagttgatgacttttttgtgatttccacaaaatatgcatataaatatcaattagattacaaagacattaaaatagaaaaattacagaacacaagaatttttttttgcaattactatacaaaatgtaatctttactgttgacaaaagaaaatacaattcttactattatagtaacaccatagatagagaatgtcataaagcaaaaaaattaaatagtaaatacaaatcattcttttttcaaatatttttaacaaatcattcttgtatatatgtacacacacaccccacaacatcccttcaacatatacgcgtcctatttccacgttctctctatattacatttttccttgaaaacatctcgaggttcaaaatctttaacccctacaaatcaagaaaaggagacagaggagaagagagaaaagaaaaacgcagaaacaatg

SEQ ID NO: 9652 - DNA, 3000 bp, Unknown
  misc_feature (1)..( 3000): cDNA_ID_1380437_gDNA_ID_1972165_Annot_ID_179741 3000 nt of promoter + ATG
aaaaattccggtatgactacaacatcttaggcaatcattcaatacgttaaaatatacttaattttttacactaaaataacaactagtgtttttttttggttaaggaaatatcaactattattacttaggttttggtacaatttgtctttgaacaggaagaaaaattcgaatctgatcaagtactgtctaacaaaggtcgtctcttgcttgaaacggaggttgggagaaaccagaaaagaccacaaccatccgatgaaggagacagacaaagtaagaaacaaaatacaagtgaagatgacgcatgcaaagataaaccatcgtcagtttttagtactcattacaggttttaaccaaaaatagatattaaaccatttgagaaagcaataactcttatttggatatcagttcattattccgtattaaagccgttggtttttgtacaactgagtaataaagttcatgttgagtatgtcaattattggatttgggagttccaaagaaaattttgaagactttatgtaaaatggaaacatctggtggcgaaaagaaatgaaaattggagtttccattcaccatacacaaaacaaaaaaaaaaaaaaaaaaaaaaaaagcctagatgtaacctttctttagcggtcataatataatgttttcgtggatgtgaattcttgacgcccaaaaataaggaatttttaattcatttatctaaccttttgataaaataaaataaaactacacgcttatttcaggtttgatctgttgtgagattagttacaactttttaaaaagttaatggcaaacaaagttgtcgtcgatagtgatgatacctagattaccttttagcttttctttctagagagttatcttcccaaacagctctcaagtatacgttttagctagcttagagaattgatcttaatttcagaaagaaaaaaaaaaaagaatgctttgaattgaagcacaaattggtttttcttaattggatttgaagaatcaatggattagactagaatcaaaaggtcaactactatgattcccgtgaaataataatcaaatatgagtgatccaaatttctatataattgcacatcattgatttgtggatctatcaagtgttatcttttacttatattttcagttagatctgacaacaattttcgtacttattctattaaagttggacctcgcaacaacctttcatatcaacgttgaagttttatagttaattattagttcttgattttaaaatgtgtcaaatgatataatgattagttcaaagttcaaaccactgatcaaagattacttactcacgttgcacaaaatccaccttgaaacatcatagtctcgatgtcacatcccaacaactagttaatgttttaacaaaaaaaacaaaaactagttagtgtacttcaaaagtatatattggtataactgattagacgaatatgtaagaaaagttgactacaagagtatggaagccgtggtaagacttccaatgaaataaaagcaatcaaagcacactgttttttacctattttatttatttatttattttgtttgcaactaaacgtcatcaatttaaaaattgttaaatacatcaaatatgttttctttataaatatcaaatttggtcagatatattttctttttcaaatttagcttcataaacatcaaattttacttttggttttgtctctttagtttgttgggcttttggagtaaagagttcaagtccaacaactaagtcgataaacagccaaatcctcgtagataaacaggatccagctacatatgtcgattcacatgcatcttttaatattcgtcctcggtgaatctttagatcaacggttactttattactaattgtcattagcacctcttattttagcataaccaaatcaaacacctttaattatctttctaatatcactaccctagtttatattttaagatccactgagaccttaaagctgaaacaatgtttttaatcgagggagtgattagagatttaatcaaatggatttagactgaaccaccaaattgaatattgaatctagtgatgtttttggctttattttcacatatccaaaatcaaacatcaaccaaaaccaaatttaataaacctaactatttttttttttcaaaatcgacaatctgatatttagagtatgaacacaagtttcaaataaaaaaagaaagagtatgaactcaattttataagaaaactccaaatcatcttattgaccaaagtgtttgtattcacacttgtatctttcttgttttgagtaggagttctttcttgttatctttctggtaatgtcaattccgtaatatcggataaaaaacaaaaagagtccactaaagttttggtggatgattaacacgtccttcgatattgatctatttacactttggagtcaaaacaagataatatcaaaatctgatagcacaataggccttgcggctctaactgaaatatacaaaaactcaaagggttaaactgcaaacatgagaagaaaagtgagcaacgctcctttctatttccttggatataaaagctgtacgggaccagagctctgcaagtcttttttataagctcatgctcattattactccgacaagtgccgtgtaattcctcgccctcggctactcttttctcttcttgcctctcgtctccgccgctgattcagctgccgccgacaaaggtttctcccttttttctaagtcttttatgagttttcctttcgttacaagttacaaccataacctcatctggtcacacataaactataatttcagagcatgaaaatttcgtacttgcttgcttcatctgcatatttcgatctaagcatctactagtcaatttctttcacgtatatttttaagggttttctcataaccttatacctgaagtatggatctctaaattggggatctttaggtatgtgtttggtacatctttcttgaaaaagctaaactatttttctttattaggaatatg

SEQ ID NO: 9653 - DNA, 3000 bp, Unknown
  misc_feature (1)..( 3000): cDNA_ID_2184752_gDNA_ID_1972165_Annot_ID_179746 3000 nt of promoter + ATG
ggtcatgacaaaactataatgtatggatggtttaatttgtatatttggagagcttgaagccacacttatagaagaaatataaatcaaagtagagaaagaagtgttttaaatgcgatttgagctgccaactaattccttacaatctgcctaaattatgtgacagtaattaagaatctgatttgattctttatctgactttttcttctactttaaaaaggttgaagaaaatatctacctgtatatgacacattgactaacacgttttactaattttgttgaatcaattatgattatctcaaaaagattttaagacgaaaaagaacaaaatcaaatctctgttcattaaagtaaataaaacatacatagagattaaatacaaaccaattcaaataccaaaaaacaaaacaagaacaaagtgtggtagaatctacagatctgattataacttagtcgaatacttacagtgttgactcgtaacattacgatccgaaacagagatactgagatcacacgaagaagacgattggactttaatcttaaagattttaagaacggttactttaccagtgactttaacaaaagtattaagcggaatgacgccagccatgacgtcagataaaagctgcgtttcagagagtaaccgatccgccattagcgtcaacgttatattcaacggcaccgttttccgcgccgcgattcggttagccggaagaggagcttcaccgatcacttggcctctgtaattcaacaacgccgacgacgaatcgtagctaaacccgatgcggttagggtttttgagagagagatcgacgttgagcgttaggtttaggaggactttgagaaggagaggattgacggaagcttggagacgatcaacggtgacggaatcgattgtagtagttgggcgttttggtttgaagagagtgaaagctaagatgacgataactatggcgattaggagaatgagaaggatagtgaaacagatacagattttgcagttgcgtttccgccgcagttttttagcggttccggtgttagcagattgcgtttccatggaagaagcgtttggtttgggtggtggtaacatggctgttgctggcttctcctcttcctttttatcatcgggtttgattgaaaaatcactcatagttattactctctttgttacgctttgtggttctctcgctgttgagtttctcaggggttttggtttatcctataaaggaggagaccactatttgtacgcggattcgttaccagtttttaattacatgactcaaacacatttcattttaataatttgttattttacattttaatatttcttgattttccacgagtatattttttaaaaaaatagttaattgatgaaaattacattttcataaattgggaagaatttgatgagatactagttttttttttttttttggtgtatgtctgtaaatggaatctcaatttaattttgtaacacacttctaaattcataaaataagtatttagaaaaataaaataaaaacggataaaagtataaaacatacataatgttcgtcgaacgtcgtaaagacagctctttataaaaatggttgttagttgaattttattaaaatcggtattgattgagttgagatttgaccatttttaataatgtttcgaagacgtgcattaattaattcagctggacgtggaagaagggagatgataaaaataataaagtgaggttagcggtagaaatcaaatacttcacatggcttttgtaaagagaccatgcttgatgcatcatccgtcgcttttgcctaatttcgtgtggttattacgtaacatattcaatgactaattcaccgtctttttctgggcccatttcttcatttacacgggacgacttctggattttggcccgtttaatctgtctctcttattaaattcatcatgcatttgaatgcccatttgttttattgactttttgctgttgagtttctgacatttttttaatcccacgatagaagttattagaatcacatcattgaaaagtaagtttccaataatttacgatacttttacctaaacatttactctattttttagtttttttaaaaaaaattattagaaaattttgaaagtcaactatagtatttttaccaaaacgcattgaacaatagcatatgaattagaacatattcaaattctcaaatagattgttttagtgatttagtccaatgtattagaacaaaatttaatgatgtttcatttctaaaccttttatcttacaaattggataaccaatcaatgacttttacttataaaataatatggctggtaaacaaaataacaaataaacataaatatccaattccaaaataataagtcgatgccggattttgacaaccaaaataacggtgtaagattgttatagtgtttgtaaacatgattgatggtcgtatatgaaagcaatacttcgtataattaaaaaaacttacatgtgtgactatgtgatgacgttttttcgtgtagttgactcatgaattttttaaaaatactaatagtaaaacaaaataattaaatattttcgaagaattctatcaagcaaactaatcaattgtcacaaggtttattgggctgggccatccatcacagcccataaaagttaatttctttcaaccccttaaacgctgcgttttaaaaatattcaatattaattttatctttctacgatctacgatgcttcggattggttcggctggttcgtgctcgaaattgagattttgaaagaaaaaaagagctctgaatcattgaaatcagcttaattccaatctgaatctgcaaaaaagtcttacgtcacactcccatgtagtagccgtcacttctcgtcttcctcctagagattacccaactctctcgcttcttctttttcctcttagggtttcttcatcctttagggtttccacaaaaattcaaaacctacttggaaatatttgggcttgaagaaggaagaattagatg

SEQ ID NO: 9654 - DNA, 3000 bp, Unknown
  misc_feature (1)..( 3000): cDNA_ID_2184760_gDNA_ID_1972165_Annot_ID_179749 3000 nt of promoter + ATG
gaaagcatttttaccaattgaagctcacaaaacaaaatgatctcatatctgcatcaacaactgtttttcaatattacagagcaaaagtgaaacaattgagcaaaataaaagagatattgaccttagacaagctcaatgtaagccattggagcattatcacctctccttggaagagttctgatgatcctcgtgtatccaccgtttctctcaccgtatctatcaggaacctcagcaaacagagcgtgaacaatctgtttctcgtagatatatcccaaggcttgtcttcgcttgtgcaacgaaccgtctttagccaatgtaatcatcttgtcaacgaacttcctcatcgcactagctctagctcgagtcgtcttgattctcccatgcttaagaagctgagtcgtgagtcctcgcagaagagctttgcgctggtccggtggtctgttcagcttcggaacacgtcgtccgtgtctcatcgcgtagatacgaccaccaccgtcaacaattttgaatccattctcaaagctttgccaatctgcgttcgaaattcgaaaaccctaacgactttggagattcaaattgagccaaatctctatgaaaagtggaaatttacctggaagtccgattgagaggagaggattgaccggagagagaccggagaaagatgggagtgaaggagaagagattgggagacgaagagtaaccggacggcgagaagacgaggaaggtaatcggagtgatgcggtggagggaagagctgatttgagagaagacatactccagactctgctcacggaatctgtaggagtcgccattgccatggacattggaatcgccattagattgtgatcctctgcaacaaagcggattttgctggtgttgaatggataagggatagaggaagaggactttgtttatcagaaaccttttgatgggccttaatgggcctataaactgtaactctgtagcgctttgccaacaagagactttttaaggtttttgttgccaaacagatatttgcatttgggctatgtaatgttagaattattttataatgtatgctattgctagatattgtttaagtgcatttgtgatttacaaacatttcatttttattttggttttaatgagcatttctattatagagactttgatgttaataaatggtgttctaagatatattaaaatattttatatactttcttaaaattggataaattttgggaaaatccttaatatcagttaaattgaagataaagagtattaaaaaaaactatgtagtaaaatacatttcacattttttgtgtataatagtacatggtattcgttaagatcactcaaaaattaacaaattaagtctaaaagggcagaaaagactattcaaatatggacttggagaaagacattcagctttttacgctgagaaactttcatattgagccgtgtgtttgtgttgtgaagagaagtaataaaaaataatttgaagtgaaaaaggagaagaaaaaataagatcgtagaaagcgtggatggtttcttcttgggttcactgccatgcgattattaaattggccatggggctagtgtttgacgtacaaaagtctaaaaattgtcagtcaaacaggtccaaaactttgtaagaaaaataatataataatagcaaattttctaaaaattgttaaaaaaagaacaaaagggaaaagatgaggatgcagatgaaagcaaaatgtcaaacactagtttcagattttatcgggaactggggtttgacagttggtgtatgtatgtaatggcctctcatcaaaacatgtgcatctttttccttttttgttatttactgttttagctctacgtcttgtccaattcctctcaagtaaaatgcctttaatatgatactaatatacaaggggactaatgctttttcccttttcttatccttgttttgtctaaatctttacttggattcctttatttttctcctctctttagattagtacggtttaaggaataccatctttctaattttagcacaaaattgcaagttggtgccccatcttagtaagcacatcgtaccacactttgattgtgtgagagacttcttcatcccatctctcataccaaacctaaatcaaatgactagtggtgcaacctgctgactccatatgaccataactaataaatcggtttatgaatccaactcatgtagctctatagaatagaaacccattcatttcacataatgaactgaatctgacattttatttacatcatttactactcaattttgtaattagcaagatcatctttttcattattcaacaattttgatattccataatttattaactttgtcatacatcataatattctgaaattttgttatatattgtaccggttccacgaaatagagctctattattatagaccaaacaaacaaaatattatcttcttgtggttagttcgagagagaggtcaagaagaaacgaaatggatcggcaaacggaagacgtcaaacacacaacgacgaacattttccgatcacccacctaatctcttcccatttttattatttttcaaaactcaaattaattaagaagaaaaaaacagaaacagagagagaaagagttaagatgaatagagatagaaagagtcattaaatgtacgaagcgacattcacaataattcgaaaggtggaagacgacttagatacggccaggcttcactgtcctcctcgtcctcctcaattacccctaacccctttttccgggattcatctccaacccacatccttccaaattctcaccccctcactgagtttttgctttttctcctcatcggagatcgtgaagacgatcaagtaatttaagaatcccaccattgataaaagagtctagcttttctactaccaaacctttttctgtttggaaattttcgattttggatttaacccttttcttaccttatttataaccatgcaatctcacgaccaacaacccttcaatctcc

SEQ ID NO: 9655 - DNA, 3000 bp, Unknown
  misc_feature (1)..( 3000): cDNA_ID_1023634_gDNA_ID_1972165_Annot_ID_179748 3000 nt of promoter + ATG
atctcttccttcctctctcttaaagcctccgccgtatttgtttggacggcgggaacagtggccgtcactgtctctggttgcggtggtgcatcggtagaagaattttctctttcttgctgctgaatcggaggaggaggaggcttatgctgttgttgttgttgttggtgctgctgttgctgttgtggaggagaaggattgttggagatctgatagagaggttcgaaagtttgaggagaagggtcagaggaagaggaaggatcaaggagcatgagagatcggagcctgtattcaagaagagcaccgagatttgggttacaagggaagataatgtctctaacgttttggataagttgaggaatagagactgaagttgaggaatggataaggtctctgataatggcgtcaacccatacagtaggtgaagcagaagaagatgaagagtcttgatccattggttgtacggacatcataacattccgaccaccacggtctgaaggaaaaacgggaagaccagagaagccacaaacagagagtggtgggtttggttgagaagatacagtagccgccgccgtaagagacggtggttgttgtggtgtgacagtattgtagttggagtcaagaaggtgagagacacggcgaggaggacgagaggagttgttgtagtcagggttagaagacatctcggaagctaatctttttctcaccatcactaaaggaggaggaggaggaggaggaggaccacggttgttgctgctgctactaccggaagaagttgttctcagaggactatgaggaggaggttgaccaccgttgaaatcgccggattccgccatggagattgaagggttgttggtcgtgagattgcatggttataaataaggtaagaaaagggttaaatccaaaatcgaaaatttccaaacagaaaaaggtttggtagtagaaaagctagactcttttatcaatggtgggattcttaaattacttgatcgtcttcacgatctccgatgaggagaaaaagcaaaaactcagtgagggggtgagaatttggaaggatgtgggttggagatgaatcccggaaaaaggggttaggggtaattgaggaggacgaggaggacagtgaagcctggccgtatctaagtcgtcttccacctttcgaattattgtgaatgtcgcttcgtacatttaatgactctttctatctctattcatcttaactctttctctctctgtttctgtttttttcttcttaattaatttgagttttgaaaaataataaaaatgggaagagattaggtgggtgatcggaaaatgttcgtcgttgtgtgtttgacgtcttccgtttgccgatccatttcgtttcttcttgacctctctctcgaactaaccacaagaagataatattttgtttgtttggtctataataatagagctctatttcgtggaaccggtacaatatataacaaaatttcagaatattatgatgtatgacaaagttaataaattatggaatatcaaaattgttgaataatgaaaaagatgatcttgctaattacaaaattgagtagtaaatgatgtaaataaaatgtcagattcagttcattatgtgaaatgaatgggtttctattctatagagctacatgagttggattcataaaccgatttattagttatggtcatatggagtcagcaggttgcaccactagtcatttgatttaggtttggtatgagagatgggatgaagaagtctctcacacaatcaaagtgtggtacgatgtgcttactaagatggggcaccaacttgcaattttgtgctaaaattagaaagatggtattccttaaaccgtactaatctaaagagaggagaaaaataaaggaatccaagtaaagatttagacaaaacaaggataagaaaagggaaaaagcattagtccccttgtatattagtatcatattaaaggcattttacttgagaggaattggacaagacgtagagctaaaacagtaaataacaaaaaaggaaaaagatgcacatgttttgatgagaggccattacatacatacaccaactgtcaaaccccagttcccgataaaatctgaaactagtgtttgacattttgctttcatctgcatcctcatcttttcccttttgttctttttttaacaatttttagaaaatttgctattattatattatttttcttacaaagttttggacctgtttgactgacaatttttagacttttgtacgtcaaacactagccccatggccaatttaataatcgcatggcagtgaacccaagaagaaaccatccacgctttctacgatcttattttttcttctcctttttcacttcaaattattttttattacttctcttcacaacacaaacacacggctcaatatgaaagtttctcagcgtaaaaagctgaatgtctttctccaagtccatatttgaatagtcttttctgcccttttagacttaatttgttaatttttgagtgatcttaacgaataccatgtactattatacacaaaaaatgtgaaatgtattttactacatagttttttttaatactctttatcttcaatttaactgatattaaggattttcccaaaatttatccaattttaagaaagtatataaaatattttaatatatcttagaacaccatttattaacatcaaagtctctataatagaaatgctcattaaaaccaaaataaaaatgaaatgtttgtaaatcacaaatgcacttaaacaatatctagcaatagcatacattataaaataattctaacattacatagcccaaatgcaaatatctgtttggcaacaaaaaccttaaaaagtctcttgttggcaaagcgctacagagttacagtttataggcccattaaggcccatcaaaaggtttctgataaacaaagtcctcttcctctatcccttatccattcaacaccagcaaaatccgctttgttgcagaggatcacaatctaatg

SEQ ID NO: 9656 - DNA, 3000 bp, Unknown
  misc_feature (1)..( 3000): cDNA_ID_3084009_gDNA_ID_1972165_Annot_ID_179758 3000 nt of promoter + ATG
aataaaaaccaaacaaaagcttcaatatgattcacttaaaatgtggtaagtaggggagatgaaaaggacttatcttatagaaattgagtcgtttattttgttggtccaccatacatttacatgaaatggttacatcaggacgagtgttgtctgagacctagaaaatcagaaaccaaaaccacaaaagaattaaaatgaaattacagacacaatcatgaatctctaacataagaaataacaaaaccaccttcacgtgatacaactctttggtttcttcaacacaaaatcccattttgtgtacagctctatacccaacattttcgacataagactttgggacatttgtacgaaacattttcttcaatttctccaaagtgcttttagttaacggaccatctcttagagttcctgatgaactaacactgcatcaatttgataagataacaatcggtaaacttgtttattcaacataaaaaagacttgattagcgagaaatgcgcaatccaactatagtttctaagttgtctagatagtagataaccgactcaactatagtgtccaagttgtcaacacagtttcaatccactacaaaccacctacggtaattacaatgctcttaaaccaacactaggctaatcactaaccctgccccaggtaaaacagagtttgtgtgtgtccctaaaaactgaaaatttgaggagaagtcaaaaaccttactcatggaaaacaacattaccaaaccgagcgatcagtctgagtttgacatcctctgatccaccataacctagcaacgtcttctttgccctatcaaatcccattataatgtcatcctccactttctctgtcacccataaccatggattttccagttttcccaaatcactcttcgctaagattaccaaagatttttcttctgcgtctttcctccactctgaagaaccgggcacaagttgaaagttgctatcctctggatccgaaccaacgagaaaccatctagaaatgtaaccgtttgcgtagattatctttgtattagtactcccgacgtttttattgtgttttttaagaagagaaggtggaacagaggatgctctcaatgcaacattttcaagtcgtttatgtggtggaacgtaagacatctctgaaacgaatatatgatactaggaaaattaaaagctgattccaaaaagataactcaagtttccgagcaacgaagtatgagaagaagaaacaaaagagtaccttttaattatatcagcttaggtcattcaaaagaagaacgacgatcatacgagaggaaactgaaaaggcgcagagcagtgaactgaagtggaagagacgagacggtttggtctttttatcactagaagtttagtcttggaaatgtgcataatatttaatttcatttcaattttcaaatcaaaaaataaaaccgataacgaaactcttgttatcatattatgagcgttgataatttagagaatctctgttcttttagaaaattgtatgaacattttgttaaataaataactatttttaaatgctaaacctcattgtttagtcctaaatgttaggaatcttagtattcatttttttttcctcttatgatatacacttccggtttagatttctaggacgttttaaatttaattattactgctaataaaaatagttatttatttttaaacaattaaataaaacaattgtatctctagagtaaaaaaagttttaaaaattttggtgaatgtttttatttggcaacccaacttaattcctgaaacgaatcacgagaattatttaacgtactacaaaaggtacatctaattttctaaaaccgaattagactatcgtcttggttgtttttggatgttgcatgtctatattatgataattattctgtaagcattacaattaaatcgtttctgtttttactaaaggagttttgactgttttaaacgactgtaaacactcgtgtgtctgcttaaatcatgtggaaagttaaatgataacagttagaacatccaactttacatatgctttgattagacattttctacgatatgtttcggattgacacgtgctaatcatatctgatcattttcccattttacatatgttctaattaggcattttcgacgatacattttagatcgataatgtgttaataatcatctgacattttttactttgtatgttctaattatgtatttatacgataaacattagatcgacacatgcaaaacattcgacaatttgttgaacactgaagacctaatttggtataatacagctcagcgaagatacgttacaactaatttggagcgtttatagaaaatataggcaaatagccaaatatgctaataaaaagatttagaactttaataggtaatttaacacattttataacacacaagcatatatatttaaaagggaaaaaactagtcaactttcatagaccatcattaccataataactcaattcaatcaaattttaatttttggctactatttttcttttctaaaaccaaaacatcatcatagtagattcttcaattttaaaatatagaattcaaattgttgaccagggaataaatagaattgcaaaaaaacaaattaagatattttacattccaacttttcccccaaaaaattagagaaaaaaatcaaattaaattcaataattccaaaacataaaacgtacaaaaaagttaatgataaaaaaacgtaaaaaaaaatacaaaaatacaaagaaaaaagaaagacagcgtggagagtaaagctattggtagcatggctgcaacagaaggccaagtgtttggtcttacaatttcatttttaactctttgtgttaattaacccaattagccctttcctccttcagggtttatttaacttgccctttctcgtttcctcctttttttcttaaaccactctgcttcctcttcctctgagaaatcaaatcactcacactccaaaaaaaaatctaaactttctcagagttta

SEQ ID NO: 9657 - DNA, 2239 bp, Unknown
  misc_feature (1)..( 2239): cDNA_ID_3042854_gDNA_ID_1972165_Annot_ID_179757 3000 nt of promoter + ATG
ttccaagagcttttgtcccaaagatgagcctcgaatctcccagtccatctatgtctgcaaaatcccacaaaacaacatgcaatcttacaaatgcagttttaagacaaaacccaaatccaatctcaacaaccaatcatttaatttccaaaaaaataaaaacctagtgactcctctgtagatagagctgcgtcgggtagaagcagggcttgtcgggttatgagatttatcaccagaaggagaagatttcttagcccttttggctcgtttaggccttggagcctccgactgaataggagaggaagtagtagtagaagaagaaacagaggaagatggagaagaagaacaagtggaagtggttaagcgcttcttcattaaactctgagaaagtttagatttttttttggagtgtgagtgatttgatttctcagaggaagaggaagcagagtggtttaagaaaaaaaggaggaaacgagaaagggcaagttaaataaaccctgaaggaggaaagggctaattgggttaattaacacaaagagttaaaaatgaaattgtaagaccaaacacttggccttctgttgcagccatgctaccaatagctttactctccacgctgtctttcttttttctttgtatttttgtatttttttttacgtttttttatcattaacttttttgtacgttttatgttttggaattattgaatttaatttgatttttttctctaattttttgggggaaaagttggaatgtaaaatatcttaatttgtttttttgcaattctatttattccctggtcaacaatttgaattctatattttaaaattgaagaatctactatgatgatgttttggttttagaaaagaaaaatagtagccaaaaattaaaatttgattgaattgagttattatggtaatgatggtctatgaaagttgactagttttttcccttttaaatatatatgcttgtgtgttataaaatgtgttaaattacctattaaagttctaaatctttttattagcatatttggctatttgcctatattttctataaacgctccaaattagttgtaacgtatcttcgctgagctgtattataccaaattaggtcttcagtgttcaacaaattgtcgaatgttttgcatgtgtcgatctaatgtttatcgtataaatacataattagaacatacaaagtaaaaaatgtcagatgattattaacacattatcgatctaaaatgtatcgtcgaaaatgcctaattagaacatatgtaaaatgggaaaatgatcagatatgattagcacgtgtcaatccgaaacatatcgtagaaaatgtctaatcaaagcatatgtaaagttggatgttctaactgttatcatttaactttccacatgatttaagcagacacacgagtgtttacagtcgtttaaaacagtcaaaactcctttagtaaaaacagaaacgatttaattgtaatgcttacagaataattatcataatatagacatgcaacatccaaaaacaaccaagacgatagtctaattcggttttagaaaattagatgtaccttttgtagtacgttaaataattctcgtgattcgtttcaggaattaagttgggttgccaaataaaaacattcaccaaaatttttaaaactttttttactctagagatacaattgttttatttaattgtttaaaaataaataactatttttattagcagtaataattaaatttaaaacgtcctagaaatctaaaccggaagtgtatatcataagaggaaaaaaaaatgaatactaagattcctaacatttaggactaaacaatgaggtttagcatttaaaaatagttatttatttaacaaaatgttcatacaattttctaaaagaacagagattctctaaattatcaacgctcataatatgataacaagagtttcgttatcggttttattttttgatttgaaaattgaaatgaaattaaatattatgcacatttccaagactaaacttctagtgataaaaagaccaaaccgtctcgtctcttccacttcagttcactgctctgcgccttttcagtttcctctcgtatgatcgtcgttcttcttttgaatgacctaagctgatataattaaaaggtactcttttgtttcttcttctcatacttcgttgctcggaaacttgagttatctttttggaatcagcttttaattttcctagtatcatatattcgtttcagagatg

SEQ ID NO: 9658 - DNA, 3000 bp, Unknown
  misc_feature (1)..( 3000): cDNA_ID_3042858_gDNA_ID_1972165_Annot_ID_179755 3000 nt of promoter + ATG
aaaaaagagatttagaacatcaaattgctacagattcagcaggagatacagcacaaagaagatgatgctattatttgccagaaaactaaacaaaaagtctaagtcaacgcaggaagagacaagatatcaagttatcaacacaatagcaagacccacatgcaccagtataaaagaaagagaacaatttgataattcagcagagatagtgacaaaagaaggatctttatagaaaatcccaggaaacaagccatgcaactactcataccacaatgcaaaacaaaacaaaaaaatctagactagctaaatcctctaaacaaactatacaaacctgaggctcaagtttagggaatttaagagtttcctcaacaacaatgtctctattccacttataatccaaacgagcagtccaaacaacatcagacaccgttgattcaccgccgccgtatacaatctcagaacccacagaagttacggcgatgtcaggagtcaacaacggtctcttcttcctcagactcgagtaagaactgaaagacctcccggtgcaataaacaagcaatgaatcatggcgatagtgagcttcccaaagcgcattgaatctaagaaggtcattgttttcaggatcatcgtgatccacctgcgaatttggtgagaattgtttaattttgtggaatctaagagacgaattggaaatcagaagtgtgagtgagagaggaaatagaaattaccaatgtgcaatcgagatcagcaactagtatgagacgtggtggtccttcaagcctatccatcgatttcaggaacccaggtgtttctctttgcttctctcttgtctctttgctcaactaactttttggttcctttattcttgacttccttgggaagacgaagtttttcttttcttattcgaacaattctgtcgagtatttgaattagttataatctttctttttttaattagttagaaatttccttaagcacgtatttatataacatgtcaacgcaacgaagttccccctcaaaattcagttttatgcgtgcgttattacgacatgatagatcctgacgaccaccacatgatgcattactagcaatggatgactcttccttatcattcattttatattcagagaaaatgtgcaagagaatttgcttggtaagtccattggtgacaaaaaatcgatttagtttgagtggaaatagagaatcataaacaataccaaaattgttagagatgtatgtagtgatacaaaaaacgatattaaaaatatatattgttctggttctattatttgttatcgtttttatgattggtaactattaataataatttttcaattatagtggtaagaagttatcaattaaagtcttgttcttttgggtctaactttggatccgattgttaacctataaaagaatacaaggaatgaaaagtaacatgactaaaaaagaacaaacaggaaaagaaaaaattataaaataagaatacaaaagaatgagtgtagaagaaaaatagaacaaatgttactgtaaatgataaccaaaacatagaacaaatagtaacaaaaattaaaaaataaataaattattttcttaattaaatagccacgttttcacgtttttttttctaattttctataaatttaatttttaattaataaatgtttaatttgtttttctgtttgttcctcatcaaatttgagaaggaacaattttcttctacgattcctcaaaaaataaggaatgattaggaatagtgtggggtctacatgttacaatttggaaaaaaaatactactgaatggtaaaaaaaaagaggaacatgttgttcctgtccattccttttctaaaaagtggtcaccaatcggaccctttattgtgatttactaaccttttcagcggtaaaatattatcgttacactttcacaaataatttgctagtaacgttaagtgttagtgacttatatgagattgttcaagtttattcgacaaatgaaatcctttcgatctttactttaatgtgtcaaatatcatgtccactttcaaataaagactcttagcttgaaggaaaactctacgaaaaactaacgcaatatgtcccatttatatggaagacgcgcgatgttaaaattagatactgaaagttggagtctaatacattagaaactaatgatcattcaagaaaaccatagattatcacagtgacaataggcacaagtcccactccggctattacaagcattgttagaaaaagtttaggtgggacaaaagatcacaccttgcatttagtcgttacacgaccatccatcaaatagaagagatcgaagatcagctggaagaaaagctagttttaaaaaaaattcttacttgatttgaacataatacgatatgattaatgtgtcttaaaaagcatagaaaaacacatcgaaggccataaacgtgagaacgattcaaatgacataatttttacaagaacaaagaccagcaaatccaacttaccaaaaaataaaaccaccaaatcctagaaggcaagaatgtgtggcaaaaaaagaaaaagaatgtataccatttggatgggaggtccaaaattttcttagaaattagtaacttaaacttttaaaactcatacacatatggattatatgttgaaaaaatcataattcagaaaaggatcatatataactactaatatatttttgaggtctttgtttttagttattttattttattttcttaaactcgaggtctttgttttaacaatttttctaatttcattatcttacaaaaaatctcaaattttaataatataaatatttgtcataggtacgggaagagcggtttgttttccagcgaaaaaaaaagaacggtttttctctatttgttgttgttgtttttttttaattattttcgcccctgattttttttaattaatgaatataatttttgcaatttttcgtgggaggctaaaagaaaggcgaggaggaagaagaaggaaccagcattatat

SEQ ID NO: 9659 - DNA, 3000 bp, Unknown
  misc_feature (1)..( 3000): cDNA_ID_3042864_gDNA_ID_1972165_Annot_ID_179753 3000 nt of promoter + ATG
gtaactttcactagcaattgtcattgattcccatcagtataacaatcaaccacagccctgtatctctgtaatctatagaaagtaaatcccatgactatacctttctcaaaagagagctcaagtcctgaggatgagactttgcaatatccccgatctgcttggctgcagttagccgagtagcttgtgttgaaccagctacaaagaaatgataattaaggagaacatgtaccttcttaagcgattatgatacgaagaaacgcaacaacaaaaacgaagcattattggtaacaaaggaaataatcaggaaaaataaaggatactgtccaacaaagtaaggagacgattgagtcgggaagattgttgctgtgccatgaaggacacaatgacaacaacgttgatgatgacgatgacaagagtgaacctcctcttagcttcacttccacatccaagctcatccaaatcacttagcgaaaactaataaccctacaacacagacacacacactctgcaggtaaatcaatgaccagaaaattatcgaaaagagaaatcgaaatcgcgcattcggatatagaaaatcaaaaagcttgggttaaagcttttttagtaattcgattgggtcgggataggcgtttctcatcttcatcctcgtgaatttctagggaaaatccgagaaagagaagaatactaaatttgataagagaaagagaaaattagggttttgttttaatacctggaaaaggctgcgaggttctcaagagcagagaatgctttgggtgcttcatatataatgctggttccttcttcttcctcctcgcctttcttttagcctcccacgaaaaattgcaaaaattatattcattaattaaaaaaaatcaggggcgaaaataattaaaaaaaaacaacaacaacaaatagagaaaaaccgttctttttttttcgctggaaaacaaaccgctcttcccgtacctatgacaaatatttatattattaaaatttgagattttttgtaagataatgaaattagaaaaattgttaaaacaaagacctcgagtttaagaaaataaaataaaataactaaaaacaaagacctcaaaaatatattagtagttatatatgatccttttctgaattatgattttttcaacatataatccatatgtgtatgagttttaaaagtttaagttactaatttctaagaaaattttggacctcccatccaaatggtatacattctttttctttttttgccacacattcttgccttctaggatttggtggttttattttttggtaagttggatttgctggtctttgttcttgtaaaaattatgtcatttgaatcgttctcacgtttatggccttcgatgtgtttttctatgctttttaagacacattaatcatatcgtattatgttcaaatcaagtaagaattttttttaaaactagcttttcttccagctgatcttcgatctcttctatttgatggatggtcgtgtaacgactaaatgcaaggtgtgatcttttgtcccacctaaactttttctaacaatgcttgtaatagccggagtgggacttgtgcctattgtcactgtgataatctatggttttcttgaatgatcattagtttctaatgtattagactccaactttcagtatctaattttaacatcgcgcgtcttccatataaatgggacatattgcgttagtttttcgtagagttttccttcaagctaagagtctttatttgaaagtggacatgatatttgacacattaaagtaaagatcgaaaggatttcatttgtcgaataaacttgaacaatctcatataagtcactaacacttaacgttactagcaaattatttgtgaaagtgtaacgataatattttaccgctgaaaaggttagtaaatcacaataaagggtccgattggtgaccactttttagaaaaggaatggacaggaacaacatgttcctctttttttttaccattcagtagtattttttttccaaattgtaacatgtagaccccacactattcctaatcattccttattttttgaggaatcgtagaagaaaattgttccttctcaaatttgatgaggaacaaacagaaaaacaaattaaacatttattaattaaaaattaaatttatagaaaattagaaaaaaaaacgtgaaaacgtggctatttaattaagaaaataatttatttattttttaatttttgttactatttgttctatgttttggttatcatttacagtaacatttgttctatttttcttctacactcattcttttgtattcttattttataattttttcttttcctgtttgttcttttttagtcatgttacttttcattccttgtattcttttataggttaacaatcggatccaaagttagacccaaaagaacaagactttaattgataacttcttaccactataattgaaaaattattattaatagttaccaatcataaaaacgataacaaataatagaaccagaacaatatatatttttaatatcgttttttgtatcactacatacatctctaacaattttggtattgtttatgattctctatttccactcaaactaaatcgattttttgtcaccaatggacttaccaagcaaattctcttgcacattttctctgaatataaaatgaatgataaggaagagtcatccattgctagtaatgcatcatgtggtggtcgtcaggatctatcatgtcgtaataacgcacgcataaaactgaattttgagggggaacttcgttgcgttgacatgttatataaatacgtgcttaaggaaatttctaactaattaaaaaaagaaagattataactaattcaaatactcgacagaattgttcgaataagaaaagaaaaacttcgtcttcccaaggaagtcaagaataaaggaaccaaaaagttagttgagcaaagagacaagagagaagcaaagagaaacacctgggttcctgaaatcgatg

SEQ ID NO: 9660 - DNA, 3000 bp, Unknown
  misc_feature (1)..( 3000): cDNA_ID_3042868_gDNA_ID_1972165_Annot_ID_179752 3000 nt of promoter + ATG
cttccatgttctaatgtctagctcgtgtttacagagggaaaagtacggtcttgttcaacaaaagtcttactgagttataaggtaaaccttgatttatgatccttttaagatttcaaacgattagattggttaaataatattggaaaaaaataactgaaaatgggttaaaattgaaaggaggaaaagcaaaggctgacgtggatgcacatccaccaatcatggttagatgaatcttcttcagatgatcaagaaaaatggattttctaaaggattatcttaatctcgactgacatactaaagatgacatctgtttgggacagaagctaaccaaagagcatagtgtttgttttgtgttatgtttgtttggggatggtgtgagtttgataaagcatgaaggatactaaaagctgaagaaggtgttgccatgtcttggtttcgtttcattaatacttttttacatatttgggttaacttaaaactattaataaggaaggttgggtcctgaatttggtctgttcatgaccttttgagggcagggagagttttgggtctctacaacaaaacctacatttctttagtcttacaaaacctaccattgtgtttgatttgcaattcttttttctggtttatatggattgttttctactatttctgtttgtttttgttgagaaactatttcgattttttaaaccatatacaaaacgctccaccaaactcacaaatcccgccttggatactgtaatctgtttttataaaaaaatgatatgatggagagaagaggagacgcaagtcacgggacatgatttcaagcataagtctaattactaattaccaccactttccgtaattaacgccctttttcactttatccactttttgttgcccatcttctttatattatttctttctccaagcccacactgctcagtttcctggtcaaatggctacctcagagactcgagtcttgttcttatctttgtgtctcatccttggcaaagtagttttgtctcagtttgatgagttatggctagtaggggacgatgatccactcaacgccttgcagacgaggcgtgaaagaagagaggagaggtgtgattactcggtggggaaatggacgttcgatgaaacgtatccgctctatgattcaagctgtccatatctgagttctgcactaagttgccaaagaaatggaagacccgactcttattaccagaaatggagatggatccctaaggcttgttcactaccaaggcacactccacactcctcttacttcttacattacttctttttaaaatttctgtctcatcaagtaaaaaagttggtttatattggctttgcatggttaattgcaagatgaataaattgactaatgaaaaatgggaaagagacattaatattaaccaaaatagtggctctttccatgatggtgtttaggtttgacgcattgaaatttcttgggaaaatgagaggaaaaagaataatgctggttggagattcaatgatgagaaaccagtgggaatctcttgtctgcttagtacagtctgttcttcccactcatcgtaagaagctcacttacaatggtcctacgatgtctttccattctctggtaattaataatcacaaatctccttttgaatcacatatacatcattggttagtagatgcaactattaaatttggttactatacaggattttgagacatcaattgagttttgttgggctcctctgcttgtggaactcaagagaggagttgaccgtaaaagggtgttacatttggactcaatcgaagacaatgctagatattggcgtggtgtagatgttcttgtattcgattccgctcactggtggactcactctcagagatggagttcgtaagtcatctgaataaacacttacatctttccttcaaaagcaaatgattagtgtataacggttcatagacgtctatgttcattgtatttgttattgtgtctcattttacatcagatttgggatttgtgacagtaacgcaagctattgatgttttaggtgggattattacatggatgggaataagatcttcaaagctatggacccaatggttgcttatgagagaggactaaccacatgggctaaatgggttgagataaatcttgatccatccaaaacaaaagtcattttccgcactgtctcaccgaggttttttcttatattctcctcttaatctcaacatatatacaaaatggacaccattaattcatgtacataaattcttggcagagagagtggtcagatgtgctacaaccagaaacatcccttgccttctttatcttcttccaccaaaccccacgtgcctcaacagtcaagagtgttgaacaaagtgctaaggacaatgaaataccgagtgtatttatacgatatcacaacaatgtctgcgtatagaagagacggtcatccttcggtgttcaagagagcaatgcacgaggaagagaagcaccatcgtatcgctggaccttcatcagattgcagtcattggtgcttgcccggtgtcccggatatttggaatgagatgctttcttcaattatcttaaccaatgctgtatgagctataataagagtctgtttttactcatgaacaatggtgttacttatatgaatcagtggtttatatattacatatcctttcccagctaacaaatatcccaatatcaaagacaagacaactcaaaggcctttaagcataaagttcatgcatcacaatgattttcgtgttttggttatttcttacctaactcaatttttttcctaaaacgttttaggttaagttttggtgttttcatcaaaatggcaataaccatttgattagagttttacagttagtgaagttctcaatttttgaataaaataatatttttaaaattgtaaaggcaatgagtcatcattattctgtcgtattctccgtcgctttcattttcaactactttgaagctgcagatctcttttggagattcacatg

SEQ ID NO: 9661 - DNA, 3000 bp, Unknown
  misc_feature (1)..( 3000): cDNA_ID_2184768_gDNA_ID_1972165_Annot_ID_179751 3000 nt of promoter + ATG
tactccatgtgccctgacactcatgttggtccttattagtatgacggtgttggatgggctccaaaggaatacaatactggtgagaaacaaaacactggagggcaggcccagggtgttggggaaattgaatcccagaaagggacttctgctccacagtctggctatgtgtgggatgaagcatctggttattactatgatgcggcttctggatactactacgatggaaattcaggtcggcatttacttatattgttatttatttctttgaattgattgtatggttgggtagctgcagctctaattcccatatctggcattgcaaaacatgtaatgggcaaaagtaagattgatcctgttggctggttgtatagtcctgctatagatgtattctattataggataacttcttggcaaaaataagtcgtcagctctggtttgttcaaactatcctgttcttttttatgattgtggaattcttatactatgtatgcaccaaactagcaaacatcgagatacaatcaatcaatcatacaagtgtatgtcttaattagacttttaaataatggctgtagggattcagcaagtgttatatgattactattatggctgctgttggacttccaatggaagttttttcttttagttattgctgagttatgccttcttatatatgtgtatgtgccttaaaatttcgcatctgatatggcacaatgatagactgttttaatgatcttggttatcactaggcacctcttcttggtgtgtggtgatgggaaacttggtttcactggtataagaagtgggtaatattctctattaatcgtatgtttctaaatatacaggtctctattatgacagcaatagtgggctttggtactcgtatgaccagcaaacacaacaatatgttccttgtcctgatcagaacaatgagagtaaagtaacagaaaaccaaccagactctgccaagaaggagaaatccagtcaacaaaaggttattatctcggcggctactacccctaatgtagaaaaagttctgtccttaccagatgcggttcaggcggctgctgcagcagcaattgcatcagagaagagagagaaagagagagtgaaagagataaaacttgcatcaaagactagcctactcgccagcaagaaaaaaatgagtaacgttttaacaatgtggaagcagcggagccatgaaacccaaatacaacgtccctcaccctcacttggtgacaatccacctacagtttcggctgaagcaaggtcgtctttctccactggacaatccatgggcaaactgaaatctgatgtaattattgcgaaggagagaagtacctccaatcatggagtttctgccctgacaactgcagaaagctcgagcagcagtacaacaggaggaactttgatgggggtgatgagaggttcttttggaggaactttgggtggagcttcttcttcagctagtgtacaaatgccgccaatattaccttctgcttctccagcttcggtttcagtttctgggagtgggagaagaaggttctctgaaacaccgactgcagggcctactcatagagaacagcctcagacatcataccgggaccgtgctgcagaaagaagaaacttgtatggctcatcaacatcaagtggaaatgatgttattgattcaagtaagagcccttgactctagacttttctaaaaatagaatcctgaaatgaggtttttattgttgttataattgggaaaatggttcgtttaaatgaaggtgaggatttaatggggttgaggaaaggttcatcggatccaacaccatttcctcctggtgtgggtggacgtgggattacaacaagcaccgaagtcagtagtttcgatgtgattacagaagagagagcaatagatgagagtaacgtgggaaacagaatgctgaggaacatgggttggcacgaaggatcggtaactttaaaaaccagaaatttgattgatgggtaacgtttatatgttaatggtgattgttggattgtggtcagggtttggggaaagacgggagcggaatgaaagaaccggtgcaagcgcaaggcgttgataggagagcaggacttgggagtcagcagaagaaagttgatgctgagtttgaggttcagcctggtgacacttacagaactcttctccataagaaagcacttgcgagatttcgtgacatgtctgacaataattgactctctctgtgtgtaaagtcagttggaaacttctaaattccgttgtgcttaaactgtgaaagtgattttgattttgttctttttgttaaattattattaatgaaaagagacagattagtactacttgagtttatatggaccttaaaacctttgtattattaatgtatctggaggcaacaacgacccgaagacaacaacagtatttaaaaaacttaccaaaataatatatgctttcaaagcttttaattacgaaagttagctcacaaaaaatatcagataaatacaactgtttttgaaaatttcagaattctattttgttaatgaataataattaattgttatttcatgctcatgcacattaataacctaaaaagtattgtttgcaggtgttcgagaagaatatatgcattgatgtatatcaatttctaggcattacttttttttcatcataattgttagtaaaggtgacatgtaaaactagttaatctcgtgtctgtcattggctcttcccaaaaacagattggttaatacgttagttggaaccattgttataatggctgggtttagttgctgccggctatttccggataaatgcctcaaaagatctttcagtgaatccaccgtgatttgcgttgtcataacgtgagatgcaaatgaagagcttttctctgttaatttagtttttacacaaccctataaatatagttttacacttaaaacccataccaattatttttgaaataagttggtattgcccaacttttttatcaaggttttttcaac

SEQ ID NO: 9662 - DNA, 3000 bp, Unknown
  misc_feature (1)..( 3000): cDNA_ID_3042840_gDNA_ID_1972165_Annot_ID_179742 3000 nt of promoter + ATG
aatcccttttttgttagcaatttcattatttactaggtgaaaaaaaagagattcaactatatttctctgctcattatctgtctatggctacgtatttgtgtttctcttctcattatctgactatggctacgtttatgtgtgatggtttcgggttttgtaacaattgagtgtcaatgcttaatgacttcgtgtgtattgtatttgtatctctggacacaatctatataacaactttagtctcttgtagccataatcatctagttcttgtgtatgttggtttatgatgtgtttcttttttaaatcaagctttgttctagttctctgcgcattgcatatactgagatatttttagctcgttgataaaacatataaactacaatgttactagagccgaaacaaacaacatcagtcaaatcatatcccatttaccaaattgtcaaatagactgtgtaaactgtaaagtaacaataacatacagcacaaatgagtcatagtagacctaacgtagctgatagctaatagctatagcatctctcttacaaactcaagtgaattaggcacgaagaaacgacacaacaaggagccaaagatgacaaaaatgtcaagctgttatatacagaaattgcatggataagaaagacactaaacaaaccagctctcatgtcaacaacaaaccggaagctcatttgtttctcttatcagatatggaagttcatgctgaggcaaaacaaactggaaacttgacctcgactttgcattcagacgaagctctttcgaacattaggagatccaacatgatctgcagctttttgtcatctccttttacctgaccatgaatttccaacagctcaagactcggcaatttctccaagatatgctttatttgcaccatctctccgatatctcccttgaactgggttatctttagaacctcaatatggcaggacgataagaaagaatacacctccaaacaatcgcaaacagtgttctcatccccatagtgattagtagtataatgcaaagcctagaaaagacaggaattttgagattgaagattttgactctttagtttgtccaatatacttttgggggtcttaggtcatacctgaatggtgagagtctttagatttggagatttctcaagcagaattggtagaacattccaacagaaatctacttcagtgctaagtgataaatgaaacaggttttcaaacactggtactgcttcttcgaagaaacaaaacacctgaaacagaattaaaaacaactaagtcagtcattacttgagcaaacattctaatcactagcaagattgatatgatcttagtatctcaatggttcctagatttaaatttcctcatgctctactagttgttaagctacagtaacatattaaagagaaacaatagcgatcacttacctgcatcgtgtcaacaacgcctaagctcagaatctgaacattttctaagcccttaatcagattcttaacatcgtaggtatcgccaaccataaaaagaggaagttctagcttagcttcaacaagggacttgagatcaacaactggatacccatctcggagaacatcaaagtattcgaagtattcaagactcggagtatcaaaactaattgactcataactagagccatcaagatcttcccagtcttcacgccgaatagtaagtttcttaaggatcttactagacacaatgcgagaccattcccaatcttcacggttgttcctatatatcactaaatcctctagcacagggcaagcagaaacaagccttgtaaacgcacaaccaccacttttatcaatgaaccgaactttatcaagaaagagagtcttaagagctggaagcaaagcgttcttagggatattgtcaataacaaaatcagaacctagtttcaatttcacaactttcttgcaagtgaagacctcaaatggcaatttgtaaacttcattgacattgatgtccaattcaagatccaaaacacctcgattcaacacattgcgtagacattcgttgacaagatggtacttagctgaatcaaattccaaagaacgtagtttcaaagagaatctccttatacggtaactgtcacgtcgagctagtaatcgagaaacgaaatctttgaagcttccattagtttcaaacgaaggattataaccaacattcgatatgatcgtaaccagattcggggattttttggaggctatgtttaggttccagagtttagaaacgatctcttgaactctcacgatctcactcatggtttcatgaattgtagtcgaaactcaaaagcgataaagaaacgcaattgacgaaatttgatgtacgagtttcacggtgaacagtgattttagcgtctatatcggaggaatcacatactacaccggaaaaatccagtataaacggcaaaatccgccggagttacagttacaagatcagagcaacgacactgctctcgtgaagaagaaagagtaaaaagcgctcgagaccctctcttttcctcattttagtcttcactttatcaactttatcttgtaaaaactaaacccaagagataagcccaaaattgagcccattatgacttgaaacttcagctaatgaacttgggcctaacactaatacagataaaacacagattatatgtacaattttcctttttcgagattgaaagaaaattgattataactaaatcatttttttctctaccatttcgtggaaacttgcattgcctgcatattggtttacaactatatactgactattttgtcttcgacaaaaaatatattaaaacaaaaaagtcttaaacgacgtcttaggaaggacttgcagtgaaactttacctcacgccaagttggacttggttaaactttttcataatatattaatagaaacaagactattcaagactcgagagagtttaaatagaaaacgaattagttgtgtattcaaaccaaggaaagaaaacgagagaggtacgtagaagaaaatg

SEQ ID NO: 9663 - DNA, 3000 bp, Unknown
  misc_feature (1)..( 3000): cDNA_ID_2184742_gDNA_ID_1972165_Annot_ID_179740 3000 nt of promoter + ATG
ttgtttcttatcttttggttaaaaatgtgaatcttttggttaaaactaattaagtttgttttttctcttgaagggtatgactcttttgacattatcagcttcagttcctggacttaaaccaggtaactgcaatgctgatacttgtcatccaaattctagtcagactgctgttttctttgtcgcgctttatatgattgctcttggaactggcggtataaagccgtgtgtttcgtcctttggagctgatcagtttgatgagaatgatgagaatgagaagatcaagaaaagttctttcttcaactggttttacttctccattaatgttggagctctcattgctgcaactgttctcgtctggatacaaatgaatgttggttggggatggggtttcggtgttccaacagtcgcgatggttatcgcggtttgctttttcttcttcggaagccgtttttacagacttcagagacctggagggagtccacttactaggatctttcaggttatagtagcggcttttcggaagataagtgttaaggttccagaggacaagtctctgctctttgaaactgcagatgatgagagtaacatcaaaggtagccggaaacttgtgcacacagataacttaaagtaagaaactaaagtttgaatctttatcctaacttcaaaaatactctgttttcaaatctaaagttttgaaaacatctcaggttttttgacaaggcagcggttgagagtcaatctgatagcatcaaagacggggaagtcaatccatggagactatgttctgttactcaagttgaagaacttaagtcaataatcacacttcttccagtttgggccacaggaatagtcttcgccacagtgtacagccaaatgagcacaatgtttgtgttacaaggaaacacaatggaccaacacatgggaaaaaactttgaaatcccatcagcttcactctcacttttcgacactgtcagtgtactcttctggactcctgtctatgaccagttcattatcccgctggcaagaaagttcacacgcaatgaacgaggcttcactcagcttcaacgtatgggtataggtcttgtggtctccatctttgccatgatcactgcaggagtcttggaggttgtcaggcttgattatgtcaaaactcacaatgcatatgaccaaaaacagatccatatgtcgatattctggcagataccgcagtatttacttatcggttgtgcagaagttttcacctttataggtcagcttgagtttttctatgatcaggctcctgatgccatgagaagtctctgctctgctttgtcgttgaccacggttgcgttggggaactatttgagcacagttcttgtgacggttgtgatgaagataacgaagaagaacggtaaaccgggttggataccggataacttgaaccgaggccatcttgattactttttctacttgttggcaactctcagtttcctcaacttcttagtgtacctctggatttcaaaacgctacaaatacaagaaagctgttggtcgagcacattgatcaagaaactggtgtggaagatatttggagttaacagtatttgtttgaaaagtgttttgcttgtaaatgttttttgtatgtggtctagttgttgttggtgtgttaggtttgttttggttttgcttatgtatttctgaatacttccagtcttccacttatatgtaaaaggctattggtaactattttatgagctttttgcttaaagctttttgaccgtctgataatatgtcctcctatattttgccattgctcttaagaaacttattatatacattggaagttataagcaataagctgggaaataaaatcaaaaactaaacaacagcatgggaaatcttaacaaaaagcaaagcacataggatcctattgtcaatacatatgtaaacttactactagacattaaacaaagagatcaagtattttcttctgtttctttgaagatgtctttacttttgactatatatctgaactgtttggaaaatgctcaagatcaggatgcataaggaagcccccttggcttcttggaggttgtctaacaagattgagacaagcaagcgtcaaaaacagattttgattctggggtttatttgttcagtaaaacccatggtttatatatatatagtcagaaacaagctttttattgagctcaactatatgcacatagaaaaagagaaagtttttttgtcattttacgaatgtggtggtgcgatgaagccaggtttggtcactaaatgagcggaagcggaaatagccagcaggactatctggaaatgaaaccaaacctaatcatttaacaaagtataatcaactctagccttgcaattatatggctaagaaggaaaaatttagaccataataagagtttagaacaaacaggtagaagtagtagatgtattaccttgatgaaagaatcagagggcgtaaaagcttatacagaatctcattctttaaatctgtcactaacttatctaaattcttaaactgttcacggacattgctgctagtgctctcagtagtataattcctaactctgtattagtgctctcagacgtggttattacgaaatgcaggcataaaccaacccgatcatacccatcacattatcagaagtcgccatcaaagagatcaccagaaatcttgggaagcaaggaacctaagttggtctgtcaattttgagataatgggcctatctcaaaacagtatcgggctcgtctgcaaaataagaaaaaggcctagaaagtcggttattacacgtggcatccttttattgtatatttacttttccgtcccttacattttcttatttaaataatctgttaacttgcttcttcttcttctttcttcatcttcatcttcatcttcgcttcacaatctctttgagacttttgcatcggagcaataataatatattcatcgcaaaatcagtgaattttgatattcaaatcttaatcggcgatg

SEQ ID NO: 9664 - DNA, 3000 bp, Unknown
  misc_feature (1)..( 3000): cDNA_ID_2184722_gDNA_ID_1972165_Annot_ID_179733 3000 nt of promoter + ATG
aaaaagataagcatttttggggttttacaacagtgaaaacaaagatagggaaaaactcagaaacgagggagacaaaagttgacacctttaacgctttttcacattgtccaagtgcttgacccatacctctctgttcttcctctctctcttcccccaccacagtcaccactttactcttctccatcaggggtccgatcccatctccaattttaaaccctagaaatcaatctcaaaagcaagcgtgcttcattaatggcgagcttcattctctccaggtcattactcgttctactcctgtctctcaccgcattactctccagcatctcgatttcggaagctacctcatcgttctcgttcacaagctccggtaaaaatgcgagctttgagtccgaagactttgccctgtacggcgacgctaagctcgtcgacggcggatcttcgattcagctgactgactcagtgagtcacggtggtgggcgagtcatctataagaaacccattgagtccatgaacaatataaaattcgagtatttcaccggattctctactttcttctctttctcgatttctcctagtcgtggtgggagactcggatttgtagtgtttcctgttaatgaaacgtttgatcactctttattccaagtaaagttcgatacttttgacagtttcacccaaattggagattctaatgtcgcggtgattgttgatggtgctacggtgtctgagaggattcgcaatttcacgatcgcaaacttggagaagacggagaaggttttgttgtacgcttggattaattaccaagctggtggcaagttcttagaagtccggttaagtaaatctaaaagctttgaatctgttcttcctctgatgtttgatcagattgatttgtcacaaatgttgagagatgaggatgagttcatggttgctgtgaattcgtatagtgggaatgtaaatcttcattcttggagtttagaagtgagacactccgagtatgagcactcttgggcgccggtgcttttggaggaacaacttagaaaagaggaacaacttagaaaagaggaggctgcgaagaagaggacaagtgataggatgtgggaggttgtcacttgcttcgtcatgacctttggatcaacagggcttgtgttctttgccatgatgcatatatatgcagctttcaaaaggaacaatcttgcgatggtgatgcaggaggaatgtgggatcaagaccaaggagtttgggtataagaagatggagaaaatggaagttgtgacgagtaatgctgatgcgaaacaagaaaggaagtgaagtcatgtttggtgatttttgtgtgtttaggatatgtgaactgttaatgtagtcaagtagattcttggtaactagttatccacgaggttcttcactggctaatgtaaccccttcttattttcatgtgtgtaagcttgcaaccttgttaccatttggcattttagtttgatttggcatgtaaaaatatgagaagaatgttgtagaatgcacaccaaacttgagtgcgagggatgacaaaaacaaattccaactcctacacaaaatagatttgtaactaatcacaatcatttgaagaacgcaatgtagtttatcttcatctacacaaaatcttcaaccggagataagcttcaagacgatgactgctgtgttaatgagcatgaggggtagcctcatgtactggcaggcatggatcagaccaatgatttggcctttgggagagtttcttctatcggtttggtggagttctccgagtgtccatcctcttggaacaaggaaacggtcttcgttgaggattgccagtgcatttgcaaagagcagcagaccttttaacaatgtccagaagcccattcttttctgtgatgcatagagctcaaaatgatcagaatcagggaaagagagtggaacaaagttatcttttaataggtttagaaacaaaatgaatggagactaagtgcatgcaaatgtaagctactgatgtgttctgtagatctaaagcgcagagaaccatgaagatagcagtgcaaaatcttgtttctaacacatcaaaaaagccaccagattgaacttattcctgccttgcaataatatctagaaatctaaacaatggcaggacggtcaccgagttagcattccaaagagccttaacctagacatattgtatatcaacacttctgaggatatgctaatcacataagcaacataagtatgcttcacgagaaaagcaacaagctcgatcaaccctaagagcactagatgagattttcttgtggatctgcttcaacaaaagtacacttagtcaatcacaacatcttgaatgaaaaaagaagaagagaggaatcctgagacttcccagtttcagcaatcaaaagattactaagtttcatcacaattcacaagtgaagaagacaatctatcaatgaacactttgtctaaaccaaaatgtgaaaatagatattagagcaaatgcataccgattaagctaagcttggtacagaaacagagaatacacaatcccaattttaagctatgcaataaattacgcaggaatcataaaccttgaaactgctgacctaaacatgagatcgagaaagtaaatgaagatccaaggttgctaatagaagaagcagccaaactaatcgatcaattcccacaaggaagcgaaaaacccaaatctagcaacaaccagtgaagaaaaaatcaaaatgaaggagctgaatcgagtgcaagattaccgtaagaaaacgctccggcgatgaagacggcctgagaacgagagaattgaatccgtcggtgaggtttaatttgtttcttctttagaaaattgaactgatttttcttcttcagcattaagtaaaaacccgaaccgggttaggattgacccggtttgaataaaagtcgggtcaggacccgatatgtttttttttgaagaggaagaagatttggataaaccctgacagtggtgtcaaaaacccatca

SEQ ID NO: 9665 - DNA, 3000 bp, Unknown
  misc_feature (1)..( 3000): cDNA_ID_2184734_gDNA_ID_1972165_Annot_ID_179737 3000 nt of promoter + ATG
aataaaaattctatcagttgttacctgttcgagggtcaaaaacatgattacgttccatgagccaaggcgtccaaagttggggatgaaacccttgtaaaatgccataggaccctgtagaggaaaccgtaaagagtttgtaacattttctgggttatatctagaacaatggaggtatcagaagcagagttgcttacgtcgctcttcagagttttgacgaagcagtcaatggtgcccttgtaagcaccagaatctcccatcattcttgacttaacctgccacacaacaagatttaagtagacaatcaggaaacgtggtgaataaactcaaggttcaatgtcatgagtaaatactttaccacgtcgacaggagagccgatgcagacagcaaagaatcctgctcccagtccagatagaatatgtgtgacaacgttgtcagtgaaacccggaatcttcaagatcgtctgaacacaaaaaaaaaaaggaatgttggttgcttcaaatatcaggatctcttatttagaaagagagacagagaacatattagtttcatacctctttcacttgatcgtaactcgctaattcagcagcattgataatagcgtttcttgctacgttaggtccaagaccagtccaaagagctcggactccttcctgtcagagccacattaataagatatgaagtagagttgaagcaacttatgcacaatctcaacttccaagtcgggataactacctgtctcacaattgttgaataagcattcagcgctccagaataccgtcttggcgcacctgcagctagttttccttcggcctgaagcctaactttcacaagatcagtgggatttgctaccatgatacccagtgcacctgagagttagacaacaaaaacagcccaactaagtgataaagaggaaatatatattacgtgttttttctaagctggtctatcgttatgctcacctgttgtcaaaccagcaagaattttcttgctcaatggaacatcacctacaaagtcttttccaacatacaagtttttcacctgagtagaataaattggttaaggctttaagtagtaactaggaaaacactgagtttaagcacttttctggagcatgaaagaagaagaatttgtaacccaccggctcatacattccaatcctaagacctccaaataggcattgacgatgcaatccaggtacaacacctttccatagtgaacgtaacccttcttcccttgctatggtaccaacagttcccaacaatcctcgatatttaggcagagtaacatcaccagcaagagcagacttttggagctgaagcctaactttagcagtgtccaatggaattgtgcatacctggtccagagagtttaattgcataagaacagaattatctgacgaaacaacacagccaaagagaagatacatgttgttctgaggataattaaacattatacagttgcgttgcatagcaatcacaatgatcaaatagattccattttcaagtctcataatcatttcaatgtttcgcaaaatcatatctaaagcataaatcaacaacactacacatgccaaaattcaatttctagccacagatctgaccgattattccgagatcaaatcatttctatcggaattacgtaatctggagaaacactatagaagctaaaatcaaaattctccagctatacgatgataaagacaaaaaagacaaagatcaacctgatcagaacttcacaaataccaacgaaattcgaaaatacatttccgcgtatagccaacaaagtctagatcgcgacacacatttctcgaacgaacaaatagttttccggtacaatcgaagcatactcagcgataagaaaaatggagttaaaagagatgaaaaattgaggaatccggcgattacctcgccgacgcaagcagcgaaggcactgcaggcgaaagttttgggcaaggaaaggtcggatttaccagccgccaccatcttcgatccagaaaacgcgaattaaagagaggaggttagggtttcgaaatcgaagaacagagaagagataatatcgggaagagggacgacgacgattacggctaaagcaacttggcctcgagtagtgtttcagttatagaaaagatcgtccctctctctctctctctgcgcgctacgaaatgagaaaggagtgggcgctttacttatttatacacacgtgtgtgacgacctgttttgttaaatagtatcatccatcgattatgttgctttcactgtctgaagaaaattcccagtcaaataaatgacacagcaccacgctggatcgaatttacttttactaactacctctctaaataatttcatttctttttaatctctaatccgatttttttaagttctaataattccattagtttaacatcgtgagaggtcgaagttttgtatatttggtacaaagttgattagctttgtagcagtggcaataaagtcagtgcgtcatcttctaggtctacttcacatcttcgtcacaatgcagagtgccctcgatgataaaaagtttaagtatcataaacttaatcatcataggttagtatctcttagctatttcaaaagaacacgttaatcactcttttgcctatatttgtttaatctaaacgatatgacaaattatatttatacactaacatccaaaaaactattcatataaaaagatgtgctacaaacgtgacaaactcttgaaaattatccattcacatcatacataaaaaatgtaaaacctaaacaaaaaaaatgattagaacagtcacataaatatataattagacacactggcgaatataaaaaattctgaaaacaaaaactcagcttcggcgaatttcacggtgacggtgactataccagaagatacatacatggtcaactacttcctccaaaacctaaaaatcaaccctctctcttctttctctatctctttccttttgtctaatcttcaattccctatttcaccggcgacgatatg

SEQ ID NO: 9666 - DNA, 3000 bp, Unknown
  misc_feature (1)..( 3000): cDNA_ID_3042876_gDNA_ID_1972165_Annot_ID_179738 3000 nt of promoter + ATG
tgcttcatttttagtaaatatcttgtggtatcaggtcaataagagtgccaagatatagagagaagacctcgggtcagtccagaaagattcatggtcaagcagaggaagaacaagagttgcattcataatcttggcaacagcgaccatgtcacatatctgcatattggtcaaaaccaacaaagaatagtacatcaaaacacttgactatggagaaaacggagatcaataccctctaatatccttttgaagtaaactcaccccagttctcatctgattcaatcctccatttgcgtgtactacaagatacccattggtttggcgttgcagtcctagacaaagacataaataccagattttgaaaaatcagaactgcaaacgagcttgaagaagaactaggaattttaagatagcaacatactcgtatagttcttagggcgcgtcacacattggcgataattcccgctttcaggtttctgccaaatttccggaatctgtgagaagagacaacaaaagcataaatccaaatgaccaagatcctcgaaaatgaagtcaaacagaagaaaaaactatcttccttacattgcaaaaacagaggaaatgataaaaaaaaaattagttaactatcaaaacatgtaagacctccgattacactgatcacagagaacttcgcgtactttaaatatgttacttaacgaatttaagtcaagttacaatttaactcaacaaaacaggttagacactaacacagattaaaccatatagtcaacggtaatgaactattaatcaaaccaatatcaacttggatccttatggaacttcaagattacatattgcagagctagaggattataaagagtttcaatttcaagtcttcacaaactagaacacaaaatgttatggattctgcataaaattagtaagtcaactaaaatggtaggaaggtattatccacacatcgaagccgcctataattccattgactatatattgctcgtcaaagtctcaatccaatagcaaaaaagtaaacctctcataaaaatcgccaccgagatattgattgttagaaaagctattataattgcacaatgataattcagttttgcaatcattaaagttgttgccagaattcatcttattacctaccccactaggccactacttcttcttcttcgtcccaaaaggagacactaatccaaacattgcaatctgtttacactaacttcgcaatcttaggatcatttctaatgaactgttcaacaaaaccctcaaacaattcagcaggaacaaacacataattaggattgatcccaagtagtatctaactaactaaaaaaaatgctgaatttgatcacaaagattgaatttttaaatccctaaatgtttaaagtaaagaagatgaacaaactcacgggaagcttttcgagaacacgcattggctgagaagaagcttggttctctgcaacttcacgttgagccattgaccaatcatcacgaagcgttctaacaacaacaaactccttcaaacgagcgtgatccaccacgcggacaccacccataaggtagactctaaggaacacagacgcaaccacaagcaacattagaagacccaagatccgacgacccacgtttctccccgatctaaacccttgaccaatcacaaccgtcgatgcaccaccataaaacggaatccagaattttcggaggagaaggtaacgaatcaccggatgactgtaaaatcggtggtagtgatcgtgatggtaatgagatccagtagatgaagcagagctttccgaagatggtgacgagtcttgaccagtcgcatctcctccgtctaaatctgttgatccaacgatgggttggttaattgtattgcagtaatcagatgaattcgagggtcgttcggagataacgtctagagaatcgccaacacggcggcgagtggtgggtgcaattggtacggggttaatcgctccgacgactgacatatcgtcgccggtgaaatagggaattgaagattagacaaaaggaaagagatagagaaagaagagagagggttgatttttaggttttggaggaagtagttgaccatgtatgtatcttctggtatagtcaccgtcaccgtgaaattcgccgaagctgagtttttgttttcagaattttttatattcgccagtgtgtctaattatatatttatgtgactgttctaatcattttttttgtttaggttttacattttttatgtatgatgtgaatggataattttcaagagtttgtcacgtttgtagcacatctttttatatgaatagttttttggatgttagtgtataaatataatttgtcatatcgtttagattaaacaaatataggcaaaagagtgattaacgtgttcttttgaaatagctaagagatactaacctatgatgattaagtttatgatacttaaactttttatcatcgagggcactctgcattgtgacgaagatgtgaagtagacctagaagatgacgcactgactttattgccactgctacaaagctaatcaactttgtaccaaatatacaaaacttcgacctctcacgatgttaaactaatggaattattagaacttaaaaaaatcggattagagattaaaaagaaatgaaattatttagagaggtagttagtaaaagtaaattcgatccagcgtggtgctgtgtcatttatttgactgggaattttcttcagacagtgaaagcaacataatcgatggatgatactatttaacaaaacaggtcgtcacacacgtgtgtataaataagtaaagcgcccactcctttctcatttcgtagcgcgcagagagagagagagagggacgatcttttctataactgaaacactactcgaggccaagttgctttagccgtaatcgtcgtcgtccctcttcccgatattatctcttctctgttcttcgatttcgaaaccctaacctcctctctttaattcgcgttttctggatcgaag

SEQ ID NO: 9667 - DNA, 2055 bp, Unknown
  misc_feature (1)..( 2055): cDNA_ID_2104915_gDNA_ID_1972165_Annot_ID_179729 3000 nt of promoter + ATG
gaattctccggcgacattagccgtctccaatatacatcttttcccggaagcggatattgagaacgagcacatatttgttggcagattctcgcaaacaatgttttcccctacaatttatagaagagaaagaaaaaaatacaataagaatcttaaaaatcaaagattcgtatgagaattaacgctttcttttttcctatggttgatcttatatctttcgtgtaattggtcaaactatgaaaatctagggttcttcctatgctgatctaaagactgatgaagattttcaatccaagacgttttgatgaatgtaaaatatgaatatgtttgtacgtacctatagccgcatggagaagacttgagagaatgagaaagattggcaatttgagggaagaaaaagacattgtttctgcgtttttcttttctctcttctcctctgtctccttttcttgatttgtaggggttaaagattttgaacctcgagatgttttcaaggaaaaatgtaatatagagagaacgtggaaataggacgcgtatatgttgaagggatgttgtggggtgtgtgtgtacatatatacaagaatgatttgttaaaaatatttgaaaaaagaatgatttgtatttactatttaatttttttgctttatgacattctctatctatggtgttactataatagtaagaattgtattttcttttgtcaacagtaaagattacattttgtatagtaattgcaaaaaaaaattcttgtgttctgtaatttttctattttaatgtctttgtaatctaattgatatttatatgcatattttgtggaaatcacaaaaaagtcatcaacttggacgtgggattccaaaaaattctcattttgttaataaaataaacctaattctagtgtgttcaaaggttgacaaaaatttgcatacgaaagatgatttatatattgtcgagttgctgctatggttaatcaacgattcaatgaactagagctttttaatccagattaaaatactttaaatgatattaacatgagtcattatgtattttcaaacttttttttatttacttttttttactattcagagcttattagtattttggtcacaggagacttttgctcagattctttgaaatcgtctacatgatactacttaattaatcttttaatgtttggtcaaacgtaatcaaaagttttagatatattgtaaaagatttagttggattatctttttcattatattattagacttttcgggtgagggtgttacttggaaacaaagcgacgtgcttacaatacatgtcttcacgtccgtatttgtctcaacgcgttactattattgtttttacacacgagctctatgacttgttgtacttcaaaattatacaaattggtatagtttcggttgaactagtaacttggaaactcaagaaattcatcctaaatacattatatctgacaagtctaattataaatcagtaataaataaaaaaagtcagattaacatctgccactagctggttatctaacttctaacgtaaacgaataactaatgttttgatgcagagcacatcagccagaataataaatttcctagtggtgtagtacatgcatttcatcgatcaaaagccaacattctttgacttttttctaggattgcattcatcaattctacaatgtacttgtttttaattctagagcaagaaacttatccaacacctacttgtaggaagctggtcaatttcttcggtttagtttggtttatactttatatggccaatttcctttgggtttgcttaaaacaaaaatttacatcaggcccaactctttattatctttgacctgccattaacaaaacaaaactggcctatgcttaatggcttaatgcttatctttttgtttaggtccgtaagagcaaagccacgtgtcataacacaagataagtggaacccacatgaatcgaatccttcgtccacctcacaatccgaatatccgatcctctctccctcctccaaaaccaaaccttccaaagtttttttcaaaacaacacagaaaaaatg

SEQ ID NO: 9668 - DNA, 3000 bp, Unknown
  misc_feature (1)..( 3000): cDNA_ID_3042953_gDNA_ID_1972168_Annot_ID_179773 3000 nt of promoter + ATG
caaagctatttttgcaaaaattgttatctagttaaggaaaagttgatagctttggaacagttctgttattgatcgagattcaacacttttgaagggtcgtatttagagggttgtaagatacatcttcttttggtgtttgcgtctatagggtattgttgaataaaggaattctcatgattcgttataaatttgcagaggttgtggaacatttcgtctgctaagttcctcaaaacatacactggccacgtgaacgcacagtattgcatttcctctgcgttctccgtcacaaatggaaagcgaatagtcagtggatccgaggacaactgtgtacacatgtgggagctaaactccaagaaactgctacagaaacttgagggtcatactgagaccgtcatgaacgtagcatgccacccgacagagaacttgatcgcatcaggctcgctcgacaagacagtaaggatttggacacagaagaaagaataaatcatcactctctctcttcagaaatcaaacatgtaggtacatgccaccttcttcatgcagtaatcatctgttgcttactaagcttgttagattgattctagcctcattatgtaaaagtctaatttttgtttggtgtaagggaagtgcaacagactgttctaaacttgtaatagttctctgtgtgactcagaactatttaggtaggtcttaaggcaaagactcctgcaagtgcaaaggcatttgagagaatgaacacaaatcttcataggtttaccctttactcattgtatctattaagctgatgcaatgcttcaccaatactattggttataaagtagtttcaggattgaaaattgttcatctgaaccatattgatgggtggctcatgggtcaaagtacagatatatgactataagtagataatgtatggtagttggttactttggttggccatgatgatgaagcttatggtcccctggtcctgtcccattttttacttttcattttcacttttatcgtaaagtcttcttttttttaaaccctacaagattttgaaatggaccacttgaaaatttgaacccactctctctttttttgttttcaatttcgaaaccaaaattttttaacaaaaagatgactttgtgacctttgttctgtcttttagctacacaccagtgggctgtttgcttttacagcgtgtctttctgtttacatgattcaagagaaagcaacagttcctaaagactcagtcatgtttgtgtctctcccaattgatacaaagaccaaaattcagctttggttcttttgtgtaaaagttctcgagatatgctaataagattaaacataaaaactctcaaaaagagtataaattgaattctttatgattgtagtagcaaacaataattgttaggtttagtgctatcataataatctattagtcaggttaaatatattcgatttggtaccaaatacgaaatcaagcttcaacaaacgaatctgcaatacacacacacccatccaaaagtatatcttcgacattttccccaaaaaagtatacatttcctaacacgtgcttaccaattcttatcattcgaagtaaaccattaaacaagaaatgttttcattattataaatttttcactaatataagtttattatttagtgcaagaaagtgcgttgcagatgaaaacttattctattgatccgggtccataaagaagaaaacaaaaattcacctaatacgagtacgacttattctagtggctacatatttccctaatcatgtgactaaaaatctgctttcaaaattttgacattcagtatttctttagatctatatcattaaaaattcatttttttcttttgcattttgattccatatttaatacaagattaaaaaaaaaaaaactaatatgtttgttcactgagcaaaccattattgttgatcagtgaactgtggtaactggcaaaagaagcaaatgattcgaaatcctactttcttacaaaatcaaattggataattttgtgagataataaaaaatcagtataaataaaataaaatacatgtcgggaaaccattattgttgatcagtgaactgtggtaactggcaaaagatgaaaatgatgcacataggactgtgtttaactgacttacttccactaatcaaaagtacgatcgtatccctacccatctctcgaggatcttaactgttgccgtgcgtcatctcaaggttgttctcgtcattatcagtcgatcagagtacagagaccggctctctgggttttgtcgatcatgccattgccttggggcttgttgttgtggtccgtcctaaggatagaaatgttattacaaagctttttaaggggttctttggttaattaagtgtttcgttttgcttaagagaggttaaagaagcgggtgtctcaataagttttggtaagtttgtgaatccccagtggtggactccatcttttcccgtcgaattataacatcaggaccgttcatttcaacatcatcaattaattcattatggggtttatctttaaaacatctttttgaatttatggttcgctttggtattgcattattacacttgtatacctgtgtaataaagtgttggattttgtcaagattaggtaacatcacgtttcaaaacaacaaggctccaaattaattaacattttcttcatgtaattatcgtttttgaatcccttcctttctaattccatgtttcattaaatccaccacatgcatatgtttctatatatgttaaataaacgacttttcaagtttttaatttgtgttttctattttcagaaaatttatgtgaaatcaaagtttcttaaaaatctccctccaagtaaattccaaaataaaataaaaataatacttttacaatatacaaataaaactcataaaaaacacacacacaatcttcatcttcctcacttactctcaccctttttaaaaccaaaccctaacttacacagaaagagaagaaaaaaaacaaaaaaaaa

SEQ ID NO: 9669 - DNA, 3000 bp, Unknown
  misc_feature (1)..( 3000): cDNA_ID_2036719_gDNA_ID_1972168_Annot_ID_179797 3000 nt of promoter + ATG
gtcttgtttgggacaagatgatttacgcatgtctgcattgtatacttacgtataatatcaatcgctgcaacatgtaatggagatcgagactactagctcttaatttatgagctaaatatataaagaaactgactctaatgacacttaatcatgtagattcttcgacttgatggggatgagtgggctctaaagacatgatgcactgagcagttcgtgattttggagaatgtgaggaaaggtaactataggaattgatcactaattcgatggtatatcggattggcaatgtaacactcataacttttgatggtagagagtttgtggatgtcaaatatcgttcaactatgagaaataacttgacttctatagttctatgagaatacagtgaaataatgccactttaggtaatgaggttttgttgtgtcaatttataatgatgatgactgcaactaatacaatagaaatactcttgtatcaacttaaaatcgttgcggaaaaggttcaatttgtgtctaaacatatatgagatcacattgttaattgtatagcagattcaaacatatgttttaaagaaaatgaatttactgatatagaagggactaataaaaggcaagaaaattcgtaggtcgattatggaagattaatgaaaaataacaaactaattcaacaataacatagttctaatcaaattgtttttttcttgctttgtcgttatgactttatgccattttattctaccatttttgtctacgctttcgtcattctcggtgttaccaatcgagcccatgacatcggtaaacatgaatacactataatgcattgcctacgcatatgtttatctttagtattttaggctttagctcatttattttaacgttaaagaagtgtgaaacaatcttttaataaatgcaaaagtagaagcacgaaggaataaaaaaggtatataccgcattcctacgcgtattctatatgtttgattttctagccattttagctttggactgtcacgtgagtcgtgacgctctaccccctaaatctatgtctatagtagtatgtacatatcagacacatgcatgaggcacctatatatttgtaaataaattatacactatatgacgtatggattcaatgataccaagagtttttgcttgtaacgcccaagattttcgaaacctacaatctaggatctaaatagtgtacctccagttataaattatatttgtcgctctagataagttagagtaatggccaaatctcgataacaatttatttgtgatctcctcacatgaatttctttggaaccaaattaatcccaaacgataggattcaataatcagttaaagttttgtagtattcgatagtgggttagagtaatgtagtgatgcaaacaagagtgctaatctattgggtctatacattggatcaaatttaatatatgggccgaactatcataccaagcgtcatgctttgaagaaagtagttgaaccaagccattatacccttttaactactaactaacccatctcaaatatccagatttaaattggtgtccatattatatgaaataagttaagactgatttgccaacaaggcaacaacaccttaataaatttaaacatctaactgaaagaaatgtatttaatcatccaactaggtacatttaagaatagatcacattcataattttgttattatcatttacaacagtcatcatggatttgtcttctctttgatcctgtcttagtgtcttgaaatctttgagcatttcttcttcttcgtctcttataatatatttaaaaggttatatatttacatatatacaactttgatttcgatactcttgagaatccaataatgaaagcgaaagtcatagagaaagagaactgcttcgtatggttggttaaggctccttttcgtctgttgatcatggcacgtgacgcctacatacgaagcattacgtcatgctccggcgccggaatttattccggtggtggatcatctggttttggtcaactctccggaaacttccaaatctgcgatccgcctagcaccgcccttcctcgaagctttaccttgacgtcggcggcacatgatcaaggctgtctgacacgtggcggacaacctacgattgcaatgagacaatcattgtccttggatcatcggaagaacaatagatgcgttgttgtgatgggaagaatagatgaggagatgtcttgtgatgatgatgatgagtttcaagaagaagactcttttcttgattatggtaattgcgagattcttacaaaagaaatagaaaaaccatctgttgaccaaaaacataagcctctaggacgattttgattttgatttttaggtttattattaggttgttgcattgtgcttattgagaaatatggatcaaacacttgaaaagaaaaatcattttgtatcatttaatattatttcttgtattacttataattgatgttaaaaaaaattacatacgattctaaaagtggtgatgcaaataattcacattgttttgttaacaaccaatgcagttctacatgattttaatatcatgagtaatttctaaaaacaaattacaacaaaaattaatttcttttaaccacaataacttcacaaaattacaaacataaaatacaaattcaaaaccacaagcacaaaaaataataatttagaaagtttatcaattactatttttgctgtaagaaaaaaagtttctcaattttatttttgtctgcaatatctttacagattccaaaacaaaacaaaaaaactatctttttatttatatatatatatatatatatatatatataaatgtaaacttcctcataagtaaattaacaagaatatatatcaaacaaaatcttgtaattttttaatataaataaagctaaacctttacgaagaagaaagactctggtgattgattctccaaagtctaaacctagtaaaagccaagtctcattcctcgggtgaactcaacaaccgacg

SEQ ID NO: 9670 - DNA, 3000 bp, Unknown
  misc_feature (1)..( 3000): cDNA_ID_2036698_gDNA_ID_1972168_Annot_ID_179801 3000 nt of promoter + ATG
aagaagaggctgcaaaatcatatggaaacaaacaattgaataccgaatcgaaacataaattagataccaaaaagaaccaatctttcatgaaattttacgattgttagaagttagaacctgttctacatgccttgaaaaaacgcatcttttcaactagattgatgttacaccgatagtttcttcataaaccacattaaagatgctatcattcttacacatagctaaaattggcaatctaaaaagaaaacaaggtcacaccaaatgcctaaagtttgctcttttaaaaactaaaagatacagaatctgcctttatttgtagaaccttgtcaaaactagcccacgataagaaactagaccacgattcaaatactattgagctgataacggtgatgtaatttggttgcaacacgatttcaattgaagaagaagaagaaatcttaaggaaggctctttacctacgaagccaattgagaaaagcttccaacaaacccattgatgatgatgattcacaaaagctccgacaaacagatccgcctgagagaattctcctccacggatctctctgagaagcttcttgtcctcgttgatctctgtcgatgatatctctctctctctctgtccagtgacggcgaattaaaagagtcaaagacaatgaatttggaccgttcgattttttatctggtataccaaatcaacggtacagatcttgtttaagtttttggttgatagaccgagaatcatggggttgctatttaaaataaatattttaaatttggattggccaatcagaggagagacacggtgacagatacaccagaagttcggaagaatgaatggatgaattactcaaccactcgcgtttatgaagcgcgtgactaacacgtatgtaccgtccgttgtttttttttggatgggtggtgccgccaaagattttggcggtgatatgatattggatagtgatcgggaagtgcacttacacgtgtcatttccaataatttatgggttgaaaacatatgtttgatgagttcttagtcatgggcctttatttgacccactagtgatgagtcgacccatcaatgattttctcctttttttattttcttgtagtatatgatgtttttgcttacactttgcatttcccatttaggacaaattaacattgaaatggacaaatggtattcaagtcatgtttatcttctacaagatacactatttgctttgtttaaattggggtaagttttttgattaatgaaaaaaaacattatgcttaatcggaataagtaaaacataattcaaaatagctttcacttgctcaaagatacaattatcaagagttggcttcattaaactgtaaacataaataaatgaacagcggagatacaaaaaaaaggtgaagaatgaattggtcaaccactaaagcagttataggtttaacacttttttattgcatgattaattatccaatagttgacaaaaaagaaaaaataattatccaattattgatttataaaaataaaaaaagttctacactagaacatattttaggaaccagagctgtaatttaatactagtttaatgtgtatgtttgatttatttgttaacaagaaatattagtaatattagattttatcccgcggtacaccgcggtaacaatttatctttttaaagttagtataattttttttttcaaattgtatctatctataatatatttttattttatagtttacaattgttattaaataacgtcctgccaaactcatcccgccaaacctgtcccgtaaaaaaaccatttatttatattaatgttgatcttatttatgatatgtttataaatcattgtctaaatatttttgtcgatgcgagatgttgaacctacacattttttgctaattggttaatatatgtttatttttaaaattttgaatcataaaatatgacagaaaaaattaagatttttttaaactctatatattatataatgatgttaaaaaattgtaatatatcaaactttttataagtttaaatattaataatgttttataaattttaaatatataaataataatatttaaaaaattaatatttttgcttataaggtaatgacataataactctaaaagcaaagatttagaagatttaaatttttaattaaatattttcattaataaataattaatctcagtgacatgacattgtaaataagttcaaatacaaaatttatttatttaaacaaaaaaggtttagtaagaataatatttatttaacaaaaaactttgttttaaaatattgttaacaaatatgtttatgctaattttaagggattgatttgaagtttggtgggattaaatttgattgataatgtgattgacaatttaaatcaaaaattttaaataaaattaattattttgaaaaaaagatttaatgctaatagcattaaattgtaaataaatctaaatttaaaatttatttgctaaaatgcctgcaaaaatgtatatataggtcaacaaaatataagtgttttcatcgaattacttttacttgtcgtctaattttctctcatttgttactattttaagccatttttaattgaaagaagtggtacatatatagcattaatgaatgctatactcaaggagaaagtatattaacgggacaatcattaaatttaccagaacgacaagatcccaataaaatgaaataaaaccaaaaaccaactcagatgagtaaacaaagtatcattcatcggtctcgtcttttggtcgcacgtctgaatccatcatcatcatcaaagacctctctttgttcccgtgacagatccttcttaaccaaacctcaccgacccttgtctttatttccccaattctactcctgggtttcgtaattacgttcccaggttcgagctttcttctccggagaatctgaaatcgaacaatttagtgtctttttctcagacattgtttacttctgagaaagcttaggtctttagactctcattac

SEQ ID NO: 9671 - DNA, 260 bp, Unknown
  misc_feature (1)..( 260): cDNA_ID_3042902_gDNA_ID_1972168_Annot_ID_179805 3000 nt of promoter + ATG
cttaatggactcctgacattccaagcgtaatgttcttttacaaagtaaaaaaaaaaaattaaaagaagaaatggcttcgcccgggttcgaaccggagaccttcagtgtgttagactgacgtgataaccaactacaccacgaaaccttttgttgttacacgtccgttaatcattgattttaactattattgacttggacaattttactgccgtcactatctctatttggtttcctctctctcaaattctccgatcaccatg

SEQ ID NO: 9672 - DNA, 3000 bp, Unknown
  misc_feature (1)..( 3000): cDNA_ID_2036690_gDNA_ID_1972168_Annot_ID_179803 3000 nt of promoter + ATG
gaaacaaaccttatgtgaaactagaatcaatcaaagactcaagttggaaaagaatcagagataggtcttctacacatgtacatcaaatgtgaaaactgttcagtcggataattgcatttgagatatgtttttttagttctatcttttttctcgaggaaacgactattttttaaggtaatgagaaagaatcagtttcatagaaatgaaatgatttgctgttaatcagagtggcaattcttttaaatccacagtaatgcttatgccaaacaaaaaattacaattgaaaaccaccaagttcgaactcaacctataccacaaacgtcttagacaacacaaaattgcagagataagtgtgaagagacgaaaggattggtctgataaattgatatgtcgtttaaagacacaaactcgtcattccaatatgttcaaaaatgaaaaccactgtcgaaaaatggaacccccactatcaaacgaaataacctaaaccaagaacactactctagagaatcatttcaactaagtcaccacataaatgaccaatatcatcaattctactgcaatagactgataaacgcaagactcctatgtcaaatcaggagttcaacaccaatctcaacacacatccaacacataatcaaaagctaaaccaaacaaacacatcattataaagaatgagacaaagagataaacttccataaccaaacttcaaatactcaaaatcaaaacataagttctcatgtctagcaccataaagatccactgacaacattccaaaatatccaaaacttgaaaattaaaaagcgattgaagataactctaaaagataaaacctttcaagaagatttcttcttccttcttacttaatcaacgttctgcataacatcctcagacgtaaacttagtacccttctccttatcagcagcagcacgtcccttagccttcctctccaaaagcgatttcctatctttatcaagacgaagcttcgttatcacaactttcgacggctgaatcccaacgttcacggttgttccattcaccttctccctcgtgattctctcgatgtgaatcacccatttgcgacggtaaacctgaacaactttgccttcacgtcccttgtaagtaccacgaacgatctgaacctcgtcgtctttacggatcggcatggatctgacattgtacttctgacgaagatcggtggagagaggagagctcattatcacacgcctctcgctggaggaagctgtgaaatgagccttcctgttctttctgcgagaagaggtcactcttgggttgtacttcatcttcgccgccgggattgagagagtctctactcttagggttttttaaggggatgaggaagaggttatgagtgtgtgtgaaggttatatagttaggttttgagtggagctaggtttactcgatatattagggctttgttatgaatgggctgggcctgttttagattttgattttaaagagttttataatgggcctcttctatgttagctacacttctggcctagtaaaagttaattcattcttggatgcaatcagtttagcgaaagaggtaaaaacaaaacgactacactgatatagttggtattctcatgttgtaataggctagctgtatcatgcaatttagagaagttttgtatcatgcaatttagaacttttatttttgagagaaacaaaagcataacgtttggatgatatattaatttaaatagagttgtgtttcaattcatatattctgcctttttagattcgattttcaaaaacacgatgcactagttgtaaaaacgttatttttatatatttaatttaacattatattcaaaaaattaatattaatttaacaaaaaaattatttttcaagcagctgtttacactttgtggagagaaagaaatgcaaggcttcacactactgtctccaaaccggctcggttacttgttaaggaaattcaagcttacaggtctataccgtcaccttttccagtacaaaattagtccatcttcaacctttcctagttcatctacaacctatcttgcttcatggtttcgctcctttcatcgatagcgaatcttttgcgtcattgatcttaatcttttgatatgtttcggtttcttgtcttgtttcatgatttctttgagctttttcattttgcaggtcaaattgtagttttcaaatgataccttggatttgagacatcaggaaaataaataaaataattagaaaattattattattattatatcagtatgtttttatacaatatattagacattcataactataatgtgatatacatcccggagaaaatctcaggtcgaaactcttacattttagaacccattgccaatgtttgaacaaggacttccaaagactcttggatatatatattttcaagcaaaataatgatgttgtacataataataatcagaggggctaacaaattatgaaagaaataagtatcatatgaagtggactttgtattaaactggccgatcaaaactaattttcttgtggtggttggtgcaaacaaattgatataaacaaataaacaatccatgttttttacgacaacgacaagtatgtcaattagtaaagaaaaataaccgatcaaacttgcactagtactatatatacacaacaatttaagctcaatttaaacctaaatgaaatctcgtgaaatttgaatgttagaacgaatgtacattttggagaacatgtgggacgtggtccctctatatgaactagaaggtttatggtgaagaaaaaggaaaaacgcatttaaagactttcacgcatataataacgatcacaacaaatcctcttaaattcatttatttcccatattactcacatttattgcccattcactgtccaaaatttccttctcttcttgatactaaaacctaaccggcgaattcgaatcttctcaaaactcacacaaattattctcattctttgatctcttctctctcggaaaaaaagacatg

SEQ ID NO: 9673 - DNA, 3000 bp, Unknown
  misc_feature (1)..( 3000): cDNA_ID_3042908_gDNA_ID_1972168_Annot_ID_179800 3000 nt of promoter + ATG
acatggttaaatgaatcatgaaaacacatcccacaactgtagatactaaaccaaacggtgaacaacgcaaaaacgttgctttcttgttgtgtttgttcttcatcaccctcatctttgtttccaaagatttatctccacaatacacaacctatgtagatccatccacacaaaaaaaaaaaaaaaagaagtatacaagtgtaagtgtctaaagttaaatacaagtgttctataactaattactcttttgggagatgaaattttgaccttataacagatttggcttacacataagagggtcaaattgtcaattttagcaagttgattagcacaaatttcgataccagatccaaataagcacaagctaaaccctaaagacagctaatttccagcggaagatgaacacaaaagttcaataaacacagaaaactaggagacagaaaaacctcgggatcttacctgaaaaagaagccggagctgaaacttccgacatgtaatgagagtctaaagacctaagctttctcagaagtaaacaatgtctgagaaaaagacactaaattgttcgatttcagattctccggagaagaaagctcgaacctgggaacgtaattacgaaacccaggagtagaattggggaaataaagacaagggtcggtgaggtttggttaagaaggatctgtcacgggaacaaagagaggtctttgatgatgatgatggattcagacgtgcgaccaaaagacgagaccgatgaatgatactttgtttactcatctgagttggtttttggttttatttcattttattgggatcttgtcgttctggtaaatttaatgattgtcccgttaatatactttctccttgagtatagcattcattaatgctatatatgtaccacttctttcaattaaaaatggcttaaaatagtaacaaatgagagaaaattagacgacaagtaaaagtaattcgatgaaaacacttatattttgttgacctatatatacatttttgcaggcattttagcaaataaattttaaatttagatttatttacaatttaatgctattagcattaaatctttttttcaaaataattaattttatttaaaatttttgatttaaattgtcaatcacattatcaatcaaatttaatcccaccaaacttcaaatcaatcccttaaaattagcataaacatatttgttaacaatattttaaaacaaagttttttgttaaataaatattattcttactaaaccttttttgtttaaataaataaattttgtatttgaacttatttacaatgtcatgtcactgagattaattatttattaatgaaaatatttaattaaaaatttaaatcttctaaatctttgcttttagagttattatgtcattaccttataagcaaaaatattaattttttaaatattattatttatatatttaaaatttataaaacattattaatatttaaacttataaaaagtttgatatattacaattttttaacatcattatataatatatagagtttaaaaaaatcttaattttttctgtcatattttatgattcaaaattttaaaaataaacatatattaaccaattagcaaaaaatgtgtaggttcaacatctcgcatcgacaaaaatatttagacaatgatttataaacatatcataaataagatcaacattaatataaataaatggtttttttacgggacaggtttggcgggatgagtttggcaggacgttatttaataacaattgtaaactataaaataaaaatatattatagatagatacaatttgaaaaaaaaaattatactaactttaaaaagataaattgttaccgcggtgtaccgcgggataaaatctaatattactaatatttcttgttaacaaataaatcaaacatacacattaaactagtattaaattacagctctggttcctaaaatatgttctagtgtagaactttttttatttttataaatcaataattggataattattttttcttttttgtcaactattggataattaatcatgcaataaaaaagtgttaaacctataactgctttagtggttgaccaattcattcttcaccttttttttgtatctccgctgttcatttatttatgtttacagtttaatgaagccaactcttgataattgtatctttgagcaagtgaaagctattttgaattatgttttacttattccgattaagcataatgttttttttcattaatcaaaaaacttaccccaatttaaacaaagcaaatagtgtatcttgtagaagataaacatgacttgaataccatttgtccatttcaatgttaatttgtcctaaatgggaaatgcaaagtgtaagcaaaaacatcatatactacaagaaaataaaaaaaggagaaaatcattgatgggtcgactcatcactagtgggtcaaataaaggcccatgactaagaactcatcaaacatatgttttcaacccataaattattggaaatgacacgtgtaagtgcacttcccgatcactatccaatatcatatcaccgccaaaatctttggcggcaccacccatccaaaaaaaaacaacggacggtacatacgtgttagtcacgcgcttcataaacgcgagtggttgagtaattcatccattcattcttccgaacttctggtgtatctgtcaccgtgtctctcctctgattggccaatccaaatttaaaatatttattttaaatagcaaccccatgattctcggtctatcaaccaaaaacttaaacaagatctgtaccgttgatttggtataccagataaaaaatcgaacggtccaaattcattgtctttgactcttttaattcgccgtcactggacagagagagagagagatatcatcgacagagatcaacgaggacaagaagcttctcagagagatccgtggaggagaattctctcaggcggatctgtttgtcggagcttttgtgaatcatcatcatcaatg

SEQ ID NO: 9674 - DNA, 3000 bp, Unknown
  misc_feature (1)..( 3000): cDNA_ID_2036748_gDNA_ID_1972168_Annot_ID_179789 3000 nt of promoter + ATG
tttattatattcgcaagtgttataacatgaaaaaaaaaatttagatgtaatggcaatggtctagccaaaatagtaaaaacaaaattaaaaaacttctgtatttaaatactgttttaaaaataaaaaattagatgtaatggcaatggtctagaataaaaccgtattaaaaaactagtttggagtaaagaaaatacggttttattctctgacaaaacatatattctctttattgttattgaatccactctaatttttttggttagaatttaaattgaaaagtatggaccaaaactcatacttcttttttcacaacataaattctaaccaaaatattttttctatatgagtatggacctaaatttctttctttttgctgtatctttacattccaaggttcgctaatgtgttagcagatttttaggctaaaaatgtcttattgtttgtaatgctacctcctataatgaagttcaattctttcagtaagggaagtaataataaaagatgaactgaaaaaaaagcactcaagaaagtccaaattgttttggatttggtcataaatctcatggtgacatttatgaattatctataaaaattctatatcaataaaagttgacaaaagaaattatatatatgtatcaatcaattttcgatttgagataagcataattttattcatttttcatgtggttttaattgttctcacgtatatgtttgaccattgaaatcaatcagttattactgtttggcgcgaccttaactagttagtcatcgaaatcaatctagaagactaaaacggaaatgagataattattaacgtcaagaactttctattcttactaaattcaacgtaccatatctagaataatggattttatcttcactaatctacaattaaatatttgttttttgttaaatgacataaagataggccggagcttctacttctagcatattaaactagccacgacatggagttatataaaatttgaaaattaagtaagaaaatatcaagttgctcaaaaaaaaaaaaggggtaagaaaatatcaaaagagctattaagaatttggtaagaaaaaatcttaggtatctgaaaacatggcaagaaaaaaggaaaaggagaattattcatgtccgaagaagaatatatgtttatgttgttggataaaaagaaagatgatcacgaatattttggagttgggatcttgaccgaagaatgttgggttacttaataaatcagcaattaaaaatgcttcttctttaaactttcggtttctgaagatgagtacttcattatctatatgtattaagataacgataacgcttatcaacattcaagggtttatctatcattttccagacctaccaaaaaagacctttcataataatttcataaagccaatgaaaacaagattaatttttaaaaaaaaacaattgagtgatcgaatctcgtagacaaaaaattattttacttattttttgaaatttatttacatgacattaggttaaatggttaaagaggaaagttttgtttcagtttcaccatgacatgtcagaaatttataatttatgtttccacataatcagcaaatgatttaaattcactatccataactcttttttaaaagtaactcttatattaatcgtacgaacttcgaagcaggctggatacacgattaccgactcagttaactgtctcttatgcatatgatcatgtaatctcttatgcatatatgtaaaaagcttacgacacgtgtgacgtattttacaaatgtgaatggaattaaatattcatcatgtgtttgaaaagtgtaagaagactttactaacctcttttccctattcttttgaccagatttttgcataatatatatgccttattatcccatgcgtgttttatgagttttttttttctttttctgaaagattgtccagagtattttatttattccttttcatttattttgtgatcttattatgttagccatttttgttgattgtcacccaaaaaaagaagctaatatatggtcgtaactcgtaatgcatatgttcgtttattcatttatttttcgatagatcggtggtaccttactactctagattgtggaaataaacaaaataagcaattcaactatgacgtgggatgaggttttctatcttcgacgacattctagaataccttacaaaactacaccattcaactgtttttgataaaatatttggtttagtttcacaggtatactttccattcatatgcacgtgaagaggatcattaggtgaaccttttccgctcttgcatatatgcccaccaccaaaccaagtttatttaaccctcgacgaaatgtttttttctttaatcattacacacacatttatattattgagatatatgacttgactatgattttttcacattatattatatatctttggttggctataaatctactcatattacatgcaaaacatggcgcacaaataaaactttcttcgcactaaaacatacgataagcataaatgttcgaatagcccactcattgtttaatttgaaacattttcgaaattaaatcaaaatgtgtatcgtcttgttctcatccaacggtcaccttttttccgtggtcacatgatattttgcttttttgagcaatcattcacacacagcaacaacatcaaataatttagtagggccgtaaaattataatctaacacggcatgaataaagagcatcttcttatataattattactaactaacataaaactataattcaataattaaaatttgagcgatatatatgactcgttttatgacgccataaaggtagttaactttaccctttataagtttctatggttcacatttggcagcatctcgctatttgtcaactcgtgtatcactataaattcacctaactggcttcatctgctattcatcctcacatcttataattctctatctctcttctcaggctcccattatctttctctattttgcaaatcagt

SEQ ID NO: 9675 - DNA, 3000 bp, Unknown
  misc_feature (1)..( 3000): cDNA_ID_2036791_gDNA_ID_1972168_Annot_ID_179776 3000 nt of promoter + ATG
aagcttctgttccatgcccgtgctgcgcataacctttgatcatacaattgaaagataccgcattaagttccggcattctatcaaatacccaccttgcgtcttgcaggtttccgcttttgtaatacaacgaaatcaacgcgttgttcacagagattctattcgaagggatgtgagatttgatcgccaagccatgaatctgcttgcactgagaaggagaggagagattcgagcaagcgcttgtgacacagacaaaactgcaatcatcaggtctatgtccaatacgttgcatctgtctaaaactcttcacagcttcttcagagagttcctcgttcattgaatatccagaaatcatcgtattccaaacaaccaaatccggcgatagaatctcttgaaataccttctcactatcatacataccatcacaacccccgcattttgagtaaaaatcaatcaaaccacttcccacatgtgagttctggtgaaatccagccttgatcagcttaccgtggaactgacggccaccgatcaaatgatccaagctagtgagagcatttaaaacacttgccaatgtaaacatatcaatcttgaatcctttaaagatcatttctttatacaaagctaatgcctttgctccttccttgtgctgcccataagccacaatcatcgaattccacgaaacttcatctcttaattcatccatcccataaaacaccgataccgcctctctcaaaagcccgcctttactataatacgtaacaaacgcgttattcacagacgagtacgaatcaaaccctcccgagacagagaaacagtgaagctgctttatcaaatcaacacggtcacaacaagctgctatcaaccctgataacgtaaacccatcaacctcaaatcccaattttctcattctcttaaacagaaccattgcggcaaaagtttctctagcatcagcgtaccccgagataagagtattgtaagagacagtgtctggttggggaatttcgtcgaacaactggcgtgcaatatggattttcgaatctttcgcgtaagctttgacaattacattgtaagagaagacattgggttcttccgtggagtagaacgcggctcgtgcgtaggaaaggcgaccacatttggagtagagattcacgaagtgatttgagagataagtggacgaagctacaatggatttcacgtagagcgcgtgaagtgatttcccagtgaagagatctctctccgctacagatttcagtagaaggtctcgaaaagttttgaacttccatggcgtctgattcatctaatagtgacaagtgaacctcagagattgtatgtttctcgcatttgcaagttctgttttcagaagaagactggtaaacaaagtcataagttttcgtttcgtctcttatttttcgttaattgacttgggcttagaatctgttcaaggcccatttattatgggctcgtttattttttaatttttttgggcaagcacgtgatgatatatacagtgggatgttatttgtgtgcgaattaaatagagtttttgtgatttaaatgttatatagaatctgttgttattcagttaaaattttttaaaagtttattaaaatctagtgtattagtttaaaatttgtaaaatgcgatctaaaattttcatgcagttatttgattcatacttttagaaagtcaataaaatttttgtgttattcaattaaaataaaagaatttatgattattaatgaattaaattattatgttattagtttataacttttgatattttcctttacaaaataaagtcatcaaaaatatcattaaaatagaaagattatttggaaaactttataagattgtggaaaactaatcaacaagattatagaaaactctctagatctaacaataatttagaatctttctattctttattttgtatgcttttattaaaatcgtcaaaaaaaaattgtaaattagaaacaataacatctttaaatcaaaagattcataaccagaaattgtgaataatacacttttttttttaatttggaccttgtgtctgattaaccctagtggcatgatcatgaaattatcgagttcggatctaaatgtccaaatccgaaatggatcttaaaattttttctaagcttagtcttactggcttcggagatattcaaattcccaaaactcccaatcaaaatttactatttattttcaatttggcggccactttttcttcagatttaatatctctaatgtccactagttttgtattataagcataaccgcagtaataatcataaacatctcagataactcccgaaacacaattggtgaaatccccaacacaatatcatgacattcgatctaaaaatagattttgtattgttttggtcgctaattcattgtcatgtatgtatgggcggtgaccgaaaacgcgttttatggacaaaactaattttgttttgtttaactatgtgtcaagctttctcttttctctattctacttcacctatccaattatcattattatcgttttctttatatctctcatgtgtttgtgtaataatatatatagtgagggttaaacaatattattctacttcctctaaaattttataacgttttagtctacttctgtttttaattaacccaatttcacacatacttcaaaatttgaaataattgttgagtctttttcaatttaactttatatagagataggaagagagattttctttagatttgtagtataagattagcaaaatatatactaactgacgataaatgattactaataaattactagctacgtgacgtcaagtaaaaaacggaagtatatatatatatagctcccacaagcaaccacattccacatctcactcttcagtcttcaccaactaactaaaacctaattcaacatatctctctcatttaccgttctcccattcttcattagtcatctttcaataaaccaaacattctttttgatttttatatcaaaaaatg

SEQ ID NO: 9676 - DNA, 3000 bp, Unknown
  misc_feature (1)..( 3000): cDNA_ID_2036781_gDNA_ID_1972168_Annot_ID_179779 3000 nt of promoter + ATG
aaccagtaatcatagcattccaaatcgcaacatcatctctctcaggcattttatcaaacacctcaaaggcatactctatatcaccaagcttaaaacttgcactcagaagcgtcgtccatgaataaacatcaggttcatcaatctcgtcgaacttcttcttcaacgaagctaagttccctaatctctcatatagcgaaagaagcgtattggaaacgtgagagtgacacaataaaccagagcgaatcgcatagcaatgaacctgaccaccaaagatagtatcacggaggtgcctagctgtagtaatagctaacgagacactgtactggtctggtctcagagttgtgcaacggtgaacatcggcgaagagcttgagagcgtttctgttctcgccggaacgagtgagacccgttagtctccggtttaaattgagcaacgtggtagagttttctgctatggctgataaactctctgttaaacatagagcttttctcatcagtcatctatagctctgtgagtgaagaaagttgtctcttttaggtttagggctttagttttctgctatatttgcaaaacagagaaaaggagaagactttataagacgaaaacgccgtcgttttagagtgtgaagtgagagatgcgtagattctctaccattgttgatcttctcatcagcaaaaaaccatcttctcaagcaaattctagaattgatctcatttgtaaaaggttccatatttcaagagttctcaataacgatttcgtagaatcaacagagagaaagaatggggttggtttagtttgtccagagaagcatgaagatgaattcgccggtgaagtcgagaagatttacagaattttgcggaatcaccattctagagttccaaaattggagcttgctcttaacgaatcaggtattgatctgcgacccgggttgatcatacgagtgttgagtcgttgtggcgatgctgggaatctaggttatagattctttctgtgggcaacgaagcaacctggttattttcatagctatgaagtgtgtaaatcaatggtgatgattcttagtaaaatgcgacaatttggagctgtttggggtttaattgaagagatgaggaagacgaatccggagttgattgagccggagttgttcgttgtattgatgcggaggtttgcttctgctaacatggtgaagaaagcagttgaggtgctcgacgaaatgcctaagtatgggttagagcctgacgagtatgtttttggttgtttgttagatgctttgtgtaagaacggtagtgttaaggaggcttcaaaggtttttgaggatatgagagagaagtttcctccgaatttgcggtattttacttcgttgttgtatggttggtgtagggaagggaagttgatggaagctaaagaagttttggttcagatgaaggaagctgggcttgagcctgacattgtggttttcactaacttacttagtggatatgctcatgctgggaaaatggcggatgcgtatgatcttatgaatgatatgagaaagagagggtttgagccgaatgtgaattgttacacggttttgatccaggcgttgtgtaggacggagaagagaatggatgaggcgatgcgggtttttgttgagatggagaggtatggatgtgaggctgatattgtgacttataccgcgttgataagtgggttttgtaaatggggaatgattgataaaggttatagtgttttagatgatatgagaaagaaaggagtcatgccgtcgcaagtaacatatatgcagataatggtggctcatgagaagaaagaacaatttgaagagtgtttggagttgattgagaagatgaagcgaagaggttgtcatcctgatcttctcatttacaatgtagtgataagattggcttgtaagttaggggaagtgaaagaagctgttcggttatggaacgaaatggaagctaatgggctaagccctggagttgatacgtttgttattatgatcaacggatttacaagccaaggtttcctaatcgaagcctgtaatcacttcaaagaaatggtaagccgaggaatattctctgcgcctcaatatggaacgctgaagtcattgcttaataaccttgttagagatgataagctcgaaatggcgaaagatgtatggagttgcatatccaacaaaacctcttcctgtgagctgaatgtatcagcttggacaatatggatccatgctttgtacgcaaaaggtcacgtgaaggaagcgtgttcgtattgtcttgatatgatggagatggatttgatgccgcaacctaatacttatgcgaaacttatgaaaggattgaataaactgtataataggacgatcgctgcagagattacagagaaggtggtgaagatggcaagtgagagagagatgagttttaagatgtataagaagaaaggtgaggaggatttgattgagaaagctaaacctaaagggaataaagaaggaaagaagaaagggacagatcatcaaaggtataagggaagaggtgaaagaagtagggctaaagcattgtaacatttccaaaagaagcatgtttagatttgtagctgaattaaacagtgtttcatgtttttgctttgtttcatcacattagttcggcaccgttgttaggaatttatactcaaccgaattaaaccgagattattactgaatcactgccaattttgtgtaaccgaatgagtaaaccgaaacatatccggtttaattcgattatagtctcaaaaccgacaaataaaccgatccaaggctaaatataaatggaatcgagtcttcacacaaacaaagtcactgctccggtgacgaacgagaagctttgttccggtgacgatcatatttgatatttgtggatgagcgtaacaacaagttttggaatttggctgaatcacataaaccttgataatcaagcaagtttcttgtataacaacccccatttttgtaatcgtcgtttcaatcgtatctcaatg

SEQ ID NO: 9677 - DNA, 3000 bp, Unknown
  misc_feature (1)..( 3000): cDNA_ID_2036752_gDNA_ID_1972168_Annot_ID_179788 3000 nt of promoter + ATG
acgagttacgaccatatattagcttctttttttgggtgacaatcaacaaaaatggctaacataataagatcacaaaataaatgaaaaggaataaataaaatactctggacaatctttcagaaaaagaaaaaaaaaactcataaaacacgcatgggataataaggcatatatattatgcaaaaatctggtcaaaagaatagggaaaagaggttagtaaagtcttcttacacttttcaaacacatgatgaatatttaattccattcacatttgtaaaatacgtcacacgtgtcgtaagctttttacatatatgcataagagattacatgatcatatgcataagagacagttaactgagtcggtaatcgtgtatccagcctgcttcgaagttcgtacgattaatataagagttacttttaaaaaagagttatggatagtgaatttaaatcatttgctgattatgtggaaacataaattataaatttctgacatgtcatggtgaaactgaaacaaaactttcctctttaaccatttaacctaatgtcatgtaaataaatttcaaaaaataagtaaaataattttttgtctacgagattcgatcactcaattgtttttttttaaaaattaatcttgttttcattggctttatgaaattattatgaaaggtcttttttggtaggtctggaaaatgatagataaacccttgaatgttgataagcgttatcgttatcttaatacatatagataatgaagtactcatcttcagaaaccgaaagtttaaagaagaagcatttttaattgctgatttattaagtaacccaacattcttcggtcaagatcccaactccaaaatattcgtgatcatctttctttttatccaacaacataaacatatattcttcttcggacatgaataattctccttttccttttttcttgccatgttttcagatacctaagattttttcttaccaaattcttaatagctcttttgatattttcttaccccttttttttttttgagcaacttgatattttcttacttaattttcaaattttatataactccatgtcgtggctagtttaatatgctagaagtagaagctccggcctatctttatgtcatttaacaaaaaacaaatatttaattgtagattagtgaagataaaatccattattctagatatggtacgttgaatttagtaagaatagaaagttcttgacgttaataattatctcatttccgttttagtcttctagattgatttcgatgactaactagttaaggtcgcgccaaacagtaataactgattgatttcaatggtcaaacatatacgtgagaacaattaaaaccacatgaaaaatgaataaaattatgcttatctcaaatcgaaaattgattgatacatatatataatttcttttgtcaacttttattgatatagaatttttatagataattcataaatgtcaccatgagatttatgaccaaatccaaaacaatttggactttcttgagtgcttttttttcagttcatcttttattattacttcccttactgaaagaattgaacttcattataggaggtagcattacaaacaataagacatttttagcctaaaaatctgctaacacattagcgaaccttggaatgtaaagatacagcaaaaagaaagaaatttaggtccatactcatatagaaaaaatattttggttagaatttatgttgtgaaaaaagaagtatgagttttggtccatacttttcaatttaaattctaaccaaaaaaattagagtggattcaataacaataaagagaatatatgttttgtcagagaataaaaccgtattttctttactccaaactagttttttaatacggttttattctagaccattgccattacatctaattttttatttttaaaacagtatttaaatacagaagttttttaattttgtttttactattttggctagaccattgccattacatctaaattttttttttcatgttataacacttgcgaatataataaatttggaaccatatggccattctgaaaattccggtttgcatgtgaacactcgaattataatatggtacaagtagtaagacgttcacattttaatgatgactaagtttcttcaaaaaaaaaaaaaaaaaagtgtttattcaaaaaaaaataaaaaaataagaggtgtttatttttgtgaaccgtcagcattaaccgaataaaaaccgaaatttttgtggtcaaaccaacaggttaataatccggttactgttattggtaaactttattttcaaatgtcgaacatatgggcttaaagcccactactagtataaagaatagtccaacccgatccaagctaattcgacccgtttgtttctgatcccaccattgttaacttaacgaacccttttttgttcatgcatgcaaatgcaatcatgctcttcttctattttcttcgatacaattttctcgtctacagacgtttgtttctctctgtaaggcgatgaatcgcgaaaaattatacggagctgacaacgacgatgatgacgatataggtgaaggcctcgaagatttaagactccgagaccaattccggttcagttggagtaatgtcgtcagattcggagagtgaagacaaagacgaagaagattctctgcatttgaaacccttcacgctattcgtagacgataaatatctgcttatcaaaatctcggtgagctcattggttaagttaccgttcgatatttgtttaattgtttctcaagaacctgggatcaacaacaaaaaaaaacctgggctcaacaaaaaaatcttcaatgagggtattttcgtaatttactgtcacggaaatccctagtgccctaaaaagaagctgtccatttgtctattgtctctgatcttatcctgtcttttctcgtacttcaatctctctttctctatctcgatcctgtcgtgttcgtacttgatacctgaagtccgctaatg

SEQ ID NO: 9678 - DNA, 3000 bp, Unknown
  misc_feature (1)..( 3000): cDNA_ID_3042949_gDNA_ID_1972168_Annot_ID_179774 3000 nt of promoter + ATG
ccagaggctagacttcacttgtgacgatgtcttggactctctcaaggaagacaacatcatcggtaaaggcggtgctgggattgtctacaaaggcactatgcctaaaggcgacctagtcgcggtcaaacgattggctacaatgtcccatggatcttcccacgatcacgggttcaacgccgagattcagacgctaggtagaatcagacacagacacatcgtgagactgctcggtttttgctccaaccacgaaacgaatctccttgtgtacgagtacatgcctaatggtagccttggagaggttcttcatggaaagaaaggaggtcatttacattggaacacacgttataagatagctcttgaagcagccaagggtctttgctatctccaccatgattgttccccgttgatcgtccatagagatgttaaatccaacaacatcctcctcgattccaacttcgaagctcatgtcgccgactttggtctcgccaagttcctccaagattccggtacttctgaatgtatgtccgcaattgccggctcctacggctacatagctccaggtaacaaatttgcagaaaatggcatttaatcaaacacttggtggtgaaatgtaaaatctctgaacttgtttgttccttgttgagcagagtacgcgtatacattgaaggtagatgagaagagcgatgtgtatagtttcggtgttgttcttctagaactcatcaccgggaaaaaacccgtcggagaatttggcgacggcgttgatattgttcaatgggtgagaagcatgacggattcaaataaagattgtgtgctcaaagtaatcgatcttagactctcttcagttccagttcacgaggtaacacacgtcttctacgttgcgttgctctgcgttgaagaacaagcggtggagaggccgacgatgcgtgaagtcgttcagattctcactgagatcccaaaaattcctctttcgaagcagcaagcggcggaatcagacgtgactgagaaagctccggcgattaatgaatcgtcgccggattcaggaagtccaccggatcttttaagtaattagactttccggcgattgggtttggtcattgaggggcaaatttgtctttctaattttcttgtcaccgacgtctcggtagtggagttaattacttaattagcccgttgttgtctggttccggttaaggcaacaattagtggtttaactcttaaggttgttgcatttcttttttcactgctgccacaattattcgtgtaggaattttgaatatgtacattgcggttgaattttgcatgataagtggttaatttcaggaaatcgaatttcgagaacattatggcttatgcatatcagcatatatatacatgcagttatgtatatgatcaatctgcccccggttcaagtatgtcaattgtgttagaccaaaaaacacttttgccccttatattcttaagaacttcatttagtttcatactcaagcaaaaactaattttttagagttttcgttgtcttaaaatgaaactagtgtctccattatgctggaatcttgcttatgagttgttacattacatattttattctcacctttgcttttacccttttggattgtatctggttgtggtagctgttgtgtcacaacaagacattccatgtgaaaaaaacacagagagggtgaaaccaaggtatgaatgtgtttgtgtgggactgaagatgagtaacgctgagaagagagaaagtgaaagctcactcacaatttgtccaattattgcaaatgtatgggtagtgtgacactagtgtcttaatgaattcagatggtcctaagatcttttttccactctattcccttgtcttgaagcaaaaatctaattttagacgaagcatttatgacatctccctctcattaattacaagccatatattcaactttgattttgactcatcaatatcaaaaaatctttagactttaggtgttgttgctatccttggtatctagtactttcttcgataaccatgactattatattgagataagaaagatataaagaacaataagaatattagttatgatattttagatgtattatgttcaaaatttcttacgttcgaatgtacattgatgatcttgtaaacctaattaaggagtgcctaactctagaattaataagtcaggagttagttatcaagaaactagaaagacttgaagatggattaaagtggtaattaatgtttttcagaggccaagattctaattaagagatgggaaatggcatgttccattctctagcttcatatatacacttatcgggtgaaactaccagattacgaatagccattagatgactaacaattgaattcaatttaaatcatccaaagatatattttatatattgagattctttcttcatctcaaacttctaagttctaacatagtcatgtagttgaactttcgggccgaggcccataacaactccatctacttaaacgaaggttagataaagggacgaacaaaaagaatcagtctggtgtcagaaactagagtatgtacttttgtgtttgaattgtaacgtttgtttctttcttcagctcttcattggtttatcgacacagtacttatgtcactccaattgtgagaaaatcattctgcacagtcgtttcgaaatcaaggaaatcaaacaagagcaacaacaatccaaagagtaccaaaatatatttggctatagagagctatcattgtcttgtacacttgtccatgttgggctatagatccatatttgtgttgggctaggctcagtttttcttaataacacaaacttacttatcaaacacgtgttgtctttttggttatttaagtagttgacaaacaaaagtacaaataagctgttagggcaaaggagcaaaaacgaaaccacagagagaaagcctccgtctcccttatcaaagaagaagaagacgtgtataacaaaacactagacacattgtgaagatagaaaaaa

SEQ ID NO: 9679 - DNA, 3000 bp, Unknown
  misc_feature (1)..( 3000): cDNA_ID_3042984_gDNA_ID_1972170_Annot_ID_179837 3000 nt of promoter + ATG
actcagcagacggtgaccaattctgggaacatagtggggaacttgacagaagtgatcgaaattgatacaccgattcaggcggttcgtaaagtggactacctaagcctgttggaacttatctcacaacttgggacgaagcacttcttgggtagttcaaatcaaattgaggggaacgagtggagggcacgttttgtacggaacttttggtccactctctccctgaaggattacaagaagtacagtgtccatttcttggaaggtgatgcgcataactagtggcttacagtaaataaattcaaaggtgagcgtatcaaaaccttcaacggctttgaggacgagttcaacaggaagttcttcccatccgaggcatggaacctgttgagagttacttcttggatcttgtccagggttgccgtacggtctgcaaatccgaagaggaattcaacaaaccaagacgttatgtgggaagagaactcgaggacaaagtagcgcaagtttgttgatttctccgaggccatagggtagacttaaggacccattgctcggtcagtaccttcaacattgtctaagaactggttgaaatggcgacattgatcgaggcaaacctcgataaggagtataggatccgcccaaagacgggtgataatccaaagaatgaaaagacaagataattctaccaactcgacgataaaagcgaatgctgggatggaaagggggcatgtgagaggtgtggaagtatgagtcacagtacccaacattgctcggggacaggataaatgcagacaagagtgataccagatcaccaaaagttgtgctaccgctgtagtcagacggggcattacataagggaatgcccgcagctacaagcggaggggtcagttggtgaaaagggaaatcgggtagggagtgagccatccggacaggccaaaagagttgccatggcaccccgcgtgtaacacccccgaaccatcctaaaactaagaacaatttcggaagaaccacgtatggttggcaaccgccagcacacaaatccgactaaagatcacccaaggccaggcccgaccatagaagaccgctcctcgcgaccacgagacttaaaggctttgcaacccataccgcgaccgcgagttgggattagtccggactagactactgagaggatacacaagatctttaagaaaaaccaatttcttattcatatagaatgtattaaaatacattaccaaatacaagtataggattttggtacaaaagccaaaacttaattcagtcgtacataaaatacaaaaataccatctaccaaggcaacacaaaactaaaccatgcttaaactaaggtttacaacaaaggttacctgcaaaagagagtgggggatgagcgctactcgcccagtaactcctagctccctctaacaggcaataattccctaacccaaaacccaaaataacaagtagtatgcggaagtataacaatattgaaagcataatctcaagaaatcaataaaataaacaatcaagctggttaccatgagtacgtcaactaaatggaaccacatgcaacacgcaatcaagaataactagaaacttaccttgattcggctgaacggtttagactcgatctaatcctaatctaaaataagccttcgatcgcctaaataatctacttggtagagcctcgacattagagctcctcgggatgaactagtcgtacctgaagaagaactagtcaacactcgctcatggactttttagagagattttggcgtttcggtgtgaatgaagaagaataaggcagaatgactatttataggggtggtaggacggtttgggaagcaccaggtggcgagataggctcaaccgagcttatttgtaactttatccaaaacctgcagacagacttgaattattatccatacacggataaacttggacgatcttatttgtatggaacggatagacatgaatgaacttatccacaagttgatccttatctgcttccatacttatccaaaatttcatacttatccacactcgttcttatttgtacctcatccttatccactcacgtccctatccatacttcatctttatccactttcgtccctatccattattgttcctatccataaccatacttatccaaaatctcatctctatttgatttcaccatacttatccaaaatctcatcttcatcattataggccactcgttcttcttacctgcttacacaaaagcaacactctcggctatacactaggcccgatcagttacaagcccatatcatcaagcataatctacatgatccattccctcaacacatcaacacattaatctcagtcagtctagtccatgttcctcttgactcacccatccggttccccgaccacttgctcacaagtatccccaaaactgcgagatcgttggtcggacgaaacaatactcgtcccgtaaggacttctttcgaatgctccgattgtatggcctgctaaatctttaacgaaaattcctcggcctagtcctagtcttggtctgaggcattacactgcgtgtatgagttaacaaaggaaactggcggggccggtaacttcaatttgatcactggtaagtcaataagccatcctagtaaaatataaacaatgcatatcatgtttgggggtagggtactcaacattgagacgatgtatggggaccctacatatttgactatggggctacgcagagttttgtgagaaaagggaagttccataaggaaccaaaaatgtatcctaccgcagtgaatgttgcgggcaggcaggctatgacttaatcatcatactgctgattggttaggcaagtttaaaccaaagttggactgtcactgtagtgacccgcataagggcaccgagaacgggcaaaagaccatatgagagaaagttgccctaaaaacacggctgattgatcattcatgcccaaaagataataaaccatcaacggggaaaggaaatatctatttgggcaaag

SEQ ID NO: 9680 - DNA, 3000 bp, Unknown
  misc_feature (1)..( 3000): cDNA_ID_2185103_gDNA_ID_1972170_Annot_ID_179840 3000 nt of promoter + ATG
cgaaagaacgaaatcacaaggtaaggtcagatacatcccacatgaccgtagtatgcttatggagttaacttggatactcccaagttccacacactacgaccttccaatcgacaatatgaaacgtgcggttcgttttcaacgcgcatgaacatagagtcctcttactaagtctactgaatactagcgagtagtgtcttgacaacgcaaccatccctctcgaatgaatggtgctaagctaacacaaccactcctataggatatggtgcttcggtctcaactgtcctagctattcgaataaacaacctcaataataacaaccacaaagcaaagaaaagagagaatagagaacatgcaagaagaaacgaaaatcaaacatgcaaaacaaaaaccggaactcacaatcaccgatgaaccttcctaacttgaccgatggtttctactcggaaactctctcagactatgctgaggctcggcgatctctaactctctcttgggttaaaagactcggacgaactctctctcacgggttaaaagactcggacgaactctctctctcacgggttaaaaggctcggacaaactctctttctctcttggtttgggcagagctttggtgcgaaggcttctaagggttaactaagcgagggttgggttctatttatagagtgaggacttgtgtaagggaagggagataaaacttggtcaccaagttggctctaggacgaaacttgctcaccaagttggctcgcccaggtggattcggctctaagttggctcggatggcttgggacgaaacttggtcaccaagttggcttcgcccaaatggatttggcttcaagtttcaagacttgggctctactctggcttctgcgggttataaatactcggcccctcttctcattctcgcaccattctctcttctttttctcttgcccttctttcttgcccgggatcaatgcgcggggtactacattgacagccgctccaattctagcagtgcgggagccaaataaaccatatgctctttataccgacaactcaagtgttggcttgggatgtgtccttatgcaagaaggaaaggtgattgcctatgcatcacggcaattaagacgacatgaggagaactatcctactcacgatttagagatggctgctgtagtattcccattgaagacacggagatcatacctatacgggaaaacaatacacatgtttacgaacaaccaaagtcttaagtacttattcacgcagccagatttgaatctacggcaacggagatggatggaattcatcaccaattatgatatgaagatttagtatcatccggggaaggctaatgtggtggcaaacgccttaagttgccgaaaaacggaagtagatgttgagaaagatctagagtcactaaccgatgagttcaagaaagtaagtatgttaactttaaaaggtgaatctagtaagcccttgggtttgcaagctgtgactcaagcaagcctacttcaccgaattcgagaggaacatgtgcaagatgaaaagttgcaagaaatcgtggagaaattaaagacattaaatggtccgaatgctagtggttatcatctagctgatgacgccactttactactcaatgggaggattacattgcatgcccgtaaaggattacggtaagaaattttgagggcagcacatacttctttattaagcattcatcaaggaagtacaaaaatgtacaaggacataaggaggtattatcattagcctggaatgaagagatcagtggcaaagtgggtaatccaatgtgattcatgccaaagtgtgaaggtggaacatcaagtgcaagtaggtttactacgcaaactaccaattcaagcatggtgataggagtcaatctcgaatgcgggaacagaagaatataaggattctacaaattcatgtattttggggaaagcaaaatcgtagggttactacatgggaagatgaagagacgttccatgcaaagtatccacagttttctgaacagaaaatgaagaagatgaagccggaccatccaatccttttggaattcaagatgaattctattaaagggggagaatgtagtgacccgcataagggcatcgggaacatgcaaaagactgaatgagagaaagttaccccgaaaacatggctgattgaccatacgtacccaaaaggtgataaacactcaatgggtaaaagaaataactatatgggcaatgatgggcaacacgggtgtgtcacgggcaaagtttgccccatcggatatggtttctgagtgttccggatatggtttggttgcatgatcatacacttttacattcattgattgatttcgtgaatcatataactgatgatttatgacatgaaggatggatattggttgcatatgtgatcttttagattcttatgctacagttatggatgggaggttgttttgagatattaatgattttatttgttagattaaccatatgtttcataaagtcttgaattcttgggtctttgtacgtggtgcttgtggtaggaggcaaagaccataagcataccaagatcgtgatatgtctgacgtttgtagggaaccgtgctatgatggggtcttgtaacgctattaattgatcgccatgtaatgcgaaggacttgaagagatggggctagctatcctggccgagtgtctacacgacggtgtagcgttttggtagagatgatccagttacatgactaggaaacccatgaggaacacgtaagggcagtgttaacgagtctgtgggagcagaagctcttcgccaagataagcaaatgcagcttttggcaaagaagcatatggttcctagggcatatagtgtacaaggaaggcgtctcaatagatccataaaagataaggactattagagaatcgccgaccccaaaaaatgcgaccaaagtaaggagtttcctagggttgacatactattacaagaattttgtgaatggattcgcaacaatagcccaagcc

SEQ ID NO: 9681 - DNA, 3000 bp, Unknown
  misc_feature (1)..( 3000): cDNA_ID_3042980_gDNA_ID_1972170_Annot_ID_179843 3000 nt of promoter + ATG
taccataaccaccaattcagccctctcacgacaataacctttattaccataatcataaattaagccctctcacaacaataacctctattcccactactcccataaccataaattaagccctctaacgataataacctttattaccattaccataaccataaattaacccttaattagcaccactttgccataaccataaattaacccttaattagcaccactttgccataaccataaattaacccttaattagcaccactttgcccagccttgttcttattctcattcttcttctcatccttcttcttcctctattgctctttgaatattgtgtcaatctctgcatctcattttcttagcctccctctagcctcccaatcatgcccttagcgtccttaatcctctacaaatcacggaggctctttttcttcttgctctcccaatccttcaccatctttttgagttcagctataacatcgtagtcttttggttgagattttctcaagtcggccacaatctcaccttccacctcttgacaaatcatgaaatactccggtatctaactctattgattattcataagcagcttcaacctacggctctcgggtttggatgtaaagatcacactttcatcaacaagtgtgaacgagtcatcaaagacaacgacctcaggttgctcaaagacattctcctcttccttcaattgcttcacccacacactcactccaaacatgccaagatgattccggttattaattaaacttatttgggtgatattctctcgtccactatcgaatctcctgctggatcccaaaataaaaaccttcagtgcattggtctttgatgccattgttgttttgaataaaaaagaaataaatgtgtgaagattgagttgaaagcaagagaaaagtataatgtgaaggcagtgtgagaacccttccgctgtttatagccactaaggcctccattcgtaatcttcgtcaaagttatgatgtaagaagatcttcaagagttttaatgtaaactttcctcttttgagttctgatgaagaatatgcatggaacctttttacagagagttgaacggacttgttttggtgttttcctttctttttttttagtctcataccttaagattcaagatttttaatgtatgaaaagatttattaggtgagatttgtttctggtaatagaagattttattagatcatttatgatgtgcttttggaaaacacgttgtagagaaaatatacaataaacacttgttcaaattggatttgtacaaattgtcatattatgacccatgcctttacaacgcgagaacagttctgttgcgtccttctagtcttaggtttctatatttattatgtccaaaccacattatacattagggtttaacaatcaaatagaatggactactttagctaaatttttatctaacattttattcccatgttgatagaattctggctacctctgccaattgcttcatggtatactgattcttggtaactcaaaacccatgagtgtggcttgaaacaattatcaactaaagtcttgcaggaaatgttaaaactattcacagccaccaatgcatgattacaagggaaccttagtttatcatacctctgtcaagtgcactgcttattttcaagatcaacaacatatcttccacctaacatgtcaagtatctcatagctccagctgatgatccgttcaaccttgcttacattagttgttaagatgattttgtgatttgcttgtcaacttccggaggaacagtacctttatgttcttgagattgctatttagattttgaacagtttttcttttgtaatgtcatgagtagatgtaatgaatctagtaattatgatgtattggatggtagttttaatttaattaatttgtcttaaattagatgaaagagtaagtgatttatattgtctatgttcaacaaatactatagcttaataatttaatatgattacaatttatacatctgagtacgactaatagaagtatcttaataaaatagggaattataaggatgtctcaaaatatgaacaagtagatgcaaattgaatatgtatatttatatccacatttagctgaccattcgaacatatccaaccatttgtgtttttgaaattattttggaaaatgtgttcgttattcatgttgcaaaatcgaaagagtctctatcagtcatgcaaacaaagatatgttgacaaaaaatacttatagtgagagaaagatgttcgctaatttatatgttaaatacaacttcataattacatctacttaacatttttgaagtacaaaataaggaatttattgggtcgggttttgttttgggttttacccactttttttgaccggatctttggcccaaatcatgttaattggcccatcaacctccaagatttcgtctccttcaaatcctctcacacctacattcactcacacaatgaatcacggaaaatcaatctcttaatcaaggcacaaatctattacattcagttttcctaatctatcaaagaatctttactaatcaagttgttgatattataacttccatgaatcttacctatcatttacctataattgctaatcgaatcaagctcattatattctgactatttatctttcaaaccatttatattcactgtcctatgataacgcttatttgaaatgcagttaccaaaacaatcaaatccatatctactctgtttggaagttacattcaagatatgacagtatctacttaacatattcaatcgccttcaatataaagatattgatcaagccgcatatccagcttcatttatttgcagagaatattcactgattgattctaaaaagattacgcctactctataatctaaaaccctatacaatctcacaacactataaatatactctatattgcataccatttctacacattgcagaatatcaagatatcgttccatttttgagaatcactttgcttacctttcaa

SEQ ID NO: 9682 - DNA, 3000 bp, Unknown
  misc_feature (1)..( 3000): cDNA_ID_2185107_gDNA_ID_1972170_Annot_ID_179841 3000 nt of promoter + ATG
gccttggaagtagatatgaaaccgttagggttaagtgtggcagacaaggccgacttactaacgcgaatctgtataggtcaagggaaggatgagaacttgaagaaggtaccaccgaatgagaaaactgagtacgaaacatcgaaaaacgggacaatcgtggtcaatggataagtaagagtactagacgacaaagaactcaaggaagatattcttcgagaagctcaccaattcaaattctcaattcacctagggatgaacaagatgcaccggaacatcaagaggtactaccaatacaaaggcatgaaaagagatatagcggaatggatatcctagtgcccgacctgaaagtcggtaaaagccgaacaacaagtctgagtggcttgttacaaacgatgtcaatgcccaaatggaaatgggaccacattacaatggactttgtaactgggctgcccactacacgggcaaagaaggacgcaatatgggtgaaagtcaatagactaaccaagtcagcccatctcattgcaatcaagaaaatggatggagtgaaagctatagccgatgagtacattgatgagattgtaagatttcacggtgtaccggtgagcatagtacccgttggagactcacgattcacttcccatttttggaaggcattccaaaaagctttgggaacaagaatcaacatgagtaggacctatcaccagcaaacggacaagcagtcggaaaagactatacggacgttggaggaatgtctacaacaacagtttccaagtgagtatagggatgtctccatatgaagctttatacggctgaccatgccgcacaccaatgtgttggacacaagtaggagagcaaagcatgattggggcggacttataaatacaacccattcggcaaagcttgtggacacaacactatacaccaaaactttcaccaaaacttaagagagaaattggaagagaaacactattctttcgaagggtacaagcgacggaaagagatagtggatgccttggagatcaaacctttggtaactcccggatcgatgaatccggcggaggccgagaaaacaactggtctaatgaccatggtgaggcataactgtaccaacgtgagattgaacgatctatgaggggctagggaatttggttaacgcatcctacttatgatattttgttctaacgatatgtgatatgtctgggggtgaaacatggggagcatcatagcatgtgcatgatcgcttagtgtaaaccacaacaatcttatctttcgttgatatcaggatatgaccaagttcgtgggaaggatttggcttagcgggagggatggctttccgggcaagtgggaggtgtcatcatcgcttccaagtgtagttataatgaagttccaaagaagaaagatgacagacaaagacagtggttgtctcagaacaagtcaatgacataattccaaggaggattccagagaagctacccgacccacgacgctttgtacttgattgctcaatctcacctgacaggtttcctagttctctttgtgatcttggctcttgtatcaatttgatgactcattctattgttgtaagacttggaatgacatatttcaaggctactaggattactcttctcctaggtgatcgctcaaagagaatccctgaaggtatcttagaagatgttctactgaaaattgcaaaatgcttgattccaaccgacttcgtggtttttgaatatgaagaagaacctccagattcccttattatgggaagatcattcttagctactgctggtgctcagatagacgtgaagcacaaccaaattgctttgcatatgtgtgatgttattatgactttttacatggacaagatgaggaaaccacctatgattgatggtcaggcattctctgtagagacctctagagacacaattgttgatcctgaccagctactaagtacaagcaagcgtccacatgaatcaagctccaaaatatttttatttattcatcaatatattaaatttgagctcacataaaagaagatacatgtcaccttgtatatagagataactttaatttattatatactagataacaccggcttaaataggggggtgtaagaaataaatgctaattttaatctctgatatttgagttctaaatcgtagttaacacattctattatgtgaattttaacaaaaggaaaaatttcttttacgataggtgtatcatgacgtacaaacatcagatttatcaatttgcttgatataaccaattacatgtgtatgacaaaacaaaattaatttaaataaatgtatatttattaaaatttaaaattcaggatattttaaaatttagaatttaaaatatgtatcatgtaacggttttgtcatatgtttcaattttgcaaaattctcgctatttcggaatcaaatttttttgagagatagtttacaaaattgttgatcgacaaatgtgattgtcgttctttttgttagtatcatctaaaatttgtgatcagagactttgatttttttttcataatttgaattgctatttttatttaataagatacatatagcttccatataattatcctcgttactttcttaaaataaattctttttttctaaataaagtaaaggtttgttgcactttgaggcactttgggaaaacttaagtgaatatagacactttcaaaagttgagggactttccctttttgtttagtgaaaaatgacaattatgtctccgaaaattagaatccggaaatcatgactaattggtcatcggttttggtattggttaattcgaaaaagtaaaaacggttaatatgtgcagtttaaaggagcggatattaagaaaggagggtcgtccaatcaaaacaatttcagcatagcgagatgatgatcttcaaacacaacaaatttacgttgtgttagatttgctttttgaaaaacaaggagttaaaaaaaactagtttctaggtttcaatttttggcttattaag

SEQ ID NO: 9683 - DNA, 3000 bp, Unknown
  misc_feature (1)..( 3000): cDNA_ID_2185095_gDNA_ID_1972170_Annot_ID_179838 3000 nt of promoter + ATG
cgatggggcaaactttgcccgtgacacacccgtgttgcccatcattgcccatatagttatttcttttacccattgagtgtttatcaccttttgggtacgtatggtcaatcagccatgttttcggggtaactttctctcattcagtcttttgcatgttcccgatgcccttatgcgggtcactacattctccccctttaatagaattcatcttgaattccaaaaggattggatggtccggcttcatcttcttcattttctgttcagaaaactgtggatactttgcatggaacgtctcttcatcttcccatgtagtaaccctacgattttgctttccccaaaatacatgaatttgtagaatccttatattcttctgttcccgcattcgagattgactcctatcaccatgcttgaattggtagtttgcgtagtaaacctacttgcacttgatgttccaccttcacactttggcatgaatcacattggattacccactttgccactgatctcttcattccaggctaatgataatacctccttatgtccttgtacatttttgtacttccttgatgaatgcttaataaagaagtatgtgctgccctcaaaatttcttaccgtaatcctttacgggcatgcaatgtaatcctcccattgagtagtaaagtggcgtcatcagctagatgataaccactagcattcggaccatttaatgtctttaatttctccacgatttcttgcaacttttcatcttgcacatgttcctctcgaattcggtgaagtaggcttgcttgagtcacagcttgcaaacccaagggcttactagattcaccttttaaagttaacatacttactttcttgaactcatcggttagtgactctagatctttctcaacatctacttccgtttttcggcaacttaaggcgtttgccaccacattagccttccccggatgatactaaatcttcatatcataattggtgatgaattccatccatctccgttgccgtagattcaaatctggctgcgtgaataagtacttaagactttggttgttcgtaaacatgtgtattgttttcccgtataggtatgatctccgtgtcttcaatgggaatactacagcagccatctctaaatcgtgagtaggatagttctcctcatgtcgtcttaattgccgtgatgcataggcaatcacctttccttcttgcataaggacacatcccaagccaacacttgagttgtcggtataaagagcatatggtttatttggctcccgcactgctagaattggagcggctgtcaatgtagtaccccgcgcattgatcccgggcaagaaagaagggcaagagaaaaagaagagagaatggtgcgagaatgagaagaggggccgagtatttataacccgcagaagccagagtagagcccaagtcttgaaacttgaagccaaatccatttgggcgaagccaacttggtgaccaagtttcgtcccaagccatccgagccaacttagagccgaatccacctgggcgagccaacttggtgagcaagtttcgtcctagagccaacttggtgaccaagttttatctcccttcccttacacaagtcctcactctataaatagaacccaaccctcgcttagttaacccttagaagccttcgcaccaaagctctgcccaaaccaagagagaaagagagtttgtccgagccttttaacccgtgagagagagagttcgtccgagtcttttaacccgtgagagagagttcgtccgagtcttttaacccaagagagagttagagatcgccgagcctcagcatagtctgagagagtttccgagtagaaaccatcggtcaagttaggaaggttcatcggtgattgtgagttccggtttttgttttgcatgtttgattttcgtttcttcttgcatgttctctattctctcttttctttgctttgtggttgttattattgaggttgtttattcgaatagctaggacagttgagaccgaagcaccatatcctataggagtggttgtgttagcttagcaccattcattcgagagggatggttgcgttgtcaagacactactcgctagtattcagtagacttagtaagaggactctatgttcatgcgcgttgaaaacgaaccgcacgtttcatattgtcgattggaaggtcgtagtgtgtggaacttgggagtatccaagttaactccataagcatactacggtcatgtgggatgtatctgaccttaccttgtgatttcgttctttcgtggggtgtgcttgacgagatgcaagtgaccccaaggggttcgaaggacccggagagactgggttagctacccaagggtcggtgtcgtttacacgacggtgtagccaaggtgatgttccggttatatgcctttgtggttataactcgggtgttcacgatttgtggaggcatgaagtgcatccgggccctaattaaaactttaagaaacgttttgttcttgttgtgtttgtgtggtttactaccttctctatgtactatgattatttatgttatgcatgtggggattatgggtggggattagactaacgtttctttgggaacccgagctcattgagtaatgctagattactcatgactctacttgttttgaaggtaacctttgaggggattagagggagtggtgaacactagggaacccggagtagtttttcaatgtccttttgtaaaagttaaagtatgtattttagaatcgtgtacttttgggcctcatgccttggccataaaaacgatgtttatgttgtggtttttccttgtattttcataactctttggtaatgaaatcggtatttattttaaagtatacgtgtttcaactgataagacttagtccgagtcgacacaacacttgggtcaagtgagggttggcaagcctaaatggatcccaagtggggaaataggcaaccttgagtgggctaagggtcggaatgtgtttccgaacctcggctactctatg

SEQ ID NO: 9684 - DNA, 3000 bp, Unknown
  misc_feature (1)..( 3000): cDNA_ID_2991013_gDNA_ID_1972172_Annot_ID_179852 3000 nt of promoter + ATG
tccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaaggttagagtgagagacaaatgtttttacttttttacatttgatccttcgtttcatcagattgattttttatagggtaaaagctcgacgaagaagaacaaaagctctgaagagaacgagaagctgccatatgttcacgttagagctcgtcgtggtcaagcaaccgatagccatagcttagcagaacgagtaacttgcatctgccttcactaatttttcttttttttggtattaatcagttgattaattcgctaattgatcactaatttttggattataggcaagaagagagaagataaatgcacgaatgaagctgttacaggaactggtcccaggctgtgataaggtttgtctcttagatatagacgtgtaatcaatttgttaatcaatcattaggtcttcatttgtgattaacgacattatatttctctaattgattcactccaaaagtaagaatttattattagatgatctagtctttttgttaagggtcttaatccttcacacctacttttttttttcttcctaaaaagtggattgcttaattgcttttttattaagaaaagtggttcctggtgtgccaaagtagccagttgggtaattgtgtagtaatgcctttagagatctcaactttatttttttatttcgtgtggggagaaatatctcacgggtacacacttagctttaaggttaactcagtcacacggaagtgataggaccttgctttatcgaattctttttccataagtgtgttcgttgagcttgaagattagtctataaatgacgagaatgaccttaggaagtgtgctagctgtaatatgccattaaggttttgggtttaggggacagattttggtggaaagatcaagatcaaagtgtgttttggggtccatcttttgatgataagtgggaaaaaagttgcaatctttctatggaaggtgaggaaggggtagtatcgtctctaacaagttcggtatctatcaaggaaaaatagaaaatgactcttagaaggacgattaaagcaaatgatcctttacaaaaattgatatgctttgagtcccacatacctaattagttggaaacatgatgtgacactcccccagacagctaattaatcatccctgatgttagaagttagcagcaattattggtgtgatagagatgatgatatggaacatcagtgtttgtttaaaatttggattctataggtgagctgtgaggacttgattgattgttcctttagcccccctagggtatactgattacttgtgattgtagtagataccatttattataatagctttagattagcacgtcattctcttgctgcttttttcactgtgtattttggaatcttggtattttctcgttgaaatattggatcatcttaacaatagttagctgtctagaaagaatttttggtatgtgaaagcagatctacctaatatgaatccgagcttatcagaaagtctttgacctgcagattcaaggtaccgcgctggtgctggatgaaatcattaaccatgtccagtcattacaacgtcaagtggaggtgagactttccgtggtccaatttttgttctttatacctatattttacaatagccctgggcacaataaaagggtcaactcaaaacaatttgaaaatgaatagaattatgtgccgcaatctcatgaaactgtgacttgtgtttccacagatgctatcaatgagacttgctgcggtaaaccccagaatcgacttcaatctcgacaccatattggcttcagaagtaagtatcaaaatctcaaacaataatttggtcattctgattagtcttctctaggaaaaatttaaccatttcatgtgtttctcatttaagttaaccatacctctttgagtagcttctagtttctatcacaaaaggagaaacttttggggtatttattgatacaaacattaatttagaccattttagtgtaaggcataggaagatcacaacgtctactctcatgaaggaaactcagggaaaaataaatacacaacacacacacacacccaatgcaaataacagtagtgggtcaaaactcggaccacctttgttctgtaaaacctttctgtgtcttctgtgacttatgtcggatgtgttacttgatgaaccttttaaaaaaaaagttaattcatccctcaataatttctgtgggtctcttccaaaatcttgttatttcaaagtgacctatctaatttcatgatcacctgtggattctcatcaaaagttttggaccaaactaaataaatgctccctctctctttcttcttacagcttgtaccaccattaaatagccagggaccctctcatcaaaccttgttcttttaggataataataacacagcaacaacagttgacttctttgactagatcaagatctctatgaatgatccctttgctgatatcttttccggttttggctctgtgtttttttctttgacagaacggttctttaatg

SEQ ID NO: 9685 - DNA, 3000 bp, Unknown
  misc_feature (1)..( 3000): cDNA_ID_3043077_gDNA_ID_1972172_Annot_ID_179866 3000 nt of promoter + ATG
tttattttctgtctatgtaaaagccatcatgattcgtttaggtgaatcagaagaaaataactctgggtaaaattccaaaatgtatactatcaaatggatatagatagacgacaagttttaaacgcgttagcgaactcttcttgtggctttggtattttagtttattaggtataaaatggaaatcatccacacttcggagcaattgttacaaaaatgcgattatctttctaccgactaatgttgggtagacataattagtttacaaaatgttctttttccatttgtcaccaaagttttcttcattattttatgaaacaagacttgggcagttggacatatatactatattagtagttaaattgcatatgtttgatctgttgatttgtatattcagttcttaaactaaataacaagtactaactatatttcagtatttgtatataatcatttagtatcgaaacggtctcgtggtcgtggcacctttaattgctgagagggccgtcttttacttttcgttctagctttatgatgtgccaccgagtagttaagagaatgcttctgctccaagtattttgacataatttaatcaaaagtattagctactttacacggacaataatctaattttataattagagtaagatagaaattaaagaagatattggtagtcgttgcaaatgacacgtgttgatcatgctttgctcgcatttgtatagcttcgacttgaaggatttcagtccaccgtacgtttaccacgatcgagtcacccactacggtcataactaatactataatttgataagtgtaataagaagacaaatgataaaaaaaaaagaagaagacaaatttgctaagatgacagtttgtaatccatatcttatcacatctacaagagagatatatacaactctttttcttaagagatgattaatgcgttaaacaagtttaaccagttatcaaaaatatgtaaatcttttctccagaggtttaaagacaacgtcacggtaattgtttcgtcgaaaaatgactattttaaactgtacggttcatggtcactttttgtgtatttacataaagaaaaaatattaaattttatactcagaattaggtatgggcacgaagcggatatccggaaaaattatgatatttgttattcgattcgttttaaacgaatacttgattttgtgattcgctttacttcgaaaatttccagatatccggaatttcgaatatccggaattttttgtgatatttgcggatatccgctttgatacatttaaatattaaaaaaatatgtatactatataactatatcatatattcaaaaaatttatccgtgcgttccttaattggtgtctccgtgtgcttttaaaataagttctaaataccaaacataaccgttgttggtatcaccggtcaacaaaatattatcaaactaattccaaaactaaaacccgatagttttttgatgccattgatcaaaacataacataaaaaaaaatgatcaaacaaacatcttaacataaaaacataaaatgacaacaatacacaaactatttatgatatctatatatagatatactatattttctaatatatataaaaagatacggatcgaagcggatattcgattttttaaaaaacaatatttattatttgattcgatttttacgaatactatatttttctatttgctttgctccaaaatcttacgaatattcggatttttcgaatcaaattaaatcaaataccgaatcgaaacggatcaaatcaaatcaaatcagaatattgagctagctgaatgaatgagataacctaagaatccaaaagttgatagtgttccctttccgaattccaatagtagcttgataacatttatttaacggcgataaattcaaccgttagtttgattaccaatcaaataattgcttgcaatagacggatgaaacgagtggtaagaataggtgattgaaacaaacggttaaaagcttaaacaaaataggtgagtttgcaacctctcttgttcaccattggaatattttagttatttaacgtttcttagatttttaaaactgtaatgtatttgaattatttactaaagagttttgtttttctttgttttttaaatatttttagttatttattaaatattttaatttagttttttttttttactgtttaaccgtttgttactaatcataactattatttaacggttcattttaaattatttatcattttttcttttaatatattttctaaccgtttttttttatcagtcttttttgtaagtgttaaataaaataaccgccttatttaaacgatattaccaattggtttaattttaggttgttcatcttttctaaccgtttttttctacccgcctttttctgtaactgctaaaaaacataaccgtctcatttaaacgatgtttacccattgcaaaccattttccttaaacaagcggacaatatttaaattgcaatgaaagcgagttatgagttcttttggcctaaacttcccaattttatctctctttttcccactaatcttctaacaattttaattaacagtgacaacttacaagtacttaggtaaccaagtatatttccctattgtaaaacctaattatgagttgtgatgatcaccttttctccttttgacgaacgcttaggacctaacttattgcaacaatggcctaactaaaacttaaatgcgatttgcattcaattctcaaatgggcctctttagttaacatgttatctccgttcatctgacgtgtcatagctcagatcaaaggttaatctactcgtaaatccaacgaccaaagaaacgaagcgtacgttactaacatacacgtgcacgcactgtaaccatctctctctctgctcttctccttcaatgaaatgattcgtcacccaaagaaagatctgcaacttcaccaccggaccagtctctctctatctcttctgtctctctacctcgcgcgacgaatcaatc

SEQ ID NO: 9686 - DNA, 3000 bp, Unknown
  misc_feature (1)..( 3000): cDNA_ID_1558032_gDNA_ID_1972172_Annot_ID_179868 3000 nt of promoter + ATG
gatgaaacgcggctattagctgtcgtctcttatccaaccgaacccaacgagttcgaaaacgagtagaatgtgaaagcacgcgccaaaaagggggcgcgtgggtgaaatccgtatccatcttcaacgggcttaagatccattttagtcagtctcagtgatggtagtgagaagaaaaagcgtcattcttacgtttttcttttaagtttcactcagagacagaagctagaacaaagaaaagagaagccttttgaaagcaatcaactttaatctttttcaaccaacactagtactctagctgttgctctttctcttcgttttcttccttccttcttctcttagatctctttcttttaacttgagtcttatcctttggatttttattcgatttgattcctccgtttggtttggtcagttttctttagactcttagtctttcctctgatctgggttttagctgtagaaactcgtgagttagatcgattgagaacccaactataaattagtaaaaagagaaaccctttataggttttttggggtttttgtctcagtctgaccaatgggttcacaggtgagtctctgtctctctgttttgaagagattgtaaggaaactagggcttgttttcttgtttagactgttcatgcaattagttttcgtggaagataattgattgaacttgcttgtagcttagttcttggtttctattgagctctaaaggataggtttttaagagatgaaattgtttaatgtctcgtgactcaagtgttgcttatatatgtttcctttgttcagatctttttggaaagaatttgtatttggatgttgttaaataacttgttcaatgcactgcttctaatgcatgaaaaaaatggaatcttgctttcgtgtttatgattgcgcttgtgttgattcttcaatgaatagttcctcctctatggagtgtctgccagtttgaatgatcctctacttttgtgcatatcgaaaaaaatgacattgcttttcacactttttagtctgcattcttcaacaaatttctatagtgtttgagtttagttcgccttcattgtgttgttgtgaggtatgagttactactggtaattaaaaagcaaccttttcaacttgcaggtttcttgtctagttgcttgaggtttttggtttttggtttgaatagagttatgagaagaggtagaggaaaaggcaagaggcagaatgctactgctagagaagatcgagggagcggcgaggaagaaaagattccagcttttaggaaaagagggaggccacagaagccggtgaaagatgaagaagaagaagaagaagagctagtgaagaagacagatgaggaagaagacaaggatgatgatacaaatggttcagtaacaagtaaagaaaatgtgacagagaatgggaggaagaggaagaaaccagtggagtctaaagagagcaacataactgaagaagagaatggggtagggtcaaaatcaagcacagaagattctatgaaatcatcgtcgtctattgggtttaggcagaatgggagcagaaggaagaacaaaccaagacgagctgctgaagctgttgttgaatgtaatggggtttgaaaagaggttcttaacgcttttgaaaccgcctttttggtattttttttgttgtttttgttagatacttttgctgttataaacccgagtttgatgcgggtgcgttctggtttcattacatggaatcaaaacttcgatttttcggatattgctcttccctcctagtttccatggcgttctgaaactcactctttcttttgaacaaagtggagcctaaaaatgctctttgacggctatgcaaaaatgaaacagtcataagttgtgaaaagcgaaaaagaaaaggttcattgtaggaagaaatatcaagaagatttgtgatagtcaagccagattagtggggggggggggctttaggccttttttcaggttgtatttttgtagaattttggaaatcaaaacaaaggaacttaaagcaaaaagtaaaaggaataatatcaaactgatacacacaaccctaagaaaattcaagtacacaatttctgatggatacatgaccgtgaaaatcgaacttcccatactctctttttgcataaatatttgttcaattatcaagaaagattttgcataggatatggtgagaagaagaagaacaaatctcattgcttaaaagaaaaagaatcactaaagtatttttagaaagaaaaaaaaatagaactaaactcaaaaagtgttcaataaccttctagttcctttgaagagtcacatccttagttgagttccaacactctggtctatctgcccataatcctcaattctttctactttagaattttaaaaatgagcaataaagttgttgtttctctttaattagaaatagtatttagaagtagttaaatagccatccatttataggtctgtgatctattcatatttttacaaactacaataaagatcaatagttttgtgattttatcatcattagactattttagtagtataaaactagtatacaataattagaataaattagctgtagatttttacatgggagttatgttccctgatctggtctggtctcgtttaaggatatcattttgtacgttaaagaagaaaaatatccttatcctcccttttgtgtttatttgttcagatgttacaaaaaccaccaaaacgcaccaacatcccaaaacgcaaacgctaaaaacacgtagctgtcgtggactagtgtcaatcactcttgagtgtctcttcttttgtcagcttctctttctttctttctctctcttctcttctctctgattctttaaaagatagcaacatctaaaatctgcaaaaccacattttctttcctctattctcctccgtccttactatttccagagttcagtacttagaaagaaagagagtgatgagcagaagcatctctttctctgtctgagtaagaggaagccaaaaccataatg

SEQ ID NO: 9687 - DNA, 3000 bp, Unknown
  misc_feature (1)..( 3000): cDNA_ID_1456224_gDNA_ID_1972172_Annot_ID_179877 3000 nt of promoter + ATG
taaagttgttagagtacctccctgagcgagttcccccctcacgagtgtttgaccaagagaaacctcgggatccacccaacgcagtctttaaaaagtactcaatttggtatccctcatcaacttcgctaaaatcaaaacatcctacataaatgaaagcattgttggagattaatatctacatgcaaatactgaaaccaacaaacaacaccttttaaatttcacttaattgacttttccttaacataaactatatcactagcattggtagctacacagtctataaaccttccttcattgtagaagcagttacactaactatagttcaaccattgaggagaaagcagaggcaaagaagagtagttgtcttacttacttttatccaaatgttgagggatgtgtgttttaccattccgattccttttggaaaccctagagtactgtttctcaaaccatgaggtgtgcttaccagagtaatcaaacccatcactccatatctgggaaaccaaattacaaaaattgcatcaaaattgaaagctttttagttcttacattgacaaaagaaatgtttcattacgacaaaacaaaaacagagacttgacattaccccaaataagtgttgtgcaaaagcattcacattacgacgcaaatcttgctttgccttctttcttccaaaccttttgcttcgagcttttgaattctgtcagaagatgatgtcaaatcaaaacgagacttatccacaagatcaaactctgagaataaggtgatattgatccaacacaattcaaagagaggcacaatccaagcatcgattgagaatttgcagaagaggaaacataaaagagagagactgacagattgatgtttgcgttgtaagataggagtcgaatggaaaagagctgttttgaggtgagaataatagtcttgcggcttcagaatcgctgctcttatggcggccatcatctccggcggccgaagagatctaaccggaatgttgccaaaccagcatttcaagcagaggtcgaacgcaacaaatgcaaaacagagaagaaagcccaattcgagcctcaataataaagcccaacattatctttaaagcccaacgtacttacccatcgctttttgttttttgtttttggtgtcacaaaagcaagccctcttaactttgacaatgcgatatttcgctgtttttgtatgacgacgagtaaaacaccattcgagagagtgattgatgtttgcttgcttgtatcggaagggatcgttaagttcattgttaaaatttaagaaagtctttgaattaagtagagactttttcgagcttaacattaaaaccaaaacaaacaaaaattacgtagagagttttttaagccaataatacatagagctgtaattttgtttggtgtgtagtcgaatgtaattgtgatttgtgaacctaatgttgagtagggatgatgatgtgatcattgtgatgtatatgtgaatggatgtgaatagtgaaagataattacagtaaatgtggacagtcgatagttcacacaaaagaaagtttctacgccatgtaaagaggagaagaaactgttactgtgatgaacttacataagtcaagcttgactagcctttttcaccttcctgtttcgagattcctccactaattatattacacggtgtgttagacgtgcacaatattgaagcaaactcttgtttcaaataaaacgaacacgagatccaaaatatcatcggaacacaagctaatataaaaaatttggttatgattggtgtcgtgacttacacgcaaaaaaagaagaagaactcgaaagtgtctatatttatcttatgaaaagctattaaaaacaaagctagaaatatgataagttcttcacattctaaaaggttcagaatctttggaacaacatgaacagaagagaagacaccaagcatgtcaccgttagacccatgtttgaaccgtcaacggaagcgctgttgcgatgatgagagccaccgccaaagaaaaaaataccaccaccgccacgaccgtgaccaccacgaccgtgacctccaccaccatgaccgccaccaccaccgccttttgcggcgacggacatgatcaaaagtgttaaaattagacaagcggtcacggatttcatcatcatcatcttcggtgaggaacaagacttcatcatattcttcagagaaaatatataataacctacaaaaacaggaaaccgatcttgagtttaatctctatatataccgagaaaacttgaagaaaatattaacttaattagggtttcacataaacaagtctcacctaatatactcggattccaagtgatgagacaaggaaaaagaagattcactgcaatgtctaaagtcctttaataagctcgagtctttccttttttggaccaagaaaacgagctaatggaaataaatatatgttaaaacctctattaattcgatatgaagcacgcggagtatcattaattacgattatgtttaaccactaataatgccaacattattttttccttttctctacttctccttcttcatagtttagagtttagactttctttatgtgaaatctaaatgttcttcattcatatttattgttttctattggatctaatatcttttgagtgtcatagggaaataaatgcacaaaatcatattgtggaggtaaatttcgtatagttgtttgcctgttttatatcatgaatgttcttttagtattctagtaaaaaattaatattttgttgcattttacatttaaaaccatttcccaaaaattttattagacctttattgtatgttctaatattattttgttacaagatttttttttcagatattattatctttatttatgcaaattcagaatttaaattaaaactgataaatttagttgggttcttctgctgctgctgctctcgtcttcttctacctactcattcctcagactaataaaaagccaatctttgaccttttcccccttattcaatg

SEQ ID NO: 9688 - DNA, 3000 bp, Unknown
  misc_feature (1)..( 3000): cDNA_ID_1443114_gDNA_ID_1972172_Annot_ID_179884 3000 nt of promoter + ATG
ccaccaagagcaaaaccatcatgctcctgttgtggttgatgatagagactcattctcaagcattgcagctgttataaactctgagagtcaagtggatactgcagttgagatcgattctatggctctttcgacatcgtcctcgaggagaaggaatgagaatggttcgagggtttctgatgtagacagtgcagattctcgtccgcctaggagaaggagatttacttgagaaacataaataagaaaagctttcaacctggaagctgacgatgatgatgattaagaagaagataagaagaagattgtgtaactttatttttcttgtgttgctttgttgtaatttgtttttgtatttttctcgatagggatggttttttttaatcgaaaattttctttcatcttttttttcttctgacggtaaaatatcataaacctttgaatccaatatggaatgtgttcttgataactattcttataaaacaacaaacttgaaaattttaatcgatttccaaatgataattagatagcttgaaattttgttggatttgaaaatcagtaagaaaatgtagaataaactattaacctttttaaaacaaaacttttaggcaaaatgctaattttattattaagtaacatggtgtgttttttcaactttgtagactaaagcaagttagtatataaatcagttatgaagcaacgtaacaataagacactttggccgagtggttaaggcgtttgcctgctaagtaaatggggtttccccgcgagagttcgaatctctcaggtgtcgtattatttttattttcttttccttgtcccctaacttttttttttgacagatttgtttagaaacgatgattatatggtcgtagaaaaatccaatttttttttgagagtacatgtcacatgcgcacagcgacatccgacacgtctattattttctgttgaatcatctcacttcatatggttttcttcaacaattatttcacttctgattacaacaaaaaaacttatttttatactatcatatgatattttcttggcaatataaaaaaaaaaaacaccgcaaaaatacattcacacgaggggagacaaaaaataaataagaacccccacaaaaacagacatcttccaccattttcaggctttcatcatttattaaattataaagtttcttggattcttgttaacttaaatataagctgccaaatatatatcagcttacacttataatggtcctgttttaattgaatttaaccttaaatctcattggaaagtgattgacaaaattcaaaaaaattatgaggaaaaatgaaaatttgaaaagtgaaaataaaataaaaataaaaactcaaatgatgtgtgcgggaaacgagcgacgtcgcgttattcgatgcacgaactcgagccaataagatgtttttaaatctaaaaatggctattagattcgtcattacttttgtatttttccacaatttaaattgacttttgccggagatgtaacttttaaactattttactacttctttttgtttttactcataaagatcacaaagattcactcacaagcgtatgtatatctgaagcaattaaaaatgagaaaatatttgtccttttacagtttttgtttttcttctctgttacaaaaatgtaattacatctgaaaacaatactagaaaaaagaaagtaatcgagcgttgtaacgcaccataatggagaaaatagtaatacaattatgaagatagtacaaaatctcagatgaaaatatagtaaataattgtaattaaatgagataaaatcaatttctaaaaaaaaagtaaaaccaccttcgtgaattgtgattcggtgtttttaaaaagtggggaataaagacaaaacagagaccaccaccattaatggctttcttcaccgatacgaacaagacaggacacaacaaactcaatcccagcctcctcctcctccgtcttctcccttattcccttttcgtttaatcccccaattttttcaattaatccctccttttctcctcttaatctgaatccgaagcaacgcataatccataacaaagtctggaaaatttcttccgggtaagagaaaacttcttctctttcttttcaatttggggttttttattttgaaatcgggaacaaaagatccagaattacctaattccgaaatttattatcgggttggattatcgtgtgacgacgaatctagcttgctttttggggggggaaatataattctcggaaggtcaatttttttttttgcttcattttgttgtctttgaatcttttggtttatgaatggattgttttgaaattgtttcataggtcaaagagacaaagatattgttgagatttatgatattgggatttgtatttttgaacaccgtttctctatagatttctgctttaacctgatccttttaattgcaaaattgtgaaactttgcttgcacgatctttgtttagctttcacaggttagatgcgttggttcttgttctctagttagatctattttcatgtttatctctgtttagttagattgaaaagagaataggtttttgtttgttctcttggaatttttctcttttgatgtttgatagtcctgtgattgattactgtttaactgttgaagtcattggaatgtgcaaaggtctagctttgttcatagctttaggcctattgctttgtttacctatctgaaagtgcatttattgttttgcttcaaatgtttgattattttattttattctttgttgcttaagaagctataaaaagtaaaagacttgatcagctgaaccaagtatctgccccttaatctacttttttccttctcaatatatcaactatatgtattagccttctcaatataagcttgtattgctaatgattccttttttcctgcaggataataaagagatccattaggagtaaattatctgacaagagaatacaaagggcaatttcattttagttgaattagggatttgggctcgtc

SEQ ID NO: 9689 - DNA, 3000 bp, Unknown
  misc_feature (1)..( 3000): cDNA_ID_2185338_gDNA_ID_1972172_Annot_ID_179879 3000 nt of promoter + ATG
ttcaacagaaacaacaaagaaactctaatttgagtctgcttataaatccataattctcatccttggaaaaagtaaatttaccgagtttaggagtttgatgtttgctgttgcctttgtgttattatctttaatgaatatttccatattggatagactcaccaatgtcgaagggaacctcctgccacaataccaaacagatgtaggaatgcttaaaaactctctagatataaaacgaatgtttatttgattatcgatgagcaagaacactgactcgaacataacccgaacagcaagagaaccaggagtgttgactccaaaccactcaaaactccatctaccttcaagataaggagacctgacaaagctagctattaggaagcatcaaataacaccttaaagcttaaaactttgaagctcaaaatcgagcaacatacgtggttggtctaggagttggattaagccgctcaagattcgttatcctttcattgacatcaatcttttgcatatcagtgatcttccctgtaactagagcctcaaatcctccagcatcattgaactgtaatctcaaatggtttcagaactccaacagagagcaatcaaattattcactaagcaatctaatgatgatttccaaaaccagatactaaattcaacctaatttctaaccaatcacagttgaaagtttcaatttttaagaatttttcgaagacttacggcgagaataagcgattccttagcagagagacgctccatttctctggcgtaaactgaaggaatcccttgaaccgagtcttgaaccatagctctgcatatcattctccggtaacaactcttcttctccgactgaaaattgagagaaacccttgacagtggaggagaagacgacggtggtgatacagaggatgagaagctcaatcgaaccgcagaggtcccagaaaccgaaccatgttggatcaatgccattgaataagggggaaaaggtcaaagattggctttttattagtctgaggaatgagtaggtagaagaagacgagagcagcagcagcagaagaacccaactaaatttatcagttttaatttaaattctgaatttgcataaataaagataataatatctgaaaaaaaaatcttgtaacaaaataatattagaacatacaataaaggtctaataaaatttttgggaaatggttttaaatgtaaaatgcaacaaaatattaattttttactagaatactaaaagaacattcatgatataaaacaggcaaacaactatacgaaatttacctccacaatatgattttgtgcatttatttccctatgacactcaaaagatattagatccaatagaaaacaataaatatgaatgaagaacatttagatttcacataaagaaagtctaaactctaaactatgaagaaggagaagtagagaaaaggaaaaaataatgttggcattattagtggttaaacataatcgtaattaatgatactccgcgtgcttcatatcgaattaatagaggttttaacatatatttatttccattagctcgttttcttggtccaaaaaaggaaagactcgagcttattaaaggactttagacattgcagtgaatcttctttttccttgtctcatcacttggaatccgagtatattaggtgagacttgtttatgtgaaaccctaattaagttaatattttcttcaagttttctcggtatatatagagattaaactcaagatcggtttcctgtttttgtaggttattatatattttctctgaagaatatgatgaagtcttgttcctcaccgaagatgatgatgatgaaatccgtgaccgcttgtctaattttaacacttttgatcatgtccgtcgccgcaaaaggcggtggtggtggcggtcatggtggtggaggtcacggtcgtggtggtcacggtcgtggcggtggtggtatttttttctttggcggtggctctcatcatcgcaacagcgcttccgttgacggttcaaacatgggtctaacggtgacatgcttggtgtcttctcttctgttcatgttgttccaaagattctgaaccttttagaatgtgaagaacttatcatatttctagctttgtttttaatagcttttcataagataaatatagacactttcgagttcttcttctttttttgcgtgtaagtcacgacaccaatcataaccaaattttttatattagcttgtgttccgatgatattttggatctcgtgttcgttttatttgaaacaagagtttgcttcaatattgtgcacgtctaacacaccgtgtaatataattagtggaggaatctcgaaacaggaaggtgaaaaaggctagtcaagcttgacttatgtaagttcatcacagtaacagtttcttctcctctttacatggcgtagaaactttcttttgtgtgaactatcgactgtccacatttactgtaattatctttcactattcacatccattcacatatacatcacaatgatcacatcatcatccctactcaacattaggttcacaaatcacaattacattcgactacacaccaaacaaaattacagctctatgtattattggcttaaaaaactctctacgtaatttttgtttgttttggttttaatgttaagctcgaaaaagtctctacttaattcaaagactttcttaaattttaacaatgaacttaacgatcccttccgatacaagcaagcaaacatcaatcactctctcgaatggtgttttactcgtcgtcatacaaaaacagcgaaatatcgcattgtcaaagttaagagggcttgcttttgtgacaccaaaaacaaaaaacaaaaagcgatgggtaagtacgttgggctttaaagataatgttgggctttattattgaggctcgaattgggctttcttctctgttttgcatttgttgcgttcgacctctgcttgaaatgctggtttggcaacattccggttagatctcttcggccgccggag

SEQ ID NO: 9690 - DNA, 3000 bp, Unknown
  misc_feature (1)..( 3000): cDNA_ID_2185355_gDNA_ID_1972172_Annot_ID_179886 3000 nt of promoter + ATG
cttatatcgcattcattataatcagatcattagttccaaatttgaaatactcaatcatgtaatacttatagacatagatattcatctgcgtcggaaaaaaaaaaaatatatatatatatatatatataccattcacttgcccaaactttagcatttttacataattttcaagtaagatcgatggatttctattgtttttgcgattaaatcccgcggctttttgttcgacaattgctttgaatttacaactttttatataaaaagatcttataaaagaattcaatggcacacattacaacatttgaaacattatcttgaagagatttttggcggactagacatcgaaattcggaaatttaatgaaatttgaacccattatagtatggactattgggtgcagacaaacattcaccgattgccatagccatttgtgatgtaatcggctcaaacccattgatattagtttggtgttttatttcaatattgactatgcacggctcacatagtcacatgaagttcttacaacatgacagtagaccgtttttcaactatttattttcaaagattatactttgtgttcgtttaaaaccgtaagaaaacagaagaatgaacttttgataatttagtatttgtctataataatagggatttttcaatcatcaggtttatttctatatagtatcatccgtacatattatcgatcaaggatgatgaatcactctcgcatcatcatgatctatgacttaacttgataataaattaatcatgttttagatctttgagataaagaattcagcgttatataactgcatttacctaaatgatggtgacaattcgaattacaagtaaaataatttagaaactatattctataacgcatacaagattaaattttgtattgttgttgtagaattcttcaactgaagtatatgaattcatcttttaggttttgcattcctcctgtaaacggaagcgctagtttattgttgtattacttgactccgatcctgactaattttgtccaagagtcccattgcttatagctgtttaaactttgaaccaaatatcacttcaagaaatccacgcatagatacagatgaagcggattcaggatttgacatctagttgttataagatttatattaatatttgaaagtggtagccatgatatcaatttagagaaaaccaagtaaaggaataatgaaaataatataaatgatcatgatggtgtgaccaatatttccttttagagacacacattaatatataccatataaccttgagattaaaatagtgaattaagtttcaagctgcatgattatagttgtagtttttctctaaaagaaagtcaaagaaataaagaaatcataatcattaagcttccgggaatgttcctaatgtctcctgatgggatataattttaatttgaacaatagctaaataagggctgcataacaatcacatatcattcgagagattgttgcaccaactcgtggttgtaaacttttaaatgaattgtttcctcatttataaaaacgtaggatactataaatataaagaaatctaccaataagtcttaaagcgtttagctgtaaattggagaagaaagaaattatcacctttttgtataaaaataaataactaaaaataaagagatctaccaacaaatcatagagcatttataattttaaattggggaaacaatttctataaatttaatgaaaaagtgaatctataaagattttttttctgtagaattttattctataaaataaagaaatgtcccaataagtcatagagcgtttgtaaaaaattggggaaaatattttctataatttaatagaaatagaattaactccaaaaaattaattttcttcatattttacccatgttggggttttctgtttctgtttttttgtttttttttggtttctttgttgattttcaaaggattcaccaagtttataacccacagttctgacttcaaattttcgactccttttggattgaagaaatattttcaagccaaagaagtccacgtcaggtacttatatgtactgtcgaacatgaataagatattttgatacgtgatttgtagttaaaaggttatatatatgtgggtatgtctgtttatatgtgatgtctgcaaaataaatttaaataataaacttttatacatctcaatgtgttactgttatcatacaatttttcatgttgacttaatgaatattcacatacttaatttttctttgggctctcctatttcaacgctcatttgtcaaattttttttttttttttttttcgtatttgaattacgttacttaagtttggattaccccttatctttaaatttggtttcaattctctaatgattattaaaaaaaaaaattaagccttttataaaaaaaaaaggtttcagttatttgtagaagtttaattgttatttcttgtcgaaacgcgctgatgtgagcattattcaaaattagggttccgaatgttgaatatcatttatgctttgcaattacaacactgtaaactacacgtgtcgttttctaaataagaaaataagattgtcatgtacccaaaatataaaatcgtcacggaacaagaagctcctgactaaggcatggatcagacaagctttgttgatgcttttgcatgtgggcaagtaccagggctgtctctatcatcatcatcatcatcatctctattttcttattccatacaataatttaataaataaccacaaaaattcaatgaacgcacataaaatatcttataatctatctataaaaaccaatctctgtgtacaatcctttatctttttctttgttcatcacctgcaagcataaaaattctcctgaatatcatcggtatatactttttttcatttaatagtttatttaattattctaagggggtttccccttcaaattctagtagttaatttattcatgttttttttgtacgatgatttgtttaataattttccagaaatg

SEQ ID NO: 9691 - DNA, 3000 bp, Unknown
  misc_feature (1)..( 3000): cDNA_ID_2185351_gDNA_ID_1972172_Annot_ID_179885 3000 nt of promoter + ATG
taggagtaaattatctgacaagagaatacaaagggcaatttcattttagttgaattagggatttgggctcgtcatggctcctggaggcagtgctttgaaagaagtcatggaatctaattcaacgggaatggattacgaggttaaaacggcaaaagtggaagttaataataacaaacctacaaagccagggagtgcagggattggaaaatatgggatccattcgaacaatggtgtttacgagcttcttgaatgtcccgtctgtacaaatttaatgtaccctccaattcatcaggtcagtagtatatgagcttgaacagatttgtaattgactaattgcaatgtttcatgttctaaatgttatttaattctacagtgtccgaatggccacacattatgttcaaactgcaaactgagagtgcagaacacatgccctacatgtcgctacgagcttggtaacataagatgcttagctcttgagaaagttgcagagtctttggaagttccatgccggtaccaaaatttggggtgtcatgacattttcccttactacagcaagcttaagcacgagcagcattgcaggtttaggccttacacttgcccttatgctggttctgagtgttcggttacaggtgatatccctacacttgtcgttcatctcaaagatgatcataaagtcgatatgcatgacggatgcaccttcaaccaccgttatgtaaagtcaaatccacatgaggtcgaaaatgctacatggatgcttacggtaaaactttctttcgatatgttttcttctttttatcaaaggtttctaatttaaagtctgattcaggttatttcttcagatgaaatttttatgcaggttgtgattttatatcatcatatgactaagcttttacattcaccttctttcgctgttatcctcaaccatgaaatattcctggctttagctcttttctacaaaatacagattggattctttagaaggaactataggaatctctggctctgctcttttatgctatttttggatttctattttgcctattaaattttgaccttgaacaatccggtgccaaactcccttactagctgctattccggttcccgctttgctcttctttgttagtccaattttacggtctccttaagtacctaccatagggtctcttagtcccactttaatcctcacacttaaacttgaatctcagttactaaaattttgtttccaggtgttcaactgttttgggagacagttctgtttacacttcgaggcgttccagctgggaatggctccagtgtacatggcattccttcgttttatgggagatgagaacgaggcgaagaagttcagttacagcttggaagtaggagctcatggacggaaattaacatggcaagggatccctagaagcatccgtgacagtcacaggaaagtccgggacagtcaagacggactcatcatcccaaggaacctcgcactctacttctctggaggtgataggcaagaactcaagttgagagtgactggacgaatctggaaagaggagtaaacgaaaaacgaaaaacgaagaaaagaaggaatcgattgaaaaatgttgtacataagaagaagcctcgtggaagagctaatgatcatatggaagatttgaagtttgttgtctggttttagtgtggtataatggattcttctccaatgggaatgaagatgagatgatgataatgacaaatcttctatgatgaatcagtttggaggagccattgttactattttgtggctgcaagaactatattatctctgtattttttgttttttttgttgggatttcttttgtggtttcagagaatgtaggaaaaagtaagacatggttttggctatgttcttgttgtaaaaccaagttcaaaacagattggtgcactttttatcttttcacaatggtgattttcattcagtttagacttgatatagcaagctcgatgtttaggcattacagcatgatgacaacacgacaacaccttacccacatagacacacttttactcatttgaggaaaggtaactaacaaatatgaaaaccaagcaaaattttctatatctacaacgtaaatatcttttccttttgtttttcgtttttgttgaatcaactcttttttctattgcaaagtttgatattttgattctccatttgttattcacctgttcattctctttttggtgcacgatctcttggctctcagagtttgtagttagtcgtagttgtgcaatcatagtaagtggtctcatcatatcttgttgcagagagaatttagactttgtgttcttcttcttaatgtttttgactttgtgtatgattttgtctggtgtatatatagttactaaaactcgtacgaatagtttctttttcacattgtgtttcttgtatgtcgccatacaaagctagatatctctttccctgcagaataatacagagcacacggagacggagtacatattgttcagcgcaagtgaaacctggatttgaacctgatacataaatttgttatcgtttggtcattttaaccgctccctctaatatttacctcctttttataagttacacatcttttacatatctctctctctctctctctctctctctctctctctctctttctttctagaatatattgacgcagccgcgaatctcatcgtcatcgtcatcgaccaagaggaaccctgatttgcggcttttcttcctttcaatctcaattcgattcgttttctttctgttgaaggatctgaccatccagattttcccgggaaatttcataatcagactcttctctttttatcttcattttatttccagaaatcccgattcatcgcgatcgattgttgattgctgtatttctccgattggatttggtgtttttgtagtccgatttcacggacttgaatccgataggattgttttgtttgttgttgataatgaaaacattggttgatgaatacaagagactgtaaatg

SEQ ID NO: 9692 - DNA, 3000 bp, Unknown
  misc_feature (1)..( 3000): cDNA_ID_2185323_gDNA_ID_1972172_Annot_ID_179874 3000 nt of promoter + ATG
taaaccgcgggttaaacccttgttcttctgcataacacagtgcttaatttgtttattttatttagttttgatcgaaaattacagtaagaattcacaaggattaatgtactggagtctcccgtttcagtaaatacatgtatcaacaaaagactaaaaatggacaaataaatccacgcagattgtaaatcagccaccactaaatactaacttctcacaattctcactcttttgctattgtttaacctctttaagaagatggataaatcgtatcgttgattaaaaaaattagataaccaagaaaaaaaaaaaaagtgtgagcaaacaaaaaaaaccctaaatcgcgcacaaacaaaacgaaagcccagcgtaaaggcctctttaatataaatgggctttctaagcttatatatatttacgggctttatgtgtgtacagagaagaaaaaaacagacagaagcagaagggataaacaaacaaccaggcatttgtccacctttcattttaagcattaaccatcttatcttttcgccttggaacttccccataattacaccacagactagtcttgattatcggttatttttcttattacacgagggtaaattagggaaaaacacttctggagcctttatcctcatgtccaaccaaaatctttacacaattcctagttcttaagaaaaaagtggaaattttcctttaaatttagtttaaaactcatacaaatccttctactcgaccactggtactctccgtaagctacttgctgaattcgattattgattttgggcgtagaagaagatgaaggcatcgatgaagtttcgtgaagagcaaaagcctctttttagggctaaagttcctttaagcatcttaggtttaccctttcaatctggaatcgtcgccggagaatccaaggagctcagtctcaatctctccactttcttcgaatctggcccttctctcaaagtcgcttaccgtccaaacgattcgtggaatcctttctctctaatcgtcaaaaccggatcgggatcgttcggttctccgatttcaagctctatgctcatgagcgctgaattcaatctcctaggtcaaggaaaccctagctttatgctccacttcaaacctcaattcggcgatttctctatcaaaaagtctcattcttcgtctggatttgagaggaatttgatcaaatcgatgaatggatctgtttccgaagatgattcttcgattgaggtggtggatactccagcggtcaatggatgcggcggaggatttagaaaagtcacggttctgccgtcaacttctgctggagatatcgctggattgttatctggcgttgaggttgcggcgaggacgtctctgcctgtgagaggacgcgccgttttgaatttccggtggggcgttagggttcctacggagatcagacgcgatttcgatccaacggctgctatttcgttgaggagattcccttttttggtgatgaataaaataggaatcgaacacgtggacggcgcagatgctaaagtgaccaaatccactggtgatccgggtaaagtttcgggtccggctcagttcacaacaagtggtgacgtggcggaggtgatagaggagcttcgaacggagaacaagcagttaaagagagccgttgaagatctccgggaagtaatatcaaacgtccgtccatactcgccggcgacaattgattacggatcacactcgaagtatcgcgaatccgagaggaacaacaacaacaacaacaacaacaacaacaacaacaacgggagatcgagagctgatcggtggagcagcgagagaacgacaacgtctgattacggtgggaagaaaagcaaggaagagggcaatgtagctgaggagctgaagaaagctttgaaaggagctgcttgaagcttctatggcggctattggtaatcgcaggctttactcgaattacaattacatttgtcgaccttaatcagctattgcttttgtatatatatgcgttgaattatctggattagatttgcacaacttgttttgaatcttttgatggaatcttcagagttttgtatgagattatgcttttcaattctctttattgaacttatatgcaggttgattgttgaattgatttgaatcagtattctattatagtatcaatcaatctgaagcttgatggtgatacactgagctctattaccttgaacgtattttgtatatcttctttttaaggcattggcaagtgtagttgaattaaaagaacttatctatgcattacaattcgagaagagtttgggaagagatttgccggtctctctaagtagcagcaaaactatatttgtcgatggcaaaagtaatctagacgatttaggacatctcagtatcatcctcggaagacatagtcatatagatacgaaagatccggatgctcatccatcaaatggtgaaggtcaatgttatggtgaacaattagacacaattctttgtacattgcagaaaatctgaaagaatgtattctctacagtactcttttttatatatttagtttggattaaacattagctgcttccgtacaatccaattttaaatgttatgagaaacgaaattggaccctcttggtgcttttggttccaaaccggtaatgccgtaatggattcggtgtaaaggttgggcctactaaagtgtgatacgacaaaaacgagcaaagtttttcaacattctctcaattggtgcgcctttgcacgaacatgttatcaacgaaacattacataaataaaaataaattctttgtcagacagattaaaaaaaaaaaaaaaaaatcagtctcaaggttttttagtggaggcctagagcaaagatttgcagaagacgattatttctatttcagttctacaaattggagaagtgacaataagcaaaatccactttgttcctttttacatttacttaatggcaaaatcagaaaacgacaaaaattctccagagaaacaaacgtggagcacaatg

SEQ ID NO: 9693 - DNA, 3000 bp, Unknown
  misc_feature (1)..( 3000): cDNA_ID_2185300_gDNA_ID_1972172_Annot_ID_179867 3000 nt of promoter + ATG
gttttctctatggaggcgttcgagcatctgcgttttcttgttcagtttggtgataagggatctgatgtatctccattgagccaagctactcctttttttgcaaattctgatccggatatgcccgctgttccagtccccgcttcccaagtgcatgactggcttctgcaaaacatagcttccgctttagaaagcattactgagagaatttctggaaaagagaacggaccttctaacgatcaagatgatgcgatgtcagatgtttgtgctgctccgaacaaggttgcacctagtactagaggcccgtgtttaatcgagggagtctccaagacttcacttgttaagcaagcctccgatctaaggggtagatctgtgaaggtctgactgttccttgttccgtttttcttccagtcatggaatctctgtgcaagcatgtcaactccttgttttgtgtatttttcaggttgtcaattgccatgattctgtaatttatcttttagcaccattgcgatatgcaactgtgcacggatgttctgatactactatagttttgggagctgttggcaaggtatggaaacaatgcttcttccttctttatcttttctgaagatagtcaaagcaacatttaacaagttataatatctgccaacttttattaaaagatgtatcaaacataattccgtatttatttctgcaggcaataaaagttgagcactgtgaaagagttcatgtgattgtagctgccaaacgagtgtgcattgccaattgtcgtgaatgtgtattcttcttgggagtcaatcagcggccacttattgttggtgataaccacaaactgcaggtgaagcttctctttaagattgtggtttaatttacaagttttatgtcatgttgctcttatttacctttctgatattaaggtaaaaaaaattgagtggctagactttttactagatttagtttggttagtttggttaataagccgtttcggacacgtcatcaagtctagtggaaacaaacttggaggggtggctagactgctgctagatacgtttagtcaaatgttttcctcaagaaggttttactggtttttaagagtgcgggcattgtcagatattgcttctagtgattatgggcttctatttttaaagtgctggcatcaatttgactttgtttcaggtcgctccatataatacattttactctcatttggaagagcacatgagggaggtagggcttgagccaacgatcaacaaatgggacaaaccattggccctgggagctgtggatccacatgactccctgtcacatcctgccggtgttgctgatgcacaggctgaatcagctgcttctgtagaccctgaccagttcgtaaactttttggtacattttctatttgggtctaacatttacgtcaataattggtgaatgcttttcagtgtcatgaagcatctaatgacgtgtttttcggtggtatcaatgacaatggcacagatcccaaactggtttagcggcgcggagcttggttcgacgaaagacaatccatttccattgccagatgcttatatggcagctcagcagagaaacgtatgttttaaagttatacttaaccagataaacaaatgcatttgttatttttgtccatatctgatcttgtatctgcaattttttttgtcatcagcttaagaactttgaagaaacaagacgatcgttaaaagaggcgcctctagaagaaaaccggaaacgagagctatcaagtgcactccatgtttatttcaaagactggctttacggtaagaaaactttctctgaatcgatccctactttactttattgatatgcatcattcattaggttttgacttagtctatgtttttgttgcgacagcatctggaaatataaggcaactctactgcctacaaggtgactaataagaataatagaccaagcggaaagtgtcttgttcatgtagagctccttcgatcatatttggcatattgctagtgaagaaaccccaccccaagaccaaaagaaaaaagaaaaaagagaaatcagcctgattcagtgatttgtagtttggaaccaatacttcacaacgtaacttatctgcacagaaatactctcttaaagctttcgtttagattattgttttcttgatttctgcttttctttccttgacatttcaatccatcgtttttgttcccttctctattgaaaatctcatcttcaaatagagcatgatgacttgaattgttataagttataacttgtaagcaaaactgttttgatagatagtcttgtcttggtcaaatagatttaagtggacgcaagagttaggctactaccatggtaggtgcaaatttctgaagaagttttagagctccaaaatttctcatatttgcagaatctcatattcgtagaaacatccaaacaatgcaacataacatgaacatctcaagatacaaaaacagaaggacatgggatggaacagagatatccatgagcgcaggatccagctaataatgagttcttgctactttagtcattgtaatgtgtgctccattgaagaaatctctcttagctctaaagttctgcaccaactgttcaacaccaatgaacacctccaatggcagcaaaagtcagcccgtggcttcccatcatcttcaacgttctgatgagtcctggaagagcaacgtttctttcaatacgagggacgtctttccagttgcaaaaccagtcacagcatctttgaatgtcttcatcatcgctccattttcctcttccaagtatctcatttctgtaggatccatgataatttcttcaaccgataaagcttagtcctttttatgtcaaacgtgatctaacaaagaaaattggcagcaacgacatagtggagaacacagccaaatactattattattgggcctaattaaagcccattaatgattctctttttttttttgttgttctcccttcctctcagcgcgaacgcaagctccgtcggca

SEQ ID NO: 9694 - DNA, 3000 bp, Unknown
  misc_feature (1)..( 3000): cDNA_ID_3043081_gDNA_ID_1972172_Annot_ID_179864 3000 nt of promoter + ATG
caaaaaattccggatattcgaaattccggatatctggaaattttcgaagtaaagcgaatcacaaaatcaagtattcgtttaaaacgaatcgaataacaaatatcataatttttccggatatccgcttcgtgcccatacctaattctgagtataaaatttaatattttttctttatgtaaatacacaaaaagtgaccatgaaccgtacagtttaaaatagtcatttttcgacgaaacaattaccgtgacgttgtctttaaacctctggagaaaagatttacatatttttgataactggttaaacttgtttaacgcattaatcatctcttaagaaaaagagttgtatatatctctcttgtagatgtgataagatatggattacaaactgtcatcttagcaaatttgtcttcttcttttttttttatcatttgtcttcttattacacttatcaaattatagtattagttatgaccgtagtgggtgactcgatcgtggtaaacgtacggtggactgaaatccttcaagtcgaagctatacaaatgcgagcaaagcatgatcaacacgtgtcatttgcaacgactaccaatatcttctttaatttctatcttactctaattataaaattagattattgtccgtgtaaagtagctaatacttttgattaaattatgtcaaaatacttggagcagaagcattctcttaactactcggtggcacatcataaagctagaacgaaaagtaaaagacggccctctcagcaattaaaggtgccacgaccacgagaccgtttcgatactaaatgattatatacaaatactgaaatatagttagtacttgttatttagtttaagaactgaatatacaaatcaacagatcaaacatatgcaatttaactactaatatagtatatatgtccaactgcccaagtcttgtttcataaaataatgaagaaaactttggtgacaaatggaaaaagaacattttgtaaactaattatgtctacccaacattagtcggtagaaagataatcgcatttttgtaacaattgctccgaagtgtggatgatttccattttatacctaataaactaaaataccaaagccacaagaagagttcgctaacgcgtttaaaacttgtcgtctatctatatccatttgatagtatacattttggaattttacccagagttattttcttctgattcacctaaacgaatcatgatggcttttacatagacagaaaataaaaacttgttaaaaagcaaaagcagtgaccatttatttgtttgtttggataaacgaagataaaaaaatcctatatcaagtaaaaaaagcatgcacatgtctagatagataaaacacataaatgtaggaattatgaattcggatcgtgatagagatttagacgtttaaggtaaattttgaaggaaagaaagataaaataaaaatacttatgtagacagacaacaagataaaacgaaatgggaccccctaacttatttatttcgttattgaccagaaaaattaacaaaaaatagtaacggggtccagcaaaaagcaaaacacggcttttgtataaatgtacgtatgcttcacccaaaacactcgaggatgaggaatccaatgacttcttcaattccatagtgtttttcatttcttttgagtggccagatcaattgcacaattatgcaatagtttgtctgctaaaattccatatttagtaagttaataagagggattattataattttgtaaaatttgaccaccgttgaaagattacgcaggaccgtcgtctcccacacgtgtgtaatgtagggtatttcaaaactgagagaagtatgtctttgcgtgtttttatttataaatggaccccacctcgatttggtatgcaacagtgcctctcttttttttgtatttcaccgagttaaaaaaagaaggaaactgtagaaaaaagcagaagaagaagacgacgacaataaaacacaagagagagagcacacacaaatcccttcttcaatgtttatttactctctccagaactttcttttcccagtacttctcctctgctttttattacttgtcttcttctctctttaattttttataaatttaattttgggttgaaaaaaacgaggaagaagagaggagaggagactctttcttttagtatttatttatggaggaggagaggagactgtcttaatcgtttccgggtctcttattctgatccattcttctctcaagatctaaggtttgtcttctttaccttccctttttttttttaatcttcgtctaactgctattccatgtattttgagaattttattgagtagagggttctcttcgttgtaacttactctaatggctattttctccaactcgcatgctctctgcttcttcttctttttttccctttccatggttttattttctctctgtcgttttctgtgtttggtgttgtctctcattgaaatcgagaaacaaaagaaggaaatttgggttttaaaatcttcacccacagcgtaattcgcgttgcttcattgtctttttggtagttctgtttccgagaagaagaaaaaagtatgttttctctcgatgaagttgcttcatgaatatgttttttttttttttggattcatgaatttgtgccgttagattctgccttggagatactaacgaggtttttttttgtttaagatctagaaaaaaaatatacgatgctttattcgagattctttttcaactttattatttctctgcattttcatcacctacccaaaacctgagttttttcacttagctttctttgaaatggttgtgttctctcagatttactgattttgaagtggagaagaaattagttgtctcgacaaaccccactagtaagttttttaactcttttttaagctaatattgaatatgaatgtttaataatcgtttttgtggttttggaactgtgtaggaaactttgtttagtgtgtcttcttaaagcctgcaagatg

SEQ ID NO: 9695 - DNA, 3000 bp, Unknown
  misc_feature (1)..( 3000): cDNA_ID_3043101_gDNA_ID_1972172_Annot_ID_179853 3000 nt of promoter + ATG
caaacaatcttttgatgaaaataaaaatgttatagttgacgatagaaacgagcaatgcttcatataacgtggaacaattgcattacatagacaattgcttgtggacattcgtactctacataaaattagtcgaagttagcaaaattcacctaagatattgaatcgtttgtgatacattgcttcttccttttgggggtttgatattaaatgcttttacaactatatttccattgacaatctacctttataatgattattagctaaaccaacttacaaacaacgttttgacaaccataattgttatgcacttttcaatagtcttaactctgcttacggatgtcgtttgctcagcaatttgggaaatgggaataactcatataaagagatatgtgtgttgttgtgtggatcccatgcatgtcaggtttgtaacagctgtcgaataatgcaagctacatagaaaaataaaacattttcattaaaacacaaaaagaagaaggttagagagagctattcatttattcatcgaaacattttaatatgggaagaagggaattcccacaccactccactacgaagagaggcttcttgggccagtgtcacgtgattaacacgcggatccagacccactcatatataaacgaattatctataatattttctaaacatatttctttattcatcgcacatttttttttttcatgcttcacgtatacatccgaaaaatctttgtggtctcgcccatatctatccttttaaatccatcatgatcccaatgtgatacgttaataagaccatctgcaatggttgtctctattttttttttgtaaatatagaagagaaaatagagatttctatttttactccaataattcttcaaaaatagaaatctctatttgttagaaagaaaaataggggaaaaaaatagagatccatatttttgtttctatatatagagaaaaaaatagagatctctataatggaagtgagaatagagatgagttggagtgtaataaaagcaaaaatagagtgtagagacaaaaatagagatgtgttggagatgccgtaagtattgtgaagataatcctcacagctttctcagcaataaaagaaaatatatctctttaattttttataaaggttttatgtgtgaatattaaaaactttagtctcatatgagttcgagactgtgctcgggaacaaattttataaagataaatcatctaaaattgaactgcgtttataatggcaaagactttgcataattagaatgtttcttattgataaagactttgcatgtttcatactcattttgacatctaattgaataaaaacagaaaagagccgtatagcttcaaaatctttatatttagaataaagtgtatatatgtgaaagagtaacacatatgtacgtaggaattaggttggttaaagaattggccacatcaatatctgagacaccaaagaagtaatggacgttgggagagtaagtaacgttgccaaattggaaatgccaaaaaaagattgtacctttcctctctttgattgagactttactactacaccaaaccttacatcaccaatcgctgaaagtgaaaccgatattttagcacatttatattccacttctacacctttttactaaatttcagttttgagatttacttacatgaagaagaaattggctaatcaaaataatcaagcaacgatgatttgttgcaatgaaatggaaattgggatttgggctcagattattagagcataagtggatttcctgttcggcccattgtgtgaaacaggttattccactggacccatctgttcatctttgtcctcaaattttcctctctatccccaaaacacccttttaaagaagtaacattaattgtttttttttttccttttaataaatttataagatattttgaattaatattattagtacgtctcaatttttattttatttttgccttttatactctaaagtttttaatacttgatgaattttgaatatttttaaaaaataaaaaaaataaaatatttttaaaaaattaatattacgcttggtagatttcatccaacggctgagataattactaaaatggtgttttgagctcaattatttttccatattaaaaagtgtttttggttcttggttatttacaggtcaacaaaataatttgacaccggaatcggagtccgtggaaagtcagaaaacctgatgtaacaccatttatggcattaactactgataataatactatacgaaaatccaattattataccgagaaaaaaagaaaagtggtcagagacagcaggctggtcctgctgaagaataaatctaatctaccgattcgattaaataaatatgtgccgttttctggtacgccctattcaaatcatttttatattatagtatcaaaatacttcaaaaatttactaattacaaaattaaggagtgataaaaaaagtttataatcagagataaaaagtcaccggttaaagcccaaaaggcccaagtaatatccattgggatccagcaaaatatataacaaaagaaccgtaccgtacctacaataaccaaaattggttttctctttcttttgtctaacagtggcctttatttaacagacgcactccactgctaacgttgctttcgtcctactcttcttctggtgtaaaagcttttcttccacacacatttgagaaagaagacgaagaagaagagagaataactattccttcttcgccaagttctctgagctatagaagaaggagggatttcttcagaccgccattgttgcccaccttctctcctttctatttttcgccgcattttactcgcttactgacaaaagtcttctactcaagtctctctctcgctctctttggaggctcaattagggttttgttgtcgtgagatttgattacacaaattgctgaatttggtttcgattattggtgttattgttttcgaagatttccagtgagtttccgtttatg

SEQ ID NO: 9696 - DNA, 3000 bp, Unknown
  misc_feature (1)..( 3000): cDNA_ID_2185273_gDNA_ID_1972172_Annot_ID_179858 3000 nt of promoter + ATG
acgtgcatcatcattcgtctgatggtaaattccacaatgggaaaagagtttatactgattactctatcattggtaagtgtccaataatattgttgctcatcttagtcttatgtcgaccgttgtttgatcagaaaatgacaatggttttttaggtattccgggggatggcagatgtttgtttcgttctgtagctcacggattctgcttacgctctgggaaactagctccaggcgagaagatgcagagagaactcgctgacgaattacgtaccagggtaagtatctatggttaagagtttttatctgtcatactttgccaccaaagatcaaagtaactgttgaattggattcatatggcatcgttagtactttttctctctgcttcagcaaagcctaggtcttaatttcatctatcaaagttcctatctatgtgttatctttgaatgtgataggttgctgatgagtttatccaaagaagacaggaaacagaatggtgagtttttcatgctttcagaccaattttcaacttcattcactggctatggactactcttaaacttatacatcacatttgttgatctcttattaattacgaactactagcagctttttctttgcatctactcattctgatgattctcatcaggttcgtggaaggagatttcgacacctacgtcagacaaattcgggatccacacgtgtggggaggtgaacctgaactcttcatggcttcacacgttctccagtaaataacctcatcctctctgttctttttggttccttaacgttcatgatttcagtttctcatacacaatctagattgaaatctaacaaactccgaaattgtgatcataggatgccaatcacagtgtatatgaaagacgataaagctggaggactgataagtattgcagaatatggtcaagaatacggtaaagacgacccaatccgagtcctataccatggttttggtcattacgatgcccttttgcttcacgagagtaaagcttcgattccaaaatctaaactttagtatacttagttttgcatctttgacttttgtcaggtgttgatgatgtttttgtttactgacacaaccactatctgtatgccttgtagaatgtaacctttttttaccttttactttgaataaaaattttcagtttcaaatgatatgctcgcttcaaaatcttagcttctggatagatacaaagcttattgtagatactcgaaaagagtatatgtggtcagtgtgatatcaggccattgtggttgaaaagttgaataatgatttaaaatggtcccaaacgtgacaaaagttagttctacttcatagaattgagtggattacacactagagacattgtagctaagaaaagtgtaaaaatgtcggactagagaactattggtcacccttgaagtcgttgacgacatcgtatgggatgggagtgatagtctccaaggtcataccttcgaccatgaatcctagtttgggtcctttaggctacctctttgtgctaatggtttctcctctggctttggatgcagccttgagctcatcatttttcttcttcctcagcttgaactccacagcacatcttgactgctgcacatgctccacaagaacatggatcctcttccttatgatcttatcgccaatctgataaacccacctcaagcaaaaactcaaaaatcagtgtagagcagatattgtcatagcttctatagagacaaagaaagaagagtaactaaatctaaactgtgaaagtacaaggttagtgtatttgttctttgatgattataggttgctaatcacagtatatatgaagcacaagaaagttagtatatatcgcaagttagggtgaaaagtaaaggagatcagattaaagtcctatatcccatggttttggtcactacactgcctttttgattcatgttaagcaaaacttcaatccaaaagtaaaggatggatatgcttgttttgaaccggtatgaatgccatccggtacggttgttgttggggacataagtgggatattcacatgcatctttgtaattggtgactttttgtcaggtggtgatatattttttttttttttatgtttctgacacagccaccacaatctatagtatgtcttataaaatgttacctttcaagtaccatataccctttaatttgaataaaatttcaaataatttggtcgtttcaaaatcatagcttgtgtgccacacattgtcaaaatcgtgataatacaaactacaaagttcataatatttgtgggcactcaaaagatatggtcagtgtgatataagtagtgttgttggtcaggccactgtgcttgaaatgaaatgatttttttttttaactgaaaaatgaaaaaaactaaaaacaatacttcaaagatgttctgtttgctgatcaagccaagtaatgttcaccagctaagtttagtaattagtgttgtttaggttcatgtctcctactacaaatgcaaattcaaaatcttgtcgtcagactcggtttccaagtaataaaaagcctaactcgtgctcattttccaacaaaaaccaaaaccaataatcatctacatcaccatcttaacaccaacaaaatttagaattttttaaacaaacaattaaaaagcacagagcaacacacctgcatcagtcaataactaaaaactttggatttatcaatcaaaataactaaactgtcacagagcaacaacacattattttattagtatttcaaatttatatccattaccaaatacatcttccaacactttttaagctcccacaagaattcaaaaaactttcctatgtctacattacaaccacgttgctactttggaaccccatcaccctaattcctctctttcgtcttcttcttccctcgtctctctctctccgcaactcctcgttgcatcactttacattgaaacataatctgtagatattaaacaaagtcttttgcaagattctgattctctagacaaat

SEQ ID NO: 9697 - DNA, 3000 bp, Unknown
  misc_feature (1)..( 3000): cDNA_ID_1021348_gDNA_ID_1972172_Annot_ID_179856 3000 nt of promoter + ATG
cttccattatagagatctctatttttttctctatatatagaaacaaaaatatggatctctatttttttcccctatttttctttctaacaaatagagatttctatttttgaagaattattggagtaaaaatagaaatctctattttctcttctatatttacaaaaaaaaaatagagacaaccattgcagatggtcttattaacgtatcacattgggatcatgatggatttaaaaggatagatatgggcgagaccacaaagatttttcggatgtatacgtgaagcatgaaaaaaaaaaatgtgcgatgaataaagaaatatgtttagaaaatattatagataattcgtttatatatgagtgggtctggatccgcgtgttaatcacgtgacactggcccaagaagcctctcttcgtagtggagtggtgtgggaattcccttcttcccatattaaaatgtttcgatgaataaatgaatagctctctctaaccttcttctttttgtgttttaatgaaaatgttttatttttctatgtagcttgcattattcgacagctgttacaaacctgacatgcatgggatccacacaacaacacacatatctctttatatgagttattcccatttcccaaattgctgagcaaacgacatccgtaagcagagttaagactattgaaaagtgcataacaattatggttgtcaaaacgttgtttgtaagttggtttagctaataatcattataaaggtagattgtcaatggaaatatagttgtaaaagcatttaatatcaaacccccaaaaggaagaagcaatgtatcacaaacgattcaatatcttaggtgaattttgctaacttcgactaattttatgtagagtacgaatgtccacaagcaattgtctatgtaatgcaattgttccacgttatatgaagcattgctcgtttctatcgtcaactataacatttttattttcatcaaaagattgtttggattatttagtcgtataatattttgaaacatatcaaacatcatgaatgcacttcacctcccaaaataagaagtctaagtccagtgctaaatttggttagcgtcgtaatgattataaatcgtcaataacattgaactgtccaagtgtatatatatatatatacttaaatgattacgaaggagacgtctctaaattttctacgttatacgtttacacgtatagaattcgtcgtacatttaaatacacgtacatgtatatacatatttggcacaatgatcgatactgatacagtgttgtgtaatagtaaatagtaaatacgttataggtaatgagtgatgcaagtcgaaacacttctatcgatcattgttcacatgttagtttcgttggattcaaccgattttcttataattcattatatatacattcaacttaaagaatgaaattctactttcaaatgcattaattgtaagatagcattaatttgctcatttgcaaagatactttgttatatgtgtctgattaaaaaaaaaacgaattgatgtcagaaatgagtgccacaaaatctgaacacaaagaaatacaacaaatcgtcattgtttgtaccttaatggtttgtttaagatccattgtaaaacaatacctcatcgtaacaatgtgatcatataacattataagttgatgcgtagacatggattagaaataagagtctcgcatacacacacaatgaaagaaaaattaaaattgataaggtagaagaaaatatagtgatgatgataaagaccggaacatacgaagggcccaggagacaaggacgaaacaaagtgggcccataaaagaagtacccaaaaaaaaggacttgtgataaagttgggcccatcgtcgatgatcccctgtgaatacccgaaggccaaaaatgatgggggggacccactgaccaagttgcacggcgagtgatgtgttctgtttgggtctaaatgggccgcgaaaacgatgggcccaacttattcattgctttgccagagtcctttgtgttgtttgtagattgtagtactaacggcaagctgttcgagactattgccagtttccggaaaagttttctgacacagactaactttttgttgggtttcccattccaagtatcaagatattattagtttaatctggacgaacgtataaataattcatttcgaaaattatcgtatgtagtaaccaaccagttcagtattcttaagtgaaaaaagtacaaaatttcaatacgatcaaatatgtactagtttaaaaaaaaaaaacatttctcatgcaaaataactggcaaacataaaaacgggttgggtaacctgaaacaaaactccagcccaaaatgatgcccgcttatacggcccaataaagctaaagtttgctgcgaacttaaaacggcagcgtttgctaattagattgagtaaagcgatttcacggtgcaacagtcgaagcttctcgacttgttattgtttcgtagcttcgtcggtccaacaagaccttgcgctagaagaacagtttcggctttgttttgttcaattctcacctcaccccggacagagtccaaaacaacggtttatttcttgcgtttgtcgggaaatcagagttgagtataataaacacccttcacgacattctttgcttgtccaccttggtaatcctccattcactctcttcacgtgtttctctcttgataattctctgatacccgtacgcaattttatctttccttcttcgtttcttcgatttcaatacgtttggattgtgtgttggtttcatttttctgatattagaaatttagttgaaacattacctgcaaatttgcagttcttaactagatagcttgctcttttagcgatccttaaggtatattttgttatctagttatgattttgtttactataccattgcctcattggatctatcaatgtaaaagacttggaaattgcgttgttgttctttgtgtaggtatctgaaattgggggactcttattataaaagat

SEQ ID NO: 9698 - DNA, 3000 bp, Unknown
  misc_feature (1)..( 3000): cDNA_ID_2185379_gDNA_ID_1972173_Annot_ID_179907 3000 nt of promoter + ATG
ttcaacaatcgagattgcaaaactttctctccgtttagagttacagagcctctcaagcttccctcagcaactctccccgctagtgcatcgatcaacgttgattttcctgctccacttgcaccgagaacggcgaggatatcgccgtcagaagcctctccggaaacatcatcgagtagagtctttactccgttttgccgtgagaagccaaaccgccggcgaagtgtgacatcgtattgaagattgttaaagtttaagacgtacgggacaggttttacgtacaaggcttcgacatctattatgtgatgtgcaggatcgtcgctttttacgccgtcgccggaatctccttttcggaaactgtcgcagtctttcagcaactcgtcgagggttggtgatccgatgggagtgatatactgagtttccgccgaaacacgtgtcatggcaatctttctaccgctgagtgatagattcatcggacggcgtcgtttagagttttggcttaagaaatcatcaaactgattgtgaagtatatatggtggaatctgaaagttcttagtagtgatattttttatgatgggacgtatagtttcatacgttggttatttataagaaaaatgtaacatgtgttgtaacttctgtaactaaaaaaaaatattagatagaaatttaacgttcgtgtgggtcgtggctagtaataagagtgaacaataattcagaagtttcgttttcgacattaaatgtatgtaaaaagcaaaatactgtgaattacgtggtcattaaattcttgataagtcttaaaagaaaattcaaaattgtatacagtactttgattttggcttctgctctgcaccacgagtcgcatttaaatttgacatatgtgtctcatcaaccaaatttgaagaatgtgttcttgtacatacagcagagaacgtttgttcatagtaaccataacacattctttggttttaatatcatccaaaacagttttctactcctaatcaccaaatcaaatattaacaccgacacgcaaaatgatacaaaatatgtatctccctttattaatatatgtcgaatcaattgatgaaataatccaaaaaaggaaccatgctgaacctagtgaggaatgcgttgacaaatatgcatgtatacagtagatgtggatgtcaaaactactaagagaacgactctctcttcaatgtggctccacaaaacggttggtaatttgggatggccgtagtttccattaattggttaaactccaatttcccaattttgttggattcatgattaatctatcttcgtagaatattggataaattgtgatatcagagattcagtatataactaataataggttagaaattaattcacaaaaaacaactttttcaagtcaactatagtttataaacaaaacaaataaagagagttaactaaaatttgtgtgaagcatgaaggagcccacgaaattatctcaaagtgtgtggctcgtaggatttgacaaccaccatcatcatcgccatcccttactgattacggtacatgatttcatttaatgttaatttcttaattttcttttatttcatgaagtttcattttcgacataaatgtatatttaggaaataaaaaatcgtgattttcgtgattgttttttttttgaatccgtgataaaggcaatttggcttcgtcaactcgatggccatttcattattatccattatcaaagctaagatagttaccaaattttgtttaaagccttgtttcgatgtatatataaaacatgttctctctcgttagtaaccaatcagtttcaaagcataacatgtaaaattaatacttttcttttctttgtcggccacaaacacattcctttgttttggaattatggttcgagtatacacaatcgctaattcaacagttctactcctaagaaacaattcaagttttaacatcaatacacaaagccaaagggaaattccattttttatatacatgttggatgaatgattgacgaaaatatcgaatcgagtcaaacgatcgacaatgaaatgataaacatgtaggaaaggaaccgattgagatatgaaattcgagagattactaaaaataggaggaggaagccggtcctaacatttatgtggcctaaagcatattttaaaaaattatatataaaaaaaacattatgaaaaacaactaaaaatcatctattgttactcgaacatgggggagattgaagatttactaatggagtttagtacaatttcaaaggagacgttaatggctaagttttgtttgaaattgactattggatgacgactattggatgatgtaacccatacaccaaatttgtactagttacttcaaagctgctgtgacatctaccaaattgtgtttaacgcgatgtttctatatcaaacatgtcactcgtaagtcccaagtactctaataagtagtctaagtttaaaaccttatcgcctataacaagacatgtaaattagtactatcatttatttttggtcggcatggttgttacggcaataaatacattttactctgttgtttctgaattatgacagtaccggtattgagattttgggggtcccaaatatgaaaaacagtcaatatttttctacaaatataataaaatttgaattttaatatttcaaccaattattgagagaccgttaaacttacaaaagataccgtcaatggtaaacgagagattactaaaaataggagaaataagtgcaatttcaaaggagacgttaatggcaagtttttctcttccaaaattgactagtcgatgatgttaattgttaatgttgtccacgtgactcatacataaaccaaatactgtatgtactaaataatctacccggtccaaaccggtttggtaaactgaatcaccgatctagagaatcaaccttacttgtgcctttctcgctcaagtagagaagctcgacggtaaacagaaacacttgatacgacgtcgcataacaacgaacg

SEQ ID NO: 9699 - DNA, 3000 bp, Unknown
  misc_feature (1)..( 3000): cDNA_ID_3043144_gDNA_ID_1972173_Annot_ID_179911 3000 nt of promoter + ATG
atcaactaaatatcccaactttggcatgcccatcactgataaagcaactctagacacacagaatcgattaccaccatcttcaaaaccgccatattcatcacaaagctccttaaaacatgaactgatcactgaatgaaacttagtggttttagccaaggctgaaacaagggtcttatgaagaggcaaagaattctccatgaagagtatctccaagtaaaacctaatagcttcccttacagaaactgtctctctctcgcctccttcattctcattggccttggcgagaaactctccgaacgaagcaacaactttcttggcgtgattaacttgcgcgtagattgaattcaacgaaaccaattcttcaatgttggagtaaaacttgggacaagactgagacaaactagattggctcaaagaagcagtgaacgagctggggaacagaacagcactgtaagtataacgatggcgatgctgcagagctcgccacttcgcagacatgtttcagtgagctgaggaaaaacagagaaacaataaaaatttgaactttatttttttcacttgaatgaaaaatagaaaatatggtaaaacagattaaagatcataccgggaaaagcggctaagtgtacgagagagcttattaggaggccggagcaataccagtgagtaacctaagaggcgacgcggcggaggcggaagaaagcacccgccttcaaatctttcaactggagaagatatgggccttacttgtgtttttaatgggcctgatttttagacaaatgagaaaacattttggttgtctaggacgactgcttagttgtgctataatgagttcttgaagccaatatttcagttgatttgagtgtaaatttcagttgcaactggttgcatagctcatcaacacagttcgaacatggtaatgctcttgtctcagattgcttataaaacaattagctaggttcttagactgtcccaaagtgaataataaacaggtgatgatgttaagtggcttttgttcgcagaatcttacgtttttgcagattttattgccgagaccaaatagatcagcccacgagctagttctcgaaagtcaaatagggtaaatctcaaatttataacaaagaacgtgcgtgagagatcatacaatcatgtttgaagaatcaaatctttaattgaaagaaaattcagatatattagagaagactgagggaggactctctgacagtagaaagataattaaactttgatggcatactttctaattggaaagtacatgtctttcttcttctctcgttctgtcttcagcgacgcctatccaatgcagagaaaaagtcatgaagtatggaccaaaacaaagcatgtcactgaattcaaaatacctggtgtttagtgagtctccttctgatggctctagtcttcttgggacggagatcgagtggcaacaacttcttgtttttgtatgcttctctaagagcagacttttgtttctgtgagctcacagtcaacacttgcgcaatcgacttcctcaccactttgctgcaacaacccaaaaacaaaagaccacaattagatccataataacttaatttgaggccttaccaagattgctaaaagtcctaaacaaaaacaatggtcttgcttgttcagagattcaaatagattatataaatatctttcttttcccatttcgcagacatacaagataactaaaaatcccaaaaactgcaacaataaacccaagactaatctaagcctcgattgttttaaacaccaatgttttggcgtctgtgtgcatagggattttgcttaagatgctaaagatatctaaaaacaatgaacataaaagcaaacacaagcaaaaaaaaactgatgactaaagactagaaatcaacaattccataagccaggtaccaataccatgcaaagggcaacacactaatcacatgaatgtatcaaaatgcctaatttgtaaacactggcaccataaacaattcaatataaatgcaattaacaattaaaaaatcaacaatctagtaatctactattctcagtagctttagatcatactcagaaagaggctagtgattccaatatcaagcagctcaaaatattccaacatttgtataataaggctgagagtagagaacaattacatcttagagagcttgttaggagcaccaccagtgaccttagcgacacgtagggaagcaagctctgccttcaattctttcaattgagtagaaagatccgattttgatttatctctcaactcatgaaccttgattctcgctgttcacggatccatttcaacacaacacaataagaaaatggagccaaacataagcaactcaaacaataatggtggaaatgattcaagagtagggacttacccatggcgtcttcgagccctctctgactcagtctctttgcactgctatagtaagacacctgaaaccctaaactgaagaagatgaagagttctaaatgggcctcaatgatataaatgggccttaagtttagtacagacagtgaataatttattctttttagtcatggttaatacgttaatctgactcaccatgtggtatttacaaaattaatcagattgtaatatgtcactttatgtataatgtttttgtaggattgattcaaaattgaccttcgtgtgtcttgcaaatatattttttcttttgccggcaatgtgtcttgcaaattttccatatatatcgaatttggtaatttgaggtcaaatgttatcttcccctaaagaaaagttaggtaattaacaggataaatttattttagtcagctggtcccataagtaaaacgcattaagcggtttttcgttaaaagcttaatctgatttgactctttgatctctccctcttactaatttttttttttggtcagatataaaactctcttatctcgtgatcctcgtcgtctatatattgaaacaaatccagttttctttcttgaaacgtataacaaaaatagaacatc

SEQ ID NO: 9700 - DNA, 3000 bp, Unknown
  misc_feature (1)..( 3000): cDNA_ID_3043140_gDNA_ID_1972173_Annot_ID_179913 3000 nt of promoter + ATG
gaggaagagacaaaccagatgatccagaagattatctcggattcatctaaagaatccgacgactgatcgcgatgttcgatcgttagatttcgaaaaccttatagtttatatatatgaatctcatgaaaacgatttatccctgacgcatgcatgtttataagtaaatcgttttttcatcttagcatcggtccaacaagcaagacagcaaaaaaaggagtgatgacactctttttggtacgttatacgtacgtggtccacataatattgcctctgtttaattatatataatgaaacggacgctagctcatacatggatcgatggtgtggtgttttaattgaatgtatcgtgtgtatatattttcaaataaactatttatttcgggttttggtcaccttaaaaggctttagcactcttggaaattttgtatcatggtttccatatgcttgcaagtttcggaacccaaaagtccagattttagccagatcagtaaaaacgttgatcagctgttttttggtccatgatcggctgttttttttttggggaacgtctatgcagccatttttgtttttaatagaaatttcttcaaattgaaaatttacattaattaaacaaaaacaataacatggagaaaaagttcttgaacaatatccaattaatttgcgattaagtggtcaaaatgtgtccgatcctatgatcagcccataacttgaacgttgttaatttgttataccttgtgcagaaatgtctttttgggtcaaagttcataagaaaactctcacttaacatgcgttgttaagtgagtgactactcacaagagtagtaacacgtttcaatttccagcccacgtaaatctagactacatggctcctatgtaataattctttctttttgttggtaagtaaacaaaaaattataaaaaggatttattcttacgttaacttgatataaaaatggaatttcgagagtatatagtatatacaaacgaataaatagaccggttgaaatgcaaaaggtatgtatttgccaaaaaacagagagttttgaatataaagaattaaagacaaagattgtcatttaactttctttttttcagtacagtaaacgtgcacaacacaatatagaccacacattaaacttataaagaagaacatacaaacgaaacagaggaattttctttcaacaaatgccataactcttcaagctttgtagtatgtaagataaacactgaaatggagaatggtatcatgaccatcagtaacatgttggtcttcctggttgtgtagagtctccacgacagcataccctttagcatgctcgaatctcccagttccacccacaacagcgatatgcgacgcatgagaagcggttcggtgaaccccaaagaagctgatggcatcatcaagggtgtcatgatgatcatgatcttcgtggagtaacactgtcaacgaaagggtctggctagttccatccaaagagctagcgagataaaacccttgggctctcccaatgatcgcagagcccaactcatggccctcggtgagctcatcgtcaaccacggtgatagagccaaacataagctgttggagggcagctatgggagggagctgacccgtggttacaaagggaaggttgttggagctaagggatccttgagagttaccgttactgttttggattacggtgttggcttgagagccactaagtcctgttaggagtggagctgtgtttggattgattaagttgttgatgctgtttgcgttcacaagcggcactgcgttatctactgggaaaatgttgttgctggatttagaaaacggtattccattcacctctgtttgtgctactatccctgtaaccacacgtgctgatgggtgtgacccgcctagcacgtcatgcataaagaactctaggattggctcgggtcctcccgtggcgggtcctgggagaggaattggtgttggagttgttgttacggcttgtggactatcatcttcctcttccggtacctgggggactaattgtggctgagtttgaacctcatcgagaagtcgagcggattggacattggaagctatcaagagaaagagaaagattgtaaggctaagagctttggccattgttctttctttttgttttggttttaggtttgtgtttattttctaaggctaatgggtttgtttatataggaagcgcggaggatgatgagatcatggagtggagttgttgttgttgttattgtcgttgcattctcatactctagttgattaatggatttaactaaacctctaggttttattcattttaatttgctacttactcctcttgcttcttctagccttcttgatttctttgacctatttttgtttctttctatctattcgttagaaattagaataaatcatgttaagaaattaaatggaagagagatcttaattagccatgttaatttcatacataagtaacataattatatttgcaatattaaccaatcacataattatgcaataccactctatttttgtgacttcacaaatttaatgagagaaaatgttgtcattctatagtttatctttatattaagttcaatttcttgtttccaccaaaaaaaaaagttcaatttcttgtaatcaatttttgttaatgaaaaatgataatcggagacaaaaccagtcttggactcttgtcattatttgggcttaaatctaaaataagatgggccaatattgctatattagatccaaaagttaggcccatgattgaatcaccgcctagcagaggaacaccacttccgtcgtagagctttggagctatggcggtaattcattatatagggtttattctttccgttcctcaccaaaatctgccaaatccgaagttgcagatgcgctaggagttcacttaaactcggagccaaaaccatcctcaagtccttccagtttcggggattctcctaaatcctagccgttgctggtggttgtagcttgctagtttgagagatg

SEQ ID NO: 9701 - DNA, 3000 bp, Unknown
  misc_feature (1)..( 3000): cDNA_ID_3043120_gDNA_ID_1972173_Annot_ID_179923 3000 nt of promoter + ATG
tatattttgaacacggccggattggttgtcttatgattaagtgaatgctttagatctggtgacgattggtatatgagatatatagtagaatgatagaacatcagaaatactataagtcaccatatttttaaaaaataaatgctatagaatttttgttttggtaattgttataactctacaaagttatgtgttatagagttttactagtttcatcgttatcatgtgtatagtataacacaacaaaagaaattttaaatatctgaaaacataaaaatttaataaaatgatgtgagtataagaaaaaaagaaagaaagaaacacgtaaaaaataaaaatcatcatacatataacaattttcaaaagatcaatgttactttaattagtcttttttcttatgtttcatgcaaatgcaatagtattacttttctttaatctaagattatgtgttgcttttaagcaagaactattcaaagagtcaaagacatgcatgtaaactttagagaacgggatctttcatcaatcttatttttttcccttttttttttacaacgaacgataggtagtaagcatgaatctggttcaaagtttggatcagtgtgggcataatcctggttcgctaaaaagaatcaatataatatatgttgagcgtaagagaagaaagctcatagttctgtgtagaaaaaacgtggagattggagagaaattactaagagagcgaagagaagagtaaacctagaagatacaaaagacgctatcaaaagattgttttatgtgtttatgaaacattcacttaggccagtataaatattaaatgtcattttgagaaagaaaaaaaaatggtgtcattttgaggatataaatattttctcaacaagatgttttagactttcaacataacgatcatttaaaactacataatttatctcttcgttaaaaacttaacattaacaaaaagttaaattcgacaagaagagtttattcaataagtatactgtatgtgtttattttattcacatgaaaagtgtcaaacaacacttgggatacatatttcatgcctaaaaatcgtataacaacatttaaggtaatcagtaaatttgatgcctaaactaaaatatgtgaccattttgaccaatgagcattttttggaaataaaactactgcatacgacctggtcaaacacatgaactgccactgcttttaaaactacctttttaaacttttgacgtccatttttatttactaattattatgttaatcaaaccactaacattatgattcgaaatttcgagtgatgattgttagaagtgatgtgaatgatgcggtataaaacaaattgtgatatatattcactcatatatatcaaaatcaaaatagcttatcgttccaaaacatgattgataaaatgtaattactattcaaaacttaaagccagtagttaaaataaaacaaaataaatagtatatgtttcatattaatgccaaaccaatattttgttttgatgaggaaaagtctttttttttttttctttttttttctcatagttaaaagacataaaaaaaattaatattacaaacaagacaaaaaaaaagaataaataaaacaacaatcattactgtcaaatcaattatcagagggaaaagttattaagaaatgtcaaccaatgagtatcattatcatcatgcttttttagacccttctttttaattcatcaagatttagtcttgtttataaatttgaagtaaaattctaaatgaatcaattctacaattttttccctacattattgtaacgataaaatttaagatcaacaattacttcgttaattttttttctgataaaaatatttgatatctttctgattatgatatattagcattgtttttgtattgtatgtatggtaattaattttagttcaaaagaataataaatggtttgattagcatgaatttaataaaaaaataagactgaataaacataggtaataaactttgtttcttttggtaaatgtaaaattagaaaaaatcataatcccaaggtaattactataattacattcaatgtcagaattaaacgtagtgaataaaaaccgtaaaacatgagaaaaacaagaatttattatctttgacaagcaataaatgaaatgctgacaaaaaattggtttcaaagtttcaacgcgtttcttataataagaattcaatttcgtgcagctaatcaggagataattatcataattaaattaatcgttactactttataatactcccaaaataatcgaaaacgaatttattttattgtaatttgtttaataataaagaattactgtttcctcccacttcccatctctcttttccttttgtgttcttcttcttctccgctttgtttccccaatctctctcttctctctctctgaagaaaaataaataaaagatctaactttgacggctctcttaatcttactcactccgtaagttccaaatctctctcctttactctcatatctatatcgtccgaacaaaacccaggagaattgcttcaccccctttttgggtttttaatcattttctcagattctcagtttctgtttccgtcttctagattctgggttcagtttctgttttgctcttattgaattttcttattcattttgtgtttcggagttattcatggtagctgaatttgttaattctgatgttgttttgcgttttcttcttttctagtttggctatgtcgtctttgatctgatgctgggttattctctttccctctgttttggtttcttttagggttttaagtcggaatagactgatgggagcttgatggttattgttagatcagatgtggatttaaagccttcgctgaactaacaagtctatggaagaagcaaagacccttgttttacactgtatgttgtgaggaatttgtctgattttgggtgataaaggtgaagtctttgagtttgtaattttgagataagattggatggtgggaagagaggatgcg

SEQ ID NO: 9702 - DNA, 3000 bp, Unknown
  misc_feature (1)..( 3000): cDNA_ID_2185443_gDNA_ID_1972173_Annot_ID_179927 3000 nt of promoter + ATG
tttgtattttgttttttttttgggggagaaaagcaggtgttgaagctattggagccatggtgtgaacttaaagacaaagtggttcttgtgacaggagcttcctctggtattggaagagagatctgtcttgatcttgccaaagctggttgccaggttattgcagcagctcgtcgtgttgatcgactcaactctctctgctctgaaatcaacagcttcagttcaactggaatccaagccgcagctcttgagttagacgtttcatcagacgcagccaccattcaaaaagcggtcagggaagcttgggacatctttggaaagatcgatgcattgatcaacaatgctggaatcagaggcaatgtcaagtcgagtttggatttgtcagaggacgaatgggacaacgtcttcaagaccaacttaaagggtccttggttagtatccaaacatgtttgtatgttaatgcgtgacgctaaacgaggtggctcggtgataaacatctcatcgatcgccgggatccggggtatgttgcccggtggacttgcttatgcttgttccaaaggcggtgttgacaccatgtcaaggatgatggcacttgagttaggtgttcataagatcagagtgaactcgatcgcaccggggcttttcaagtcagagatcacacaaggtcttatgcaaaaggagtggctcaagaatgttaccgagaggactgtgccgttaaaggtgcaacagaccgttgatccagggcttacttctctggttcgctatctcattcatgactcttctcaatatatatccgggaatacatacattgttgattccggtgctacattgcccggtgtgcctatcttttcatctctctgaaaatcgaaccttataatatcttatcttgtgcaataataagtgaatacatttactcattctctactactttttaagatttacatacatcgtcaaaaatttgcaataacaaaccagcagagacacaaaaagaaaggacagaaaaataaacagcctcctgattgtgatgctttggttgtggctaacaaaatcgggatcatctaatttgatcatgcgtcactcggtgatttcacttttgggattgaaacagacttctggtttttctccttccatagtcttcagttttgctagagactatcatctctttgttatgctctatctttgaatttcttgaagtcaaacaagacagctctatcggatgtactatggaatgtacgaccagagtccataacccattctttgcatgtgctttgagtgctcacagttaacaccaaaggttgcggaggctcagttgcaatattagccaattctgcatgtttctttctttgagggcattcccttttccagtgatcttcctttccacagataaaacaacttgtgttgttacttggccttgactggaatttcccatttccacttgaacttcctgtacatggccttttatttcccttattgtttgatctgcccttaaaatcacccaataatgcttctgaatctggttttgacacgttcagcaatcccttttctttcaactcaatttctttagagtatgctgaacttatgactgcatttagtgtcagggtatccttcccactcccatacttgagtgtatcaactagtgaatcatattgtggtggtaagccagccatgaattgtagagcctggtcttcatcactagtgttgatgtctaaacttgctagatctgcaactagcttgagagaagtatccagattttcttcaatgcttttgttctccaccatcttgaagcttgtgaacttgtgcttcaaatagatcatgttggctaaggtctttgtctggtagtttccttcataaccttccttagaatcagatcgcttagactcatgcttatcagactcttagctattttatctttctctgctttctttggatctaccctaggttcgcatccttcctcttgacttcccgggtctgatggtgtagcatcttcaaccaagacagattctaagcctagaatctccaactgacatagcatcttatgcttccacaacccaaagtctcctttgccatcaaacttctcaatatctcaaatcttgcatttgttggttccatagctagatgtcttccttacaatcaaacctggattgctctgataccacttgtagagaaaactgagaataataatagcttgtaaaagaaacaaacacaagaatttgataaccgagttcacggctaaccgctacgtctcggggaaggactcttatttccaagcttcactatatgatcatagaggttacacacaccactaacttgtgatgtccttggttctttttcagattttacacacaagaagaacaagattcaagaacaacaaagaggaagaagaaagcttgcttcggaagctctttatctatcttctcttgaactctctttagcttgtcttgtcacacaactaccaccacctctctttgtacgttgtaatagaaatgttatataggtgatatgtgatggaccacttttgttattctctcttcatgccattttcgtcaggcccactaaggcccaaaggatgtgtttagtcaaacccaaataacaaacttggtccccaaacaaaagaaaaaataattatatacagtatttgtttagattcttcacaagtactaaagtaaagaatcaataaaccaatcaatccgcgagaaactcatggttatataatatttttgcttgaagtattcatagttgtcaaaagaataaaagtaaataaataatactaaggataacaataaataaaaattatcaaacctaaagaatcagcggagacattggcacgttaaattgtctatttggtgatgaagaagagtgttgactaggatagaagaacctacgggttgggcataaacccgccctttgttatgtattatatatctaagttctatttgtacatcttagttattttatgggcttcttcttctcctccatcgagcacacacatagaaaacaaacaat

SEQ ID NO: 9703 - DNA, 3000 bp, Unknown
  misc_feature (1)..( 3000): cDNA_ID_2990233_gDNA_ID_1972173_Annot_ID_179929 3000 nt of promoter + ATG
cggattggtaacaggcataattggattgcttatcttctaattgttatagtccgcaataggcatatatttgatctactctttaatctattggattctcagtcttttctaatgtcaagaatcttcgtttgttaccttttatcactctgtttgtgccgacatttttaagatcatggtcggagaacaacatatgaagagaagagagaattggagcgtcaagaaataataatccaatatattaagatacttttggtttttagactttagagcattctatgaaagatcataaaacaatacagaataaaatttatggttttctaaaagaggaccaaaactccactcttctaccaagtggtccacgtccttccatattcctccaatgattcaaatgtaaagtttaagaacaaaatgtataagctgtctttgtagagcttgtgggatcatcagccttgtttttgcagcttgttagggcaagctgaagaaagatgacctttttctccgcactcgtaacagtttctctttttgatcttaccagtgctaaccgcagatgttaagcttgcatcattagctccatttgtcacatcaatggatatcggaacagtagcatagctctcatccatgaacgaaccaccattgttttcagtgtctcttgttttcttttgaagactatagcttgttacctgagtcggtcctgcctcaacagtttggtgatccagcgttgagtttgtgtgagaagtgttttgaagctttatgggacaggctgtagaaagatgacccttttctccacactcataacagttcctccttttgaccttaccagtgccaacagcagatgctgagtatcctccattataagtttcatttgtagaagcgtatgtctcattcatgtagtaagaatcaccactattctttggaagaccatagctttgcatagccggtctaccatcaacagtctcttgacccagctttgagtttgcctgatcatcagccttttgaagctttatgggacaggctgtagaaagatgacccttttctccacactcataacagaccctccttttgaccttactgctgctaaccgtagttgcaaagtagtttccgtcatcaacttcgctacgcccagctaaagccggtactggatcagcagcagcataagtatcttccatgttgtacgaaccagcattgttcgtttcaccaggtgtatgatcagtagctggtctgtctttaagtgcacaacatatcttgacaggtcttccgcaaataacctgctgatccagcttcagcgcaatcgccacagacacactatccttgaaatccacatgcgcataccctttaaactctcctgtttctttgtttttacccaaccgcacagagtttattacgcagtcagagaagagcttccgtatgtcacgctctgttgtgtcccaggctaaattcccaatgtataccctgttatagccatccaccatttctggagcgaaaccagaagatgttttccttcttggaatggaaggggtggtggttttcacgtattgctggattgtcaaatatcgatcacccctagtagtaaagtaaagaaaaattactcaaccaatatcaaatgtgaccaaggaaagtcttaaaatatttgagtcacagctatagattacttacatagcagctctatcaaaagccaaagcacgttttgcgccatcttcagtctgtataaatgaaacgaaaaaaaatatcaacacagtgtatgacacagtccatttaaccagtctctaatctccagccaccaaggcaaaaaactaactctaaagtctaatcccaaaacaacaacgatctatgttcttacaaaaacaaaaggctgcatcataacacagcaacgttacatggaaaaacttacgtcaaaagtgatgaaggcaataccactgaaagccccatcttcaggacgcatcttgcaatcaactttaatgatgactccacagcttctaaagtagctacgaatctcatcttctgtactctgataaggaatacccccaacatataacttgttaggaacaaccccatcttcttctttactggaaaacaaaacaccaagtcgattaatttacataaaattgaaactaacagagctttaaaatgaagtcggttaaaacaaacttacttgtctgtattaacttcaatctcttctaccttcaccttctcttctacattgccttcctcagccttctttggcgttttgtttacctttctcttcttcttcttcttcttatttttcttcttctggggtttttgctcttccttagttccttcatctccttctaactcgtcgacttccacagcatcgtctctctttctcttctttttaatcttcgtatcagtcttctcgcttgacccaccattcccaacttcattctctctgatttcgtcgtcttctctagcgaaagtttcgcaatttcttcgtttctctctcttcgacaatctgggtttgtggctagatgaatcaaggagcaatttcagagactgagattgtggatttgtttcggatacagagacagatagtgattcagccaaatcttgtcgaatcctctgcttcagcttcttgttcgacagcaccatcttcttcactgagaccgccaaaaacaaaaaacataaaaccctaattggatgattttgataccacctacatatgggccgggcttcagatttattatgggcttttcataaaacgtctactactgtaacaaagagccccaaaatgtttaactgttcatcctaatttgtatatttatgtaaaacacccattgaaactgtgcgttttggttacatttttgttatcttgcaaagatttattattttgaagggccatttttgcaaattagtgttttttttgtctctctgacatttttaaaaggtcaggaagtttcaaaagtggataaactgagaaagaagtgaatccataagagaagacaacaaaagatctatctctataccacatattacactttttctccaatg

SEQ ID NO: 9704 - DNA, 3000 bp, Unknown
  misc_feature (1)..( 3000): cDNA_ID_2185447_gDNA_ID_1972173_Annot_ID_179930 3000 nt of promoter + ATG
catacttggacctgatcacagcagtctgcctttctccagtcagtatccagcaagacacctctattatcagaaacatttagtaactgttaagcatcatcatttcagttgtggaaaaaagatgcatacaataagcgaaaaacaaacttaccaatccaaccagaaatgaaaacacctccagcaatgtacacgatcgtcaacgaaagctgcacaaaaatgagagcataagtaacttaaaagaggaacacatgattggagtacaaaaccagaaatgccaattccgagcaaaatcatgagttgtcagaagtttcactaacctggacgagtcggtcaaactggtgttcagatctctgctgactagaatcattagagaaagcaagaacatcaacaatcttggcgaagtaatgcaagtagacaataagcgcagtaccatgagcagcagcagcaacagagccaacaatcataagcacccaatcaaagcggtcagcgcaagcgaagagctgagagaaaggaacagcagcaggaggtggttcaagctcatcttgatcatccatctcttcatcagcctccgctagcgccgccgccgtgcccgtgccaccaccagactcagcaccagggtcgagataaggagaaggagactcaggtggctcggagacttcagagactggagttaatggttgcatatgaggcggagaccatccgaataaacctctagagatcatcatcttcggaggagcaccacacaaaacaccttctgtgttgaaaaccctagattttcagatttttagggattttgattttgtttttttcttcttctaaaattagctggatctgttgctaagtttgtagagaggaagaagaagaagaagaatcgtagaagaagaaataattttcttccgccttttttttcttttaattattttccaataattttggtgagattttttataataatttgtgttgccgttgcagtgtactgtgccgtcacctaccgtaacacaagagctggttctgctaacggacacagcgacttcgagtttgcatattttttatatattactggtgagctaattcttgacagagcatttcgattactgactttctcgtagctgtaacatgacactttataagccctttctggttagtagctgaagctacaaaactatgactagagatcaaattgaccaaacaagatgaagttaggttaaaagcagagagagaggtaaggaggcaagtcaagagttattgaatctctcttacaggaaaagaatattgttaagggaaagagagaagaagaatggacaaaaatacaagaaatgggcaaaacaagagacaaccaaagcaaacttgattacagtattttcaaacagtgatcttgaaggaatctaccacagtgtgaagcctatctttcatcttctcccacctcctttcattcgctcccgtcgtcagtgtgtagaagtttcctgcacagcaaaacgccatttctcgatgagcattggatactgcagtcagtgtgtattagatatgaatgtgagaattcatggggatgtatataccgttgaaaaccgtgatggtacccagagcatggcgagtgtagtttctagcttgaacagtgaactcaaactgataataagtcttcccatcgacatcatgctgcagcactcgaaacaaaaaccaaacaatcaaaaccaccctctctctctctcttattattacattcaagagcctccactcaattagtcgaaaaaagctatcaaaaggagcaaacctctgatgcatcaataagggttgttttctgatttggaggtgccaaaactttctttatcagtgtttcagctatctgtaaccaaaccaagttcaatcattaaagagagtgaaaaacaacaaccaaacaaaagagaagaacattacctgcttgggagggccaaattctttaatagtctgtttgctagttgggaccaaattcacactaacactttctaaaggctcaatcacatctttgtataccttatcttgaccttcaatcacaacttcctaaacacacattcaaaacaatgagacaagacattgtaattgttaaaaagtgggcaaagaagatcacaaaattgatacctgccaaccaaatggatagagaaacgcataagcatctttattgtcagagacagcaaggaatccttttttgctttctgcagcaactgagccatatcaaacatttcaaaattacacacaaaaattgcaaaattagtgacaaacaaaaagggtacttacatgataatggagctctactaagcaatgagatccaaggagcaacaacaccaaatgttacaatcagacgtctctgacatttatctgaaaaaaacgaaataaaaacacaaactttataaaagggtttgaagaaagattcgttttttcctcagagaagcagaatatagagagtaatttgaatcggaaacacgtaagaaaagacaaaccttgaagatgagaagaagaagacgaggaatggtgctctgcttttacaagaaatgaaagtcctttcttagaggaaggaatcacaccaaccttagaaatggagattggagaagaaggtgaaagcttcagagaagccattggagaaaaagtgtaatatgtggtatagagatagatcttttgttgtcttctcttatggattcacttctttctcagtttatccacttttgaaacttcctgaccttttaaaaatgtcagagagacaaaaaaaacactaatttgcaaaaatggcccttcaaaataataaatctttgcaagataacaaaaatgtaaccaaaacgcacagtttcaatgggtgttttacataaatatacaaattaggatgaacagttaaacattttggggctctttgttacagtagtagacgttttatgaaaagcccataataaatctgaagcccggcccatatgtaggtggtatcaaaatcatccaattagggttttatgttttttgtttttggcggtctcagtgaagaag

SEQ ID NO: 9705 - DNA, 3000 bp, Unknown
  misc_feature (1)..( 3000): cDNA_ID_2994155_gDNA_ID_1972173_Annot_ID_179928 3000 nt of promoter + ATG
gtcaaaagtgatgaaggcaataccactgaaagccccatcttcaggacgcatcttgcaatcaactttaatgatgactccacagcttctaaagtagctacgaatctcatcttctgtactctgataaggaatacccccaacatataacttgttaggaacaaccccatcttcttctttactggaaaacaaaacaccaagtcgattaatttacataaaattgaaactaacagagctttaaaatgaagtcggttaaaacaaacttacttgtctgtattaacttcaatctcttctaccttcaccttctcttctacattgccttcctcagccttctttggcgttttgtttacctttctcttcttcttcttcttcttatttttcttcttctggggtttttgctcttccttagttccttcatctccttctaactcgtcgacttccacagcatcgtctctctttctcttctttttaatcttcgtatcagtcttctcgcttgacccaccattcccaacttcattctctctgatttcgtcgtcttctctagcgaaagtttcgcaatttcttcgtttctctctcttcgacaatctgggtttgtggctagatgaatcaaggagcaatttcagagactgagattgtggatttgtttcggatacagagacagatagtgattcagccaaatcttgtcgaatcctctgcttcagcttcttgttcgacagcaccatcttcttcactgagaccgccaaaaacaaaaaacataaaaccctaattggatgattttgataccacctacatatgggccgggcttcagatttattatgggcttttcataaaacgtctactactgtaacaaagagccccaaaatgtttaactgttcatcctaatttgtatatttatgtaaaacacccattgaaactgtgcgttttggttacatttttgttatcttgcaaagatttattattttgaagggccatttttgcaaattagtgttttttttgtctctctgacatttttaaaaggtcaggaagtttcaaaagtggataaactgagaaagaagtgaatccataagagaagacaacaaaagatctatctctataccacatattacactttttctccaatggcttctctgaagctttcaccttcttctccaatctccatttctaaggttggtgtgattccttcctctaagaaaggactttcatttcttgtaaaagcagagcaccattcctcgtcttcttcttctcatcttcaaggtttgtcttttcttacgtgtttccgattcaaattactctctatattctgcttctctgaggaaaaaacgaatctttcttcaaacccttttataaagtttgtgtttttatttcgtttttttcagataaatgtcagagacgtctgattgtaacatttggtgttgttgctccttggatctcattgcttagtagagctccattatcatgtaagtaccctttttgtttgtcactaattttgcaatttttgtgtgtaattttgaaatgtttgatatggctcagttgctgcagaaagcaaaaaaggattccttgctgtctctgacaataaagatgcttatgcgtttctctatccatttggttggcaggtatcaattttgtgatcttctttgcccactttttaacaattacaatgtcttgtctcattgttttgaatgtgtgtttaggaagttgtgattgaaggtcaagataaggtatacaaagatgtgattgagcctttagaaagtgttagtgtgaatttggtcccaactagcaaacagactattaaagaatttggccctcccaagcaggtaatgttcttctcttttgtttggttgttgtttttcactctctttaatgattgaacttggtttggttacagatagctgaaacactgataaagaaagttttggcacctccaaatcagaaaacaacccttattgatgcatcagaggtttgctccttttgatagcttttttcgactaattgagtggaggctcttgaatgtaataataagagagagagagagggtggttttgattgtttggtttttgtttcgagtgctgcagcatgatgtcgatgggaagacttattatcagtttgagttcactgttcaagctagaaactacactcgccatgctctgggtaccatcacggttttcaacggtatatacatccccatgaattctcacattcatatctaatacacactgactgcagtatccaatgctcatcgagaaatggcgttttgctgtgcaggaaacttctacacactgacgacgggagcgaatgaaaggaggtgggagaagatgaaagataggcttcacactgtggtagattccttcaagatcactgtttgaaaatactgtaatcaagtttgctttggttgtctcttgttttgcccatttcttgtatttttgtccattcttcttctctctttcccttaacaatattcttttcctgtaagagagattcaataactcttgacttgcctccttacctctctctctgcttttaacctaacttcatcttgtttggtcaatttgatctctagtcatagttttgtagcttcagctactaaccagaaagggcttataaagtgtcatgttacagctacgagaaagtcagtaatcgaaatgctctgtcaagaattagctcaccagtaatatataaaaaatatgcaaactcgaagtcgctgtgtccgttagcagaaccagctcttgtgttacggtaggtgacggcacagtacactgcaacggcaacacaaattattataaaaaatctcaccaaaattattggaaaataattaaaagaaaaaaaaggcggaagaaaattatttcttcttctacgattcttcttcttcttcttcctctctacaaacttagcaacagatccagctaattttagaagaagaaaaaaacaaaatcaaaatccctaaaaatctgaaaatctagggttttcaacacagaaggtgttttgtgtggtgctcctccgaagatgatg

SEQ ID NO: 9706 - DNA, 3000 bp, Unknown
  misc_feature (1)..( 3000): cDNA_ID_2185436_gDNA_ID_1972173_Annot_ID_179925 3000 nt of promoter + ATG
cgaatgaccggtttttaccaaattctcatagaccatatttgattcttttgatttacttctggtgcaggactctctgtgcttatggaagttgatgttgggggaaacaactctcttgtacagtggggaaaaaacttcttcttcttctttctatcacatgaaaatcctcaagggccattattagtatgatcagattataaaattgtaaggttaggggctttatgaggattttgatggacttgttacaatgtttacatatacactcagcagcacaatagatttttgttaaacttacatgttattcaagtaaaagtactatgtagatgttgaagtctaattgaagaattagttaatgatagtcttaaacacttgattcacttgtcatccaattttggttttgcgcatagtttctcttcttttatttcctctctaaaacaccaaaaccaaacaaaatgtcattttccaatccttaaggtttcattcattttagtgattttttgggtacaaaattgagcaatgtctagtgacgtttttactcaaactcataaaccaacattctaatcagaatcacgatttggactttggtttgggaccttctttctacaccaactgggcttgtaatcagttggtagagaaagcccaattatatattatttaaggcccaaaataaatcgatctagggtttacggttttgtttcattttcacttcccttagaataaataaaaaccaccaagcaacttggatctactctagggtttctgtttcgccgctcaggttcgtcaatctctcgatatcctttctctaccttctcctcagctttctgagtattgaatgttgttgttaactgtctctgaatacgattgattttgtgtcatttttctcgtgcttcgtatttgttgattgattgatttacatgtcatgatttgaaatctttgtattgctaattgctattgctctgtttactgattttcttttctggggttatcaggtttcgtgaaaagaatctatcttgagcaatgtctccagctaaaggtacgcctttttttctttcattgttatctgatttgattctacatcgtcttctatttctcttttgcgtgtaattactttgtttatcattattcaatactgtgactgaacttactactgtatacagctttctgaaatgtatgattcttatctggctctgtaaagttcgtattttttatattctcttgctcgtacctactctgttatggattcatctgattatgtgcttgtttgtctgttatttgccaatgatcaaactttccttgaatgagatttgttaccagtagtgtaaatggtttaatgttccattatttttgcagttgatgtcaccaagaaagccgaccctaaggctaaggctttgaaagctgcgaaagcagtgaaatctggccaaatcgttaaaaagcctgcgaagaagatcaggacaaaggttactttccacaggccaaagacattgaccgttcctagaaagcctaagtacccaaagatcagtgctactccaaggaacaaattggatcattaccagatcctcaagtaccctctcactactgaatctgccatgaaaaagattgaagacaacaacaccttagtcttcattgttgacatccgtgctgacaagaaaaagatcaaagatgctgtcaagaagatgtatgacattcagaccaagaaagtcaacaccctcattaggtaaacactaaaacttcactgagatatgggtttatgtaaacatggagtgatgagtgtatgtttgtatgcaggcccgatggaacaaagaaggcgtatgtgaggttgactcctgattatgatgctttggatgtggctaacaaaatcgggatcatctaatctgatcattgtcgctctgtgattttactttttctggtttttctcttccatagtctcagttttgctagagaagttaagatattactatcaccatctctttgttatgcttttatctttggattcaaaaagattatatgtttggtatttgttgatgcgtcatagtttctattcagatcgtgttccaattcttaatgctacctctctaatcccggtttaacctggttatatcgtaccttcgtaaataactaataagtaatacccaacccaaaattcaagtggtccattggacccatctctttgtttagatgctttcaaagtacagaacaagttcactgtggtctgtggagcccaatctaatcaacaaaacaatcgatccgcgagaaactcgtggttgtaaaaaacttttactaaatgaattattgttgcttgttgccggaaaacgacagaaaacgtcggtatcattgaactaacgtcggtattattgaaccattgattgatagttggaaaaaaaagaaaaaaaaaagaaatcatatattccttttgttcctttttgtttgattttctaaaaaaagatatatatattaaaaaaatatattaaagttgattttaaatgtattattttttttgtgttttacaattttctataattttaaaccaataatattcaattatttttattaaagtttataatttatcagtaataactaataaatattgtataaaaaaatctaaaaaatcaatcttcttgaaacaaatatttttcttagaaaatcaaataaaaaagaacagatggagtatctatatattaataaagataacaataaataaaatcatcaaacctaaattgtttcccacgaatcagtttcgagacattggcacgttaaattgtcgatctggtaatgaagtaggctttacatgtagtagactaaagtgttaattaggacctagaccctacagatttgggcataaaccgtcctttgttatgggacgtgttctacttggtatctctagaaccgcggtctttggcagatggatcagattatatctttttgacacttgtatttatatatgttatatgttattggcttctccttccccattggccatcgaacacaccacacagagaaaacaat

SEQ ID NO: 9707 - DNA, 3000 bp, Unknown
  misc_feature (1)..( 3000): cDNA_ID_2185411_gDNA_ID_1972173_Annot_ID_179916 3000 nt of promoter + ATG
tgcaccacctttgtctctttttgcactgtctcgtctttctgctgtctcgtcttctgtgatattatttcgaacctcttaatgacttactagtattaatcagaaaccccaccaaagtttcattcttgagaaaaatcgaacgatagacattcaatatgggtagggtaatcaataattcttgatggctttgtcaatttggacaaaatgtgatccatgaataatatatagtctctttgctaaattatgaatatagttgcaagagaataaccataaattacaccagtatctaatagctgatttagaaaaaagaaagaaaataactatatgaagtcatgtaagactcagcttccacgaccacaagataccaagcataataaccatggaaagtagttatgatgtgccttaatttatttggtagaaaagttaaaaactgaaagttcatatttaactgaatgcgctttagaagtaaaatccggtatactatacgtatatgattatctctaagccaaaagaatataagtatgaacacagagaaaatagaacaatgaacagacagaagaaaatagagtaaactccgtagtaatttttatgtaatatatacgttactcgttacaatacatacactattttcttgtaacacataaaccgttttcaaattccttataaatgaaatatacgctcattataactacataatcactcatacggattcgaatgaactttgatagcatgatcttaagagctggataaggaagtatcttaggtaaaagaaataagtggatgagagagaataggcgtcttggtttgtaatcttgttgacgaggagagggaatgagagagaaagtgatcatgaatagggtttgaatttgattcgagggaatagttgctgtttcaggactcaaattgagaggtccacatgatgaggaatatgtgtagttttatttaatgtctgaatttgatggatccttctgaaacctttgatttcgacaaaacacccacaatgtgtttgtctctcacttctttacgtaacctttgtagattctctcactctctctcatgtccatttgcgccacgtcactcagatggttgtaccatttgcgattatttgatctcaatgtggattgttatacgtgacatgtcatcgtcctattggtttagaatcaaaaactttaatctcccgcgtccccttacccaaccaaaaaactattgatgatcactttgccttttttttggccgtccattattgtaacgtatactacacttgtcatggtggtacgactatacccaaattaatactttgaggagtcaattacgtagatgattaaattatgaatattatctggaagagatcgacgacatttggttggtgtaatcaactttttcgggggtttgtgtcattcataaataacaaaaatttcagaagaaaaagaactaagttaatcattagacagaaatttcaatagcgtaacttcaaaaaactaattataaaaaaacaaaatcaactgtgtaacttacgtcagatgtaatgtttattagatgtaataggttccactaatccatatcaatattatcatttatgagatggagtgggattttgtcttttatgctacattaacaagtacatgataatttctgggtttcttttaccggtcttaatattaataaacatgttggtatgcatggttaagagttaggacttaattaggaggaggctcatacatatatgacagaactgaaaaattcagtagcaaacatttatctataacatgtcgtgtaaattacgttggttctttttacgacagaggtttactaatgtatatggattatctcatactcataatatgtagttacaatatatatatatatatatatatatatatatatatattataacttttttgaatctagattatattcaaagaaaaaagaaacatttatacatgtgaatgcaaaatgcaaactttttaaaaaacaaattacaaagattttctatccttaatgttgctcgatgcaaaccacgtttggatctcatccgcatatttcttcacttctccttttcttaaagtgctcaagtgatttcaaatgttcttatcaatcaacttaccagttatatattttatatgcatggtattccctatttaaacaagttcaacattcctttaacaaaaagaaaaagaaaaaggaaaacaagttcatgcctctcttgcctcaccttaagagtagacgtaccgatgttcaggggcgacctaggcctctaatacgtcttcttatgatatttcaattgtcaaatcgatggtcacacaacggtagtcatcgtagatatacatttgatatgtttgttacaacagttatcttttctttattaatggtaagccttaacataagtgttaagacttatgattatatgccttgtatatttcgcactatggttttatattgtttcaaaaggaattcggtgagttacaattgttgaagtcattattttatttgccattttttaaagtatcaatcctttaaaattccgaatttatcgtttactctccttttatgtaatcatgtgctcttagagccaatacaactaactttcattttcttatataagttaaaacattaacaaataggtatagatttaatttctagaagattatggaaattaaaacacgactaagtgtttttttgcagaaaatgtatagagagagaggggccatggatcacgtggaggatgcgtgagatggaaatgaaaaaacgaagggagaagagagaaagagtgattttacaaatctcctctaatcctttctcagccaattatgatcaatctcccacgtggggcttctggccccatgcatgcatatcatctttcaactattcactcttttgtctccttcttcatctttttgcgtgatcttcttctatatatggctgtctttatctccacaagtggcttttagaaagaagactctcttttaagtttgggtgttaattctagggtttccattaacaatg

SEQ ID NO: 9708 - DNA, 3000 bp, Unknown
  misc_feature (1)..( 3000): cDNA_ID_3043152_gDNA_ID_1972173_Annot_ID_179908 3000 nt of promoter + ATG
tttcattactgatgtagcatttgggattctgggttttcaatatttcaagctgcttgacattgaggatttagtagctccttttctcagtatgatctggctagtgagaaaagtgaaaccttatcttccaaaaaatttggtttagcctggcttatggatttctaattattaattgcacttctgtaaaaaaattcatgttacctctttctacaagattagatatttgacacattcatgtgatttgtgtgcgtttatgttacctgcctggtggattttatgattgttaaattttgtgttgcttctatgttttgtgtgtgtgttttactcccaaatgaatccacatttttaccttcttgaacaaaagtcccttgttaattgtgaccgtaaacagagaaattgactgtttaaaaggatcaccaaatagaaattactcgcatgcttctgcttctgttgcacaccttgctcatatttccagtttttcttatgggctttgtaatttatcttgtctgcgatgtacccgttagtgtcttcaaaggaaaataaagttacttgaatctatgggcaaccaaagatcttcttgccttagacgtttatctatctttctaagcctcagttctaaagtcattatgaatctgaacagggtcttttgtgttgttgcagcaaagtggcgaggaagtcgaatgcgtaagggttgactgtgatctacagaaacaaaaatctactctaggagaggcatacagagaaaaacaagaagttgccactcgatctctgtcacaagaagacttgatccatcaggggaggactaaccaagcaccaggaagtgatggatttacttattcaattctaatcagtttagtggaattatactttgtctggtccatacgaaataacttattctctgcattgataatacagaatgagagaagaagaaaacattgtagaaagtaagacatcaaagtttaatattctcttgttgtatgtatacctctgttttgctgtcaaagatctttgatctcctctgatatatttaaactaaaagatttaattcttcaaacatatcattataccggagagggagaggttcatattctaaaacatgtaagcattccgagcaaaagaaatgtttatattattcatccaaaatgttggttcgtgtcacacgataatacacattgtagaaggaagactagaagtagaaccagctacattagagtttaatgtatctatataataataagtcaaaaatacccacttggattattatgttcttatcatttttggggttatcaaagatactttataaacttttgacttttgcattggcattgtctttactccgatgatctacgcctgagagttgaccgcttcacagtccagtcttcaaattgttttcgcacttacgatatcattcatttctgattcgttagggctcccccaagcttacaatcttccttagtaaagtttgggaaaaaaacaaataacataaacataatcaatctcaatctgaaacgaactaaacactactatagttcattttctctcatatgtatataacaagataattgtcaaaacaaaaactgtgagttgtaatcaaatgatggcattgatcaatagtcattgctttgttgattgaagaagattccacttttaaggaaaaaagacagctacaataactaaattctttaaggttcgttagcaatgtaaccgaatacgtgaagtaacactagccattgtttaaagaaagagagtcgtcgaaacaaaacgttgactagcttatatgctcttataatgatttagacaactcacgtatatacgacgttgaagccaaattagttgaaatgtatatgtaaatgtagttgactttggtaagcgaatctccattttggtcttttaagaatctgtaacgcctggaaattgccaatacctccggttcgtatatctttatatcatgatttatgagtgcgtatatttgactttttcttgcaaaaccatacatacataacatgcgaatgtcttgtgtctgtgtatatgatatctaatgtatgggaaaacttggaatataggttttattttcttctagacaagatcatgaagtatagtacgtatcttttatgatcatctttttggtcagacgaaagaatattagttttatataatacataatttgtgatttgtttttctatcctctataagcacaaacatatactatcagattatgacacatcaacagtgctaatataacattaggctgtaaaatcaacttaaatattttgtaacacttttctcttaactattacaataaacgtatagctgttagtttgcaaggacagcgttaacaacttattgtatcatagtattgattcaaaacgttaattactgtgataactataacttattaactgaaatgcagacgttgacagacacacaagaattgaaatgtagaaacgcgtttatataagagaacgctaaatatataaatttcggacttttctagtgaaactctattagtcttcttttttttctttggtcaaaaaacttccaatacgaaattcgaacaagaagtataattagtgatcaataatgcgaatgatgcaataaaaagtcaaatgaaatgaaattgatgaatttaactgttatataaaattataagttgacagaatgaaatagtcatataattctagttctagacgtggatagcaaaaactttgtcgcccatatgtatataaaatttgtactctagttatcttttaagtatataaggcttatattatacatcgaagtcaatggttctttgtggtctgggtctataatcacaggtaagcacatcgtcatcgatttcattttcaaagtcaagaccaatctcgctctctatataattgttaaaaaccatctttctaattaaaatagaaagagtaaaagccaagtaacaccattttaaaaggcttcgctttcaattcagaaagaagagaatagagagcttcttcttcttcaatggcgaaaatg

SEQ ID NO: 9709 - DNA, 3000 bp, Unknown
  misc_feature (1)..( 3000): cDNA_ID_3043148_gDNA_ID_1972173_Annot_ID_179909 3000 nt of promoter + ATG
tcatcaaactttttgacgtaaccatttaatcccccggatttaccatgcccttcatagtccattccatagaccgagaaacccgcattggccaacctcactgcagtgcctgatgaatatgttttaatatcaattaaaatgtaatcatgaatgtatatatattgacgagtatattataatcatgattttaaaagacggaactgctcatggtgatgcttgattccatggcgtagccatgacagagaaagattaaagcctttggttcttgctgctcctcttgtttccatgaacacgtgaaaagttgtatccctcgtgagttcgaaacataatcctaaacaacgacaaacgaaaccccaaatttttatataagcttaaaacaataattgtatcatgaatcttcgtttttagatacaaagcaaagagctttgcatgacaaaagagctaactcgtaattgaaaagagagaaagattaagacatacctctttgtacataaccatgatgttctatttttgttatacgtttcaagaaagaaaactggatttgtttcaatatatagacgacgaggatcacgagataagagagttttatatctgaccaaaaaaaaaaattagtaagagggagagatcaaagagtcaaatcagattaagcttttaacgaaaaaccgcttaatgcgttttacttatgggaccagctgactaaaataaatttatcctgttaattacctaacttttctttaggggaagataacatttgacctcaaattaccaaattcgatatatatggaaaatttgcaagacacattgccggcaaaagaaaaaatatatttgcaagacacacgaaggtcaattttgaatcaatcctacaaaaacattatacataaagtgacatattacaatctgattaattttgtaaataccacatggtgagtcagattaacgtattaaccatgactaaaaagaataaattattcactgtctgtactaaacttaaggcccatttatatcattgaggcccatttagaactcttcatcttcttcagtttagggtttcaggtgtcttactatagcagtgcaaagagactgagtcagagagggctcgaagacgccatgggtaagtccctactcttgaatcatttccaccattattgtttgagttgcttatgtttggctccattttcttattgtgttgtgttgaaatggatccgtgaacagcgagaatcaaggttcatgagttgagagataaatcaaaatcggatctttctactcaattgaaagaattgaaggcagagcttgcttccctacgtgtcgctaaggtcactggtggtgctcctaacaagctctctaagatgtaattgttctctactctcagccttattatacaaatgttggaatattttgagctgcttgatattggaatcactagcctctttctgagtatgatctaaagctactgagaatagtagattactagattgttgattttttaattgttaattgcatttatattgaattgtttatggtgccagtgtttacaaattaggcattttgatacattcatgtgattagtgtgttgccctttgcatggtattggtacctggcttatggaattgttgatttctagtctttagtcatcagtttttttttgcttgtgtttgcttttatgttcattgtttttagatatctttagcatcttaagcaaaatccctatgcacacagacgccaaaacattggtgtttaaaacaatcgaggcttagattagtcttgggtttattgttgcagtttttgggatttttagttatcttgtatgtctgcgaaatgggaaaagaaagatatttatataatctatttgaatctctgaacaagcaagaccattgtttttgtttaggacttttagcaatcttggtaaggcctcaaattaagttattatggatctaattgtggtcttttgtttttgggttgttgcagcaaagtggtgaggaagtcgattgcgcaagtgttgactgtgagctcacagaaacaaaagtctgctcttagagaagcatacaaaaacaagaagttgttgccactcgatctccgtcccaagaagactagagccatcagaaggagactcactaaacaccaggtattttgaattcagtgacatgctttgttttggtccatacttcatgactttttctctgcattggataggcgtcgctgaagacagaacgagagaagaagaaagacatgtactttccaattagaaagtatgccatcaaagtttaattatctttctactgtcagagagtcctccctcagtcttctctaatatatctgaattttctttcaattaaagatttgattcttcaaacatgattgtatgatctctcacgcacgttctttgttataaatttgagatttaccctatttgactttcgagaactagctcgtgggctgatctatttggtctcggcaataaaatctgcaaaaacgtaagattctgcgaacaaaagccacttaacatcatcacctgtttattattcactttgggacagtctaagaacctagctaattgttttataagcaatctgagacaagagcattaccatgttcgaactgtgttgatgagctatgcaaccagttgcaactgaaatttacactcaaatcaactgaaatattggcttcaagaactcattatagcacaactaagcagtcgtcctagacaaccaaaatgttttctcatttgtctaaaaatcaggcccattaaaaacacaagtaaggcccatatcttctccagttgaaagatttgaaggcgggtgctttcttccgcctccgccgcgtcgcctcttaggttactcactggtattgctccggcctcctaataagctctctcgtacacttagccgcttttcccggtatgatctttaatctgttttaccatattttctatttttcattcaagtgaaaaaaataaagttcaaatttttattgtttctctgtttttcctcagctcactgaaacatg

SEQ ID NO: 9710 - DNA, 3000 bp, Unknown
  misc_feature (1)..( 3000): cDNA_ID_3043196_gDNA_ID_1972174_Annot_ID_179947 3000 nt of promoter + ATG
atttactagcaaaaaattatggaaaatgaagcataagaaatgcttactgttgtgttggaaaacacggatagtagctcctgaacctcgagcgccgttgacaatcgaagtatggttcaaagaatcgcttattatcaaccctccctgtacagatggcagcacataaagctacaaaaacataggttttgggagtaacataagtgtccatcacaagatgtagcagcatatacttacctttccaatcaagacgggaatgatagccgagtttgttgcataacccatgccaaaaataacagcagcaggttgtccgacatatttagcaacacaatcctcaagttctgcatgcacagatgtagttcctgataacagaaacaactagtgtcaggcaaccacaaagagaagagattgttcgagacctaatacacaaagacgaccctgtacctgcatcaacgcgagagctacatgtacttgctgaaaatttcttcagagactcaatgacacgaggcgtgcaatattcatcgaaagaaccaaatccaagataattgtaggaacccaaattaaggcacctgctagtctttgtagttcgcctgcacagagttgcaaccaaaggtttattctttgacatcctaagtgataaaccaattctcaaccgtatgaatccaacctttacatttggtttcatattctcttaatgtgaccaaagaaattataattgttcaacagaaaaaaaagcagaggaagacagactcactttaacgtcttgttgttatcgtcagagactctctcaaccacatcaatccaagcatcaggtgcacttgaaatgggacgtccaaaacagtccttcacacataaatttaagaatcaaacaccaaatcattgaaacaaagacttcacaaaaggaacaaacgccgaattgagaaggtacctgaatccgatgatacaatcgtcggatgtagaaatcctcatgcgccaagcagatcggagcgtatccctaaacgaaatgtgaaatcagaagcgaaattagaaaacaacgttaaaagagattttcacaaacatcatcaaatcgagaatcatgtgggagacaaacaaaacctggagattgttggtgcgccaccaatcgaagattaggcgagagtaatcgcgaagctgaccaaacgcgaaaagcaagccgtagctgaaatacgttgatacagcggtaaggtatgggatcgtaatcattgtttcagctccgtgttcgtcttcttcttctccctctatctatctatctctctccctctctagctttgagtttgaatttcaatgttgagatctggaaaaatctgcaactagctcacgcgagagagacagagaagagagagagattttgaattcaacaacctcttcccctttcgtcgaagaatcagatcattcctgatttccttcttctctttttttttttttaaacgagggcttttcgtcaaacgtagccactaatttaacttattagggaatgttatgtgtattgatcgatgactatgaagagtaaagatctaattaatactatatactatacaatatcaaaaatgaatatttatatatagcttaaaatagagatatggaagattttattaattactgtgctgtcatcttttccttatttaaaaatgaatagaaaaacaattgattagggttctttaacgcatttggtttttttttcatgacattgtttctccacaatttttgggtttgagtgactcttagctccgaataataactgcgttttgcggtacgcgagaagtgcggtgcgattcaaatagtaacgaaaatacatagatacatatgtatatgtagagattttgatactgttacagcactgttgcggtgcggttttgagtgcggttttgtttaccattcacagctttagattcaaagcagattcaaactgttaaccagtgaaatagggattcgtaacaataactagaggtatgggctctttgtatttcaatttagttacacactgtttccttgtatcctttgcaattgagagaagtagggagagaaaaataaaatgtagcgagtataggagatgtgatatagcaatataattttcacttcaacgtagagtcaatcagtcaacttgtgttcttcgatttcaaaacccgtaagacaacgaccaaactcacttttcgttttataatattattaagcatgtctttgtcttcaccaattctatgttgtcatcttcttcgtcacgagtttatgggtatgccataattttaaatagttatcaccattcgttatccgtcagtttcatatgcttttctttcttttctttttggaaatggaaaataactctcattgacatcttccaaattcatatcttaactagtaggcagcccgtgccgtgccttgcacgggaaaacaacaataccaataatacattttgtttctttgaaatctgcaactatacacaaatgatgaatatcacaacctcacaaaatacaatgtgtatcattgctctataactctcaatagaaatcctcttcaactttactcaaattgtaatatctatatgtgtcaaaattggagaaaacttttattggaaacatcaaatgatcttacataaatacataaacttctctcatagacatagagaaaaagagaaggaatagatgaagaaaagaaaaaatatatagaaccgttttttcttctccaaaagcttaacaataataataatggagaaatgaattaccttctaatcaaaacgctttttttaactcgaaatatataagatgctttcacatttaaattattttacacactaaaccgtagaagaagatgccatgtcatgccacccatctctcaaattggttatcttcttcttcttttgaattgaaagccccaaaacatttgcatccattttgtttctatacgattctcgtaaacttatgtggtcattttgtcgagcagctggtgtgcatggaaaatgtaagaagataagaccaagtaaaacgcaacaaaatg

SEQ ID NO: 9711 - DNA, 3000 bp, Unknown
  misc_feature (1)..( 3000): cDNA_ID_2992991_gDNA_ID_1972174_Annot_ID_179959 3000 nt of promoter + ATG
atgacactctcttcaaaatgagtacacatttttagtacctcctctgctagtttagttaagttagtcccatactcttcaagtgttggcattttgctgtttccgctgcttcccccaccaacgcttgctgtgacttcattgttttccccgaccatacgtataacctaaaaatgatatatgtatctcaaaatgttataacgaaatggtttactaagacataacattaaccttagaatccagagttggtgcatttacctgtgtccgtatattactaggatctgcacccaaattctccaagacacgagctgccacaccctccccttcacgaagtagaccaagcaaaaggtgctctgaaccaatgtagttatgccctagatttcgaaatagcaaaacatttcccaaatggagaagaattagttagcttcatcagtcaagaaagcttatgtattgcacaacacataacaagctccaaggctaaatattcataatagaaatagacccataccaagttgtcgagcttcctctagtgacaactccagcacccgctttgcgcgaggagtaaatggaatctccactgccacgaatccactgcctctcccaattatcttttctacttccacgcgtgaatctttaagattgatccccatggatttaagaaccttggcggcaatcccagtcccttctccaattagacccaacagtatttgctcagtcccaacaaagttatggccaagtctccgagcttcctcttgagacagcattatgaccttaattgctttctcggtaaaacgctcaaacattgctttgggtacacatcggctagctttttctctcccagatgattttgcaagtttatacttaacaaggaaacctggactaggccttcccaaataatctaatgcactgggggcccttaaccctgagaagctctgaattgtcagaagaggtgcttgtaaactggacatcatcttcacacgccctcttggttctctgtattctgtggcctgaattctcagaacaggtgcttttaaactgctcatcttcatcacacaccctcttggttccctgtattctttggcctgcacatgccttccgggaccaaaaaaaggaggtgtaagaagagctatcgaccaagccatgatgcaatgttggaggctgcattgggtaatggtagaacatcagtattgctaattctcttaaacacgtatacagaaagagctcaggcacaaaaatacacaatttcaattcaccaactaagagcagaacaatgtcacaaaagcttgagctatgtttcttatctccaaactctccaaagcaaaacaagcaatcatctttgaacaaatcgaaacgcgaatacacaaccctaatctcaaagtaagcatttttgcatatcaataaaaccaaataaagagtacccagattcagaaaactcaaaatgaaaccaccaaaagaaacgaaaccaaacgccatgagaaatagaagaaaagaaaaactcaacctttaaaacagctcacacaacagagaagcagaaacctaaaagcttcttcaatgaaacacaacaacaacaaatgaaaaataaaaacagactgagaaagagagtgagtgtagcaaagaaaagggttttatgtgtagcaaagaaaagggttttataccgtcgacgcctttggatagcgaagttggagaaagcgagagactccttttattgggaaagagataggaaagtgaagaagaagatacccaagagacaagagatttctctattctctctctctttatcttctctcgcatcgccgcccttcatagattaaacacactcacctaccaaagttgcataccagccgttagattactcataagtgtattccaccgtcggatttaactactttttaaagagtcaacctcaataagaatcttgttcccaaagataagggtttgtgttgagtttaagaccggtttaatctgaaaactccgtcaaaccaaaaccaaaccgatttatcataaaaaaattcatatcatctacttccattggctagagacagattgtaacggtgtcgtcgtcgccaaacgatttgcctcttcctaaaggtaggttcttcatttctctcagtgcccctttgcgtgtttcagcttcttctttatgatctaattcatgtctatgtttcgtttgattctttgttcaattctgaattgagaaaatggcgattcgagatctgtctcttcggttttttagttcgactgatttgggaatgtgaagagatcagattgatttgttgacagagtcttgggggttttcaatcttattcctctagattttcgaaattcgattcctttacatcagatttcgcttaattctctgtcctagtgagttttacgatctttagtcttctggtttgtcaaattctatgtcttttcatgttcttctgagttttaatggttgatcttcaattacttggccacaatctctagagtttgagactcttgacttgtcttgcatatattcctctgtagattggttttatgtttggtttcaattccttgttgaactattctgatacggaagttttcctttctaaggtttggtgtttcctttttctgataaatagtgatgaagatcgattatgatgatcatgtaagaatataatctagctttggtgtttgtattggtttacctgagggaagaaaagtctttctctttgggactttaaactttgattacttaactccaacattatcatagttgggttctgtagttcatttcacttatagcagtaataactcattgattgatgcaatcaatcaatcctgtgatggaaatggaatcatggaaattgagggattcagggaggattgattgattagaatttcatatttatgagagaataagagaactgatgtgtgtttcttttcctacttcttaaagttgtgctctttcctatttctataagctcttgtggataacaacagttgattaacgttcttatgcttgtttagggtacaacaaga

SEQ ID NO: 9712 - DNA, 3000 bp, Unknown
  misc_feature (1)..( 3000): cDNA_ID_3594167_gDNA_ID_1972174_Annot_ID_179960 3000 nt of promoter + ATG
atagattaaacacactcacctaccaaagttgcataccagccgttagattactcataagtgtattccaccgtcggatttaactactttttaaagagtcaacctcaataagaatcttgttcccaaagataagggtttgtgttgagtttaagaccggtttaatctgaaaactccgtcaaaccaaaaccaaaccgatttatcataaaaaaattcatatcatctacttccattggctagagacagattgtaacggtgtcgtcgtcgccaaacgatttgcctcttcctaaaggtaggttcttcatttctctcagtgcccctttgcgtgtttcagcttcttctttatgatctaattcatgtctatgtttcgtttgattctttgttcaattctgaattgagaaaatggcgattcgagatctgtctcttcggttttttagttcgactgatttgggaatgtgaagagatcagattgatttgttgacagagtcttgggggttttcaatcttattcctctagattttcgaaattcgattcctttacatcagatttcgcttaattctctgtcctagtgagttttacgatctttagtcttctggtttgtcaaattctatgtcttttcatgttcttctgagttttaatggttgatcttcaattacttggccacaatctctagagtttgagactcttgacttgtcttgcatatattcctctgtagattggttttatgtttggtttcaattccttgttgaactattctgatacggaagttttcctttctaaggtttggtgtttcctttttctgataaatagtgatgaagatcgattatgatgatcatgtaagaatataatctagctttggtgtttgtattggtttacctgagggaagaaaagtctttctctttgggactttaaactttgattacttaactccaacattatcatagttgggttctgtagttcatttcacttatagcagtaataactcattgattgatgcaatcaatcaatcctgtgatggaaatggaatcatggaaattgagggattcagggaggattgattgattagaatttcatatttatgagagaataagagaactgatgtgtgtttcttttcctacttcttaaagttgtgctctttcctatttctataagctcttgtggataacaacagttgattaacgttcttatgcttgtttagggtacaacaagaatggaagaagagtatgagagtcgtcgattgaggagatgggaagagttggacactgacatcttagtaagaattttccagaagtttagcgtctttgagttgacttcgggattagctcatgtttgtagaggatggagagctgcttgttgcgatccgattctttggaagacggtggatttgtcaaacatgagatctagtttcatcaagatcccattagagccttatgtctatgtggaacgccgatctgatgaggccctaacccgcatcctgaaactctccatgaaccttagcggaggaagcacgaggaccttgatttttcatttcaacttgttcttgagtgatgatcagcttacttacaccgcagaaaggtatgtccttttcgttcttccacttatttgtcttccaaattgtttcatcatggccgtaaactatggttttttagtcaaaagttggttcagtttttggtttggttaagttcatgtacccactttcagtcaaaattgctgaattacaattaagctgaatctcgcaaatgctaaaagttgaaaaatttgttgtactgaatattttgcaggtgtccagggttgagacgggtcgtcctaccggcttggaacagaataaagaagactggtatatgcaaagcgataagaatctggaaagatctagagtcactaacaatgccaagcatcgcaaacccgccttatctcttaacagaaattgccaagaactgcaagaattttaaagagctgaagatcatgggtccattcgaggtcttctttgcaaacacgctcatcacttgcctcccaaacatcaaaacactcagcatcagatgctcggcgataaagcgggaagcactgatgaaaatccttgacggattaccaagccttgaagtgctcaacatatcacactctcacctagtggagtacagcggttggcagcctcagcagaaggtgattgttagagagctcgataagacgataatggagaaaacagcaaggctaaagaaattcttgacttgcatggatcacaagacgtgtgtgatgtgtcagaggactgaaaacgatgaagggattgtgagatggtacaagtatgaggaaggagactggaaggttgatgaagtgagttctcttcatctttgatgtttctgctgtgatcattctctgtgaaggacttaacttgttattgttctcatctttgactgttgaattgtttatttctttgtgttgtttgttttgatttgaatcgtattatgtgtatatatctgtaggctatgccaatgaatgtctgtagtgatcaacttttgatcaccaccaaccttgcacaccaaataggaaaataaaacaatattgttacaattatttgtcttgatattagcattattagtcacatttgttttgcaaatcatctaccttttttttttggtctatatcttattcttcttagttcttacctaccagtcttctccggcggcattaacgacaccgttttatcgagctcagccaccactagttaggtaacgatatatattcttaaaaacgtttagaaaatttctatgtatgtttcacacgaacaaaaagaaaatatttttcagacatcaacggtcattatggacgacgactgttaaacaaaatcgtttaaaattcttgttgcgtaatttgaccattttattttattttataccaaaaattgaagatattatatatatgttttaattcgatcgcaaataaatctgaaaattaaaacacaaaacgttactcttctctctcattctctttcgcttctcgatagcttctcaaatc

SEQ ID NO: 9713 - DNA, 3000 bp, Unknown
  misc_feature (1)..( 3000): cDNA_ID_2185251_gDNA_ID_1972174_Annot_ID_179957 3000 nt of promoter + ATG
aagatgaagagaactcacttcatcaaccttccagtctccttcctcatacttgtaccatctcacaatcccttcatcgttttcagtcctctgacacatcacacacgtcttgtgatccatgcaagtcaagaatttctttagccttgctgttttctccattatcgtcttatcgagctctctaacaatcaccttctgctgaggctgccaaccgctgtactccactaggtgagagtgtgatatgttgagcacttcaaggcttggtaatccgtcaaggattttcatcagtgcttcccgctttatcgccgagcatctgatgctgagtgttttgatgtttgggaggcaagtgatgagcgtgtttgcaaagaagacctcgaatggacccatgatcttcagctctttaaaattcttgcagttcttggcaatttctgttaagagataaggcgggtttgcgatgcttggcattgttagtgactctagatctttccagattcttatcgctttgcatataccagtcttctttattctgttccaagccggtaggacgacccgtctcaaccctggacacctgcaaaatattcagtacaacaaatttttcaacttttagcatttgcgagattcagcttaattgtaattcagcaattttgactgaaagtgggtacatgaacttaaccaaaccaaaaactgaaccaacttttgactaaaaaaccatagtttacggccatgatgaaacaatttggaagacaaataagtggaagaacgaaaaggacatacctttctgcggtgtaagtaagctgatcatcactcaagaacaagttgaaatgaaaaatcaaggtcctcgtgcttcctccgctaaggttcatggagagtttcaggatgcgggttagggcctcatcagatcggcgttccacatagacataaggctctaatgggatcttgatgaaactagatctcatgtttgacaaatccaccgtcttccaaagaatcggatcgcaacaagcagctctccatcctctacaaacatgagctaatcccgaagtcaactcaaagacgctaaacttctggaaaattcttactaagatgtcagtgtccaactcttcccatctcctcaatcgacgactctcatactcttcttccattcttgttgtaccctaaacaagcataagaacgttaatcaactgttgttatccacaagagcttatagaaataggaaagagcacaactttaagaagtaggaaaagaaacacacatcagttctcttattctctcataaatatgaaattctaatcaatcaatcctccctgaatccctcaatttccatgattccatttccatcacaggattgattgattgcatcaatcaatgagttattactgctataagtgaaatgaactacagaacccaactatgataatgttggagttaagtaatcaaagtttaaagtcccaaagagaaagacttttcttccctcaggtaaaccaatacaaacaccaaagctagattatattcttacatgatcatcataatcgatcttcatcactatttatcagaaaaaggaaacaccaaaccttagaaaggaaaacttccgtatcagaatagttcaacaaggaattgaaaccaaacataaaaccaatctacagaggaatatatgcaagacaagtcaagagtctcaaactctagagattgtggccaagtaattgaagatcaaccattaaaactcagaagaacatgaaaagacatagaatttgacaaaccagaagactaaagatcgtaaaactcactaggacagagaattaagcgaaatctgatgtaaaggaatcgaatttcgaaaatctagaggaataagattgaaaacccccaagactctgtcaacaaatcaatctgatctcttcacattcccaaatcagtcgaactaaaaaaccgaagagacagatctcgaatcgccattttctcaattcagaattgaacaaagaatcaaacgaaacatagacatgaattagatcataaagaagaagctgaaacacgcaaaggggcactgagagaaatgaagaacctacctttaggaagaggcaaatcgtttggcgacgacgacaccgttacaatctgtctctagccaatggaagtagatgatatgaatttttttatgataaatcggtttggttttggtttgacggagttttcagattaaaccggtcttaaactcaacacaaacccttatctttgggaacaagattcttattgaggttgactctttaaaaagtagttaaatccgacggtggaatacacttatgagtaatctaacggctggtatgcaactttggtaggtgagtgtgtttaatctatgaagggcggcgatgcgagagaagataaagagagagagaatagagaaatctcttgtctcttgggtatcttcttcttcactttcctatctctttcccaataaaaggagtctctcgctttctccaacttcgctatccaaaggcgtcgacggtataaaacccttttctttgctacacataaaacccttttctttgctacactcactctctttctcagtctgtttttatttttcatttgttgttgttgtgtttcattgaagaagcttttaggtttctgcttctctgttgtgtgagctgttttaaaggttgagtttttcttttcttctatttctcatggcgtttggtttcgtttcttttggtggtttcattttgagttttctgaatctgggtactctttatttggttttattgatatgcaaaaatgcttactttgagattagggttgtgtattcgcgtttcgatttgttcaaagatgattgcttgttttgctttggagagtttggagataagaaacatagctcaagcttttgtgacattgttctgctcttagttggtgaattgaaattgtgtatttttgtgcctgagctctttctgtatacgtgtttaagagaattagcaatactgatgttctaccattacccaatgcagcctccaacattgcatcatg

SEQ ID NO: 9714 - DNA, 3000 bp, Unknown
  misc_feature (1)..( 3000): cDNA_ID_2113881_gDNA_ID_1972174_Annot_ID_179951 3000 nt of promoter + ATG
attgcagcagcaacagtgttgagctgaacctgtaagctaaacaacaaatttaagaaaaaagaagaagaattttaagtatatgagaacgaattacatagaattatactgtcgtagttgttaccttcgagaaacagtaaaacaggggaagaacaggaaaatgggatctgcaagcgaagaaacccacacttaaaaccgccattgaaatcaaaaagtttcaccatttcatcatgggcttttaagctttatcaagctgcttttgatggaatttgaagaagcagagattttttcagaaatgttagggtttttgaagatgaacaatgaaggggtttatagccacgtggccagttctcatttgaaataccgttccgtcaaatcgatgccgtttcatgttactcactagaacatttcggcgttcgctggcttgtcttaagttatctacgcagcgttttataaagtgaaagaactgtaagccgtcttaagcttcagaatgagaactacatgctgttttcatactcactcgcttagatcggaacttggatacttttgaattgaaagatcgagaatttcacatcgtcttctcctggaaatcacgaagctgaagcttctactggggaatcgatgaagctcttgcatctgatattcttattagctttgactactggaatctctgctgttctaatctacattatcggcgtctctaatctctgtaagtaatctccatcattgtcccatgcttgtagtgttgtatttcgtgattttttctgaagtatgaagatgattaatgataaagaagatgattccgtggatttagacgagtctaatcgttttaccaatgaagatttagaggcgttgcagtctttgcagaacggattccagaagtgcgtagtaagtaaatctgtgttagcttccttatcttgtgttataccctcttgatccgtttggagttatagatcgtacctctgaatctggagcttagctgattagaactgatctaatgatgcagagtgcaaatggtttgggactacaagctgctatgggtagagattattgcaaagtttctataaacttccctaaggatactgtccccaaatgggtaaattctctcttctgactatttgtttatcatagttaagcttgtcataatccttgtcttagtgtctagcaaatatggtctaccttattattatgtcttggattatgtacaacaacagaaagatcccaagtctggagagcttgaaggattgtcatatgagtttgacctgtgtgaagcagtagctacatgggaacaagtgggtatttgcagttcttaaagtgtgtaaagtttgatttcatataatttgttttagtctttatagtgatgggttaattggcgagttggttgactaggtcaggaatagctctacaatactcaccaaggaatacattgatgccttaccaaatggatgggaggattatgcatggcgcagaatcaataaaggaattcaactgtaagtattgactcacattagaccaaggatgaagtgcatgatcattggttgttattattattgttttttacagacaacagctcaacacttgcttagttgattgttctcagtcgcaatataccaagtagtgtaaaatgctgtgttgtcttcttccttttctggccttaatgagactcgcattctggtgcagtaatcgttgccagaataaatctttatgcattgagaagctttcattggtgcttcctgaaacaccaccatatttcccccggcagtttgggcgatgtgctgttattggtaactctggtgatctcttaaaaacaaagttcggaaaggagatagatacttatgatacggttctaagagaaaatggtgctcctattcaggttaataatgacttcttttatataacttccagttcttttgttcccgctgtagactcacgtatcttcacttttgtttttgttttttggaatttcttcttgcagaactacaaggaatatgtgggagagaaaagtacattccgtcttcttaatagagggtcagcaaaagcccttgacaaagtcgtggagttggatggtactatataactgttctcttgttttcactccttcatggttatcatcaccactgtttctctctctctctctctctctctctctctctctctctctctctctctctctctctctctctctctctctctctctctctctatatatatatatatatatatatattcatttgtgtgtgtcacattttttatgcttgcaaatagataatccaatctctctgatcctttgaaattatgcagaaaaaaagcaagaggtcctgctcgtcaaaacaacaatacatgatattatgaacaagatgattcgggtttgtttattgcacttaattctctcttagctgttttggttttgaatatctgtacactccccctggtctttgaaacttatttgaggatttttctttctatgcaggaagtcccaataaaaaatcctgtgtacttaatgctcggtgcttcatttggctcagcagccaaaggaactgggctcaaggctcttgagtttgctctctcgacgtgtgattcagtggatatgtatggattcacagtggatccaggctataaagagtggtataaagtctacctatatttattttgtcttgctgtctacttactaaccatgtttatttctgtttatcaaccatggtttacgtttaatctcttgtaatattctttcaggacaagatatttttcagaatcccgacaaggacatactcctttgcatggaagagcttactaccagatgatggaatgcttgggtgtaagtctctggtttcccatcattctttattatccagttatccaatactagttgttagatggcaataaccacttgatgtgtttaatagatttgcattggcttattatagagattcagagatctcttcaaggtttttggttttaacttggttctctcttttttagctcattaaaatacactctcccatg

SEQ ID NO: 9715 - DNA, 3000 bp, Unknown
  misc_feature (1)..( 3000): cDNA_ID_3043177_gDNA_ID_1972174_Annot_ID_179955 3000 nt of promoter + ATG
gagggtattaacctctctttgacgcaatgctgcttctttcctatacaaagacatattcaacatgagcgattaaaaactaccaccttggtttctgaaaaagagagcaagaaaagagaagctaaagaaggcacaggctcccacctgcttaacaatttcgcctccaaggaaactccttctccaagagaggcaaccttttggaaccaaaaataaaaacaaatgaaaccttgaacagatgccaatacattagaaatatatgatttaaagtaaatttaaacaacgaggtgggatgctgtttcaaaaagataacaacaagatatacaaagagatttaaacaagtggagtatttttttcagtcagaatttcaagacgcaacataagtgaaaaatggactactcaagacaaccagttcaaaaacctgtttctcgagctccttagccctagcttctgcttccacccttttttcttccgcacgacgaagctgtaatcaagaataaattttatgaacaacagaagtaaacagctttattacataatataaaattcaatcgcagagatcaaaccttctccagtacattctcattctcctcttgtagcatatccagctgcatataaaaatgaatcagccccaagtcaactcttatgactcatacacaaattctaatttgactaaaatttacaataactaaattgacgagataccgcaaaaggttcaaaagaaacaatcacatacttcatcacgaagagctgaagcttcccgctgatcacccttttcttttgaatttactgatggtacatcagcaaagaacctaaaaacatcaaatatccgaaatcaaacgcaagacgcacaaccaaaaaccagcagggatctctaattcttggagcaaggatcccatttctcatgaacctttatagcaacctctattattaggctttgaggataaatatttagtcaacgaaaaatcatattatacaccaactccaaagagcaaccaaactggttttgacatattccactaagtcacacgttcccttgactaccaagatttgagaactataataagaagcacaatttttaagaacttcaaaatgttatcaccttttatctctgctccgagttggaggatcaagtggaggaatagaaaccggagttttcaccgacaccctactaggcggcattagattaggaatcggagtcggagtcgtagatctagcagacattgacggccttccggctgaagcagaccgcactgaagaaggtacttgctcggcgaagttcctgcctaactaatcaaagcacaaaaaaagagagagactaattagccctaaagaatcaaattcaccacaactacaatcaaatcaagctaatctgagctaattcaatcagctagaaaaacggaattcaccgcaggagacggcgatctagttcggggagcaaatgaaacagccggcaaattattatttccgttgctgctattgcttccggtggaggagatagaagaaggtgcatgacgagcaggttttaaagaagcagatgcgaatctgagacttagatcttcatcttcatcttcatcatcttcgtctccgttgtctttgttctgtaaggccatgaccttagctaatcgctgtgccgcggctttggcagctacgttctgagtccgtttaacggtggagaaacctccgataccaccgagctgtttccggtgagcaggagacatcgccggtgatgttgcctccgtactgttcgatgattcgctccactggcgaccatacactgggctacccgccctcctccgatccatcagtgtgttggtgaaggtacttgttggttggatgaaatcgctgtatttaagcgagcaacaagcaggtgaaccagagaaaatgaaatttctcggggaaaaaggtagattttctcgagaaaacggaagggaaaataaacgttcggtgagattggagaaaagtgttgaaataacagtgacgccaaaaacgacagcgtttaacacggagaagagaaacacatgcgagctttcaaaggtaagtgattaatgataagattatagttaacaaaatctttaatcattttcacttaatctgcgtaccatttaaaaacaaaaatatacaactgtttatgttgtatctgttctgaatcatattatctgtgatattttaatacagtttataaagagatttgtttctcttctaagagaaaatttatatacacatattaatcaaatcacatgagtaaattaaaatcccccctgattcgtggtttgtccaggttattttttcgaccaagtttagttttattttggaagaaaattttacaaattcaattattcaaaagcacatggtttggtatcaaagactataatatatataactagcccaacaatgttggagaactaattatgggattcaaaatcctcaaacctcttgacaagaatccacaaaggaaactgttactccaagtctaatcttcttggagctggcagtggcaacaaatgaagttctagccatgcttggctaagttttctcaaaggtaattaacaaagtgctcactcaaggttcgaaatttgggtaatggtaaacaagttcacgtatggagagataacttgttacatacaaataccatttacgcatggtagaaacggtttactaattttgattattctaaccaacaatcaaagatcagtatatctttactatatacagtgttagtattattagaaatatatgtttcttttcagtgatttattcggtctgttgacaagtaaagagtcgtgacaaatcagtatttgactgtttctatcgccgtcgtcagtcaatggtaaaatatgcaaatagtgagggggtaaaaatgacatttcataaccaaaaactcagcacctataaaaacgtcaaattagattccagcaaaactcaacctgacatttttttctctcgaagagaaaagtcgaaaaaccaacagaagaatttgaatttctcatctcctctctcgaaatg

SEQ ID NO: 9716 - DNA, 3000 bp, Unknown
  misc_feature (1)..( 3000): cDNA_ID_3043173_gDNA_ID_1972174_Annot_ID_179956 3000 nt of promoter + ATG
ttagctagatgtatgtagtgaacaccatttttgttctatactagacaacagaaacaaaataattaagaaaaataactggtagttctgtttcccttttattgctctaacgtgacggctacgcgaggaatattcttgtaattttatgcacttacagatggagcaagcgcagtagctggagaagcaccaccagtggttggcctaataaaatgataaaattatagttaactgatggagtgtctttcataattagttcttaaatgaattgagtattgatgatgaaaacttacaatccagctaaaactttgacagcatcatagataacccactgcgctccagtgagtgttcctatcatgaaaatgcgaagaggaaggccacgggttaacataccccataaccctagcctctttactgcctgtagcacatgaaagaatcaaaccaagtcagtagatcatataaaaagctctgtgttgtgtatccacaagtttgatgttgtggtgaagagtatggagcttttttacttacatcagcaacggttgctcctttagagttattgaggaaagacaccaaattatctgcaggatgtgagatgatggcgcagaatattccagcaatgtatccacctgcaaagctaactccgagctgaactggctttgagcactcttcttttggggtaggcatcactttcttgtatatgagctccacagtgttttcaaaagtagcaaatttcatcatcgtatctgcaaagaagtcgaattttcttttagtaactgaaatcatcatctcaatgactctactacattttcttgtgtatagagacttacatggaatctggcgtccccagagaggaacaagtcctttgtgtaacccgcggaagccttcggatttgatgatctttggtaaaccatcagataaaccgcgggcgaaaccaggctgagtctggaccctgactttgacagcttccattggacaaagagccacatcagcgacgatttctgcagaggctgagccagcgaggtaaatcaaggtcttgtatttagctgcgtattctggtccaacaatgtctgagtagtatttcttggcgtactcatagagaccgtatttaaaagctccttgggcactgtaaccaagaagcgttggtgaccagcctctggtgaaacccttaagcccttgctctttgattgttgtcttgaaagctgaagttatgttcttgtacttcagtggatcaatctgaaataacaacagaattaagggtcttttttggaaattcgtggaatattctctctgagtgaacatcaaaatcatgcatgagattgaaaagtcttcgacggcgttgaagagtcgatgccgtgtaaaacaagaaaacgtaaaagttgacaaaaacaaaaattgttattcgctgtttttttttccgctaataatttctatattcaagtttttctcactaaatattttacttatcacacacgtattaaaaatgttaactacaaatagagaagttggcttggaactttcacctgcatgttgcatttgatgacatcaagtggcgtaatcgccgtgtgggtgataccgcagctcagcatcccggcgaccgtacacgccgcgaaatacgccggcgagtacatttccactttttcattcggcgtcgcgatggcgaaactggtaccgttggatgagactgaagaattagtcggagaaatcaacggctgtgatttaaggtgagtactcatggtcgtcgcctgaaaaagacgatgatcggacgagtagagaaagctcgggatcagcgatctgcttgagtcagacatttcgagagaggagatgagaaattcaaattcttctgttggtttttcgacttttctcttcgagagaaaaaaatgtcaggttgagttttgctggaatctaatttgacgtttttataggtgctgagtttttggttatgaaatgtcatttttaccccctcactatttgcatattttaccattgactgacgacggcgatagaaacagtcaaatactgatttgtcacgactctttacttgtcaacagaccgaataaatcactgaaaagaaacatatatttctaataatactaacactgtatatagtaaagatatactgatctttgattgttggttagaataatcaaaattagtaaaccgtttctaccatgcgtaaatggtatttgtatgtaacaagttatctctccatacgtgaacttgtttaccattacccaaatttcgaaccttgagtgagcactttgttaattacctttgagaaaacttagccaagcatggctagaacttcatttgttgccactgccagctccaagaagattagacttggagtaacagtttcctttgtggattcttgtcaagaggtttgaggattttgaatcccataattagttctccaacattgttgggctagttatatatattatagtctttgataccaaaccatgtgcttttgaataattgaatttgtaaaattttcttccaaaataaaactaaacttggtcgaaaaaataacctggacaaaccacgaatcaggggggattttaatttactcatgtgatttgattaatatgtgtatataaattttctcttagaagagaaacaaatctctttataaactgtattaaaatatcacagataatatgattcagaacagatacaacataaacagttgtatatttttgtttttaaatggtacgcagattaagtgaaaatgattaaagattttgttaactataatcttatcattaatcacttacctttgaaagctcgcatgtgtttctcttctccgtgttaaacgctgtcgtttttggcgtcactgttatttcaacacttttctccaatctcaccgaacgtttattttcccttccgttttctcgagaaaatctacctttttccccgagaaatttcattttctctggttcacctgcttgttgctcgcttaaatacagcgatttcatccaaccaacaagtaccttcaccaacacactg

SEQ ID NO: 9717 - DNA, 3000 bp, Unknown
  misc_feature (1)..( 3000): cDNA_ID_3043193_gDNA_ID_1972174_Annot_ID_179948 3000 nt of promoter + ATG
ttgataattgctatacataattgatcatgtaatgcatattgtgtttaatctttctaaagtacaaatgtaagtcgatactaacctttctttttcgacttgaagaactgcaagattgatgagaactttgaccaacatttacttcatcgtcttgcatatcaagatccacaacgattattttcttcggtttctctttgttttcttccaatgattttctcatcgaatgttgaacctcggaagaaaccttttggcatgcacttctattattcaatccagccaagtgatgtttcattctatttatttcacttccaacgtattgtttaccacaaaagccacaagttataacttttctccgtcttgaatcaatagcttctctaacatagttccaagccaaatcttgtttgtgatgactggaacggttcgacgatttctcttgctttatattgcttgtatttggtgaaaaagccttctccattgatgagtaaactacaaaaaaagaagaagtaaaaacctctacacaattaacatatgtatactctttaccaataaaaaatgtatataactcttacaaggattaaattaaacgaacaaaacaaaagtattcgaatcactcaaagttatattttcatttgtatatattagctagcgataagaagactaggccaaacgaataaacacataaggattggaagaaactcgacataatctaattatactaaatcaacagtcaattttataaaaactgcaagcttctctttctgccacgtatgcttaagtctaaaattttgctctttcaaaatcgtaaaccaattcacttctttttactattcaataaaattcttgtttgacaaaaaatgaaaataatttttttttaccactttttcagcaactgcttcttccacgttcttaagattcttcagtttctctcccatctttcaaaaaccctctgccagttaatttacgatctcaatggcaaccgtataagccattctcagaaagataaaaacaggttcaaattcttcttcttctctcctttctcataaccttaaatcctccattctttcatctaaatacgtctaacagagaaacgaaagtatgacgtaaataatgaaagttgagacttttgtgatgcctaatgtgatggacgctgttaactcctcacgacacactgagtttggtccacctaatcgctggtatgaatatcactaaacctttggccattttgttgcgttttacttggtcttatcttcttacattttccatgcacaccagctgctcgacaaaatgaccacataagtttacgagaatcgtatagaaacaaaatggatgcaaatgttttggggctttcaattcaaaagaagaagaagataaccaatttgagagatgggtggcatgacatggcatcttcttctacggtttagtgtgtaaaataatttaaatgtgaaagcatcttatatatttcgagttaaaaaaagcgttttgattagaaggtaattcatttctccattattattattgttaagcttttggagaagaaaaaacggttctatatattttttcttttcttcatctattccttctctttttctctatgtctatgagagaagtttatgtatttatgtaagatcatttgatgtttccaataaaagttttctccaattttgacacatatagatattacaatttgagtaaagttgaagaggatttctattgagagttatagagcaatgatacacattgtattttgtgaggttgtgatattcatcatttgtgtatagttgcagatttcaaagaaacaaaatgtattattggtattgttgttttcccgtgcaaggcacggcacgggctgcctactagttaagatatgaatttggaagatgtcaatgagagttattttccatttccaaaaagaaaagaaagaaaagcatatgaaactgacggataacgaatggtgataactatttaaaattatggcatacccataaactcgtgacgaagaagatgacaacatagaattggtgaagacaaagacatgcttaataatattataaaacgaaaagtgagtttggtcgttgtcttacgggttttgaaatcgaagaacacaagttgactgattgactctacgttgaagtgaaaattatattgctatatcacatctcctatactcgctacattttatttttctctccctacttctctcaattgcaaaggatacaaggaaacagtgtgtaactaaattgaaatacaaagagcccatacctctagttattgttacgaatccctatttcactggttaacagtttgaatctgctttgaatctaaagctgtgaatggtaaacaaaaccgcactcaaaaccgcaccgcaacagtgctgtaacagtatcaaaatctctacatatacatatgtatctatgtattttcgttactatttgaatcgcaccgcacttctcgcgtaccgcaaaacgcagttattattcggagctaagagtcactcaaacccaaaaattgtggagaaacaatgtcatgaaaaaaaaaccaaatgcgttaaagaaccctaatcaattgtttttctattcatttttaaataaggaaaagatgacagcacagtaattaataaaatcttccatatctctattttaagctatatataaatattcatttttgatattgtatagtatatagtattaattagatctttactcttcatagtcatcgatcaatacacataacattccctaataagttaaattagtggctacgtttgacgaaaagccctcgtttaaaaaaaaaaaaagagaagaaggaaatcaggaatgatctgattcttcgacgaaaggggaagaggttgttgaattcaaaatctctctctcttctctgtctctctcgcgtgagctagttgcagatttttccagatctcaacattgaaattcaaactcaaagctagagagggagagagatagatagatagagggagaagaagaagacgaacacggagctgaaaca

SEQ ID NO: 9718 - DNA, 3000 bp, Unknown
  misc_feature (1)..( 3000): cDNA_ID_2032744_gDNA_ID_1972175_Annot_ID_179967 3000 nt of promoter + ATG
attcaatataacaagtctctggagtatattgaagttcaaaggaagttctttaattgaagtgccatccaagtatagagtttctagattttgtgagatcacccggaattccttaaggtttgagcagttgctgaggatgagaatttctaaagagactaaatttatctccggaagagacttgagacttgtacacccttttagatttaggaaaacaagacgttgagcctttgataaccccgaaatgtcccacaagttacttgaatgactgagattgacccactttaattttggtgtatcctgtgacaacacaagttttagccaccagtagaaaaaactattcattatagttttactcatacagtcaaatgataggaggaggcacaccttatgcttatcatcactccagattcgttcaatcttgctgtggggaagcttaaggtcgacaagattttgcgggttgaaatctggtggaatttccttcaatgggaactctagccagtggagatagcgaacctctttcagtgggaagtttagcccatcagggaggtttatcttattgttaggcttacattgctgaggacaatgtgagctatagatcttgaggtatcggagaccacacatcgatttgaaagtgcaactgtctaagctcatctccctcttcatttcattcatgtttaggaaaatccctctgacttctgcgccttcctgggagacaagtcacggtcgtcaaatctattattcattatatacagtaagtcttgaagaactttgtaaaatatatgaaaagttttcttggtttaggctcacctctatgttctttagcacatcagttatgtcttggtggtgccacaacctatgtggctcccttccatcttgagcatatgctcttcggcaaagttccctagcgaaagtatatagcaaatcatgcatctctactcggtcctcggaaacattaatcatgaatttattcatgagagcttttatttcacttgcagcttcagatgaatccagtagactagcaatgtaactctcatcttccgatctaaaacaagctatgtcgagaaatatatctttatgcacttgactcagttcatcataacttacttgtaacacatctcgaatactatggctggaattttctgctagtgtagccaattttgttttccaatggtcctcgtctttcccattaagatctgcccccaacaactttagaacgagtggatgacctctaccataatgcacaaactctttcgatagcttcatgatgacttcattgttgtgtatgttggaatgacgatcaaaggcataacgcccaaagtgacctaagccgtctttgtggttcaactgtgggacaacataagtatagtcagccacatcttgtattagtgatttgtcgcttgttgcaatgacaatcctgcttccctgcctaatccagttgcatctccccagaagaacatctatctgttccttgtcactcacatcgtcgagaacaacaagaactttatgtgtatgtagttccatcttgtaagattcatatgcacatcgagtagattctatgtctggaattgtcacaccgagtaactcttccaagagtaatgcaggcaagcaatccaacccgtgctccttcgatgttctacgaatatcttggattaatccatgccttaagaacttgcaccgcaaagtttcataaatctcccttgcaagagtggttttaccaataccgggcatcccaacaactcccaaaatccgagtctcctcacaatcaagatctagcttctcctttaattcttctaaccgttgtttgagtccataaatctcgtgcttttctcttcctacggacattgaattgtttttcgaatgatagacgaaagcatctttggttttgtccaacaaaatcttgctcagcgcttctttaacctcttcaacaataccattgatgaagttgtgctcgtcgctacaaaaatcagtaagaaaaaaagccaggcagatccttattgagaaggtcaaactctaacaaagtctcaaacttgtgctctagataaactctattaggaaactaaaaaaaagatacctctttccatcaaaggagaagccgatccggtctgcaacagagctcaaagcttcagaccactggtttttcttgtgaacatcaacattgcgcaaattcttgaaaacacaaccaaaccgtcccttctgataccgaacttcgtatgctttaaccttgtagaaaatgggaatgatgaggagctttcccttgtccatgcattccttcatcttcactagctcgttcaagcaccatttcgattcggtgtacctaacggaaaaaatggccaaagcgatcctcgactcttcaatcctctggaaaaacacatgtaaaggtttacctttttcctcattcgtgtctatgaagatgttgaccccatgcctaaccaatgcacttctgagatggctaacaaagctgttccgcaactcttctcctctgaaatttacaaacacttgatgctgcggcggcaaaggaagtgcttttacctcggaagaggaagaggcctcctccatcggagtttgtttggaaacaaatcgttcttgagtttccttttgagatacaagacgacatgcttgcacaaacaaccttagagataccatttttcaaaatcttgacctgttctactcatctacaaaacaaaaagaattgctacgaattaaacaaactataaaacttaactatcattctggttttatttaagttcaagttgaggtgttgtgacaaagagaataagcgaaacttccgagaagaacttggccggcctcgatcaaaaaacacaattccaagaaatttgtaagaaaaactaggtcaacactctactcggaacgacttcttcatcgtgaggcacgtctctttacgaattcactaattccgacttgatccagtctaaatgaaaaaaaaaaaaaaaactgaaaatcccctaaatctaggtgcaagaaaaacgcgcctaaacaatcatg

SEQ ID NO: 9719 - DNA, 3000 bp, Unknown
  misc_feature (1)..( 3000): cDNA_ID_3032705_gDNA_ID_1972175_Annot_ID_179979 3000 nt of promoter + ATG
agaaagttacatcggtaagctaatggcctgaggctcatatcaatcatcattttcttctcagaaaatattttgatatattaacttctttgatgcggatttgattcaggggaagttgcctgactcattccatctaatccaacacacggaggcccaacgttttgttggtaaatgcttggaaactgtgtcaagaagattgcctgcaaaggagctcttagcggacccattccttgccgcaactgatgagagagatttggcgcctctttttagattgccgcaacaattggcaatccagaatttggctgcaaatggaacggtggtagagcatctgccgtcaacgactgatccaactagaacaacagatatgtcaataacaggaaagatgaactcagaagaccacaccatcttccttcaagtacagattctagatggcgatggtaagttaaagttctacttactacaaatgtcttgcctggtttgattggaacatgaaatttgttgcgttgctagaaacttgctcagctgaaccgggctacaggatttgtagcacctttagtattagctattcatcataagatagaaatggacgattgtaaccttagcttctgatttttgtaaaactttgttagaagaatcaccaatggaaaatgtttttatgaatctgtttggctgtggcacaggtcacatgaggaacattcagttcccgttcaacattttaagtgacacacctctagaagtagctttggagatggtgaaggagcttgagatcactgattgggatcctttggagatcgctgcaatgatagaaaatgagatatctttgctcgtccccaactggagggccaatgactcttctatccggcacgaaagctttggtcatgaagatgatgaggacaatggcgacacagagggaagaacgcgccttttctcctctgcttcttcctctcacgactctcctgtagcagttagagagaacaatgacgattctagtaacgatgtgatcccagatatggatgatggcaatagaagctctaacaggttgctgaattcttcaacataccactactcacctgccattgatgatgatcaaaatcagcaacaacggagacgagtaaggctacaacagaaaatgagatcgctggtggacacgagaacacaggtgctacaccgatcgctcatggagttgatcaacaagcgtcgtgggcgtggctttgacccgaacacaaacgagctacaacctcaaccgtcgtccactgatttcattcgacgatgttgaaaatagtatgatgagagagcctatttgtgactctttcatgataaagacagatcttcatattggtactagcattttgatttgatgatactatatgaaataattgtttagagtgctttgtatatatgatattcttagggaagtgttacctttttagctctatctcgatttgaaagcgatgcaaaaccgctcgaattcgatttcaagtacgaaggtagcttcttccctgtgttaaagagacaatttagattacattttatgcattttccattacagtggtaacttaatattcaaataatcataggaattaaggatttttctaatcttgatacgaaagttgtttatcttctcgtatcaaacgtagaggcagttgaacaaatttacaaacgaaaatgttcttagattggtataaccattcgtcgaaaactataaagatttacttttatttaaccataagatgatatcatctatcaaaaagtgttaattatagttgatcatatataataagaacaaattataaaggctatatacaaaggaaatttgcgttaattaggttatctaaccgcatgcatccaaaacaaatcatgtatttaaaaacttgatcacaacttgagcaaaatatatggagagcaaagggccatcgccaatagttccacttgtgcttgtggtactcttcggatggttcctatgcggctcgtaccttgtctcactattagaagatgttgtattaccaatcttacaaaccggaacgttcattgtaggaatctttctcttgcttctccttttgcttctccatgtcttatcttcttcttggatctatccatggatcccttctcttcttcttttaccatctccggcttccacgacttctactgactcagacagctttggtcttggatcgtttcttttgttcacactttttctcatctctttctggttttttgggtcactctaatgtttattctacttgtgaattgtatattcctgattgatcatgcaaaatattgctatacactttatacatgcaaaatattgctatacatgttgtacatcatgcaagattccaacacaaaatgtttagcaagaatttgtttaaaattaatttattattaattactgcatcgctcttattccattttcaatgtaatacaacatatatcatccgtgaaaacaacataagagagacaacctagctactaggctactagctaggagcctaggagttgcataataatgagtcgaaagaagatgttatataataagtctccgtgcaaccacctttgacgaccaaccagcacgaagtacatgccacagacgaaagatcacatgcattgttttgggtttttacattataaatagggtcagattttgagtaatatgtgtgtttaaatgaggtaaaaatatataagaaaataaaattgcaagaaacttcttacttcattttattattttttccaaaacttttgtgaagatgtacaaaacatatccaagaaaataatttcaccaatttggtaaatattgcatgattggatatatgtgcaatgtgctatacaaatctttatcaatgcttaaacttcaaatagcttttaccaaactatgttataaaataactttaaaaaaaaaaaaaattaaaatgttttatatgtcatttgaacatttctttgatataaatgtccattattagtccattatatacttatgcaattttcacccaacaaaccgttggatat

SEQ ID NO: 9720 - DNA, 3000 bp, Unknown
  misc_feature (1)..( 3000): cDNA_ID_2032685_gDNA_ID_1972175_Annot_ID_179982 3000 nt of promoter + ATG
gagtcatacccggacaagttcggtatgttgaaccgtaaacatatcacctatgatccactgactaacacggtttgagtcgacttgtcataaaattcacctagtaaaaccgacaacctgccttaataattaaaccgtcgaattccggtttgtgtctcacaagtcacaaccgtccggatcccttgcccatttactttatcacgtgtttttccccataagtttatattttttattaattgatggacagaaagtttttggttttgggatgaagtcacgaggacaagaagaaatggaaaaggcatcatgacttgtaagggttaacaacaagagatagaggttatatgcttacgcggtcctaagcacgaatactagaagcttagggttaggaccactagagatataatgcaatttggaagtcaccacaatgtttaagaattttatcagcaactttggttgaaaataataaagaagaatctagttcgaagttttctctccatgattttttgaaactgatggaccatcaaaacatctttggcgtatggtggggcctcagaacacatgggccgggcttggttacacatgagaaaattgttgtttttagttagattttggtggactagtataaatggataaaagaagtcgttggaagaaaaccaaattgatagaagaaagaagaagaaaaatagcaaattgttgaaacagggacagaggctgtctttaaggaaaatcccgtatgattaaagtgtacgtaatcgattagtgttcctctgtaagcactaagtcaaaagtaaactctaaagccaaaggtttcaattttcaaacattgttaaagcgaagtctgtccacgagaattagcacatactggtccaccatgttatcaagaaacgccaaaccttttttttgacaatttatagtttttgaaatatttagtagaaatcttttatcttaaggaagagattgacaaaaatagataaataaacaaataagaataaaagattgaaatttttgaaattaacatatatttagccatagtggaaagaaaaatttataataaggttggtatatcaaaaatcaaagaacatgtgaaaaggtttaataaaataaaagctatagaaaattgataagttttgtccttatgaaattaatgtcatgatatatatatatatatatatatatattattgtactttttaattaataatccctttttgaaaagaaaagaaaaatatgtataagaattttttgtagtgttcatattcagttttctagaaaagctaggaaagcgaaagtggcctggcatggttttgtaatttccttttttaatatgatcataaaataaaatatgtaaaatgaaaaaaaaaactcattaacaaggtaaggaataatgagttgacaacaaaacaaaggtaagggataaatgatgaactattcggatgaacatattattgcaaaattcagttatatactatatggtccaacgctactagcaaagtagcaatacacatgttggtcataattattgaaattagttacaatttgcgtgaactttcttaattaataaatatttaatttgtaggttatgggaatgaactggaaagtaataaagttgaaccgcatgggtgaaaagatgattgtttttggctaaactaatgtgtttttatattgctaatttgatcggatccccatatattctcataatcactccctcttattacgttgaaacttgaaacaaaatgctaagctgcctaaaactcctttcgctttttagaatctagaggagagaactaacaaaataataacgaacttattttaagatcttaatatgcgaatatgcgattaccaaaactatgcctatatatcaccgtgagtctttctttttttgggattactttgccagtttgcctataaccatgtcattgagtctatgactacaacatggcattgggtttagatgtagtggtcaacatcttatagttattgagatattgagtccattggtaataaaaaaaactcggttaaagaaaagaaaaaccggtttaaaaacggtataaaacatgtggttgaatgattatgattagtgaaaacaaaaatttgactaaaaaaacttactaaaaaaactttaattagtatacacacaccttgcttccacttaactatcatgaagccatcatcactgggtttacatcggctaagtttatgaaagtgaatgtctctataaatgcttactctctttttaccatacatattagcctagagaagtatgtagagttcaagtttccaacatacattaatttgaactcaatacgtacgtgaaagcaagccttcctacatcaataaagaccgacctactagtttcttcataaatcagatagaggccgtgtttgaacgtagatgcgacttggtgtctcaatgagtgtaaaataaaaacctaaaaaaggaaaaaggtaggaccaaacacgccccatcccttaatctcattattatcacctcttccacacgttacctccctgcaaacctcacgctccttccctcataacacgtgactctcacgctcctccacctctcaaaaaaaccaaattttccttgtaatttacttgaaccaaattcatatattcacctaaacataactaattcttgatctaactttcgaaaattttcaaattaaaacatctcattgattccaaaaacatactttattgttttatatggttagtattttaatctttacgtaaataaaagacgttggaattggaaattactactagtagattgctttatcagaattttataatctatacaatgtaaaaagccgcgtcatctgttcaaaaattcagaagatcagagtcacgcctatatttctctctctcccgtcactctcactcttcctcttctgcttcttattattacatcgatcctcgttgtccctcctctgtttcttcaatatctctttctctccaacaaaatcaaaatcaagaaaacaaaaaagaaaaactctcaagaaaca

SEQ ID NO: 9721 - DNA, 3000 bp, Unknown
  misc_feature (1)..( 3000): cDNA_ID_1533420_gDNA_ID_1972175_Annot_ID_179987 3000 nt of promoter + ATG
cagcagccggctaataccgattcttgatagttctgtttttggatatttcagattaacttgtgtcttacaagaatacatgtaaacattgataccgtttatagcgaaaaccgttgctttacatcgaacattgtaaaagcctaaagaaaatttattgattaatgtttctgaggattttgaaggtaatgcatggtatatcactcttacaattattttttcttataattattccatttataaccaagtttttttatgatatcaatatagttgattcgttggggataagaaaccaatttcttagagttttatgatttttctactaacctttgtttagctaaaatatttttgctattcaatcatatttcactattcatctaacatatatgtcaaaactcaattatttcatgtaaaacagaagaagaaaaaaaaacactgtttttccacatttctactgttaggttaggtatgggatatatagaatttagggctcatggatttatggtatgaataccagtgtagaattgtacgcactagtcgcaattcgcaaagcagaccaaggcacgtccaacggttagttgaaatagtgtcattttaaaaactgagactttcactatgtggcccttctttatgaccgttagtgatccccaccacaaactccatcattgacgcagctaactccggcacaactccctctataatccaacggtccaaatactctttcacttttctccaaataaagttatatttctaatcacatttctatttctagattagaagacaattgagaaaacgactacaagttcacacttttttattgaatccaacggtccaaagattctttcacaaatactttgaatttacttgaatcaattaatctcacttgctataatgataagatattcacctccctcttataagataacaaaattagattttataaaaagtgcttaaactataaataaagacaaaactagtaactgagaaggcaacggacacttgtagctttatgcaactttaattattccctacatgagaaaaagaccgttgcgataatataaagtcttcgttcacacacaatctcgaagaaaacaacaacagttttgatcactctgtctctcttactctatcttcttcccaagttcttgtcttttgatggccgaaaccctagaaccctccctcgtcggggaaatcgacacttctgcgcctttcgagtccgtgagagaagccgccactcgctttggtggatttggtttctggaaaccttcttcccttaacatctccgaagcttctcaggtcttatttctctccttctccctcaaagtctctgtctttctcactgatttttgtccatttctttgcttttggggttttagttgaaatgggtttttagattcatcaatttctagatagatcttgtctttagttgtttcttgtgattatgatgcgaaatttcgaatctttggttgcagaacgaagttggtatggttttgaaagcgagtgagttagagaaggaactgattgagaaagaaggagaaactttgaaggtgttgaagtcacttgagtcgaccaaagccattgttgaagagctcaaatcaaagatacagaacaaggaggataaagaaaattgtgacatgaatgttttcaaggaattgaaccaagcaaagatgaatctgtgcaagacgacaaaagatttggctgctattcgcgtgtctgttgggttactaaacaagagattggaagaggaaagagctgcacttgagaagacacgagagagactaaactctgagaatgcagctgaaatgtccatggagattcagagactaagttatgaagctaaggaatttagtagaacaggagagaatgttcggtatgcggttaataaagctgtggctgagattgaacaaacgagaaacaagattgaagctgctgagatgcgtttgatcgctgctagaaagatgaaggaagctgctagagcggctgaagcagttgcaatcgctgaaatcaaggcggttacaagaagaggaagaaggagaagaagaggaggaaatggtgaggagactatgcaggaggagattcttgagacgattgatgaaacagcaagagaaatcagaagcagtaggaggacacttgaagaaggtttggccaaaatggaagcagaagaaggaaattggtggtggacagaacagaggaggagatcatcatgttcggctaagttcaagaaccctccttatatgatggatgtaaaaggtctgaatatgatgatgaatggtgatgggacatcatcctcagttgctgtcttgaaaccaacaatgtctattgggcagatacttagtaggaaactacttcttgctgatgagtcagcgatgatgatgaatgggagagtttcgttgggtcagattcttggaaagactaactttggagatagagagaaggaaaaaaggttcaatgggaagaggaagcggttcggattcgcaaacttgtctgtgatgttaaataaagagagtaagaagaagaataagaagaagaagatagctttgaacttaagttgttaaaagagtgattgaaatggtctaatctttacattaggacttgttgtttgtgtgttatctatttgttttcgatgtgtttattggtgtatgctaaatattgaaatgagatgtgatttgttatatctttatgcttattccaaagtccaaactaattgcatattcgaagataatagccacatgtatgagatgacgtggttggataatagcttgtagtgttaaaatacctcatttgacctttcgacattcatacgcaatcgactcattccacggatctgcttactcattgattctcgataaattgttcttctcccacagacaccagattctaccaatcatttgctcgaaaaggtaaaatctttctctacaatttcggttgaatcttttgataactcgatatatctcttgtaaagactcttgcttgaatcttctgatctttttttctttatcaggaatc

SEQ ID NO: 9722 - DNA, 3000 bp, Unknown
  misc_feature (1)..( 3000): cDNA_ID_3032701_gDNA_ID_1972175_Annot_ID_179984 3000 nt of promoter + ATG
aatcctcagaaacattaatcaataaattttctttaggcttttacaatgttcgatgtaaagcaacggttttcgctataaacggtatcaatgtttacatgtattcttgtaagacacaagttaatctgaaatatccaaaaacagaactatcaagaatcggtattagccggctgctgcgatagcggtggaggtggcggtggcggtggcggcagtaacaagcttttccgtcgcttccgaatgaaataaaaagcaaatccagaaataagcaacaaaatcacaaaaccatcaatacctccaactaatcccaccacccattttctcacattagatttctcatcactcaatctcactcctttaggaatcttcaccatataactcaatccactaactctctcaatctgtttaacacccatcactatcccatacatgacacaactctcttcagaaacagagtaactcgcagctccacactcacaatctttcttacacaactcttcacatctttctttgcttatgtttctcacttgtgtcccgtttcttagcactgtagtgactccatttagctcaaccatctcatgatcacatagcctcttcactgaaacagcttcttccccgttgatgctgctgcaatatccattgcttacaaccttaatgcaagaacaagactttgagaatgtacagattccatatggtttacacgctacaggaagatcacaagtgtcgctcacagcttgaaacgttgcctcgaactttcccttttccggtttatacgaatagagtcctaaattaccggttctgtttccaagcgccaagaatctgatcaacggttgctctattcttccgattatgcgactgttatcgtcgaataggtcaagaccctttaaccctagtctcacgaagttgaccgttgtgttcttctctctaggcttgtattcccagtaagagtacttgagcttgttcaaatttaggaacagagcaatcttgtcgcgtaagacttcaaaggaatagaacagagtcgagtcatttgggaatgaagttagttgcgtagccacgtctagtctctgaccactcaacatcacatctgttgggaaattgaaactttgccatttgatcagattcttagcatcaaccaacactagattccctgtgctttgtatctccaacctctacaaaattttgtttccaaacacagtttagcatgttacatgtttctgtcattaaaaatgatcaaccaatcaaatcttatacctcaacgccttgtcctgaggttccacttctccatccaacgtgtttatagctactcttgagtctcaagtctccatctttcgtgagctcaatgatgcatttgctagaaacgtacatctttgagtaatgccctgagctccaaactcttacatctccaaggaaaatttgaagggaacataaatatcttccatcatctttgtcgcttgattccattgttaacgcggctttaaaaccaggttctcttgttgacgatgattctgtctctatgatataagctttccccataaaccctggagtgtattctagaggagaagtgagcgtcagagaattgccaaggctgatatctgatttgcagtgaccttggagcttcgagaacaagcagattaagaaagtgaacgtatagaacttcatcatcatgatttatgagatgtttctgcggctgttgatctttggaattttccgggaaaagagcaaagatgataagaaaaagaaaagaagggaaagtttggtatgagtgtgttttactatacacttttgcagggaaaaggtttctgctttcatgttgcctttgtggataatcgttcttgttatcctaaaaccttttttcacctatatttggtatttattttatttttacttgaaaatattttccaaaagagacacatattagtattatcagtctttccacttatttgtatagtttacttcaaaaagtttctaataacaaagcaagagaacagacgttggtgcacgcttggtcttccacaggctcaggctgtccatgtggggtttctgctctgcattcgaatttggatgacacacaatataggatatgagttatttcttttttgtttgtaaaaaaaagtagatgtgtaaattaaacatcgtatataaaaggatatgagttaaattatgttttaagaataggaaaaaaacgatgatgtattgactagcaagcttatatgtaggacttgagagtggggaagtaaagcaggtattgtgttgggaattaggtgagatttctttagtactaataattttagttggactataataattgatattggctggctaaaagatggaccacgaaaagtggcgatccctgtcattgttgttcatgccctttagtgcctgatgtcagcgatgcgtatataaacaccctgggctccaaaaataactccaaaacctgacacttccggcttccaaggcttttctatattttcggcccacgaattgtctaatgcgacccattttcgaagaggagtgtatgctcctactatctattgaaaactgaacttctaaagcaactataaaaggtttggttctgaagaaaaaatccgactcaaatcaatgaatcattaatccagtatacagtatcagttaaagaaatactatgttaaaaaaacaaatcaaatatgggaagatatatagtatatatcaatcctctatcttataatcttttaaaattaaatggaaaaacagaatttactacataaaaaatctttcagatataggggaatgagagaaaaagatctccgttacttaaagtttaaacaattaattagaatttcctttcgaaattaaggaaagaataagaaaaggaaatcctaattatactgatacttaaaacttccgtaagagtaagaacactatctataattttagattttatacgcttacaaaagctacacatactttcgtatttagccaaattcataacaaaaaaacaaaaaagattcacaaaccgctacaataatg

SEQ ID NO: 9723 - DNA, 3000 bp, Unknown
  misc_feature (1)..( 3000): cDNA_ID_3032695_gDNA_ID_1972175_Annot_ID_179989 3000 nt of promoter + ATG
tagtgttaagatgtggtggacttgtattaaatctaatggcttaattatattatacactactacattgacttatgttccctaaacgcagaagacgtagctccaacaacagacgaggcagccattttgatccactcggcgattgactgaaggagacttaaacgacaaccatctctttgattgttatctccacgggactttttttatgtgttttgtgttatttttttttttttttttgtgaatttaaagtcttgttttgtctatttgctcagctctttgttttaaatatgatatgttatttatagtcagatttatttttgttcaatattttcccatcccttttatgtataaccaaaacaaaaaaaaaactaatgatgaaagggtaatagagaataactataacaatgctttcatgttgtgactgaaggcaaacatggaacaagtaacgtgagagtaattgttaacagaggaatgaataaaatgttttgttttcttgaagctatgtctcacaaacacatctcatattgtacatcattttgtaaagcataacaatcacgtaaccagagatatatactaaagtaaatagtaaaaattatgcagttgtttctagagtctataaaaattaaagatgattttggcttatttggacattggacaaagatctatatggttcctctcaccaagttgtatgaaattgacaggtttatagaaatatgtggtggttccgaaatccgaagtctgattatttctcctagtgaaaataagtcgttataggtcaagagttggacatttttgttcccgcatattcggatgttgaagtaatgtagtttacttcgaaaagtatcaataactaacaagtatatatgtaagtagtgtattttaaatttgtataagattttgttttgaggattatgggtccgctaaaatctagattaatatattatactatttttgaaatattaaagcattaatatatatatatatatatatatatattacatatgaaaataaatttaggaaaagatagtctaatataaagaaaacaatctaaataataaattttatgattacaaatttagaaatatttattatgaaagaaaaaatggaagatttaagaatttctttagtagttttaagaagttagataggataagcatctatatatggtttatatgcaatattatagaatgctcttagaaaaatgaaaagtaattataaatggaaatgacagtgtaacaacccctgtcactacagtctacaaatagaacaaatcttcctcacttttatatccatattcacatttagacaatgcttacgtatgtccttacatctctttaataaacaatcctttaaaggaatataatccggtgccttaaatatatacataatcaaatattaaatttaagaaaaaattgaatggaaaaaataaattgaatggaatatatgtacattaccaatttttgttaaagaaaaatatgcacattaaaataggtggttgtctccatacatttaaacagataagagttgtgtttagttgcagatttttttttcaagttcaatactaagatttgatttcaaagaacaattcacatgatacttttttcttttgtcaacgagaaagataagatgggaagtgcaaaagaaaacaattgggggatccgtagaatctttagatcattggtgagaaagatacatcctaaggagccaaaagatcatgaaagcacaaccgaaaatagaggtaattttttttccccggtatttgcagtttgataaaacaaaaatatcctgataaaagctatgtattcaatttattataaaatatcaaaaactgaaatattgggatagtttttccctgatattgaattacctgtttcttatgtaactgtagatgtgatgaacaaaaaaaaaatcttacaagattataaaatttgactttaaaagatatgaaagtataaaatggttacttaagaagaattttagataaaaatataagaaacaagaaaaatatatatatagaaaaacacttagccaaacttttgtttttacatacattaatcttacgacatgctcgacccaagtgggatgagcaaaagtgcactggtccaaagatttatgtttactgacaataaattaaacaagaaaaaagatcataactttcagggtcaaaactgaaatgatctaaaaaatgaccaaaagaacgagtgggtctagtaattaagtttatgtattatagaaagatttatatattccagttttttttacccatgggaccaaaacgatgctgctcatatgcctaatatatatggatcatggatgacttatgatatattgttttattcttaacagaattggcgatgattgacggttcaacctgtattttttcaaaacattacggtaatttcgccgcccttaatctttaataagagttaaacatatttaaaatataatttattgagataaaaatttaatcaatagatttatcgaattaatgatttatattttagggcttaagatgtcatagttagggtttcgtttttatgtgaattttagttcgtaagtacaaaattagaccaagacaagtgacttctcgatttgtgctactatcgttgatgtgtcatgaattcaagtctgcatactgaatgtcgttgaaaaaagaaagtttcagaaatcaagacgagactgcattggttagagggtgtaaaaatatatgtaacatacaagtattatagaagatttcccaagaatgaaattatctttgtagatgataacgatcatctttctactcataaatttttgatctgaaaccttgtttctccagtttcagtctacttattttaagataaagtaaggaggaaaagtatatccatcactaaatctttgtttttttccttacatattacataaatagaggttcttaggttcttttatcctataaggatagtccgctttgtgatcaaatagaagattaagacaacttatataagatatagttataagataatg

SEQ ID NO: 9724 - DNA, 3000 bp, Unknown
  misc_feature (1)..( 3000): cDNA_ID_2032694_gDNA_ID_1972175_Annot_ID_179980 3000 nt of promoter + ATG
cgaatccccagccaaatgttcagagctcacaggttcccagtcaagtttcctcaatacgaacctttgacaatcccatcagttttgggctcccatcgccattcaccataccggtgtactctagtggatccactaccagtagtttaggtttctcacctccaacagaacttgtttttcctcaacccggtgaagatgagcgttttgaagatccatgttatgttccggatccgatatctctactgggacctgtttcagaatcacttgatttaagagctgctgggtatgaaactggcataggacaggtaaaataccaggcgatgaagaatacaccttcttgtgaagccaacaagccatctccaattgagtctcccttgtctagatcacgggctgcggatgaaaaacaagctaatgatggaagctggcaaatgtggaagagtcctctaggccaaaacggtcttggtttagttggtgggtcagcaaactgggttataccttccgaaataagtagatctatcgaggaaagtgatatgcatcacgcgcctcagcatagaacagaatcattattttcaaaagaggattgccagcttcatcaaggtgcttattcacaaaggaaggactatcttgaacatgatcagagaagtggcgttttcagccccattactggtccaaccactactgatccttggtctcagaaaatgttcttccctgcattatctggtattgagagtcctttttctactaccacacaaacaaaaagcgtcttgaacaatgcggcagggtacagaagtccaacgggatctggttcagacaatccatttgaacatccttctcctaatcactggctcaagtaagtcctgaaaacttgttgtttctgtagttttctgagatggcaagacaaagtgtaaatcttgaaaagaagcagtaatgatttggtagaatttgtgaatgtacaggaaggtgaagagctcagggaatgggagtgggaagcaagttttagcggccggtgaagttgagaaccaccaaaaagatgtagaatcattctggtagtcacaaaattaaacaaaatgaggtcaaattttttgcagatacacacacgttgactgtgtctgtctgtctctgtcttttgtcctctcgggtcttcaatggagatatagagataatttagattacattttatgcatttaccattacagtgataacttaatattcaaataaataataagaattaaagtatatttctaatcttgatacgacgaaagttgtttatcatctcgtatcaaacgtagaggcagttgaacaatttaacaaacgaaaatgttcttagattggtataaccattcgtcgaaaactataaagatttacttttatttaaccataagatgatatcatctatcaaaaagtgttaattatagttgatcatatataataagaacaaattataaaggctatatacaaaggaaatttgcgttaattaggttatctaaccgcatgcatccaaaacaaatcatgtatttaaaaacttgatcacaacttgagcaaaatatatggagagcaaagggccatcgccaatagttccacttgtgcttgtggtactcttcggatggttcctatgcggctcgtaccttgtctcactattagaagatgttgtattaccaatcttacaaaccggaacgttcattgtaggaatctttctcttgcttctccttttgcttctccatgtcttatcttcttcttggatctatccatggatcccttctctttttcttttaccatctccggcttccaccacttctactgactccgacagctttggccttggatcctttcttttgctcacactttttttcatctccttctggttgtttcagtcagtgtaattaatgtatattcttcttgtacacaaatagtttctctcattggaatttgtattttcctgattgttcatgcaagatattattatacacttttttacatcttataggaaagaccacttgataaatcatgcaagattccaacatataatgtttttctttttgtaatgtttaaataattaattactgcatcactcatatttcattttgcttgtaaagaaactgaatacaacatatatatatcatctgtgaaaacaagatataagaaaaagaagtaggggtgaaacaaatcaaacacaataaaaaaacctagctagctagctaggatcggagttgcataataatgagtcgatagaagatgttatataagtctccgtgcaaccacctttcacgaccaaccagcacgaaggacatgaaatgaaagcaacaacatgacacagagggaagatcacatgcattgccttgggttttagattcaaattttagggtcagattttgagtactgtaatatgtgtgtttaaataaggtaaaaactataagaaatttttttaagaaacttcttacttgatttatcattttttccaatatttttgtgaagatgtaccaaacatatccaagaaaataatttcaccaatctggtagataatgaatgattcgatatagtatgtatgtgctataaaaacttttatcaatgcttaaacttaaaatagctttgaccatatctaaactatgttataaaataacttttaaaatattctttttttaaaaaaattcttaaaatgttttatatgttatttgaacatttctttgaaatgcccattattagtccattagcccaacaaaccgttggatatatgggtggggcggcgtttaagaggcactgacttgacccgactacccacccggttcgttccttggttccggttttgccttgtaaacattttctttcgtttttcttcatcatcttcttctcaaatctttcgcgtttacggtttcttcgttagcaggattcgaacgaaagccacgagactacgtgattcaacccgaatacgatccgaatcaggattctccttccatcatcttccatccccaatttcaaagctcttctctttttggctgatgctttgcttca

SEQ ID NO: 9725 - DNA, 3000 bp, Unknown
  misc_feature (1)..( 3000): cDNA_ID_2032704_gDNA_ID_1972175_Annot_ID_179977 3000 nt of promoter + ATG
aatgaatcagaatcctccagttcgtctggtgctactggaaatggtagacatgaccaagaagactcgttggatgcaggagtaagtataccgagtacaactgggcctgatttaagtggatcacctggtgaaacagtgccttcggtttcagaggaacgattttcgggagacgcaaaagacttggctactttgaggatccaaaagttagagatttccgatgatgcaatgaaatctccgtgccttagtgataaggaaagtgactctcctttgaatggtaagcatcattcttttaatcagatgagaaatggagaagttttaaatggaaacggggtggggaaacagcaagagaattcctggcatactggttccagaagagttaaagatatacatattaatgagaatgagaatgagcatgttggttatgaagacctgccattcgcaagtgcagtaccttggccacaggaggacatgcatctccactactcaggtcattgtgtttctggcactccgaatatgctgtctgacctctcaggcgattacgagagtcagcttaacagtttgcgatttggtcgctggtggtttgattatgtccaaaatggtcctatgtctccactatcacctcctgggctgcctcagctgccgaacaacaattcatgggaagtaatgcggcatgctctgccattcagacgaaatgcgcccactccagtaaatgcaaatggagttgttccgagacaggttttctttcatgtgaaccctcagatgattccaggtcctggttttggtatcgaggaattacctaagccacgaggaactggaacatacttccccaatgcggtaattacttatttgcctctctaacatctcttacagacactccgtaaatggccaagcttctaacgtctcctttatgcagaaccattacagggatagaccgttctccccaagaggaaggaactcacaccaagctaggtcgccgcgtaacaatggccgaagcatgtcacaagcgcactcagaaatgaattttcctgacagaaacacccgtgagagacagcttcattatcccaaccaaacaaatggttcatgcgatatgagtcacactgattcacttgatagctttcctgataccaatggctctacaaatcatccatatgaaaaggctccagactttaggcctacagagcctctaccagtggaagtactctcccctcctgaggacagcaagccaagagatagcattgaaggtcatcataatcggccacatcgtccaaaacctagaccctcctcaacacaggaagaacggtacagcatatatctcttacccttaaaaacatattgtcttcactgaattattaccatggatcaccaaagccactatctaattcactgtagtgatgtacatgtagggtaacacctacacagtcataccatttgacggatgatgatgagttccctcctttgtagctctggcctgaattacaaatgcatgctctctagaccgttataggaacaggtatagttttctaacttggtttgtctcctaagttatttgtttttacctcctgcaagcgcaaaaaaaaaaaaaagaagaagaatggagctgatatgttttgggctgtggttctttcttgtatgttatctctggtgctatagaataatttatatgtatctttatcaaactctctggacaaaacctttgcagagctttgtattttctacttagacaggtttgctgagtgtattataggatgtttttttttttctctcagtctctattctatcttggtaattctccttcttgtttcttgattcttcttcctaatggatgataaaaaaaaaagtaacaaggttttggtcattataagttgattccatatcatgtcttcttttagtaaaatatgtcattagttgaaaagtgcatgaaatagtaaagagttttaaaaaaaaataaataacagcttttaatatggctaatgcgttcagtttttgtgattggtaactatcaaaatggtaaggtccaattgttgacatcaaatcgtaagatttttttagggtgagcagaagtataatatcgctattttttccgcttttgtgattggtaacaatcaaaatgataaatcattcattgtgaaaatcatcactgaattccttatgttttgttttggtctatgtatagatttagttgaacccaatgtgacaagtttattattctctcaatcagtgctggattctgcaaatcactttcaaaaacattgaattcgaatattgtaataagaaaaacaaaaattgtggggaggggaaatagtcaaataaaagggtaatggtgtcaaagtcacgcaatcatcggttacatacattactcttacatatcgacatacttaacgttaatcaaatctcgtttgacaaaccatcatcaataaagagcacaagaacaaagaagaaggaaaaagtagagcttttttgggaatcagaatcatcatcgatggtgaatccaaagcgtggcaataggtttttcaaatacagaattgtgtaaattgctctctatcttcttctctttcaaattctcttccttttgttgtattcaataactttttccccactttgatgggctgcaaccacatattcttcttctatctttaacttttcccaccaaacttctccttttttttctttttttttgggttctgggtctgcttttttgttgttgttgttgttgaatgaaggtccgtaagggaagaagacagatgattgcgaaagagcaagacgaatacaaattacgccaacaaggtcttgtttttcaaatggcttctcttttcctctctttcgattactccttactcttcttttggttgctcttccgcgttttcttatacgagaatcacgaacgaaaactccagattttctagcacacctcttctctctgcatcgccatcttgttttttcccccaaattttcgattttttttttgtataacttttgagattctgatagatccggtacggagtc

SEQ ID NO: 9726 - DNA, 3000 bp, Unknown
  misc_feature (1)..( 3000): cDNA_ID_2114138_gDNA_ID_1972175_Annot_ID_179973 3000 nt of promoter + ATG
cacatttgacatcctccgcttcaattctaaatctcccggcgaagaaaattaccggcaaatttcacggagaaacctcgccaacgaagcggagttatggcgggcatggctgcggtggcaggattacgaccgtggaacgcttttattcaagctctagttctgatatctctatcatttccctttctctccagcgcttaccgacctggagatatcgtccggatgagcaagatggggcagtatcactctgttcgtacttctctttaacatattagctgagattattttctaatttgatcggagactaaggatctattgattctctggcagtcgagaacgacttggcatgatgtgatcggaaagcattgcccgatcttcgccgtcaatcgcgaggtactgtgtgcaaataggcttaagacatttgatggataatttggaaatttagattgaagcttgcctttctttgccaatttttaggtgttgatcccaatagcgaaaccaattggctacacaggaactgatccttataagatgtgagaattttctggtatttattttgattgcatttcaaatgaaaattttgtatagctctatttggtgcttttgaattgagtttacttgcttagttcattactggtttaaccagcttttagattgtatttagcaatttcgattgttgctactctgaaaggaaatgatgaagatactgtgatgttttcgccatttctctcatctcttttgattagcttaagccatttcgtatgttttttttagctctgtcttactgcagtttgtgtttttctgatgtcttatctgtgctgaacatggagtactgacatggctacatctttatcgtgtttgtacattattcatatgcaaattaagagtaattttgtgcctgatgtgtgtttatggatgatttttacatgcagaaaattccaagttggaagtgagaaatttctgattcactggcttttggtaattaatcgtaagagctcagaagttccgatgatcgatgtaaatttggtatgtttagcattgattttgagtttttatctaagctttgattgattagattatttgctaccaggaaaaaaggcagatttatgtaataccagtttttggatttttcggtgtgggttgattttttcatttgcgcagagatattctggaggagatctgcttggagtcacagctcaagttatcgacatgcctcatagctgtacgtaatactacctatctagctatattgtgtcctgattaggtgctcctgtttattaacaactgttttctgagcgaataagagaattgtctggtctggccaaaccaaatatgccaagtcctacgttcatatttgaaaactctagattatatgatatattaggtgatagcttctcggtgttgtgatgtttggttgcaaagcctatggccctagttaagctggcttcaatttgacactattcttattatatccagagtcttacagtatctggtgtaagttaatatcatcttcaccttcttagagacactgggtgctaatatattggcagtttgcattatagtccatttttctgttgttattttttgtgtcgattacatagactgattcaatctgtctgtctggtggcattactaaataaatttacagtttcatggttatgttaatagtggctttgaaaatttcttgtaactaatgaatctcatactttctctgctctgattattgaattttcatttctgcttgccttagagtagcactcagttatagtttaattgagttgagatcttacccatgaacagatctgaatacacacccggagatccgcaaacagttttgggatcctcaacactggccaaaacatgttcttgttagatacacatggtacaataacttttctcacctcttttcctatctctcctagctaataagtttgtgcatatggtcgaatcacaaagcttaaggataccacgttactgatacgtggctgagatactttattgtgatgcaggaaggagcagtcagagattgatgtatcctcaggattctatgtcctgtttggctcaggtaaaccatttttcgtcttgctaaacaattaattaaataagggacaataagctcatacacttatgtattctcatttttttgtttacttgtgatcagctctcacattttcttttgtactctccatttacgtcttacaatcgtcacgagagaagctggcaaggtaaatggtattcatgtcccctccaattcatacttgtatctttctttcttgaaccttattcttgaaaatgttgttgtaggtttgtaagagagacggtggtggagagcagcagcatgaatgttggagaatttggcaagggggattgagtcacatagtcaagtatatgtatgtttctacaattttagatacttggaatatggaattggccgttcaactctcagaaaagatttttcatcaaacatgaatagtcgaaagcaaaaactttgtccttgtaacattatggtttaatagatttacgtttcttaaaagttactgaaccatcaaccatggttttggttcaatatcaattacctagtctagtcttaaattgtctatagtttgagggatccaagacaaatcgtttcttattttgtaccagcgaggccagacacagtttcagaaaaaaaaaaaaaaaaaggatgtgtatacaagagtgaattacatttttatatagtatatagtatagatctgacaaaacggagagtacgtagtaattaaaactacaaaagcgaaagataagagaagagaaagcaatgcaataaatgaaaccaaccaccaactaacctcacaccttctactttcatgcatttgcactcataagctctctctatataaacccaaccttcattaccattcttcattatccaatccaatccattacttactaagtaaaaagagaaaaaaaaaaaattaagatatggagggactcttgaagttgtcaactttggtgattgtgtgcatg

SEQ ID NO: 9727 - DNA, 3000 bp, Unknown
  misc_feature (1)..( 3000): cDNA_ID_2995065_gDNA_ID_1972175_Annot_ID_179974 3000 nt of promoter + ATG
tcatatactattaaacagataaactaagcctaaactgtatttaccttttaaaaaaattagtcaaatttgtttgacacagcatggtcaattggtcatactgaagaggacagattaccttctcgagaaagcagagggtgcaaatcccaccaatctgattgaaagagatatcaaccacgatgttttgcaccagacatttaacaagcttgacctgcaaaagaaaagaaatttaggtacttgaggagataacaatcaaaatgataagcatgcataaacaccatatacaaacttggaatactcattggtcactgcagactctagtttctggaatttgaataacacagagattatgtaaacaaacctcagcccgtattaactgcacatccttaaccacaaattgggaggacaagttatgctcttccctctcaagtacagcaaaaactttggcagccagttcttcctcatgatacagcccaccaaaagcagtgagatcaatgtctccatcaggaagatacgttttcaatggaaccgatccaaaagaatgtacctgaaagacacataccagtagaaaaaatcacaactttgcaaaccacactcatagtcaatcaaagttataagccgcaacattgcagaatctctggtcagtaatagaaaaaaggtctgctttttgcacaccactttcgaaatataaaacaacaagtagatgacttgagataatctaacaagaaaagccatcaacttaagaataaaaagacacaagacaacattaaaaagccatcaacttgcatcaagagaactcaataaaatgcagaacaacatcgccgactcaagtaaagttccaacatttaaagtttttatccaaatgttaatgcaaacagagaatgttttattcaaatttacctcgcatccaagtgtcattctgataagtttttgaacatatagaatcacatctcttcgtcgatcctcggagacaagagttggatgaacctgctctataatttcacgggttgcttcctcaactctcatccacaactccggctgattcaacggagaccgaggcggcggaagaagcggtggtgataatgaggaagaactctcttcttccaaatcatcgagatccgcagccatgaaaaacaacaaaaacctaaaaactaaccaaaaaaatcgattgatacaagaacacaccgattgatcaaaccaaggaatcagttcgttgtaaactacgcccaggaaattgaaaatccgattgagttcgaacaaaacaagcgagtacaaagaatcgagagatgtctcaggggaagaagaagaagaaagatgagttttttcttctaggttttgaaagatcccaagtgattactgttgaggaccgattttgtgttatttgattgttctttcttctctctcttttttgttttcactgcatcggaaaaaaaaaaaaaacaaatttgtcttaactttgtgtatgcaacttgaaacccttttagatgtcgctctttttgtgtacctttttatttaccttaacgatgcagtatttagaaacaacgaccagcattaaattcttaagacatcatttgaagtttgattagagtgacttgggaagttatttgttcagaattttgatttcactatagttggttaaattgtaaagttcagatattcttccattaagtttttatagagttgtgattcttatgaatgttttaagagaaatgtcaaagattttaatacatgttttcatggtttagctttatcttttttatcattcaaaaagttagaaacttttaactttttttttctatgacatactaaattctcatgtaccttaacaaatataaatttttttttatgatttaactaacgcagtcgcgcttttttctattgaataagctcgattatcataactgattatgcttttaaaaacgaaaaaggtaacatttgagaatcattgtcttcaaaatcctttattcgagttaagttataaggggatccaactgtgtttcacgtgttccagaaatttgatcacctgttattctcgaatatgattttgttttgacgtggtatccacatataatgatatggttagtaaaacaaaataaataactccaataattagataaattaataattaattttgttctataaaagaattttaaattgaaaactccaattacaaaaatctagtaaacgttttgttttggaaaaaaaaatatataaaaatctctaattttagtcccgttttgaaaacaaaaatcaaaatcttgttatacacagaacaaaacaatatagaaaatctgcaaaacaaaatcaaaatttaagaattttacatggaatattaaaaacttatgtataatatttaaagcaacagattttactgatgtgaatataacagtccaaaaatgaacatcgttatatcttaaatatatataacaaaacatatttgttttaacatttagtcgttataacaacgacatttcaccccgaaactatattttcataattttttgtgaatacttttctatttcgaaatatataacacggtcttttaaatcaaaattaggaagcaatgtactaatgtattctaatactttgtgtaaaattttcttatctaaaatctcataacacaatccgtttagctacagatcagatggtcgtgttttttttttttttttttggtaatgatttaaaacgaaattatatacatcactaaaatatgttaaaccatgtctctttttttttgttctgatataagttgattttttggtttcgtcaataatcagttaccaggccctccgaccaaaacaaatatcagttactaggccctatacctggtcaaaactgagttggaaacaataaagttgggcctgatattttggcccaataataacacggatgagagttctcagttctcacatttgacatcctccgcttcaattctaaatctcccggcgaagaaaattaccggcaaatttcacggagaaacctcgccaacgaagcggagttatg

SEQ ID NO: 9728 - DNA, 3000 bp, Unknown
  misc_feature (1)..( 3000): cDNA_ID_2032711_gDNA_ID_1972175_Annot_ID_179975 3000 nt of promoter + ATG
cgtacagctatgaggcatgtcgataacttgagctgtgactccaagcagatctcctccagaatatctctgcgcaaatgaaaaaatcaacccacaccgaaaaatccaaaaactggtattacataaatctgccttttttcctggtagcaaataatctaatcaatcaaagcttagataaaaactcaaaatcaatgctaaacataccaaatttacatcgatcatcggaacttctgagctcttacgattaattaccaaaagccagtgaatcagaaatttctcacttccaacttggaattttctgcatgtaaaaatcatccataaacacacatcaggcacaaaattactcttaatttgcatatgaataatgtacaaacacgataaagatgtagccatgtcagtactccatgttcagcacagataagacatcagaaaaacacaaactgcagtaagacagagctaaaaaaaacatacgaaatggcttaagctaatcaaaagagatgagagaaatggcgaaaacatcacagtatcttcatcatttcctttcagagtagcaacaatcgaaattgctaaatacaatctaaaagctggttaaaccagtaatgaactaagcaagtaaactcaattcaaaagcaccaaatagagctatacaaaattttcatttgaaatgcaatcaaaataaataccagaaaattctcacatcttataaggatcagttcctgtgtagccaattggtttcgctattgggatcaacacctaaaaattggcaaagaaaggcaagcttcaatctaaatttccaaattatccatcaaatgtcttaagcctatttgcacacagtacctcgcgattgacggcgaagatcgggcaatgctttccgatcacatcatgccaagtcgttctcgactgccagagaatcaatagatccttagtctccgatcaaattagaaaataatctcagctaatatgttaaagagaagtacgaacagagtgatactgccccatcttgctcatccggacgatatctccaggtcggtaagcgctggagagaaagggaaatgatagagatatcagaactagagcttgaataaaagcgttccacggtcgtaatcctgccaccgcagccatgcccgccataactccgcttcgttggcgaggtttctccgtgaaatttgccggtaattttcttcgccgggagatttagaattgaagcggaggatgtcaaatgtgagaactgagaactctcatccgtgttattattgggccaaaatatcaggcccaactttattgtttccaactcagttttgaccaggtatagggcctagtaactgatatttgttttggtcggagggcctggtaactgattattgacgaaaccaaaaaatcaacttatatcagaacaaaaaaaaagagacatggtttaacatattttagtgatgtatataatttcgttttaaatcattaccaaaaaaaaaaaaaaaaaacacgaccatctgatctgtagctaaacggattgtgttatgagattttagataagaaaattttacacaaagtattagaatacattagtacattgcttcctaattttgatttaaaagaccgtgttatatatttcgaaatagaaaagtattcacaaaaaattatgaaaatatagtttcggggtgaaatgtcgttgttataacgactaaatgttaaaacaaatatgttttgttatatatatttaagatataacgatgttcatttttggactgttatattcacatcagtaaaatctgttgctttaaatattatacataagtttttaatattccatgtaaaattcttaaattttgattttgttttgcagattttctatattgttttgttctgtgtataacaagattttgatttttgttttcaaaacgggactaaaattagagatttttatatatttttttttccaaaacaaaacgtttactagatttttgtaattggagttttcaatttaaaattcttttatagaacaaaattaattattaatttatctaattattggagttatttattttgttttactaaccatatcattatatgtggataccacgtcaaaacaaaatcatattcgagaataacaggtgatcaaatttctggaacacgtgaaacacagttggatccccttataacttaactcgaataaaggattttgaagacaatgattctcaaatgttacctttttcgtttttaaaagcataatcagttatgataatcgagcttattcaatagaaaaaagcgcgactgcgttagttaaatcataaaaaaaaatttatatttgttaaggtacatgagaatttagtatgtcatagaaaaaaaaagttaaaagtttctaactttttgaatgataaaaaagataaagctaaaccatgaaaacatgtattaaaatctttgacatttctcttaaaacattcataagaatcacaactctataaaaacttaatggaagaatatctgaactttacaatttaaccaactatagtgaaatcaaaattctgaacaaataacttcccaagtcactctaatcaaacttcaaatgatgtcttaagaatttaatgctggtcgttgtttctaaatactgcatcgttaaggtaaataaaaaggtacacaaaaagagcgacatctaaaagggtttcaagttgcatacacaaagttaagacaaatttgttttttttttttttccgatgcagtgaaaacaaaaaagagagagaagaaagaacaatcaaataacacaaaatcggtcctcaacagtaatcacttgggatctttcaaaacctagaagaaaaaactcatctttcttcttcttcttcccctgagacatctctcgattctttgtactcgcttgttttgttcgaactcaatcggattttcaatttcctgggcgtagtttacaacgaactgattccttggtttgatcaatcggtgtgttcttgtatcaatcgatttttttggttagtttttaggtttttgttgtttttc

SEQ ID NO: 9729 - DNA, 3000 bp, Unknown
  misc_feature (1)..( 3000): cDNA_ID_3032713_gDNA_ID_1972175_Annot_ID_179972 3000 nt of promoter + ATG
ttcaactctcagaaaagatttttcatcaaacatgaatagtcgaaagcaaaaactttgtccttgtaacattatggtttaatagatttacgtttcttaaaagttactgaaccatcaaccatggttttggttcaatatcaattacctagtctagtcttaaattgtctatagtttgagggatccaagacaaatcgtttcttattttgtaccagcgaggccagacacagtttcagaaaaaaaaaaaaaaaaaggatgtgtatacaagagtgaattacatttttatatagtatatagtatagatctgacaaaacggagagtacgtagtaattaaaactacaaaagcgaaagataagagaagagaaagcaatgcaataaatgaaaccaaccaccaactaacctcacaccttctactttcatgcatttgcactcataagctctctctatataaacccaaccttcattaccattcttcattatccaatccaatccattacttactaagtaaaaagagaaaaaaaaaaaattaagatatggagggactcttgaagttgtcaactttggtgattgtgtgcatgttagtgaccgctccaatggcgtccgaggcagcaatctcgtgcggcgcagtcaccggcagcttaggtcaatgctataactacttgacccgaggcggtttcattcctagagggtgttgctctggcgttcagaggctcaacagcttggctcgtaccacccgtgaccgccaacaagcttgtcgttgtatccagggagcagcgagagccttgggttctcgacttaacgctggtcgtgctgctcgtctccctggtgcttgccgtgttaggatctcttaccccatcagtgccagaaccaactgtaacacgtacgttatcttctatctcactctatatttattacatttttacttgaggtcctaatatttaatggagtggtagtaaccatatgattgatgtatttggttggttgcagcgtcaggtgatcaaaagaagatagacgttgaagggttttcatataatcgatgagagagtattaaaaataattaagatgtcacactatatacacactagtgtatccttttactgttattattgttgtgtttctagattttgtgttttcatgtctttctttgtatatgacggtccatttaattggtcgtctgtgttatgtactcctctaatgatatattgaatttacgattatgtattatcttcaaactcttgccattaactttggtcacgttctgcttttggatgcatcctattccttcttcttctccacagtccgtacacaattctcttaacacgattattatcagttgacttgtgtagatgtaaatagaataagttataatcaaatattaattaagatagtccaataatggactcatttgtaaaaagaaagaaagtaaaactatgtttcgattccctaatacatgtggaaccaacaaactatagaatatcactgaaataaggtttgatttcattaattcatcctcaaatatcctcaaaattcactctaaaatatcctcaagagtgtactcatcactctttgttaaccaatccttatctacttcttcaaactctcacaacttgctcatttacacttctcactctatcattcgtaatattttcgtcggtgagtgtgtaatatgtcgatcgaccctacatgcagttgctaaagacaccttaccttttttctttctcttgtaagcgttacctttttaaaagtgaaaaaccagaaacataccaaaacaattaaaatgtcgatcgaccctagaacttttactgaattcttttattgaagtttgtagtgtgttttccaagcataaattaattacaacgattacattaccatgcatgtataaaacgaaaaacaaaaaaatggttttatcatgcactagatcgatttacgattatacagattatatctattttctaatatgagttgcctacgacattttttttttctttttctgattttttttttttgtaaataacttgcctaggacttgtggagatccttttggatttctccaagtacgtgtgaccgtataacctccaagagtccttgttcgataaatatataaatctcttaggccgtctatttgttttccatgctttcctctcttgtcattttcctttgatgtctccaactctttaccatttgatgatgctttggaccattaccatttttttcttctctattccattacttccttgaactgccacttgatcaccatttttggtccacatgtccaatagactattggcaatagtattactcttttgaaatcgtgtggcctcataaatatgtgcttagccttatgaccaccttgtttgacatgtacccaagaataacataagtacactcatttcttttctattcaaaatcgatgcaatgcaattccgttgtatttgcatatgtttctacttggtgtgtaaaaagaaggattaatcatatgtttccactttattttctgttgatcataaaacaaattcactataataatttcatgattttcttatctagttatttcagaaaatattgttatatgattcgaaataacaaggacagtccaatttactattaatcaagaagaaaattacttaacacaaaaccattacaattttttccatcagtcataagtttaagacttaaacccataatatctattcggattataaaaaaaagttaattagtttcttttcaatcgccgaaatttgtaatttataattccgtccagagttgaatctagttttctgatgtaacaacttcttgaaactcaattaagcgatagggaatgcaacgtatttactttggaatatgtgtattttaatcttaattcaacaaaaaaaataaaattttcattaaatttgcatgcatatggaactaagcataattaacgggtacgcatgaccttcatgagtgtttccaattataaaatccctaccgacctcaacaaagtaaaagcaataaaaaacaaaaatg

SEQ ID NO: 9730 - DNA, 3000 bp, Unknown
  misc_feature (1)..( 3000): cDNA_ID_1379940_gDNA_ID_1972176_Annot_ID_180001 3000 nt of promoter + ATG
taaataaagaaaagaaagatgacgattttgccccaaaagttgaaataattacccaaattcccgcttgcgcctcccaacactgagacagtgttgtgtctgtgtactgcgtagggtttagtgagtccatttgcaaagatgactcgtgagttctaatctatcgacctctctcgttttctcgcagttgcagagtctcaggtaaaccctacaaactataagcatctctcttctcattatcgaagaagtttttgcttttcaataattcaattgtcctcagatgataagaatcactcttcgtgtgtgttgtctgggattgagagtcttcgttttgttgtttgttatttagacagttactgtttcgaaataatgaactaaacggatctgtcttaagaattgtgtttctttggtagacttgttatgttgtctgattctgatttcactttagctcttctgctacaggattatataataggacaaagagagagagacaacatgcactctcttaagactacttgcgttgggcaaatatttgctctagctaagcctcacgattctgtaggcaagaggactcgtaatcggattcctaaagaagagagaaagacactggttgaatcttttataaagaagtatgcacctaattctcttccttagccggaattttgaattttcccttttcaatcccagcttttgtaattagtgtttgttttcaggcatcagaaactaaacaatgggagttttccttcacttagcctcacacacaaggaggttggtggatctttctacactataagggagattgttagagagattatccaagaaaatagagtccttggtcctggtgacttgctacttgagggaaatggctctgtgcaagatcaaagtctgtcaagttcaatcctgatggatcctgtgccccctttatctttgtccccaaacggatttcattctgggtcatatcaaagtcttgatttttcttctgagtcacctgagggaaacgttaacggtagccaggtttgcttggataattgcagggaagtgagtggaagtcaacttttgaaagaagacattgggctcgtacaccagtcaatggactccactgacatatctatgactcagcttgcaacatcttgcagtgaagacaatgatatcaagagtaatgcagggctacaaaatagaatggagacagtgtgcgatagcgttgacaccaaaccacaggataaaagactcgatgtggataacaaagacgaaggatttgaggaacttcgtttcatggaatcagacggcacaaagcctgttaacaatgacgatagagtgaatgatgcaggagcagcaatgaccgaaattaagaacggattaggcacaattgatatgtcagcagaaacagttgttgagacgtttccattaaaatctgtgacttcaacgatggactcaccggatgcacaacctactgagttgaacaaagtttgtgagggtgggaaaggaactgaaacggaggtggaagctgatcgcagcacagtaaatcatgttgatcttggggagatttcatcatccacttcatctgctgtacttgaagacatagggacggaagtcattgttggtcaaataccaaatcatatttctgtccctatggaaaagaaagttggagaggaaattgtaaattctgcttcagtagatgttgaatgtgctgatgctaaagagacagttgttgtgaatggtgtgattggcaacgtccatgagacaaaggaatttagtaatggaactttgacagctgaacagaaaatgccaacatctagcactgaggtaagcttcgtctggtatatgtgtgccttttaaattctatttggatactggaactagataatcttcatgggttcgatgcaagaattatgtttgtgttccacaggttgtcctaaatattctcttagttttcctatctgagtttaggataaggtttttcatcatagtggctgaaggacgttaatgatggaatagtcaacctcttgaatgttttaagatgttttggtagtcaattttgatgttccaactttgagaactaaggtgaaactgaatatacgcggagctgttagttgattgttcttaaaaactgagttaaactacttggcacatgaaaaatctagaaaaggatgataactttgtaaccttttaactgtgtaacagtcgggaagtcgtaagaacgacagagcaaaagtggacactgtgagtagctatgccgggaatgaagtcgcaagtgtagagaagaaggcaaccatggaaaaagggaaaattgatgctccagatagttccagctctcaaaaagaaaacaatgcaacattaaacagaattaaaccgtgagtgaacacactccgaagtctcagttgtgctttagcgttgttggtattgtgtttgggtctcctttttcacatagctttcgttcttcttgttttcagtgaatcgtggaaaggggaatctaatatgggaagacaagaaacaaatcctctcttggcagttctgaaatctttcgtgacagcctttgtgaagttttggtcagagtaataattcattgtagagatccgttggttaaacttttgtagttttcattagtgagagttggtaagcttaatatggtttgaaatgtgctgtacaatttttgtgttgaatgtttaggttacatataatggtttgagtcaaatatagtccaatcagggatgaaacatcagaattctgattatcttcttgaacatttcaacggagatgatggatttcagttgtatgaatttatcgattattgcttggagaatgagagattacttctcattggtcaaaaaaatggtaattacctgaaccgagcattggtttagttacaccacaccaactgaatgatgcagcaaaacccgccacttcaacggtaacatgcagcaaagaagccatctttctgttacactgactcatatttatttgattatttattgagagaccacaaggttttgatgcttagtgaaaatg

SEQ ID NO: 9731 - DNA, 3000 bp, Unknown
  misc_feature (1)..( 3000): cDNA_ID_1030715_gDNA_ID_1972176_Annot_ID_180025 3000 nt of promoter + ATG
agatggttcggttaagttcggtcatggtgatggttcggcttatttgttcgatcctgatatttataccgatggacggatttcggttcaagggattgacggtgttttgttcccggaggaaaaaactccggtcgagaagaaaaccggcgttccagttgtcaagaaagcacctaaaccaagaagaggtaatcaaattttgatcaatctttagtctattaatttttgtccttacctatttgatcgtgacattttaaccccaaattatagaaattaaaaaaatacataccactactacaaaaatacaaaagttttggtatagacaccattacaaagttataaagtcactcgcttagggaattttttatgttctatgattttgtcatattaaatggataactaaatcattgttatagaaagataatggtgattagtccatatacaattagtctttcaacgagagagtactaagtaaacaagtgagatttggaaaaagtacaaacgtgtgagaatggagacaaagtctctctaacaaactttgatataatatataaaatttcaacaatattatacaaaattttggagataattaggatttataactacttaatgatccaccgacgaaagtatcccatgttaaagtgaatgaaaatcacaaagtgttcctttttctttgttttttgttctaaagccaagtatgagtcatataatcatattgtaataaagagagaaaattttctttatttatttctaaatatattatttttgcattagttagaaacaatcattttaatagtccttcgttgttattgttaataaaacaaaaaccaaaccgtttgaaaaaattaataatttgtatgatttatattatattgcaggtaaattgatggaagtagcatgtacaatgctgggatcacaatttccaacatgtcaatgagatcaaattaaatccgggacatgagaattttataattctgtaaacatgtgataaaaatgtgaacagaaaaaagaaataatgtaaatgattatttttttgggctcgttgcaatatgattgttaaattgtaattttcagttgttttgagctgacgtaaccaaaccagattgggtgggtcttttcttttctgttggatgctactgtattggatcgaatctgtccatttagagatcttctaatggactactagattaagcagccctaggtggtaggttatgcattggaaatactgtaaactgtaaaggcaacaatgtccataactctaagaaaataatccatctaattcagaacatcaatatacccaaatccagttttagaaacaaagtaaaaacagtataaaaaaaaagccaaaatgtgatgagaagtcacatgtcatctcgagttgatattccaacaagttgctaacattaaacaacatgggatagcatatttgatattccaattcacaacatgagcatgcccggtccacaactcaagctacccaaacaatggctaagatcatcaaaagagatgagtaaaaatacaaaatattataggtatttgttattaattcattttttgttggtcttttttttaccatatcacatgagttttaagctttaaagttaataaatactaattaagcggattggtaatgaatttttagtaaaattttggttagaaaaaaaaaaacgaaaacaaattttttcttcttctttttgtatgaatataaaactatattcaaaaagacgtttgcacaaaattttaatttcgattgattccattgttatttatttttatgttggcttggattccattggtattaaggtaagtgattttagtgacaaaatggaagaagttgctttgaagaaaaataattgaaaacaaaaaaaaaaaattgactattgtttttattttcttacaaactatttatggatttaaaagttgttttatcaagttttagtatgattttttttatattatattattagtaaatttgcgagaaaaatataaagagcatggtttttttctttacgtaaacgttcaaaattatcagtccggctctaaacatgagatagtagattctaattctcgtcatgagatcgtagattctgattgacaacaagagataggagattcctgtttacagtatgagattgtagatttcattcacaacatgacatcatagatttcaattcacaacatgaagcaaatcattaattattttcaaatgtcataccaatctcgtcttctcgaatgtttggagcttcatgaccaacctttgagtaaagagcattacaaagtcgtaatcgttttaaaaacaagttaaagatttcgtttctttggatgattttatgaatagtataatacaaatttacacaactcaccacataatatcctttgtatgatccaaccaatttcagatggagaaaatatagttgcatgagtatctacaatctaagacacaaagacatagatggatctaagggagactgaactcttgtataatggattcacaatcacaagaaacaaggagagaaacacaaattgaacgttattatttccagcttaatggacttgaagaatgaccatcatgtttgtgcctaatctgattttctccaaattctttagaattctctctttgctaatcctgaccaatatgagaaattcaccatttttttgctcataggtgctatcaataacagtttcaagtttcaacaattcaccatttatataacattaccaacagtccaacactagtaacataatcaccaaaatatattagtaataaattttcatcacagctttatatttttgtgattagaaattaggatcttacagaaatctttcaaaaaaaaattcataacagttccattttttttggtaagattcataaaaaaattcaagttaaatgcattttataaaaatgtaggaaaaactttcatcaaaaatcgttgagaagaacatacagtatatcttatccactctcttcctcatccacgcggcaaaggcacaaacctctttagaaaa

SEQ ID NO: 9732 - DNA, 3000 bp, Unknown
  misc_feature (1)..( 3000): cDNA_ID_2994876_gDNA_ID_1972176_Annot_ID_180023 3000 nt of promoter + ATG
tgtagcatatcatcgttttaccaaaaaccgttttttcatccatgactaaaattagttttgtctatatttttgttaaaagaaaacatgtatgtttctacatatatattagttatatatttttctattacattataaacaatatgtagtcaaagttcgttaatttatttaatactctctagtctctattatcaatgcgcatgcatgccagcatagagtagatattttaacaacataacttcgatattagatatatataagtctaacgatacatatcgttacatatgccatatagtttttaattttttttatatagtttttaatttatgtctagttttttttccaccatttatgtctaggttaaatagaggaaatgtatagtgtattccgatccagtgaataacattagttttcagattgtcttgtgtcttattacgtgcatgtgcccagatcatagaccagttagctgtctgaaatataaatgtctgttgttccattaaatgccatgatccataaaatatcacgcatcaaattcatacaaaccgtgtattctatattttcgaataattttaaaggtatgaagcaatcatatggttgtcccaataaagacaaataaaagtgatttattgagaactcgcatcgcatctaatactgaattgtaagatcttccgtatcaaaaattgacccaaatagttcgcatctaacagagaagtttccgaagcagtttcttctttaactattgcttttagtccatttttctttttcctataaagaaaagcctcgacaaagggctgcttttttcactccattattttaataaacaagtaaacagacttttttttttcatctatcacattccttttactgctttacataattagatgccaaattttactggacgaacttaactatcacaaatgttgaatcagtgatccaattgttgtgtatctgtatatccaagactgtaggctaggccatataatctggcaatctattatatatacgatttaaatcaaagcttttatattataaacataaaacttctcactcactaggccagccattagatcaaaattatataatttacagatgtacatgttagaacaaaatgaattttcaggaaacctactattgtgtataaattcgaagttaatgagttcgaagtagattttgtcacgggtttcttggcaaagtttttaatcaagaaacaattatttaaaactttgaaaagtatctggtcgtcaagagtaaattcgtgatcagtgtataaactgctgtttggaggcacgtttattttcttctaaaattatattttgccggcttactttatttttgacttgtatagatgcttgaaaacaaaggtatatgtgtttgaaggcgatgaagaacctaacggtaagcgaaacgtcgtcgtttcttgttctacagcatgtaagggaagcgatgtgtactctaattaaggcttagcgtaaacggtaaacactaattgacatattcccatgagaaccttagccacttttttattttcacgttgttgtaagaatataacaaattgaaaactatatgctgtaatttgtatgttgcatatttcgtattatactaatccctataacaaacatctttgcatacaatcctagttttttcttcagctatgacaatttatattagtccctagaaatcgatatataatcttgcaaaggtataacttcgattcttttcgtataaaaatttgaacaatttgcgtttacgctatatattaattaataaaaaattgttttacaaattctaaacgcaatgttttttgttgttgttgtttgcgtatgaaatagaaacaacttttgactaaaacagtaaagttacacgattagatctagattgtatgatttgccaaactgaacatctggctatctgagttattacatattagaaggatcaccggcgaggattctatgattcaacaaacacaacgttaaaccaatgatttcttataaagaaaataattctctctttagaatatttctgagaaggggttgttgttttttaagtgtcgcttactcgcttcaaactaaagggaataaggatagtaaatagctcatccaggcggctatcacaatcatattaaactataggttacttaaataaatatatcattgaaatttttaattagattttcatgctaattccttagaagttttctttttctttttttttgttaaaactaatttcttcgaagttttgacggtcacgccgacactttgttttgacatgcccgtctaactctttttttgtttgtctttctttaatactactaatatacaatttgtatgacacttaataatgttagtgtttaaaaataattatagttctacataccccaatacaggacaataataagtacatctcttttatttcttatgcgatttcatttatgtctactacgaaccaactagaatttgcatccatcacgatgaccaattgacaaaaacaattgcttaacatttaggttttacggaaattatcattccttaagaattttgtttattttattacagatagaaaaagacgaaaacggaaagattttgacttgaaggcaacgtgaaatttgtgcatttgagtaaccgacacacatgaagctcaaacacaaagacagagctgagctgttgttaattccctgaaaagctcaactcttggcttcatgttttatcgacgtcaccatacatttatttcccttatagacccacttctcctccccaaaataaatactataattagagaaagcattaaacccacccacccaaaaccattaaatcattaagaagaaaatgtttattaataataagaaaaatgaaattatacacaactaaaaaaaaacaaaaggaagaagaaacatcacaatcaccaatcacctcactatatcaaattctttccttattcactaaccaaaaaataaataaactcaaaaccattcttcatttcgccgacactttcttctccaccaccacc

SEQ ID NO: 9733 - DNA, 3000 bp, Unknown
  misc_feature (1)..( 3000): cDNA_ID_3032745_gDNA_ID_1972176_Annot_ID_180013 3000 nt of promoter + ATG
aaacgacatatacttccaaacgctatatacaagtcgaagagaaaattaaatgacaataacaaaagatatattttttgacaaataatcaccctgaattcaaataaatagtttgtatttttaatcaaaaaataaataaataatgttaccacaccataaacttcttaaaaccacatcatatatgcagcaagccagcaaatatagatatatcttttgacaaatattcaccttgaattcaaataaataatctgtatttttaattataaataacataaaaatgtaacaacaccgtaaacttcttaacaccacattatatatgcaacaacttttgataacatgcgtttttaccaaattttgtttattcgtgaatagcatattgttatttattttattattattaattattagttatagtaggcatgttaaaaagtcttgaatggtgacataattattagaccactgttaaattgtttagtccgcacgattcatacacggtcttaacttaatttcgatttcaaaatttgaatttcacagtgaactaatataatctcagtcccttgacgagaattgtacatggatactggaacaccgagttgctaacgatgttgtatctgttagagctttccatcgccatctttgtgattcgctaacatctcgtagagcttatcgtacgagaaacaagatgttcaaacttgttttaaattaatcagcggtttgacacaagcggttcttgtgtaggtggctagaatcatctatgatccaagcatcataagccatatctacatttccgggcctaaagattgaagatgctgtatctgatggatcattggcttgctcggtgatctcctttacttttttgctttattttgttttgaattcgtttactttgttgaatcttccaagagtctgccttaaacttgtgaagtacttcatgaatttaactggtttatatcattggatttgttttgtttgagcttttttttttaaactttgaaattagaaccttgaagtatttgatgaatctagttcatttgatcagtgtcagaatttggttttaaaaaagtcacatcaaaataattggggttgattggctctttcccctcatcaatacttgcttcttttttatacccaaaacaaacaaacaaaaaattgttaaaaggcttctttctgtttttttcttttactatttgacttttactttcgtcaaaaaaattaaaactttggcaaaaaaagaaaggggcattccgagaattgaactcgggacctctcgcaccctaagcgagaatcataccactagaccaaatgcccttttgttcaattgtttggttgacatagtatatttatcttcgacatattttgggacataacctaaactaaagtatgtttaagaatgttcttagaaccaactaagtaacaaaagaaaaatccccacaaatttcccacagaattcttaagaatagaaacataaatggcaatggtggtggacctgatgggtcaagagccatggaggagctggtggaccacatgtctatcttattggatgaaaaacgacaaatctttgtacaaagagcgttttgagaattgaaccccggcctctctcattcagaaaattaatacaaatgcaaaacatataatttgtttatcaactgcttatagatttcccaaaaagaaagtagaaggttcaacaatttcatgttactagctaccataaacattaaaactggaaattaaactagaaaaaaatgttcatttcatggatatgaattgcttctgtagcctaactgggtttagatatgtttctagttagtcctccaattaaacagatcaattcgattaaattttagaaactcaaaacagatgtctgtcacatcatccatcacaagaacttaaaaaaaaaaaacacatttctcatatgtcaatttaattagttttttttttccaaccaaattggttcatgtacttgattatgtatacactatacacactcatataaatggataaggtagttttatagtccaaccaccgacaaaacgtgcattccacttcttcttcttcaattgccatgccgtcgtcaatatctcaaacttgactaatataaaccaaagaagaagaagtatataacagaaccaaaaaatataaaaattcatgttcgttgtattaccaaatttaatttacacttaaataaacctaccaaccaatcactcaaaacaaataccagttcgttacacaatggacacttgaagttgaaagcaaccgaacaacaaaagttttaaaaactaataaaaatttaggtgaatataataataaggccaactatgaagaaaaggtctattttatactttttatataaccttttgtcacgggcactgtttcattcccttggaccccttcttcttcaagatctgtttcttccttctttctctctaaccagattttgttgtaccagagagagagagagagagatcccttaataattcttacacatttatctttcttgtctgaatcctaacaaagactttagttttggtcgatcttataattttctttttttattctatggatttctcttccgggtttcaataattgtcacttccgtagtgtaagtacgcgtgtattgtatactagtcagttacacaagtgtccttatgtgtttccttgtctttaattcatttctgaaactgaatttattcttctctcagattctgcaaaggttttggttttttctccgagtttttttgtccttcaaaaaaaactttggttgctctctctctgttcaagaagatccgagcttgattcctaatctgtgagttttatgcattccatttaaagctctgattttgtattcctgtatcaatgtttccccctaatgttatagattttggataaaagattaagtcttgatggatcttatgattaattgtaacaatttatatcatccttgggtcatgaatttacctctgtggttttgcatttgcagatcatttgagaagaagaaactaagaa

SEQ ID NO: 9734 - DNA, 3000 bp, Unknown
  misc_feature (1)..( 3000): cDNA_ID_2026998_gDNA_ID_1972176_Annot_ID_180005 3000 nt of promoter + ATG
gttcacctgataattcagtaacgtcacctgataagtgctgcaatagttgtggttccagatctgtggaacaagatgcttattcttctcgagacaaaggaaaacatatttctgagagccctacaagtgagtattcccaaccacagagcagtaaaggtatcaatgagcattcttcatcaactattcggtcgcctcctgtaacgcaaccaaactcgagaggtggtttctttggcagtactaccactaccattcatgaagtagatgatccattagtttcagtgaaagatgtgaagcctgatacttgtgaaactgtactgaccgcactaaagcaagcgaagctgtctctgcaagagaaagtcaatagcctacatatcagaaacccggattgtcattctgaaagctcatatccttcaacaccaggttcatatatgaacacatatgcactaccgatggaaccagcatttagtactaaaccatctctccctgcttccagtgtcgggtccatggtagagtttccagttatctgtgctgctggacttttccgtgtccccaccgattttacatctgatgcttcaaataggaacacttttctagcttcgagttctcagaacgccatggttacccatatgcctgagcgagacgtccccctagtacctggagatcagcttttcagcagaacagccacaaacaatctcctaaatactggcttccaaagccaactagaaaccagtcctcctttgtcagtggatgaccgactttcgaccaccccatacatcggtggaccaaaactatggtccagcttcagggcagatggtccaccgatggttgatgttccaggattcagacttaataaaggcataccaagagtttcaggcagtgcaatctctggtggaacatctggttttgaaggtaaccaagtatcgtcaagtacatataatacccctgtgacacctactcgaagcttgtatcctgattcagttctaagcagtagagaattgtattcgactccttattacacacgcccgtttgggctgtctcctactagtggttcagatgatggcttatttaggcgagaatgattctgttgatccttgtgaagccgtgatatgattgttggatctttgtagagtgtggtggttgttatatacactgtagactaatatcagctttgtgtaacgtcaaaatactgtatagaagaggcaaaagttatgtatgtgattcataacttggtcattataggaccgtttgttgaaatcccatttgttgataatgtttgtgtgttcatttgttcggtttatgatatttaacatgacaaatctcttgaaacttaactagcaatgatctaactacaagtcacgaactaaagagacactgcacagcaacaacaagagatttgtccagtaagaaaaaaaaaacttcttgccagcatgagaagagatttcgagtccccttagataaggagatgagactcaagattcaagtacatacaatggaaaataagaaatcttcattttgaagtttatggtgtttttgctatacagaaccaaagtgggtaacattttcatcgtgttcaagtaatatgactagtcttcatgcccatcagatgattgatcatcctcatcatcatctttctgatcatcatcacccgtcgcctcctttttgtcacttctctcgttcctttcattccatcttgcccaggcccacttcaggacaagaaaccctccaagtgcatatacctgaaatagttatagagaatactccactaaattaaccatgaaagaatccaactttttccaggatttgaaacaatcatcagaacaaaactctttcgtatacgtcaggagtccattgatgagaaaataaagcacaccacaaccaaaacatctcgattctcgagtcatgctattcatatatcaagtcagcctttgatagctctgactactacaaaacttgcaattgaaaggagcaaaaatagtatgcttcctactccatgaacgacagaacatcaagctaattgttagaggtcatctaaagcattaccaggaatcgaaggcataacaaaaactgaaaccattttcaacattcattgtagcacactgcaactgactgcaaccaatgaaatacattgaaaacatcgaaaactatttgcctattgatagagaaaaaaagccagaatagtttctagtaaacaggaagtgataatctgagtcatagagtcataattatgaacatctaccataaacaaccatgtccctacaattctcataaataacataacaaagcacctctcaccaaaccccaaattataagccaattcaaatcatttttcatcaaagaaccctctaaaatataaacatcttaacaaaatcacctgccaaaggatgacagagttggaagtcctgccagagctgggctcagcctcaaacttgattggctctgcgcttttgggtggattgtaagggaaagtgacagtctcgtaggtcgatttcagaggttccttctcgccggtaggtttaggagcattggcatcaatagtagcaggaggaggcttaggttgaagaaaggcgaataggttggtgatgaaaggaggtaactttatgggaggagatgatgaatcagagccattagaacgatctacttgagcttcttcagccatttttcctccaccgagacggattttgagtttagggttttgaattgaatcggtgtggattaggtaggctttacaattgtctggtggtcacttctctccacttctctccttctttgcttacgacacgtgtcacacgtgtcttttcaagtttttgtttctattaacctctaatgggcctaaagccttatttggcccataataataatcaccgtcttcagtttgttttttgtatttttgtttttatttaaactccattggaaccaaaaatctgagaaattcgtatccaatcaaagttctggcttttagcctcctgaggaaaaatcaaggttgcaactttcagggtttcgatg

SEQ ID NO: 9735 - DNA, 3000 bp, Unknown
  misc_feature (1)..( 3000): cDNA_ID_2032797_gDNA_ID_1972176_Annot_ID_180007 3000 nt of promoter + ATG
aaagagaaaaacaaaatcagtgtttacaagaacagatacatgatggaagaattcaagtaatatgaaaataatgcagataactccaaatagatcaggaatgagaagagcacgcagagagaagtattaacaaattgtattgtacctggtgatgaactgcaagctacagaggatggtgttgtaggggaaccataatctggaacaatggctgctgtgggacttttatcagcaatatttttgtttaacgaatgtagttcctctaaaccgttttccatcaatgttgttccatcttcatttgggttaacatcaactttctttttctcatatttcgccagtccctcaccccacccgagacgttgtttctttctagaactcatctcctcagaaagatgagtagttgtggcacaggcagtagcgtctcctgaagaagattgagtcacagtaacaattttaggaagaacctcaatcttccgatcgctggaatcaacagcccccaagcttttcaagctacttgaatgactaaaacctgaactctgagatgcaaaactcccagaactattccacagtggaagtttcccagttgctcccagagaactctcctttgcacatttcctatcaccgtctatatcattgataccatgtaaactattgttatcttgcgggtctttcaggcgaagttgttcccaagtcccctccagctctgcattggggattggagcatctaatgaattatcactaactaaccttcgaccatacatcaaatcattgcattgctttgctggtgaacaaaccttattgccataattgttctcagaagaaggccgttcaaacaagctaatacattcagaatgaggatctgaaggaagtgataacctttgatctgaaaatttatgctcatttttaattttaagagaccgtactggggtactgatctcattgtccagataatgagccgagttggctggatccaaagagttcaccacggtagaatgagtatctgaagcatgtagcggcctttcatcaactgacctccgaccatttctaataccaaatggcctctcaaaacttctagaagatccgttgctcatctcccatgtattgcatttccattccttttggcttacagaaactctatcatccctgcaattcctggtatatctccagtctccacgcgatgctgatggcctataattatcaaacattcgggcactggaccgagaagatgtgtatccatgactagtctcctccacaaactggtgccgtccaccctgcttaccatgaccttcagaaaattttgaagacaaaaggaagatgagaatcacaaactaaagcaagacctgtattcaaccaaatatataacttgtgaaactaaaaacgacatctatccaaaaaaattagacttttactgctgtcaaaacatgtagtataagattctccaaaaggaagtcaaacttagaatcattataacacgaagtcaagttaggagaaaaaagtgtcattacgcccacacagggtttcaatactaataggaaaaattatacaagtaagaaacctgcaaaagtaggagctatcttcatctaaatctacaacatgtaaaactaaaactaacaacactccacgatgctaggactttttatccgttttaagattcatgaacacaaaacacaaacacaattgaggtaataaagtcctcttgcaatgaaactaaatctacctgagtattaaaaattgctcctttgaagagtaacctcatcaattcacttcctatcaatcttaagagctgtgttaatgctccaaaaataccctaagctatcatgacacagtgagaactcaatctaagaaacaaggatttgcctctaaatcaattcaaaaaaaattatagaaccaaaaaggaaaagtggatatctaacaaatccacagaaaaatagactctaccaaaaacagagcaggagaattcaaagccctaaattagagagagaaaaggaggtcttacaagaaggtctgcggaagtctccagatcccaaacgagaagaaaactctcgaggaacatggtgagaagaaggcgaatccctccatcgaaaaggcggggattcaaaagattgttcaggcctatcgtgtttcctttgcctcaagagctctttccgatcccacgaagcgtgatcctgcggcatcaagttatccagaagaatcgcataagagtatccttcaaacccaactccagattccctccgtacctacctccgtcaaaaaggtctcggaacaaaaaaagaagaagaagagctggtggggaaaccaaatcaatgaagactcgtcgtttctgaaaccaaaatcaaactagggtttcgtcaatctgaagattaaaatccgaagtaaacccaaaaagagcggaaacagaatcaaaagaggaagaaacctgagagcggagctgtatgtaaaaatcactactgagagacaaggaagggagatttcaccgctgaagaaaaaagctcaatagagaaaaagagatttcctttaatttcggtgttgaaagacaaagtaggtttttttatggcgattcctctctgtttattagctcacaaaatccaaagaagaagaagaagaagaagaagaagaagagatagagagagagagaacaatgaagaagaagaaggaaagagaaaataatccctgtaacctaaagattccaattaaactctatttcattttatttttcgcgtccgctctatttatattattttactcctattctgaaaaagacattttttttttttacttttttttttctgtaaatctcaatccaaatccatgactttgtctactacacaaaaaagtataaaatcgaaattagtaaatacttacaaccaatgagaagagagtaaaatacattagtgaaagattaaaaaaaaaactatcttcattgacttgtgtaagcaaagagagagacgtcttcttcttcacaccgatcttcgaagttcgtagatcttttggttcgtctacacgatg

SEQ ID NO: 9736 - DNA, 3000 bp, Unknown
  misc_feature (1)..( 3000): cDNA_ID_2032791_gDNA_ID_1972176_Annot_ID_180008 3000 nt of promoter + ATG
tcttgcagagacagcttcgcttgctttagtgcggtcagtacagtttcacaagtatcaggcttcacatctttcactgaaactaatggatcatctacttcatgaatggtagtggtagtactgccaaagaaaccacctctcgagtttggttgcgttacaggaggcgaccgaatagttgatgaagaatgctcattgatacctttactgctctgtggttgggaatactcacttgtagggctctcagaaatatgttttcctttgtctcgagaagaataagcatcttgttccacagatctggaaccacaactattgcagcacttatcaggtgacgttactgaattatcaggtgaaccatgcgacaaagtttcaaacgattctctaaagtcaacttcattagctatagaccttgtatcacggagtgaagggactactgtagaaccttgaagtggagattgagctttttctccgttactttcatccgtcacatctgaatggtttccaacgtcacataaatcctgaaagattggacaagaagtattgttcaggaattccagtgaattaagcggagactaagttcaacctttgtgaactaagatatcttcatagataatgtcttcagaaacaatatggttatataacagttaatacaaagaagaaaaaaagcatacatttttcataactttttagcacaatggagagaagacagaataaaagaatcaatgtatacgcatgcaaaccaaatatagaaaactgcagcatatgcacaattatcaacgccacataaaagaaactttgttggttgattcatataaacacgaaatataccataatcacaattgatgaaaacaatttctaaaggtcaaagcctgagatatagggcataccagggcagatgatttattctctctgaaatttttctcccattccctttgagtctcttccatttcttcaaaagatccgataacttgagcacggttttctaacgctctctccaagttgatgtccgtactgtttcccttctctaaaccatttgaatttgacaacttgttcaaactatcgtctcccttcacaacagcaacatccaccacggttctagatacttgatcattcttttgaggaagcatttcagtgcgaactccattttcttgaaattcaaccggatttccatctctcttgtaatcctcagatacatttctggaaagttgaaaaatgttggttattctattacacaacatacataagcaagctttacaattgctttactaataaagcgatttatgatgtatataattagagagacgatttctaagcatataaccttcaatctcaaatttctaagcactgtgtttctaggcaatgcttgcacaatttgtaatagtaaaccactcataaatcactgagcagctaaagataacaaaacagaccttgcttcaccacgtctaatttgccgacaagatcttccttgacgatgtctcggtgaggaaaaataagcacactcgaaacctctgtgatgtctcctattccggttttccttgatcttgtcagaagaacctggttccctcctgcgacctttccaggacaaacttttgcctaacactaaaaaacaaacaaatctccgacactgagagttgctcaaatctcattaaacccatgaatcagaaactttcctcctatcacataaaaactctaacctgagttactctgagagtagcattcatgatcagagtttgaatcataatcatcagacacatcattatacccattttcctctaagatcgcaagaacatcagcagttgcctgttcagccttcttcctctgtaaagatacaatcttgagctgttcctctaactcagctacctaaagatattaagacaggacataagactaaagaacatttcactggatcatccctacaaattataaaagaacatactttatcagcgagaccatcaagctttgctctagcactcttggaaacagctctttcagctaataaacgtgcacgaagaaactcaatagtcactgaagtaggatcttgtgcctctgaatcaatacacctataaaaatgtaccaaaacccaaatctaaatttcgattcgcaaaacgatcttattcatctggaaaaaaaaagacagaactataccgatgatgatctaacttgtcttgattcgccatcgtgtagacgaaccaaaagatctacgaacttcgaagatcggtgtgaagaagaagacgtctctctctttgcttacacaagtcaatgaagatagttttttttttaatctttcactaatgtattttactctcttctcattggttgtaagtatttactaatttcgattttatacttttttgtgtagtagacaaagtcatggatttggattgagatttacagaaaaaaaaaagtaaaaaaaaaaaatgtctttttcagaataggagtaaaataatataaatagagcggacgcgaaaaataaaatgaaatagagtttaattggaatctttaggttacagggattattttctctttccttcttcttcttcattgttctctctctctctatctcttcttcttcttcttcttcttcttcttctttggattttgtgagctaataaacagagaggaatcgccataaaaaaacctactttgtctttcaacaccgaaattaaaggaaatctctttttctctattgagcttttttcttcagcggtgaaatctcccttccttgtctctcagtagtgatttttacatacagctccgctctcaggtttcttcctcttttgattctgtttccgctctttttgggtttacttcggattttaatcttcagattgacgaaaccctagtttgattttggtttcagaaacgacgagtcttcattgatttggtttccccaccagctcttcttcttctttttttgttccgagacctttttgacggaggtaggtacggagggaatctggagttgggtttgaaggatactcttatgcgattcttctggataacttg

SEQ ID NO: 9737 - DNA, 3000 bp, Unknown
  misc_feature (1)..( 3000): cDNA_ID_2032781_gDNA_ID_1972176_Annot_ID_180011 3000 nt of promoter + ATG
acaggaatacaaaatcagagctttaaatggaatgcataaaactcacagattaggaatcaagctcggatcttcttgaacagagagagagcaaccaaagttttttttgaaggacaaaaaaactcggagaaaaaaccaaaacctttgcagaatctgagagaagaataaattcagtttcagaaatgaattaaagacaaggaaacacataaggacacttgtgtaactgactagtatacaatacacgcgtacttacactacggaagtgacaattattgaaacccggaagagaaatccatagaataaaaaaagaaaattataagatcgaccaaaactaaagtctttgttaggattcagacaagaaagataaatgtgtaagaattattaagggatctctctctctctctctctggtacaacaaaatctggttagagagaaagaaggaagaaacagatcttgaagaagaaggggtccaagggaatgaaacagtgcccgtgacaaaaggttatataaaaagtataaaatagaccttttcttcatagttggccttattattatattcacctaaatttttattagtttttaaaacttttgttgttcggttgctttcaacttcaagtgtccattgtgtaacgaactggtatttgttttgagtgattggttggtaggtttatttaagtgtaaattaaatttggtaatacaacgaacatgaatttttatattttttggttctgttatatacttcttcttctttggtttatattagtcaagtttgagatattgacgacggcatggcaattgaagaagaagaagtggaatgcacgttttgtcggtggttggactataaaactaccttatccatttatatgagtgtgtatagtgtatacataatcaagtacatgaaccaatttggttggaaaaaaaaaactaattaaattgacatatgagaaatgtgttttttttttttaagttcttgtgatggatgatgtgacagacatctgttttgagtttctaaaatttaatcgaattgatctgtttaattggaggactaactagaaacatatctaaacccagttaggctacagaagcaattcatatccatgaaatgaacatttttttctagtttaatttccagttttaatgtttatggtagctagtaacatgaaattgttgaaccttctactttctttttgggaaatctataagcagttgataaacaaattatatgttttgcatttgtattaattttctgaatgagagaggccggggttcaattctcaaaacgctctttgtacaaagatttgtcgtttttcatccaataagatagacatgtggtccaccagctcctccatggctcttgacccatcaggtccaccaccattgccatttatgtttctattcttaagaattctgtgggaaatttgtggggatttttcttttgttacttagttggttctaagaacattcttaaacatactttagtttaggttatgtcccaaaatatgtcgaagataaatatactatgtcaaccaaacaattgaacaaaagggcatttggtctagtggtatgattctcgcttagggtgcgagaggtcccgagttcaattctcggaatgcccctttctttttttgccaaagttttaatttttttgacgaaagtaaaagtcaaatagtaaaagaaaaaaacagaaagaagccttttaacaattttttgtttgtttgttttgggtataaaaaagaagcaagtattgatgaggggaaagagccaatcaaccccaattattttgatgtgacttttttaaaaccaaattctgacactgatcaaatgaactagattcatcaaatacttcaaggttctaatttcaaagtttaaaaaaaaaagctcaaacaaaacaaatccaatgatataaaccagttaaattcatgaagtacttcacaagtttaaggcagactcttggaagattcaacaaagtaaacgaattcaaaacaaaataaagcaaaaaagtaaaggagatcaccgagcaagccaatgatccatcagatacagcatcttcaatctttaggcccggaaatgtagatatggcttatgatgcttggatcatagatgattctagccacctacacaagaaccgcttgtgtcaaaccgctgattaatttaaaacaagtttgaacatcttgtttctcgtacgataagctctacgagatgttagcgaatcacaaagatggcgatggaaagctctaacagatacaacatcgttagcaactcggtgttccagtatccatgtacaattctcgtcaagggactgagattatattagttcactgtgaaattcaaattttgaaatcgaaattaagttaagaccgtgtatgaatcgtgcggactaaacaatttaacagtggtctaataattatgtcaccattcaagactttttaacatgcctactataactaataattaataataataaaataaataacaatatgctattcacgaataaacaaaatttggtaaaaacgcatgttatcaaaagttgttgcatatataatgtggtgttaagaagtttacggtgttgttacatttttatgttatttataattaaaaatacagattatttatttgaattcaaggtgaatatttgtcaaaagatatatctatatttgctggcttgctgcatatatgatgtggttttaagaagtttatggtgtggtaacattatttatttattttttgattaaaaatacaaactatttatttgaattcagggtgattatttgtcaaaaaatatatcttttgttattgtcatttaattttctcttcgacttgtatatagcgtttggaagtatatgtcgttttgcatcttaaaaacgacaggtagtccaccatctccaccacacggctctttcagtcttcttcctttgtccatcatcaccaaacaaactcattccagtctttcgcagatttttttccttttcttgagggatttttttttctgagaagctgtgaatg

SEQ ID NO: 9738 - DNA, 3000 bp, Unknown
  misc_feature (1)..( 3000): cDNA_ID_2032789_gDNA_ID_1972176_Annot_ID_180009 3000 nt of promoter + ATG
acccgagctttcaacctagagcagaggaagttagtattgagatggacatactggtaaatctcttacttactatacgccaccttcattgatggctttctggtccaaagacatgtcttttcttcttcttagctagttttgcttgtatgcaggacgaaccaacactatggaggctaaagttctttgtgaaggatgcgttggataatgcaatgaagaagaagaaagaagaggagacaaagactagagaattgagtggagcacaaaagaaagaggtttcgaagaaacgaaatgcgactacaaagttagctgagaggaaaacgaagcggtcacgcatatgagtacccatgaacatgagagactgatctcttttgtatattaaacgtttttgtagtagtacgtggatttaactaacattgacaaattgcaaaatctagaaataaagctttcgtctttatgattctatttggtctattaattaagcgatccatagttggaaggttaagtatataaaggcgctttgaattcctctgttacaatcatgagtctgagagaaatggaagatgtaaaggtggaaatgaaggtaaggaagaatgagaatgaagcgttggaaacgggtttggcagagagatcgatgttgctgatgaaagctccatctctcgtcgcgagttctctccaatctcattcttttcctgacgatccgtaccgtcctgacgatccgtaccgtcctgacgccaaagtcatcctcggcgtcgatcctctggctcacgaggacgaagggacccaagtatgctttcgtcctgcgcattttctctcctctctgcatgcgtatctctcgttacattgaatcttcctcaggaattgcgtggtttagctatttagggtttctagtaaccattcgggaaaatttcatcctttgagaaacttgcttttacattctctgaaattccatggatttggggaaatgggttttctgagtttggagatatcaagtggtcctcactttgatcatgaaattccttgtaatttgaggattgggtagtgtatgaaacatttctgcaaattagagatcttttctcttttctttctacatttgagcttgctttctatgaactttcttgctcgtcacttaaactacgagtttcttggtgtaaaacatggtaactcttttgccttgcagttcgtaatggaattagctcgagctgactctggaaacatgccgaggcgttacactttggatatgtctaaagattttattcctatgaatgttttctgtgagtcttcagatggtaagttgtacacttctccacacattgtactccgaagttattttacaactgttggttcatctatggcgttacgttggttataattgttgaataatggcatttacgtttataagattttggatcattgggtgaagaatttagcattggtatgttcatttacagtccaggtgtaccttattttgtttgacagttgtgcagattttcttcaacaatgttctttgtaggaaagatgtcagtagaagggaagataaagaacaaatttgatatgaggcctcataacgaaaatattgaaagctatgggagattgtgccgtgaaagaacaaacaagtatatgggcaaaaatagacagatccaggttgttgtaaagtggtgtgtggtgacttggagtttcaaacaaacctcctctgcatttttccatgatcatgtttctggtttcttgaccaggtcattgataatgccagaggaatgcatatgaggccaatgccaggaatgataatcccaaccgcggctccggtattttatctttcccaattgtaacacacacattactgtagcttaaggatcttgaattcttacaagtcattggtttttatcaggaaaagaaaaaattgacgaacaggacatcagaaatgaagagaacaagaagggaccgtagagagatggaggaggtgatgtttaatctctttgaaagacaatcaaattggactctgaggctgctcattcaggaaactgaccagccagaggtgagcacaaggaaattacagactttttgtttagtgtttgactgagagattcaatggagaaataagaaaacaaataccaaaaatgaaggtttgtgttgcttatggaaaagtgtatttggtgcagcaattcctgaaagacttgttgaaagatctatgcatatacaacaacaaagggagcaaccaaggaacttatgagctgaagcctgaatataagaaagccactcaggaataggtttggtcaaaaggttttttcagggtttgttttggatactatcttttgattatctatagtgaggttaagcttgatcagttacttaaattgtaactgatcttcatggctataataagaaaggaaggttcgttcaattgtatgccttaagtattcacaatattaacgtaactaatcatttttagtgatgctttagaaagtaatcagttgttttaacttttggaaattcatgtcccaaagctcataaaagttgtggctttacttgtgctttaagaaacttttcaccaacaaagtaaaaaggctatgtgaagaattggattcgagtgatatccaaccaggacatttaacaattataactctctctttttttgttgacaaaagaaaaacacattattccattaaaaaaatataaccaatagtttttccaaatgggtaactcttgattattctatcaaaacaatcaatagtgatattatcagcagtaacaaaataacaaatatatcttgtaattattagtttttactcaaaaactaaaagagttaaagttaataactcttgaaattaggaaaagaaaaaaaaactcttgaaagttggtataaataagatttgaataactgagtttgactcggatgtgattggtctatcccggtttggtttattaaagtctccttcacttcaatttctgtttggttttatttaccggatttgagaaaccagaactgaggccgaccaaccggtaacgatg

SEQ ID NO: 9739 - DNA, 3000 bp, Unknown
  misc_feature (1)..( 3000): cDNA_ID_2032805_gDNA_ID_1972176_Annot_ID_180004 3000 nt of promoter + ATG
tataaaaggggggatggtggttgagaagattccagtatttacctaaaatccatgtcccggatggatttgtgtgcctttggctcatccaaaattacacttaggtttggccactccataattctaagacatccatcctgaaaataacttgtagtaagctacaactaaattgtcgcaacagtgaaagaaaaaaatcccttatattgcagttccttaccactcccccaacagctaatttagacccatcaaagctgaaggccatacacttttgtagtccagcattttggagaggaaggagttctttggctaagatcgtaatacctgttgctcctccgacaagctcaaataacctgaaaaccaaataaagttttaattaccatctagaccgtaaaacaaaatttgtatagacaatggggtagacagtgtccaaaaatggttgaagacaactcctcgtatccatgaaataagtggaatagtagagttgctaaagatgaatgcaagaaagggaagtcaaaatattatgaaagagaccaattataaaaggcatcggcaatctccaacaaaagtataggcatatataaaataaaccaaaccttaaacacaagaaattcaagcctcactacaattaattctacatcagcaaacatgggaggtgggagatcgtctgatgtaatgagagaagtaatgtaaagttctagtaatctgatatctagttctcatcataggtttaacaataccaactcaacaaatttagaaacatagtatcagaggaaggaactgtaggatgtctagtaatcataagttttgggtggtaaaagcagagatagaaacgtacttgcaaccacctttggaggttgagcaaacaaagtaatccccaccagggtgcactgaaacagccacaggatcaccatcactatccttaagcgtgtgtgttgcctttggtcaaagaaaaaagagaaaaaaggttggtttttttatttcattagtccacagaagtaaacaccaaaagaaaggggctttgctctgctttctcagaatcagaagaaaacaacttgaagaaccctagatttattgcatgattcagaagaacccaagtttcgcaatccaaagaactatagtagatttcaccctaaacccaataagatttcgaagctctcgattgaaaaattcaaaaggtgtaagaaaaatttaccaaaggagaggaggaaagagaagcagtaatggggtcaaaagagaagatgttgaggagagcaggagaagaaacagatgagccacggcgtttggaagctttagcgataagaacccagtttactttcttcgggcgacgaatccatgatccgcacacaacatgtccactttcacgactcgcttcttcaatctccattcgttgttggattgattgttattaatttcctctttggtctctccctaatttggatccttaatatatatatagacagaaaattgtttttttttgtgtgtgtgtgtagttgttgttccagagtagagaagaggaaaacagaaagtaaaacaaaaaccaaaaaggagttgactttggaaattggacagagagattttgttgagttattatataatgggattgaaaaatctcagatttaacaaacggacatttgcggtggtgggaaaggatattccttaagatccatgttccgatgccgaatttaatacaaacaagttaggtcacatcgtgcttccgtaatctatagcagactttcccattggtgtcaatctcgttgtttaaaaaaaaaagtaatattagaaaagattgaacgtaatctgaatattaagaaaaaggataaatatgaaaagatatgatgtaaatatgtaatcgatgcatactcttaattatgcaatgtaattctttttttgtgacattaatacattatatatcctttatcttataaaacacaagtcacttggcaaatcatgttttgacatgtggcaaatttatcaaaaacaaaatccacaatgtaaaacaaaaatgaatttttcgacaaaactcaaaataaaattaaatgtgaaaacagtgtacaaaattaaaacattatcgtcaattttcccacgatcactctcaaaagaaaataaaaatcaacccacatattctccatactcccacaatttctttttcttctattcaaactatgtaactcttttttttcaattaaaacattcaaactaactattgggaaacaaagacagatacgatctcaaacctatatatacaaatctcggtatcatctttctattgttgatattggtttttaaaagaaggttgagagtaaaatcatttaggagcgagaccttctttgtaacaagagtcttcaatctctaatcagttcatataaggcaatatggccagcgtatgttatatttcttttattttattgattgcgtttagatgagtatattaatgctttctgtttttgaattatcttttattatgtatgtttaatatctttttgcttcatagatcaaccactaaaaataaacaagcaaacttgatcgatagaggataaaacacaaacaaagtagaagacttgagcaagaaaaacaccaatggcaaagtagtaggaggttgaagacgaagtagaagtgtacaacattaagacataaatgatatcatctatgtattgagtcaacttcactctggtaacttttttttgtctatgactataatctatgtttgtattgagtctttgaataccatatgtaattttttattttatagcttttgtatgtattctagaaagcattgaagttggaagctaattctctatatttggaagactaataattttgtgatatcaacttcaattctccattatatatcaaattatcatctgaaaaaataaaatccacaaatacatgaaacgatatatttttccctacacgattatatactaatctatttataaaattaatttttcatgtataaatatcgataatatgtaacatatcataacatttaaattcaaaaaaaga

SEQ ID NO: 9740 - DNA, 3000 bp, Unknown
  misc_feature (1)..( 3000): cDNA_ID_3032757_gDNA_ID_1972176_Annot_ID_180002 3000 nt of promoter + ATG
cacacgcttaaggatagtgatggtgatcctgtggctgtttcagtgcaccctggtggggattactttgtttgctcaacctccaaaggtggttgcaagtacgtttctatctctgcttttaccacccaaaacttatgattactagacatcctacagttccttcctctgatactatgtttctaaatttgttgagttggtattgttaaacctatgatgagaactagatatcagattactagaactttacattacttctctcattacatcagacgatctcccacctcccatgtttgctgatgtagaattaattgtagtgaggcttgaatttcttgtgtttaaggtttggtttattttatatatgcctatacttttgttggagattgccgatgccttttataattggtctctttcataatattttgacttccctttcttgcattcatctttagcaactctactattccacttatttcatggatacgaggagttgtcttcaaccatttttggacactgtctaccccattgtctatacaaattttgttttacggtctagatggtaattaaaactttatttggttttcaggttatttgagcttgtcggaggagcaacaggtattacgatcttagccaaagaactccttcctctccaaaatgctggactacaaaagtgtatggccttcagctttgatgggtctaaattagctgttgggggagtggtaaggaactgcaatataagggatttttttctttcactgttgcgacaatttagttgtagcttactacaagttattttcaggatggatgtcttagaattatggagtggccaaacctaagtgtaattttggatgagccaaaggcacacaaatccatccgggacatggattttaggtaaatactggaatcttctcaaccaccatccccccttttatattatttgtaatgcaaaactgtaattgaggtagtaaaaaatggtcttctgtatagagctgagaattgggttatacaacacaaatagtaattaatggagattgtgaaacgaaacccattgtgtgcatctttctcatatttgtatatttttttgtagtcttgactcagagttcttagctacaacatcaactgatggatcagctagaatatggaaagcagaagatggttttcctttgtctactttggaacgtagtggggtatgtgattgtgagagttaaagtttgcattagcattcctatatttctaaactaataagatccagtgaaatttgtatgaaggatgagtttccatgtctatgatcttttccaataaatatagttctgagatttctcggtctcgattttgtctctgtcgtgtttcctatattggcttctgatatatcctgactgattctgatattgtcatgtctgcaggatgaaaatattgaactgtgccgtttctctaaagacggaacaaaaccttttttgttttgtgctgctcaaagaggtatataatatatccgactctcgagtaacatcactagtatttcaaattaaaaacatcatatgaaagcttaaactattggaatcaggtgatacgcctatggtcaatgtttatgacattagtacatggaagaagcttgggttcaagaagctgtcaaggaagactgcatcgacaatggcagtgagcttggacgggaaatatattgctttgtgagtctttcttcatcccgggctgcttatcactatcaggcttgtgtgattgtacataaaacctcatactttgcacctatttttgtaggggtgggaaagatggagatgtatctgttgctgaagttaagacaatggaaatctaccactacagtaagaggctgcatcttggtcaatccattgcttcacttgagttctgccccagtgaaaggtatggggaagcaattgaaaggataatgataaatcaaaacccttatgtctccgcattgtttctaatgttgatctttatctaattggttctttctagggttatgctgacaacttctagcgaatggggagagatggtgaccaaactcactgtaccaaaggagtggaaaggtttgttgctaatctctttctctgaaaatatgaatggcacatatttggggtttatacatttgtttctcactattatctatttgtttgatgtgcagagtggcagatatatgcactgctgttttgcttgttcatggcatcagtgatagctgcatacgtattcttcgagaactcagattcgttttggaagttaccaatgggaaaagatcaaaaaagaccaaagattagtctatttggaggttcctcctccacgccttctgaggatcatagtaggtggaacttggacctatagaaagattatgtaactttcctctgctttttcttctttcttccttatcttgttgcagcgtttttttttgtttttttcctttcttctgattttgctctgacaaatacctgttgattaattgatttatttacagacaattactgttgctaattacttgtgctgaaaatattattaaaattgcagagaagatcttttgtaacaataagagacgtgatggcgtcatatgagtggtcccattagctcttgagaaatataaaaatagaacctctcactttttatcttcatgaagtaacctctaacaaaaataattagacagaataacccaattcaatattgacggtgctgatgtggcagcagatattagttttgtgaagagggtgtttttgttattgtggaaagttggagactttttctagtaatgtgttccactttacgtaacaaacaaaagtgattgcattcccggtgcagaccgtggggtcccaattgtatcgtcgtgagtcgcgtgaccgtcagagtcacactcacaaacatttttggacatgaattgaaaattattataattaccagattttttatctatcgtcgaacttgggactgagaaagtagcagcttcgtttgcttcctctgatatttttctacactctctgtctctctctaaagatg

SEQ ID NO: 9741 - DNA, 3000 bp, Unknown
  misc_feature (1)..( 3000): cDNA_ID_2185478_gDNA_ID_1972177_Annot_ID_180042 3000 nt of promoter + ATG
gtacaagtgtcaacaccagatctagcgtaaaacacttaagctagtacttaaatagattatgcctattttttcgaccattatatattaaactttccagcctttcgtgaaaaaatgcgcatgttcttgttggaatctaggaatcttcttctactaaagattggcatgcacgtggtaacgatttccattgtatactatctcgatattttcccaccttaaatatcttgaaaattaagatcaaattatatgagaacatatattgtatcattgtttgtaatagccttatatagtgtgtagatgtgaactatggatacaaaaaacaataggaaagaaaaagctgcagagaaggtgttgctttacaactatgaatatgggctcatgagatgtacactacagataagcgaagattcctgttgcatgaaaatgtgttactaataaaaaaaacacatgcacatttctataaagacgaatttcttttaaataataaatttctataacaaataaagataagtgctcctttaaaaacatgcaaaagaatatatagatttaccgtatcagattttcatacaatttttatattttttgagcttgaaagattaacatgacaaactgtatcgtgtgtcctcgtctattcacccctagaagaagtgaaacatggaactttatgtatttgcatacggcgagctagcttcttccctacttgtccaatagatgaagacattatcactcaggttcagctacttcgaagcgcaacatatcgacaaaaaatcgttttagctctatcatctgtcttttgaagaaaaatatcaacatatcaaatacatatacacactccccacaaatatataaccacaatatatattggttactacgaaattccaatgatattgctctttgaaacaactaaactgtgaattacaagctaaggcaatatatctattatattctttctttgtgtctcaacttcatccctttctaagtaattcaaattaattggaagttttgtcatctaaattgaagttcttcttaccggatcattttgtctcaggttgatatatactttcttagtctgatacgaaaaacttataaatataatgattagagagagacatgtttgatgttatatttttctggtaaaaaacatcttgattatgaactatatagttagggatatgtttgatgttgtgtgtcgacatagtgaggtccattaaaaagaaggtctgattaaattttacgtttggaccacaaatctttcttttagaaatcgcggactgggacaccttcctacaacatgtccgtctttactaatcttacgtacccctcacattcgtaaccataaaatcatcaaatataatatagagactggtgatcataattcgaaatatttttcactaattcaatgttatcggtaagttatattaggggtataacatcaagaatcacgaaagaattaaaaacaaccttgtcgaatcatgatttgattttttggcttatactttctaatttttatatcttgtgctgcaaattagcaccaaaatatatatattcttcttcttcaacatcgaattctttattttgttaaaggcatttttttcttaacagaggaattttacatcattcttagactgaactttcgggataaaaaatctcgccatgcaaaggtaatttattttttcatgacaaaagccacaatggcgataattataactataatactatgcaaaacgaaactttacttgggtcataccgaggaaaacaaaggtacactcgattgtgacaactccaccaaagaccaccccactaccaattcacctttatttgtttctttattcactcaaaatctttttaatttttttaattaattcaattattcgcttctctcgttgttttttaaccttttaattaaaaattgaaaggaggtgcctagggtttctctctctgcatggccactctcgctcttcacatctttttttgggcaccattgttaacgtatgcaaaaaaaaaaaaaaaaaaaaaaaaaacttacatgctaagaaaactctctttccttgtcgtttctctcataaaagaaatttatttaaacttattttagtccaaaatttatcgttgctgatgaaaaatacaatataggaagtgggatcggatcggacaaggagtgaattatctaccaacttagatttcactcgtcttttgattgacaagtaacatacacaataaacacatatgcataattatttccatcttcaaccaaatgttgtagtgaagtaatttgatctatgttatacggacatctatctactaaatttttgaaaaaaaaaaaaaaaactatctattacatgctccaaattattacttgcttatgtaatttatgcgtatattagagatgttggtgtttttctgaaatttgatatatgttcttttatctctgaaatatgatatgtgaatcatcatagcattttcagtggttacaaccttatcgaatcgacaaaagattgaaacaaattggaaaaaaataaaatagttttactattttctaagcagcgtgaaatgaatatcagtataatatatgaaacaaattcgtacgtgataaatatgtatacagtgatacaaccaagaacgatgacgtatatgattgacttgcaaaaataagcaaacaaaatacctgttcaaatcgacacttaattccaaaaaggttagtaataagtaagaaggcttttatttatgaaaacaaaaagaaataaagagcctaagagaatgatgaaaattgaaagagaaaaaagagcattgttatagaaaagaaaaaaaagagagagtaaagagaattaagaaacacaataaattaaacaaaggaaacttcatttcttctctttatcccattcagctcctcccttctctctctctctctctctctctctctctagatcaattctttcttctatgatgtgattatccaccatatctgcgacctcttacctaaaaaggatacaagtaagagattcaaag

SEQ ID NO: 9742 - DNA, 3000 bp, Unknown
  misc_feature (1)..( 3000): cDNA_ID_2185490_gDNA_ID_1972177_Annot_ID_180047 3000 nt of promoter + ATG
agctgtttcttctaaaagagaatggtttggtattgaggggagtgttaaaaggctttaaaaaagagagggcgttatgaagcgaagtgtttatcctcgccgccattgatgaaagaggacatccaccggagaagaagcagaggaaggaaatgaagaaagggactgctaaaatttggagcgcaatttaggtcatggttcggttttatcggtcagcgaagcgagttatccggtataccaaggaaaatataactaataaagtcaaatttttaaatttttttatctatttcttgcagagcattgagaatatgttaatccaattgacgcccactcttccggttaagagagccgtggttgatttttactctccaacattgcaaaataattacatgttggtcatctaagatcacctatcaactaagtaccaacagcccatacgtcaagtgcttcgttcgtgataccatgagaaatggactctagtgacatgatcaagttttatcataagtggcgatttacagggctccaccagctagttttattaatccgtttggattttctaaagtcgctgagttttgcctctaatccttcatagctatgaaagagtaaaatattaccgctgtgaaggtccactgaacaaagttacctcgatgtacatattgaagcccttgaaggatcatcagtgtgaaacggcgaataaagtgtatgggaagagttcctgcagtagcatactccataaagtgtatggaaatgcttttttatctcatggaaaagggttcctgcagtagcatactccataaggaaaccataggttgtcggagtaagcttatgtatgcactttcccgtgcattgaacaattacagttgaaccttggaacactgagattagataaaattcttgtctcgcctcagactcggatttacaactcttatagacataatacaccacattgccatccggtgtataaattgcagtagctccaccttagcagaatccgcctcagacgttaatatcttcttcattgtcctagggagtaactctagatctatttgatcacacaaaatctcttctgctcctacttttggtcttgctaaagccatctgtttcatctctttcacaaagtctgcataactatgagtagggctggacacaagacaagtacttgcaaaattgaagatatttgtgacccgacttgccttatacaagtaattggatttttggcttgttttgtcaaaacgagtacttggtcaagaaaattgatttcaccgctgattaagtcttacggaatcaagaaaattttgttgaatcattaaatttattttgcttccaagccattgtttcatttcttttattaatttgtgtgaaattttattaatttgtcttctgctctagccctctctttcacgtatataacatacatagattaaactcatccattttaacatgtatccaagtccaattttctcggtggtcaaagtggcgttcttcgtacaaattatcgataaattttatagagaaattttacaaattatgtaatttcttacaaaaatttgatctaaaaagtagttttttctttataatcaataatgtttatgaaaccaattatacgtagaaacaaatattttgttttaaaaaaaaaaagaaaatcgacatagtaaaagtattagaattgaactttataaagaattaatacaaattgaaaaaaaatagtagaattatatttcactaaatatttcaaatttcatatttatatattaatttataaagattttactgtatttttttgataacatttacagcaaatccaataagtccattgaaaaatattcagaaaatcactaaaacattctatttctcgtcttaaagttgtcaaagattaatttttgtttgtataaaaaaaagctcacttctgttactaacttgttggaccttttattaatttgtcttgtgatttagtttagacccctctttcacgtatataattttgttacatatgaaaaacgagacaaaaaatcatccaatgaaattataacacgtgtagatatttatttcaatctgcttacgaaaaacgccactttgaccaccgagaaaactggacttggacaaaaagacagtctttgttctggaacggcgtttcacacaggtggaggccaccatcaaatatttaattacaaaactataacattatatattccaatttataattttgttactttcttatttgtttcttttttgtttagagaagaaatagtaaacgattgattattcacatcgttgacttgttaatctattttaggactatataaaatcaagagaaaaatattcagcaaatcactaacacattctatttctcgtcttcaagttgtcaaattatggtatttgtttgacatttccaaagaaaaatctacatttcataatttcatatatattaatttccttacacataaacctctaaatattttcatatttacataaatagaacaatattccataataattaatagcgttatcattctagaaaaagggcaaaactttaaaaaccaaccctttcttcctcctcctccgagttcttctttctcttcttcgcctcctcctcctccaaggtaaagtattcagctttttcaaattcagtttcttcacaatcggaaataatgaagctttcttaatccaacattttctctttatccaacaacagatctattttttcctcatcagattcatagatttcgtactgttttttaaatccagattgtgtttaggtcaccgagttgaatcttaggtcgtattgatttgtagattttcctctttcgtactcttgttcttcgttttatccctcagaatatgatttgagaaaaaaaaagatctctttgatacttcatttcagttaggacgacattaacgtgtgtgtgtctgtttgtttgttgtgtgcagtgtagaacgacgattgttgaatgcgttattgtaattgttaagaattgaagttaaagtgttgtttttgaatctggtgaa

SEQ ID NO: 9743 - DNA, 3000 bp, Unknown
  misc_feature (1)..( 3000): cDNA_ID_2991829_gDNA_ID_1972177_Annot_ID_180050 3000 nt of promoter + ATG
aaattggtacattatctcatttacctaggatcacatatatcatgatgtaataaaggaaacataaggcatggcagacagatgaacgaatctaaggacaataggataaccttggacggtgatgagataagcacgtgggatagtctaaatggtcagatcttaatccaatcgctaacattttcaagtttcaaatctttgaattttgctttgggaatttatttttttcctctttttaagaaactaacaatatacaagttggatgaaaaaaagaaagaagcaaacgcaacattctacgtttgcgtgaaattttggatttcaagttagataacagacgaaaaaatagagattgaatctaatttttcaaaataatcaatttttgttttgcatatttttttcaacgttgtttttcaactttatacatatgcgcaatcaatgcattatctctgatataaaaaagggaaagaaaaaaaaacagtgcatttttcacgccaatcatcaattcactattaataattacaatttcttttagttaaagaaaattaaaactaggtaaaaaagttaagtaaacaaaaaaaaaaaaaactttcccactagcaaatatcaaattcaaagttgagatttcaaaattttttatctgaaatttatacaataatgaacatcaaacttaactttaattttatttaccaaaaccaaacaaatattctacttattccttaaaatagaaaaatctgaaaaatagagagaaagctgaccttaacatctctgacaccagcacgaaccaaagcgttgttaagattcctcatcgccggtaagagattattgatcatgttattatctccggtgagcagaatctcatttccgactgagatatacttaatcttcgtctgaggatgaaacggcaaaatgttaaccgaaacccaccgacgagcttgtcttccgttagccaacgccggaatatcaccgttaggaacggtgacaacgacggagataccagttccagcgaaggcacgtaggatatcgggattcacatcgaagatcttgacgctatcaatcgaagtttgtgtcttgataaagttagccacctgagtcggtggtgggaggtttccgagagttccgtagttaacaccgatggcggagatcacggcggggatggtgaggaatacggcggcgcagaggaggaggagaagagagattgacggtggcgctttggccatctttttatatttcggaaatgagaaaaccaaacgattccaagtgaaacccgtgaatcgtttgagttgtgtttttattattacgacgaatagatttttttattcttatcgagaaagtatttataataaaaattaatagatatgaccgttttgtatagcgtatacgtgtgtatatttttagtgaggaacagctggattttgtggaaagcaaaataaaagaagaagtttgtgttgtctttgtttttcatgtgcgtcggcttaaatttaggccgttgtaaattattgaaaaagtggattttgttgtgaccgtggaaactttagttaattaatttggctaattatagagtctgcttttgtttggataatcaatttgtcatctttttctttaatggtttttggctggtaaatactcatactatccaagtttaatctaaaaatatacctctttcttgttaatcgtaattttacaatcctaattttatccagatacggatgaactatatttgaaaaaaaggaactaaagtgaagttaagaaaacaaaagagagatcgagtgttgttttttcttggatacgtttattaaaagatgttcttaatgaggtcaaaggagactatctgagtttttactgctaaacttaaaactaaaaaaaaaatcgattagtaatattgatgtatcaacgaaatgtatatggttaaatattaagtgaaaagaaaaagaagagagatcgacgcggtttgggataatgccattggcccattggacacgtgtttgtaggaggaatagtttggagtttgaacactacggaccaaagtcaaagagattcgaagtatgaagatgttgttgaggaagctgattcgaagtaacttttaccgacacgctttagccatttgttatgctttctttgggaaaagaagatccgcgtccatgtctcattgttaacagtttattgtcattttcaatgacatggttacactcattgcacacacacacaaaccacgtaattttgtatttttttaattaaatcccatccttattttttgcaataacaaattaccattgttactttttaatgatatcacataaaataatcgatgccactcgatagccctttagactaacaatatgtttgttgaagtatgccacaatgtttgaagtgagccggctcaatgctctcatggtggtttagtagtttaacttgagaacttacaacagttttctccttctccacactatttgtatccaagaaggggcattacaatatagaattgcataatacgatttaaacttttaccaaaaaaaaaaaagaaaaaaaaagaaagaattgcgtaatacagaatttatctttaagggaatacaaatataatttggtttcagaatcatctcaataggctttcctttaaccaaacttgggttttattgatgtgcttgctttaatgggcctaaagcccatacaacagcatcactatccacgccgttgtctattcttattattcaccccacccggtacaccgaccaaaccttggccaacacgtccataatatttcatcctccctcctaatttactttaatatcctcaactttcctaatcgttcagggaatattctcatataccctagacatatgcgtcttttccaatctaaaatgttgagagtatatttttatttatatatatatgagtgacccctgcgagagacaacggccactgaacactatcgatctaatcttttcagctctctccatcgtcgtcgtatctgtgactctcgtgatcatcgcctgaaaaaaatttgagata

SEQ ID NO: 9744 - DNA, 3000 bp, Unknown
  misc_feature (1)..( 3000): cDNA_ID_3032814_gDNA_ID_1972177_Annot_ID_180053 3000 nt of promoter + ATG
aatctcacattgtattattaatagatcccagagttaatcggattaaagatctcatctcattgcaataataataaaaagatcacaaacggttatgaacctatattttcaccatctactttctaaatatttgtctagaaaaatactaatttcggccagtaccatctatttctctaactttggagttctctccaccaatataaatagcgatcttcacaagtgtattttccaccatcctcaagttcctctctaagccttctagtctaacaattttctcaagctttctccaattcaattaaaaatacttaccaaaatggcaatcaatccattgattctcttaaccatattcccactcttccttctcttgagcttcaccgacgccggaatccctagagtcttctcaggtggttcttggcaaaccgctcacgccactttctacggtggaaacgatgcttcgggaacaatgggtcagtctactctccttaaacacatatttcaagaaccatacttcatttatcattataccaactctctaaaacagagtgctctgtttcttgttcctttaatttacttttgtttttgttgttgttattttaggtggcgcgtgtggatacgggaatctgtatagccaaggatacggaacaaacacggcggcgctgagcacatcgttgtttaacagtggtcaaagctgcggcgcatgcttcgaaatcaaatgtgtcaatgatcccaaatggtgtcacccgggtaatccttctgtcttcgtaaccgcaaccaacttttgccctccaaacttagcccagcctagcgacaatggtggctggtgcaacccgccacgctctcatttcgacctcgccatgcccgttttcctcaagatcgctgagtatcgtgccggcattgtccccatctcttaccgcaggtatacttaaacatccctatatgtagcctacgatttgagaaatgattcgtatataaaagaagttgcaaatgcaatgaatcaaaatgctaagattacgaaatgtgggtatttgtatagggtggcatgtaggaagagtggagggataaggttcacgatcaacggtcaccgttacttcaacttggtgctgattacgaacgtggccggagcaggagacatcgcgaggacgagtgtgaaaggttcaaagactggttggatgagtttaactaggaactggggacagaactggcagtctaatgctgttctcgttggtcagtcactttccttccgtgttacatccagcgatcgtagaacctctacttcatggaacatcgctccttcgaactggcagtttggacaaacctttgtcggaaagaatttcagggtctaaagtgaattgatgataccgaaacattcgaaatggtagagacaaaaagaagctccactttcgatttgcacatctttgactatgtatttttctattaagctttttactgtgctggggagttatgtggtaattattgggaagtgtaagaaagacaagttgaagtggctgttgataaaagttgtaaacagcccgcagctcttaaaattatatgcatggtttgcttgtaatgtcaaatttcattatataatctaccacttgcttatactaaagttcgatcttctcttcttttctctgttagcatgaaaaatgtggctacaatattaattttaattcatatattcaatagtagtagcacaatgatcttacttctatgcaaatttttctcagagttgtaacactgagtgtcttatgaaattcactacagtaactcttgagtagtaccatgaatcctaagacattgttgacatgagttatataattcaactaaaattagtttagaattgatcttctctatcgagttgaatcgatttatttagttatgcaatcaattaatttatatcaagtttgaattttctttgatataagaaatgtgaaactttttttaaaaatcactaagttttttttttgtgcgaaaaaatcactaagttaaatttgattattttcacaatacaaatatattttagaattattatttcttttcaccatttttttccacttagtaatagtttttttttttttgattgtcgagccactgatcttatacagttcgatccggtaagcgagtgacccgagttctctctcgcaagttgcaattgattcctccaacgcaagcatctccgatttctctcttcaacaaattgtgttttgcattcctcttatgtaagttttcccccatttctctaaggtttttgcgtcaatttcaatccgtagacctaaatcgttttttgttctattgtagaaactttacctagcttagtcggaatcaaatcggccgttgtgaatgtggaaacccttatttctctcagaactggcattgaatttgaatagatttggactttatattgtacaaatttacttactgaattgagtagatttaacagccatttgtgttaactagaggagagaggttttatgaatttggacttgttactactgttctaaactctcttaattagagatgttaaaacgggcttaacatttagggccggcactagtccgctaaagaaattaaaagccctagccctaataaaatcaaaaaagagaatttcgggcttatatagggttttggtgaaaaggtttcgggcttcaatagagctgggcctaaaacttttttcttttcttaattgttttttttttcttcgatataaaattctcttcttcagttcttcttcttcaaacactctcttcttcttcttcaatcttttcttcgatctattcttcgtttgtgagtaaaggtttgatttgtgctctatatctttcatctttcttattttgaattgattttgaattgctttggtaaatctgaaatctcagatttgagtctgacaatctattaagaggttgatttttgacttttgagtgtcttatggtttgcttttaactccccgcagaccgcgaatttaatctgaaggttaaggtggtgtgaaatcagcgttaggggatg

SEQ ID NO: 9745 - DNA, 3000 bp, Unknown
  misc_feature (1)..( 3000): cDNA_ID_2185522_gDNA_ID_1972177_Annot_ID_180058 3000 nt of promoter + ATG
attataggtatgatatgatatgacacaaattaaagttggtgactattgcataatttgtcgtctaacggatagccaagagagtagtcttttctttcttcatcaaatatgggatatatacaaattaaagctctcgaatatataattctgttaagtgttgtttatttggatattggcttaagataagttgtaggtaaaaagcgccattcgatgagaccaaatagcaaagatgatcactttttagaaaaacgaaaaaggaccaataaaacatgaaaatgtgaaaacccccaaaaagtttttcaaacactcaataattaaatatgaagaaaaaaaagaaaagagagagacagagaagcagaaacggtaagaggagggaccaaaagaaaggaaacgtctgaagaaaaccctaaaccctaaatggtgacgagtgatagagagagagatgaaggagctgtcaaatgtgtcaattccatcgatccacaaaacttaatgcttgtgggctacgcaacgcatctctctgctctcttcgttttttaacactcttgcttgctccattaatttactctatcttcaattcctttctctttttatccctcagatttgcctttttaattaattatggccacagtgagtgttaatgagctttggtatatttggtatcttcgattacgatgtgcaactgtttccctaatctctctccctctctctctctctctctaatattcaagaaaatctcaaccgttgatctctttctctttcttctatttaaacactttaccctttcctactttcttcaccctaaatctcttcctctccttcagatctctttagtctttactattagggttagcatgttgatgacttcagattctgaagttagtggcagtcattgtttgctattgcaacatcttcaagattcagaaatcagattctcttatgggttttcttttgagcctttattttttggtttgagaatcttgatgatgctgcagcggcaattaaatggcttacttatctagggtctttttttccattttcatcatgtggttaatcagaaatccagatcctcatatgtagaatcctccgatatgataacttgaggtgaaacttatttcacaggtatgcatatgattatatatatataagcacacatatatatataatagatttgtgtgtgtataaacatatttgtggacaaaacgatgatgaatgatttgaaaaacgaatatgtatatactactctcaattgattaagtgaacccttgcttatagatctttttttttttaaaaaaactttttgctgcacgatggatagatcctgaaaatttccaaaaaggttttagggttttctttctaacgacaaagtatataagacctgtttctgtagactcaaggtgattcataaatgcataaatttgatttatataataatgactgaaagggtttggaggaattggacatatgtatgaaggagcatgtatatgtctgttgttttatgttcggttacatctggttatgtctcttctctttgtccactggttaatcaaatgactcatcttcatgtgaaaccaaaccccttgtttttcgtgtccatgtttctttatgtatgtgattagatctctatatatgtttctctaatgtagtagatgatgatgtgatgtatgtgacaggtttgtataattcttataagagttctcgactttggatctatacatatatttcgaatttgattcctaaatcggatttgagaagaatctcatttctttttcttgttttttatttcttattgttttgtttagggtcttaaatctgaatctaaatgtagtagtgccaactcgaactatgatctacctgaatctgtatatgaaatcgaaattttacatatgagaaaggtttatatatgagaaagagattagtttgtgtacgttgcttgttgtgcagttgttctctgctgcaaagattcgctcatgtatttgtattaacatttaagatctactaagaatttttaataacatggataccattttattgatggaaaagtccacatctacgtaaaaacaaaactgtgtgtgggtaatcttgattttcaaagatttatacagatgagaattctaattaaatcaaacttgcttcctaattataaacgtttgatctcactgatgtgtgaatttctgatatgtggacttggataaaaattacaacaccaaaaggttttagtttgttttgtcgagcatatgcatgatgagttactccaaacatgaagcaagtgatgaaggtttgagtcatggatccttttttcaatattccaaacaaatgagtttatctacaaataatcatcaatggaatggttggctaagatgtaaaataatactagaaggtcaaaaacttggataaaaattaattcagactacccaaattatagttaggtttgaaaacgcgtttttatccgatatgggtctaacgtcaaaattggggcttaattactaaactaagcaattttgcaagattatcattagtacgagtttttgggccggttatgctgttaaagtttgggtggtctgtgaattcgtttattgtaatttaaagtgtgcgttttaagttgcaaacgtcgaccttagtgatatcgtaagatgtaaagactttcgttgtgaatggtggtatcattatttagacgttgttaaacttttctaaaggtaatgttacgcacatttggaatcttagggatttaatctggtgattggtcgtttaattttatgcttatcccaattaatagcattggacaattaaggcctttgtaaatttgggcctttaattttgggcctcaactatcggtgtatgcacatactactatttttcttaaccctcggtcctccactcctcctaagacacttttgctaatcaaaatagtttttgttgagttcactactttaatctacgaaaatctagtgacccaggggctaggttaaattggagactcgtacgatactcgtgagataattagta

SEQ ID NO: 9746 - DNA, 3000 bp, Unknown
  misc_feature (1)..( 3000): cDNA_ID_2185546_gDNA_ID_1972177_Annot_ID_180066 3000 nt of promoter + ATG
ggtgacactgaagacaattagaccaagaacaaatcgtcctagtgaatcattaagagaattagtctgaaagtttgatatattattatagtcgaaaatcctaaaaattctgaaactcctagtttagactcttaagaccagccttgcggttctgttgtcaccctcaagtagtttctgttctggtttgttcaagagcgatattctaatgaagatatataagactttgaaattgttttcacaaggcgataaattaccacttaacttccttgacccttgttattaactgcttccaaacattgctctacgagactcttgatttacatgtttattacatcatattggtaagcataacatagaccaatttggttatcgccaacacctaagcttagtagtagtaaaaaccttatgcatgagctgattttgtatctttcttcagtttggagttgatggacttttcttgataaagctttggattacgagttgaaatccagagaaaagctccaatagcaaagtcacgcttatgagccaagtcaccataagtagacaaaccgtaatctgctaaaaccctgtcgagcttccactctggcatgtcttggtaatcttctttggagtatcttgggtaatgaagaggcatgcgaaacacactcccttcaccgttcttgccattttcaacatccatatatactgtacaatattattatttgaagaatactctttcctgttctgttcttgcttctggtgtgtaaatatgcatgtgtttatatatgttcttgaggcttatttatataaaggtgttgcaagcggtggtttaactacacacttaacgtgtgagtttttgtcacacggatccgtttgtttaccttcttcattgcctttgttaaacgcatgaacatgtgtaaatggaaacattgttgtgatcataactttggataacactaatcattcacacgtacggatggagtttaaaatgtaaacaaaacttcgattcacatacgttctaaatttattaagaatacagattactgtaaacttatatgcctaaatctatggttttaacttttaagtatatcatgattcatgaggtgttgtactgttgtttttcttcattagcatgaattgaaatttaggtagttcttcatacaaaaagttaaagcaaaattatttttaaaaatttttgtgaatgtgtcatcatactaaatactatgaatttttgtgtttccgtttatgggtatgatttttcttagttaatattacgaaaatatacaaaatcttgaaataaaaatgtaaaacctaattggtttaaagtaaaattttgttaggtttgtattaaagtgtgtacactgtgttgtagggttaatttacagttctcatctacaaataacattctaaagaataaaatcacccataaacccaaacacattgttcttggctaattgcatatgttgttcttcacaaaaagaaaaaaacttaagaaaaaaataagacaaagcagtgatggctaggatcaggttcttgagaggtcccacatggtgactcaaagcctgcgacgtgtcatcacaatcattaaacgaaccccactggctaatttagccgacatatgaaggaccaaaaccacacttctacttccagaaacttcgtcacaaactcttggcttagatttcgtcataaacttagtggttcacattttgccacctgtctgtttagtccccacgtgatttatcctacgtggctactctcgttcctaaataatgatacttttttgttggaaccaaccccaaacttattgatactttcgtaactcgcccctattctttgatccaagtataaactcctttgtcattccttatcaatcattcgtcaatagaattaaggtcgtgtcttaacacactttctaaagggaaagcctatttctggaaatatatttttagataacgttttaacaaaaatggatttgatcaagtgaaaactttggtccacatactccactgagatatttacttggcttacaacatatgtcacaagatatatattccaaagagatattttacttggctcacataattcccaagatatttcatatgttttggttttgttttcgatgaagataagatatttcaaatgcttctccacctaaacccaacaacttttgagaattccaaattctgatcaagatagaaattttttatattgtttttcgaattaattgtttttcatatcactacaaaacaaaaatattatattaattaaagtataaaaaatggtactaatttaaattactcaaaataaatgatacacatatacatggtgttatatcaattacaataattgacactattattgaattgtttgacattgatttaataaaatcggtacaaattcacattaatttgcatctttttcaaaatattattacaacaacatttaaatcactatgttcttaatcgtcttttcgtaataataattaaattttgaggtttttcgtttttttagataagaaaaaaataatgtaaaaaaaattgacgagatcatattttggttgatcacaagtgaggaaaatgaagttattatgtaaagaaggattctataatcgattgaccaacattcctccaaagaaatatattttattttataaaaaaatctaataaataattggaaataaaatcatcattcaccaaactttatactgttttacaaatctacgttttagtcaatttcttccccatacttgacctcatgaagcaatgaacacaaatctatgtttcgattttaccatggaagagggtcttagtgatatgaatttaaatgtcgggataaaatataagattataaaactataaaggtttattttgaaatacagcacacacaagaaaaaaggcccatcaacctcgcagtcctaattagataaatacacgtcaacttctctgggaacaaaaaaactgatattttctgattcgtcgtttcctttctactttcttcttcgtcaggttttcaaaactgagaaaa

SEQ ID NO: 9747 - DNA, 3000 bp, Unknown
  misc_feature (1)..( 3000): cDNA_ID_3032802_gDNA_ID_1972177_Annot_ID_180060 3000 nt of promoter + ATG
tttcggtcttgctaagttatatgagcatggatcggatccgggggctacaagagtggttggcacatttgggtacttagcaccagaactcacaaaatccggaaaactgacaacaagcaccgatgtttatgcgtttggagcggttttattggaagtagcttgcggaagaagacctatcgaaacaagtgcgttaccagaggagcttgtaatggttgattgggtttggtcaaggtggcaaagcggagacattagagatgttgtggacaggagattgaacggtgagtttgacgaagaggaagtggttatggtgatcaaattagggcttctatgctcaaataattcacccgaggttcgacctacaatgagacaagtagttatgtatctcgaaaagcagtttccgtcgcctgaagttgttcctgcaccggattttctagatgcaaatgatagtatgtgtcttgatgagcgcagcggtagtgcaggcgagtttgaagattttgtggattcagctaggttttatagcggaccgaatgaaactactacttcgtcgatattttccttctccggtaaaacaagaactgatccaagataattggttcttttaaccatgttttagtaacgtttcaagcataatatttcaccatgaaaacaagtaatctgaatgttaaaatgtaaaatatttttatcatatgctgttgcttaatattttgagttgatcgttggtctcaaatcttgtggttagcgtaacctgattttgaacaattcattgcataagttcaagattacaacacgaaatagagataaatcatttttcagtcatagtctcatagaacaaatatctcggaacagagaacaaggattcttctatgagaaaaaaagaaatttataaagctcaaataaaaagaacatagacgaataaggttttgtatataaaaaaaggacataaaggaacaaaattaaatgcatttaaaaaaagaacaacactagcataaactattagtgggggtaattttgcgtgtctatgttgttaaaataagagagtagcttccccttcttaaccatgaagtaaggaagctcgacatcagtactaggttttgcagcggactggctcgagctttcaagtgtgtctcgaggggtaacatcaacataacggaggatgtcattgtagatgacataagacccattgtgacaacgtgtcacatagaaaaattgcaagaactttctctctgttttgtcgtctagagtcacgaaaccgcaaaccatgataaacattctatctttaaaggatctgctgatctgataatccacactattcaatataaaattagaagccctcttatgctcatttgagaccctcttgttgattgcctgcaccaaaaaactaaccccttagatttattccactaaaatttctctagaaatacattggaattaggaacttttgcaacttacatcgaggccaggcatctcgaccattgttctaccagaagtcgaagtcggtctgctcataatactttcattgacatacatcaaaccaagttcctcacgcataggcaactcgtagtaaaccttgacaaatccagctgcaaaatctgcttatatatatagtcacaccaaaactaagttagtaagttttgtaatctcatgaagctaaacacttactattctaaaattgaatatcaaacacaatttatacagctgtttaccggattcaggaacagaaggtaatgctggtattgaatcgatatagcggaggaaatcattgacaatggcataagacctatcttgacgacgagctaaatacaaagattgaacaaatctcctcctcacttgtttgtctttacaagtcaagaaaccagtaaccatgataaatgctccatcttcagaactggtattgcaactctgagcagcaaaactcatcacatcaaacgaagcaccttcatagtcgcatgaaacgatttgctcctgaattgcctgcaccatcaaaaaattgtttgtccttataaatcgtttacagcttttttcaagtttatacgttttgaaaacgttaaaaatataactaaaagaattattgttataaaatataattactcccaaccagaacatcaaactaaaaacagaaactcatgagaaagatttgatctgattaatgacaatacctcaggcgatgtaaaagacatcattgtaccatcaggaccgggtctagtcataacactgtcgtcggcataccacatcatctgaactacctcgggatagactcctagattcaggaagtaagattggagaaagcaattggctaatgcttcggaagtatttaagttcgtgaagtgggattgaataaagccattggctaacaatacggaaggatcaacatctttgatcatggaatccatatctgcaccagtaattatgccctaggggagacgaagaaatatccaaagtaaaccctagctagatatcaaaatctcttaaaaacaaacttatctctctgttgagatcaaccgctgatctataggctaaaggaatcaccggaagagagagagagagaggaaagaggcggaagttgtgacttgtgagacggtttggattttggaaacctacgttccattgaacttctttatatattggtttttcattatgggatatagtaatatctttataaaaaaaaaaaaaaaaattatatatatatatatatctttaatacattattaaattaaataatatacggataggaattactataaatctttataaaataaaaataaaaggagaagtcccttttatctaatttggatggttaatttgtgaattttccatatttatctaatttcgatttgaaacatatccaacgttaagtcagattcttgtggtgaaattattgcatcataacataaagtcatgagagtaggagagaaagtaataagtggcaacatcaaaacgacgacgtttttaagctagtgcgtcagcaacagttaaaccatatgaagttaatggtctgtgttaatg

SEQ ID NO: 9748 - DNA, 3000 bp, Unknown
  misc_feature (1)..( 3000): cDNA_ID_2185550_gDNA_ID_1972177_Annot_ID_180067 3000 nt of promoter + ATG
tatgaacagaccccaataattctcgaccctttaacctggaaaagattgacaatttgacatatcttatctgaggatttatcacaagaacaatacttgctttgcatataatacgaatgagtttttttgtggacagatactggagcgctccttacatttggttgggggctttatggacaggtgagcacgatcgatccctggctttatttattacagtatatgcttgaaacttgaatgagttaagattcttgcttccagctgaacacacatgttgaggaaagctaatcatcatagtgttgaactaattctcaaaatgtttttttatatataccaaaacatagattcaacacaggattcaggtttgataaaacatagaattagggaaaaatgctagtctgcatttaaaataagactggaaaagataattgaaactttcatttgttatacatccgcagctaatattttcactttctgttgggtatgtggaagtaattgattttttttatttttgttgctctgtgaagtgtggccaaggaagtacagatgatgaactaagtcctacatgtgtgtcgtctttgttgggaatccgaatagaagaagtggctgcaggtctatggcacacgacctgcgcttcatcggatggtgatgtttatgcgtttggtggaaaccaatttggccagttaggtactggttgtgatcaagctgaggtaaaaaatcttgaactatattgtttccctggctattctagtaaatgctaatctgattatttctagaggccctgccactaaacttgaagtcatttgatctttcagactcttccaaaactattggaggctccaaatttggaaaacgtaaacgtcaaaaccatctcctgcggggctcgccacacagctgtaatcacaggtaacccatttaaccaaagactagattcagtttcatgttagctaggaaagtgattcatcttaaaacttaaaaaaactgctctgtgtttttgtttgttgtagatgaagggagagtattctgctggggatggaacaaatacggacaggtaaaaagagaaagaccatatggagtttctgaattgttattgtcgttccattgaatgacgtagtttgtgtcttgtctgaaacagttgggtataggagatgtgattgacaggaatgcacctgcagaggttagaatcaaagattgcttccccaaaaacattgcatgcggttggtggcatactctgcttctaggccaaccaactctatgaacacatccgaatttttgttagggtttaattagagcaaatgccagatttttcattctttttttttgttcttttgtcaagctttgacctttttctacatacacgtagacctttagtatcgcattgtacatacacaagtcagttttcatttgttaattgtatgagaaaatgaatgtttagcttttattcatccaacttagtattatgcatgaagtatgaacatactatcctatctccataaaagaaatatgtaaatatacgataacgagttaacttattaaaaaaacattaaccaaacatactatcctaacttaaaaataagaataaaagatgagacttgtatttgtatataagcataagtagtataaagttaacccaacatttccggctacaaataaaagtataaaacataaccattcaccaaatgaaattccttggagaaaaacaaggctccatgggccatgtatactcttcttcttcttcttagtcgtcctctagatgctcatacgttcttcatcaacttcttcttcttcactttattatcctcttatatgtgtgtcatagctgtttcagtaaaagacagcaactcaagccgattgaatatatctaaaaactagtaatatgtagtataaaaaaaagattagaagaagaagaagaagattaacgacgataggattggttaagaatgattccagtggaagagagtgctcgcagtacgtgctcttgggttttttgtagctcgccacatgcagagatggtgacaggaccagtgtaacctaaattccgcaacttccgttctatacactcacggatctgaccagcaatccagcatcatacccactaggatccggaaagctgtccatgtcccaccataccgacgttttagcctccgcctcctccttgcttagcgccttcttcggcagcattatcaaaattggacatataatctcaataatcttcgatacgtagcagttaaggcatttagggtttctttcaacttttaactatatacacgaaacttataggcatagccgcataggcctatttatttctattatatatgttctttttttttgccttaatacagttgacaatgtttaattttttgtaacattaattacaataattagataatcttgtaaagatgaatagaagataattcatattttcactaatagtagaaaatattttacttttatattttggtttaatgaaattatcaagttttgtaacatctgttttaccaaaatttctaaaaaaataagagttacacagctagtcagtagatcctttaatcctcccaaaatcgcctcttcatctcagggcttagtttatcgacgatcctgtgagatctcgtataggtaaatatgactttctcttctcttcacggtaacgactaacgagcacgaatctaatccgtttccttgacttgtggtgcatatgattttatttctggagtggttttgtgcgatttgtctgtattgatttgttttggcctacgtaatttgggtcttcgtttctagggttgtggattagggttatgcgtttaaaaccttttcagtgatgattgttattttcctaaatgtttattttctttagttgtgagctttgtcttaatctggacttgcctacaagaatttacattactgccgtgacatgttctcacaatagatgcatgttgttgtgattttctctgctttttctcttgactatgttctctacaggaaaagggaagttagtagtgcatcaag

SEQ ID NO: 9749 - DNA, 3000 bp, Unknown
  misc_feature (1)..( 3000): cDNA_ID_2185513_gDNA_ID_1972177_Annot_ID_180054 3000 nt of promoter + ATG
agcataagataagtaaaataagaaaaattcactggtaagaatcgaaagcacagaggaatttgagagactgagaacgcggcggtgaagtaacaagtagagacaagtcaaaaaagggtttagggttttggttggttgggttcacggtgtcaatacgacaatacggatccgaatatccgggtcagcccgaccttgtctatacaaacaaaatctgtaaaccaaaaacaaaaaaaaaggaaaattaacaaaaatctaaacatttttacagcaaaaagattgtttgtttttggagaataaacaattgtagtgaatatggtgcgacataattataggtattttattatttttacttgataaaattataattatcaaatttatgctacaaatcctctcgtgaaatctgtttatgttaaacagtgtgactatgtgtcagatttaattttagttttgtcaaaagtgaattagagatgatatatataacactcaatactatatcttgaacttaaaatctgtcttattttacattttcgattacatctttctctatagaatgatttcttagctatttcttaagaaaattctaattaacaaatatctcatcggttgtccatgatattagtgttcaaatttcgatggagcatatatgtaggatcatgtttaatttaaataaaccaaagattcatttatgcacaaacataaaaagtcatcatgtttaagctaaaatccgaggttcctttataaatcattttgtatgatttcatgtattgcttgatttggagttcataattagcatctatacttacttgtattccaagcctaaggaattgctgcgcatgtacatgtttgtgacattatttcatgatttcagcgctttgtattagtattaattaagcgcacacatcattttcttcccaaaacaaaggttcctagatacgtttctcaaatcaaatcaaagaacaagtgttatgtaaatcaaagattcctttataaatcattttaggattagataacaaactttacttggattaataaccatacactaataccatgtcaaagttcaatagtaacaacttaataagtgaattaactcatatacagtaggagactataggagtactatacttgctcaatatatgtgaaatgaatcgatattttaaagacatatagttggattcatatatatcatatcagattggatcttttgggttgtgctatatatcatgttttcattgacatatatttggattcatatatatatatatatatatatatatatatatcatatcagattggatcttttgggttgtgctatatatcatgttttcattgtcagatgatcaaatacatgatcgtacgccgtacatgccctagaccctagtcctcttggagcagtgggtcagatctatttatgtactttatatttgttcgacatacatttttccacattaatgtgcaacttccgtagactgtgataccattcaatacacacggacatgccttacaatgttttagcatatcgatcgtcaagttgttttgttagttggagatgaaaaattgagaattggcatctatatacacataataaaatacataagaacaatagatagacataactagaagtgaaaactgtttttgtataaagaatgaaataaatgaaaagacgagaaatcgtcgggagagagtagaggtagataataaattcacatgcaagtggttacgtatgcgttcatgtgcatttggaaaaaatataatacacgtcactaattacacgtatatatacactattatgtcaaatgtatctcactttaattttaactaaattagatacgacttatgatttatagttatttcacattatcatatctactaaaaaaagaaagaaaaatctgtaaccacgagaagctataaactttgattaattaaacataacacgtatgtatattttttgctggcgtggatgatgtggcagatatacaagatctggttggtgcatagatctgctttgtcatcaccaaatgtcgttaatgctcttccaccgtcaccgcccctaactgttttcctcttttttaatttccatctcatgcttcactcacttcgatttgccaacatattattgttaattatgaaaactatcccaatggattgattatttacattttcataattttattgcatagttgttgtagataattttttaaatataaaatgtatggttctggtgtatttttttcatatgcttcatgtttgatttgcattttttaatgataaaaatatattgcactggatttaaatagaaatttacgatattacttacaaataactcgatttgtataaatgcatcatgcatgacaaaagttggctacgtagacgtgctgtgtacggcgtatatacctaaagtatcaatgtattaatttgaaaagcgtcgaaaatataaacttttgttcaaccatggcagagtttatacatatgcacattattcatatttttggtagaacttcgaaattattttatgaacactagaaagacaaagtcatgcatatgatgtcaactcaaattctctattacgttgtttaattatttcatcatcgttgcttcaagaacgaaccagttaattgttagtttatattgtatgactgatataatttctacgtggttggacattttccaataagctattttaatttgaagttaatctcacattgtattattaatagatcccagagttaatcggattaaagatctcatctcattgcaataataataaaaagatcacaaacggttatgaacctatattttcaccatctactttctaaatatttgtctagaaaaatactaatttcggccagtaccatctatttctctaactttggagttctctccaccaatataaatagcgatcttcacaagtgtattttccaccatcctcaagttcctctctaagccttctagtctaacaattttctcaagctttctccaattcaattaaaaatacttaccaaaatg

SEQ ID NO: 9750 - DNA, 3000 bp, Unknown
  misc_feature (1)..( 3000): cDNA_ID_3032821_gDNA_ID_1972177_Annot_ID_180051 3000 nt of promoter + ATG
taaattcatgattttggtttttgacctctatcctacatttgtagttcgtcggagacaaggttgcctatgcacttgctcaaggtttgaaagtgattgcttgtgttggtgagactcttgaggagcgggaagctggatcgaccatggatgttgtggctgcccagaccaaggctattgccggtatgtatattgtcaaacatttaatctctttttgctatctcagttcgttctcgtttacagtgagacctgttttgatgatagtgatgcccgtttctacgcactatactcccttagtgtgtgattcaaaccccacagaaatatttgttggctaaaaaactctttttgttggtaatggcagatcgggtgacaaactggtcaaatgttgtcatagcctatgaaccagtgtgggccattggaaccggaaaggtcgctagcccagcccaagctcaagaagtaagtggttctcgatgcgcagttgcactgtaacgtgttgcatatggtcatgatttaataggaaaaccaatgctgttttccttacgagagcttgtttcgtttatgaacaggtacacgatgagctgaggaaatggctggccaagaacgtgagtgctgatgtcgctgctacaacccgcatcatttatggaggtagatagatgataacacgatctttaattaaacacccctatatagttttctatgttacttagcttgattatgcaaattattatcaggatccgtcaatggtggtaactgcaaggagctaggtggacaggccgatgttgatggtttcttggtcggtggtgcttctctaaaggtacatataatatggtttctcttgtaatgatatctttcgtttgtctctttcaaaaccatgactaatgttttcattcttggtctttttgcagcctgagtttatcgacatcattaaggccgcagaggtgaagaaaagtgcctaatgagctcattaagcaatttaaaagtcctttgcttttccagtcgcaactctgaaaaaatgaataagttggtattatgatatgatacattttgcttcagttgtatttggcaaaagtttctctcttactatattgttttgagaacgcaacaatcattttcttcgccatttatttagctgtggacttgcaatttgcaaatcccttccttttacagtcttctcaactcttcagagaatctgtgtttggagttcataacccctcgggccttttgatcaaacccctatttctaatgtcgtccgatcataaacctgtgtgttatataatatgttgtttgttccattttagactttggtattttgtcatgcttgatctctgaatcatgctgtcaaccactttgaaaatggctttacttgttaaataaatgacgagagaatacaggagaagtgggaaatgactttattttttcccttttatcgctttttgcctattggtctgtcatttttgacattttagcttttagaacattattattttcaactttattgtcatcatcttgaaaaatgtccaacattacgaaattattatgtagagagtaaaaaaggaaaagaaatttcatggagaaactcattgtattaggaatgtcaatgtttgtagaaaacaaaatgcttatgtaatttgagtaaaacggctcagtggaactaaagtgataatgtaaaagagacggttaagtccaaaataagagctcccgtatgtcagaattgttcaaaccatttattaaaaaattggactcagtatgatgaaaatgtgtatggattttgatccgaccacgaaaatccaactagtgccaataaaaactccacaatatgtgactcagctacaaatgtgataacgtattatctcccaagtcaacccacatttctggtgacttatattttatttatttctgagtaatatttaagaaagtagggattgaatttttatgagtattatattatatagttgaccttggacttatttgcgtaacgagcaaacaattgtgaccttagaaatggaggtttgactaagtcatcgatcatttcagcaatagagtaattttgggtccgtatgactcaaaacaagttttggtaaaaaatttctctgttttaaaaacttgtatttataaaacttatgtcccatcccatgatactaaatttaattacattatacgtatgtagtcaagcataattttttcctgaaaaatcttatttttcttacctacttgtaaactttaatttaattcctggttaagtagatatttttcttagttcttacaaatcttatattttcttacctacttttataaacatttttgagaccactattactaaacccgaatctgtttcatcattccacacccaaagcatataaatcgaaaatatctatgatcacatgaatatctatcattttcgacaaaatttgtccttttttttctttctttttgtatccaaccccaccacggcgaatttatttcaggcctattaaagattccaaaatctcatgaccatctgactcagatgtcatatctattaaaaacgttattttgaatcttaaacatatatcattagtgatctttttgcacgtttactcagatgcttaagatcatcaaaatcaatctatgaatttcaaaagttttaaaaatcatacaatagaaaagtcccactgatcattaaattgttattactaattttatttagaactcgtttattatcttttggtcaaaaatataacttttgtctgaattcgttttttttttgtttggacaagaaaaagacctttcttcttccttcggttgcctctaccatctcatcaacacacatcttctctttctcttctctcatcctctctcttcttcagtgtttactttttctctttctcttttttttttctctttattatttcgctttaatgagttttatctgatagaatctgctccacccaaaaacagcataagaagaaattcattgtcagagaaaagtgcaaaaaaaaaaaacgatcttcttcatcattctactaa

SEQ ID NO: 9751 - DNA, 3000 bp, Unknown
  misc_feature (1)..( 3000): cDNA_ID_3032798_gDNA_ID_1972177_Annot_ID_180049 3000 nt of promoter + ATG
tctccgcactaaaacacacaaattacacaatgcataagagcaggaaatacaggcaccacagaatatatcttttcttcctatgaaagcattccatagacaggtaaatcatattacacctacttgtctaaccaggcacgaatccaatcatggtcttactaccaactactagttgttttcttaatcacttaggttacacaattcttataggaaagaagataaagaagaagaacagatggaaaaatcgattcgtttataaacacaatcatattcattttcaaaaccataaatatttactgcatgaagcaataatggtaaaacagcttaaagtatacaccaatggttagaatctcacctcacttcaccagtgaaagcacctcctttcttaacccaacagttttgtgccgcaacaaaaaagtcagacctcaatgtgctcttaaccaggggaagaaaaacatatggagggctaaccacaacctctgcatttagtaaaatttcatcaaattattaatacaagaacaaacatacttataactatcaacaaagatagaaccataacaagtatatgataaagaacattttaactaacaacaaacactagatctatccatggttcctaagaagcataaacactatagaacatcgatgtacattgaaacaggtttgtaattgtatgcccaaaatatttgtcactacttaagatttcatagacatggaaattaaaaaaaaagccataatgtcgtcaaagcaattgagatgctacacatacctacaacatcctgtgaaggaacctgagcttcattaagagtgttcacaatcttcttcacctcctcagcagttccgttctatataagattacaaattcaaatattaacatgttaaaatagtttaaccaacaaaattaacacacggatccaccaaagctagaacacgagatatcaattgaagaaaaattcctactcaaaattttgacaaaaaaaaacaactaagatccggcatagaatcgacaaatctgaaccatatgcattacaattcaaattccaccgctacaaataatgaaaaaaaccttagatcttaagatcgggattttccgatctctttgacttgatcggggaaggatcaagtgacaagactaataataaggtgcgcaatagaaggtaaagatcacttacacatttccagttgcctccgacgaagaactttctggccattatctcaaatttttttcaggcgatgatcacgagagtcacagatacgacgacgatggagagagctgaaaagattagatcgatagtgttcagtggccgttgtctctcgcaggggtcactcatatatatataaataaaaatatactctcaacattttagattggaaaagacgcatatgtctagggtatatgagaatattccctgaacgattaggaaagttgaggatattaaagtaaattaggagggaggatgaaatattatggacgtgttggccaaggtttggtcggtgtaccgggtggggtgaataataagaatagacaacggcgtggatagtgatgctgttgtatgggctttaggcccattaaagcaagcacatcaataaaacccaagtttggttaaaggaaagcctattgagatgattctgaaaccaaattatatttgtattcccttaaagataaattctgtattacgcaattctttctttttttttcttttttttttttggtaaaagtttaaatcgtattatgcaattctatattgtaatgccccttcttggatacaaatagtgtggagaaggagaaaactgttgtaagttctcaagttaaactactaaaccaccatgagagcattgagccggctcacttcaaacattgtggcatacttcaacaaacatattgttagtctaaagggctatcgagtggcatcgattattttatgtgatatcattaaaaagtaacaatggtaatttgttattgcaaaaaataaggatgggatttaattaaaaaaatacaaaattacgtggtttgtgtgtgtgtgcaatgagtgtaaccatgtcattgaaaatgacaataaactgttaacaatgagacatggacgcggatcttcttttcccaaagaaagcataacaaatggctaaagcgtgtcggtaaaagttacttcgaatcagcttcctcaacaacatcttcatacttcgaatctctttgactttggtccgtagtgttcaaactccaaactattcctcctacaaacacgtgtccaatgggccaatggcattatcccaaaccgcgtcgatctctcttctttttcttttcacttaatatttaaccatatacatttcgttgatacatcaatattactaatcgattttttttttagttttaagtttagcagtaaaaactcagatagtctcctttgacctcattaagaacatcttttaataaacgtatccaagaaaaaacaacactcgatctctcttttgttttcttaacttcactttagttcctttttttcaaatatagttcatccgtatctggataaaattaggattgtaaaattacgattaacaagaaagaggtatatttttagattaaacttggatagtatgagtatttaccagccaaaaaccattaaagaaaaagatgacaaattgattatccaaacaaaagcagactctataattagccaaattaattaactaaagtttccacggtcacaacaaaatccactttttcaataatttacaacggcctaaatttaagccgacgcacatgaaaaacaaagacaacacaaacttcttcttttattttgctttccacaaaatccagctgttcctcactaaaaatatacacacgtatacgctatacaaaacggtcatatctattaatttttattataaatactttctcgataagaataaaaaaatctattcgtcgtaataataaaaacacaactcaaacgattcacgggtttcacttggaatcgtttggttttctcatttccgaaatataaaaagatg

SEQ ID NO: 9752 - DNA, 3000 bp, Unknown
  misc_feature (1)..( 3000): cDNA_ID_3032825_gDNA_ID_1972177_Annot_ID_180045 3000 nt of promoter + ATG
acggaatagaccgtgtcctcgtcgcatacgaagcaccctgattcaaaatccttctaacagctagctttgtaacactggaaccagcacgaaaccacaccatttcaccagattcaaaaacaacactttaacttcaattcttaacaattacaataacgcattcaacaatcgtcgttctacactgcacacaacaaacaaacagacacacacacgttaatgtcgtcctaactgaaatgaagtatcaaagagatctttttttttctcaaatcatattctgagggataaaacgaagaacaagagtacgaaagaggaaaatctacaaatcaatacgacctaagattcaactcggtgacctaaacacaatctggatttaaaaaacagtacgaaatctatgaatctgatgaggaaaaaatagatctgttgttggataaagagaaaatgttggattaagaaagcttcattatttccgattgtgaagaaactgaatttgaaaaagctgaatactttaccttggaggaggaggaggcgaagaagagaaagaagaactcggaggaggaggaagaaagggttggtttttaaagttttgccctttttctagaatgataacgctattaattattatggaatattgttctatttatgtaaatatgaaaatatttagaggtttatgtgtaaggaaattaatatatatgaaattatgaaatgtagatttttctttggaaatgtcaaacaaataccataatttgacaacttgaagacgagaaatagaatgtgttagtgatttgctgaatatttttctcttgattttatatagtcctaaaatagattaacaagtcaacgatgtgaataatcaatcgtttactatttcttctctaaacaaaaaagaaacaaataagaaagtaacaaaattataaattggaatatataatgttatagttttgtaattaaatatttgatggtggcctccacctgtgtgaaacgccgttccagaacaaagactgtctttttgtccaagtccagttttctcggtggtcaaagtggcgtttttcgtaagcagattgaaataaatatctacacgtgttataatttcattggatgattttttgtctcgtttttcatatgtaacaaaattatatacgtgaaagaggggtctaaactaaatcacaagacaaattaataaaaggtccaacaagttagtaacagaagtgagcttttttttatacaaacaaaaattaatctttgacaactttaagacgagaaatagaatgttttagtgattttctgaatatttttcaatggacttattggatttgctgtaaatgttatcaaaaaaatacagtaaaatctttataaattaatatataaatatgaaatttgaaatatttagtgaaatataattctactattttttttcaatttgtattaattctttataaagttcaattctaatacttttactatgtcgattttctttttttttttaaaacaaaatatttgtttctacgtataattggtttcataaacattattgattataaagaaaaaactactttttagatcaaatttttgtaagaaattacataatttgtaaaatttctctataaaatttatcgataatttgtacgaagaacgccactttgaccaccgagaaaattggacttggatacatgttaaaatggatgagtttaatctatgtatgttatatacgtgaaagagagggctagagcagaagacaaattaataaaatttcacacaaattaataaaagaaatgaaacaatggcttggaagcaaaataaatttaatgattcaacaaaattttcttgattccgtaagacttaatcagcggtgaaatcaattttcttgaccaagtactcgttttgacaaaacaagccaaaaatccaattacttgtataaggcaagtcgggtcacaaatatcttcaattttgcaagtacttgtcttgtgtccagccctactcatagttatgcagactttgtgaaagagatgaaacagatggctttagcaagaccaaaagtaggagcagaagagattttgtgtgatcaaatagatctagagttactccctaggacaatgaagaagatattaacgtctgaggcggattctgctaaggtggagctactgcaatttatacaccggatggcaatgtggtgtattatgtctataagagttgtaaatccgagtctgaggcgagacaagaattttatctaatctcagtgttccaaggttcaactgtaattgttcaatgcacgggaaagtgcatacataagcttactccgacaacctatggtttccttatggagtatgctactgcaggaacccttttccatgagataaaaaagcatttccatacactttatggagtatgctactgcaggaactcttcccatacactttattcgccgtttcacactgatgatccttcaagggcttcaatatgtacatcgaggtaactttgttcagtggaccttcacagcggtaatattttactctttcatagctatgaaggattagaggcaaaactcagcgactttagaaaatccaaacggattaataaaactagctggtggagccctgtaaatcgccacttatgataaaacttgatcatgtcactagagtccatttctcatggtatcacgaacgaagcacttgacgtatgggctgttggtacttagttgataggtgatcttagatgaccaacatgtaattattttgcaatgttggagagtaaaaatcaaccacggctctcttaaccggaagagtgggcgtcaattggattaacatattctcaatgctctgcaagaaatagataaaaaaatttaaaaatttgactttattagttatattttccttggtataccggataactcgcttcgctgaccgataaaaccgaaccatgacctaaattgcgctccaaattttagcagtccctttcttcatttccttcctctgcttcttctccggtggatgtcctctttcatcaatg

SEQ ID NO: 9753 - DNA, 3000 bp, Unknown
  misc_feature (1)..( 3000): cDNA_ID_2993213_gDNA_ID_1972177_Annot_ID_180043 3000 nt of promoter + ATG
actaccggattggtgcaatcttcaaacgcgttatatccattactagaaggtaagggaggtgttaatcaaggtgattctcaacagaagagtagtgattattccaatcagctaatgtttaagcccttgatggatttttcttcaggcggggttagcgccacgcaaacaagaaatgtgaaggcggaagagaatgatcaggatcggggtagggatggggatggagtgaataacttatcaagaaactttttgggtaatatcaacataaactcaggcaggaacgaggaatacacatcatggggaggtaacagttcttggaccggtttcacctccaacaactcaacaggccatctctcattctaagtactcagcactagctattcttgatgattcttttgttggttggggtgtacattggtgcttgtcatgcgagttattgctgaggaagatcaaaccatgcagctatatccaaaggctaattttgaggctcaaaggaaaggtatggttataaaactatctttttgatcttttaaaagatcttcaaagtgtgagtatgtttattggttggcttctggtgatatttatgttttattagaatttggtcttatatattggctatatatagaggtgtgggtgatatgtatgaattcaagagttgatgttggaaacttttttgtgtgttcattgaataatcatcgaattctcaatttcttggagacccattatgagacattgagacatctatagaacatatatgtaatgtatattaaacgtacttaagtcgaattttatgaccaaagtaaataaattatgccgaatgtacatgctaatatcgagtttaaactattttttccaatataacaactattttctctttcgtccaacttatatactcttattctgattcttattttcttctttttaattcctttttcctttcccaagacacaaaaaaaaaaaaatacagaaacgaaaaaaagagattttaaaaattcataacccacgagaattatgcacctaaattcagactaatcccccaaatttcagaaatttatgtatttttgcgatttaatattgtgttcacaatcataatggccaactaactaattgaaaagacaatggaatgactgaaaccatgcataatctctcaagtctcaacctatgaagaatcatgtaaccaatagactatcatcatgattagttaatgcatgatctataatgtattctttgaacatagatatgtcatttatctggatataaagatggcgttttaacctactttgcaatttttgttatatctttcttctaatacatatgatcaatacacttttgtttttaaaagaaattaaaaacttatttcaaacatcgatcacaacatgacatagggtgaatctacacctaaattgactacagtagttagatatatatacttcaaattttaaatatagtgatgtacgtatgtaattggtacttcatattattattatgatgtatgtaattggtacctatattttggaacagaacaaaaaaagaagacactaaacgagctaaagaacaatggaaatttcagttataaggaattgtgggataagggacaaattaaactaacgtaagactagcgcgcaggtctatatatgtgtcaaaagcacggacttatataggtacatacatgagatacaccccccatacacacttatacaacacattcatgaagagagtcatatttcattttcttttaacgtattttttgggccaatccattttgttttcgctattattcggattctatatttctagctccctattaatatgaaattcattaatcaataaaaacgttatttgtaaagatagaaacgttttcgaggaatttctcccgcgacatcaagtttacatattgcggtatcaatacacattttctgaaaatagagaaatgaatttttatcaaaagctgaaagaaacagaagttttttattgctaattacaaactgatttataagcgttaaaagtgaaccgaatttgagtgtgagtggtagcctaatgagtggtgatctccaagggattgtggaatctggacctttaggatctgcttttgcaaaaaccaatgccctcaaaagaaagcgtttatttcccaaaatcatatcactctcttccccattagcattagagttaagagaagcatatgtttaagtctcgtcctcaatacatatcaacgcaactttaggcccaaaggtcatctttcaattagtgcaacttctttttttccttgctctattctgtttttgaatgtacgtttttcatattacggtctatccgaaatagtcgctcacgttcttccacatgccctcaaaccatgacctcactatcttctttttcacatgataattttatgagatattacctttctctaatgaataaactttattctaattcacttttgattcttttccttaaaccaagtgcgatcggtttctgaattattttattggaaatttggcaaagatagagctttgttttgggcttgtttccatatgatctctagtgttcttgggctccttccaagattaggcaagtccagtctcctgctcatgtagtagttggatatatctcttctctgggatacatacctaatcggttttgatcttttgttggagattgttcgggtccggtcttcggcttcttcttttgtatgtaaccaaaccgaaattgaaattgtacatctctctctctctaactggtatattggatattttcctctaattcattatttccattgacaagatttttcccttaatatgaacaaacatattccattttagctttaaatcacaaaaaaaagagataaatttctcaaaagaaattataagtagacaccgccctttttataaacaaccctaaaagtagtaaaaataatatcgagacgagacgggtttgtttcttctctctatctctatatctaccaaaatcctttgccccccgaatctagttctctcgatcgaccctgtgacg

SEQ ID NO: 9754 - DNA, 3000 bp, Unknown
  misc_feature (1)..( 3000): cDNA_ID_1010051_gDNA_ID_1972177_Annot_ID_180044 3000 nt of promoter + ATG
gtagtgcgtttctttttccctattcatgaatttgtcttttgcttatttcaattgtgcattgatttggtttcaatttgttatggcattggctaaagcttgattctttatgattggttctgttgtgctactttgctccactcattggataaaacattaatgacttgttttcctcgtctgctgtttattcatagtgatgaatttgttatggtaccaatatttacattgcattgaaacttttatctctctgattgcagtgaaggtggcttttttaatgcaattatgtcgtttccggagaattatccagtttcaccaccaactgtgacgtttacctcggagatgtggcatcctaatggtgactgatttttctggaaaatatatctctttctcgagcttttaggatttagtcttctgatgatttatactcttttgactgcagtttattctgatggaaaagtttgcatttctattcttcatcctcctggtgatgatcctcatggatacgagcttgcctctgaacgttggacccctgtccatacggtatgttttttcttttaccgtttagcttcagtactctggtaatttgtttgcagggttgagttatctatggcttcgaatatcttggggtctgctttatagcctaacattcttcgaatacagctagctttctcttgtgtagatagcttgtagaaacagacatgttttgttcgatattgagcttatacagtgattgcttttcaaatgttcgtggaatttataagtcaggacttaggaatactctggaggatagtgcaacttagattgaacctctgtcgttagggtgcttgagtggaatatgattcactttctgatttatctgccctgtaccacctcttaatcgatagtgttcttattagatcatgaggaaagaaactagaggtacattgaagctaatgttgggtctgtgtatgatatgcaggtagaaagcattgtgttgagtatcatatcgatgctctcaggtcccaacgatgagtcaccagcgaatgtggaagctgcaaaggaatggagagacaacagagcagagtttaggaagaaagtgagtcgctgtgtgagaagatcgcaagagatgctatgaacatctctccagcgtttttttcgtgttgtagaaatatcgattctaatcttcttatgagaaagcctaagcagaaccaaccatcttcaagcagcagccagatgaatctgactttgcaaaagcttctctttctttttcctttttgggttttgttctctaaggtttggtttggaatattggtgtggaatcaaatccgctccatattttaggattatattattgcactcgttaatggattcgtttgatctggctttttaactttattctggttttgggttacaaaatacttgcctcgttaattatctcaaatttaactgatggtggtttaactgcaaaaggccagaagttcgaaaagagtattgttattcagttggtatgcaacaaaaaattgtggttaatggtttcaactgatgttgccgcggtcataagaaacaaaacaaaaaatattccttgaagattgcggggtctagcacacgagctcacacataaaataagataagagcaacgagaagattatatttttaaatgtcctaaccatatataatttaacaattaagggatcaatcataaatttattcgtatttcagttacatgactggttaattatagcccaaattttttacaattaactattattatattcatatgctaggtttctttcttactcattattggtccactcacatcttccccaaacaattgtatttaagtttttttcttcgaaagttatcacttttagttagatccgcaaaatcgtggatctccaaagctaaaacgaaaaaaaagaaaaatagtctataagtaaaacatgataccgaacaaaacaagagtatataacttatagactataagtaaacaattaaaacaataaagaaccaaaatatgtgaaccaaattaaaattagtgttaaattttgttttggttattctcgtgaaaaggaggaatagctcgaacgtcattttcacactttctttaacgactccactccagcattaattacccaaacagttctgttgcaaaaacatttaaagagagaccagcaaaagttttgagttattgtctcttttgtgtgtacctaatccattttttttttttttaaagaagtaatattacggagtatattgctttcttaatgatatgtcagaaatgtcccgtgtaagtaatatgaaaaccggttttcaaatcaaagtgcactttctctagctcacctgtgtttggtcgaactcgaatccctctgaccactactaacgtaaaaaagctcattgcattaatgtttcgaccgtttcatcgtttattatactgtcttaaattaaaatcattaagcatttaattgatttgtcatttcgaaatttatgttgacaaaaatgactttacgatcaaaccggtttgattaagtaacgtagactaatgctattatggtgatatatatgcaaaagataagaatagtttatcaacgaaaggatctataaattatgcttgttcgacttcttagcatagaaaattggtaatttatttacacctcatgccgttaaaaaatcacaatcacaagtattcataacctaaaattcaacaaagaaatcaattacgtattcttcatttttccacattaaaccagaatcttaaaccaaaccaatccaaaaaagcgacatttaaaccaatccggttatcaaactatctctctctcactcacacacctttctcttttcgcatcactttccctctcattcttctttcttatctctctctctctctttctctgactctctccttgatgcctcgtgactgcaaccaaagcaatttaaaaccgccgcacttctcatgagtcttcttcctcatcatcatcatcatcaccgttaactgtaatttatcttctccgatcttcattctccgcc

SEQ ID NO: 9755 - DNA, 2083 bp, Unknown
  misc_feature (1)..( 2083): cDNA_ID_2185570_gDNA_ID_1972178_Annot_ID_180087 3000 nt of promoter + ATG
aagcttgaagaaatcaagctcattgcgaagagtgtattttgagtgtgaggaaaatatgaatcgtatcaaaatcgttttatttatttattgaaagctcatgtacaaggagaatgagaacatgcttctacagtttttgtcagtataaattggtaattatttgagtactttgtgtatttttatggaatagctaaatactttatatgtttttatatttttttttgacatgacataagtaaatatctaacaaaaataaattctcaaatttgagtctctatataaaaataaaaccaataagcaaaaaatattaaaatctaaaaaccaatggagaattaaactgtcttctactaacaaacccttatttctttttcttcttcacttaattaaaaatagtaaatgtattattagataatcgtggaaaagtcagaaggaatgtctctcccctacacctccgaaaaccaagaaatacgagatttgaaaaatagaaatacaaattgatagaaaatgttagggccacatctactcacgaatacgcatctccaaagtagcatacttaacaatttccttatccttgattatgagaatagaaaaataatgaaaacttcacatacttttcgtcgtcgtaatggcttcgttttgcttcttgttctgattcatttttctgtgtttggtttctcttcaaatatcgatgtttcttatagagcaagaggcatcaaaatcaacggtgaccaaaaacgtgttctctcgaattccaatcaccctcgcagcgattttcggaaatctcttcaacatggaaaggaacattcagcatgtacgaatcataaatctgttcgaggtccaataacgcgtattttttgccaagacggatatgttatcaccaatatcaattttgccgactatggaaatcccactggtacatgtgaacactttagacacggcaaatgcggcgcaccagctactttgaggcttgtcaaaaaggttagcagaattaactagcgttaatatgttatgttggttttcttgtcaatgaatcttatcgtacgttggcattgtttatgcagaattgccttggaaaaccgaagtgtgtatttttagtgacggatgagatgtttggtccgagccattgcaagggacctcctacactcgcggttgacgccacttgtacaaaaacctaggtttcttattcctacttaagatttttgttatagagattgttttttttttctctttctctcgtttcaatcaagttggtgttggtcattgtatttttcaaatttcaaaacataagcaaagttagcaaaccaagcttttgcgttacatgtacaatcctatacaaactcgattgacgcttacgtaacgtttgtgcatgtatacaccataatcgtcaatgggacaaatgttttggaaaatgttagttttaccaacacaagctagaaaagttagcctgacacattccctagctaacattagaacaactagatagactaataataaaactaaggaaataattcaaaataatgaatataattgtgaaatctagttatagaggtaactggatttcaatcccaattttgaaatcatttatttcgtatatatagtacattataattatcattagttgggtgggaatgtaagaacacaaatgagctgtcatgagatacataaattaatggataatattctgacatttatacaacaataaaacacttagcagaggcataattctctaaaatttaactaacagctagagataactgtgaaacaaattaaactcatcacgtctatgaaaatagaaaatgttactaattccttctctttcactggagaattaaaactattaataaataatcgtggaaaagtcaacaggaatgcctttcaccaaactcctccgaaaaccaagagaatggaaaaatatagaactacattgagaggaaatttcgtggccacatttacaaacgaattcgcctctccaaagtttgattaatctaagtttaacgaaagcaaaagtgtaactacatccataagaagtctacttaaacaaatgtcaataccttgattttgataacataaaacaaaaacaaaaatg

SEQ ID NO: 9756 - DNA, 3000 bp, Unknown; identical to SEQ ID NO: 9649
  misc_feature (1)..( 3000): cDNA_ID_3042826_gDNA_ID_1972178_Annot_ID_180114 3000 nt of promoter + ATG

SEQ ID NO: 9757 - DNA, 3000 bp, Unknown
  misc_feature (1)..( 3000): cDNA_ID_3032859_gDNA_ID_1972178_Annot_ID_180112 3000 nt of promoter + ATG
tgcacttcattgggtctataaatgttgaagattgaaatttaagacttttaccaattacaatacatttgaaaaaaaaaaaaaaaacgtttgcgtttctcacaccatcaaccttacatatggctgttatatgagcctcgagagacttggctttcttcaaacacaataaatagatctgaacgaaaaaaaaaaagatgtgaacgagttaactttattgattcaaaataatattcagagtcggctaaaaggctttagataatgacaacttcttcttctaccacattcttctagctaggtattaataatattattccaataataagtgagaagttttgttggtgaaaaaaagagaagagtaaaataaaaagaaactttgaagggaaactttgatttggtcaaaagccaacgacatgcattggctctatatatatgtgtctttaagaactcatttattactcttcacttcaatcaaagacaagaagaaagttagccagaaaaaaaaacagataagaaaatgtctatctttctttgtttcctcttacttcttccactctctttaatcttcttgaaaaagctcttaccgtcgaaagggaagcttcctccgggacctaagggtcttccgatcatcggtaacttgcaccagtttggaagatttcttcacaaatctcttcacaaaatctcccaagaatatggaccggtgatgcttctccatttcggggtggtccctgtgataattgtctcttccaaagaaggagctgaggaagtgctcaagactcacgatcttgagacttgtagccgacctaagacggtggggagcgggttgtttacttacaactttaaagatattggttttgctccgtatggtgagaattggcgagagatgaggaaaattgcggtttccgagctctttagccagaagaagctcaaatctttcaggtatattagagaggacgagagccaattgttggtccggaaggtatcaaaatctgctcttgagacaccaacttcatcagttaatttgaggaaggtcatttttaccttcgcggcaagtatcatttgtagactttcttttggacaaaatttttgcgattttgtcgatatggagacagtggaagagttggtgcttgaatcggagaccaacctcggctccctggcgtttgctgacttcttacctgcagggtggatcatagatcggatctccggtcagcattccacggtgatgaaagccttttccaaactcaccaatttctttgaacttgtgattgatgatcatttgaagagtgggaaaatcgaagatcactcagacatcatcagtgtcatgttggatatgatcaacaaacccaccgaagttggttcttataaagtcaccgatgatcatctcaaaggacttatgtcggtgagtataaataatacctttagtaaaatcttcaaagttctacattagaggtaacttgagggacaatattatagcttggaaagcaagttaacttataagtataggcaaatataccgttttgttcttatttttctgacttggttcataatgctccctagatttatattgatgtcctattttaaaaccaaaatcatgaattattttccatgtcattggatcaggatgtgtttttggctggagtgaacgcgggttccatcacaatgatatggacgatgacagagttaagtagacatccgagagtgatgagaaaacttcaagaagagattcgagcagcgctcggacccaacaaagagaaaatcacagaagaagacctcgagaaagttgagtacttgaagatggtgatcgaggaagcattcagattacacccaccggctcctctcttactcccaagactaacaatgtccgacatcaatattcaaggctacagcattccaaagaacaccatgatccaaatcaacacgtacacaattggacgtgaccccaaaaactggacaaaacccgacgagttcatccccgagaggtttgtcgataaccctatcgaatacaagggtcaacattttgagctattgccgtttggagccggacgtagggtctgtcccgggatggccacggggatcaccatcgtcgagcttgggcttcttagccttctttacttcttcgattggagtttgcccaatggaatgaccactaaagatattgacatggaagaagacggagcttttgtcatcgccaagaaagtctctcttgagctcgtaccaactcttcatcgctggtgaagcatgcaactataactatgttaaataatgacaagaattctatatttatgtccactttactaccggtttggattttgctttgttcatgtaatccgcatgtttcatgttatctttcaagttctgtttttatgttattgtcaaaaaaaaaaaaaaaaaaaactgtttttaagttgacaaaagaaaaaaaaaaaaggttgacattacattacattaaagtatttgactcccgaagatccagggtttgttatgataaataattggttttcaaaagtatgaaggctactttaagttacttgtagaagaccaatactacgtagtcaaaactgctctaatgcttttcattcaatgattgaaccgtgttattaattagttaattagatgtatccaaaacagtttaattgaaaaaacatataatagtaaaactttaaaatttggagttcttttcttctaaaacatatagttattggagtaaacatccaaaatattatgacttttcatattctgttattagtaaattttgttttataattattcttttagaacttggagacataatataaataaacaaacctgacatttcgttgataatttttttttttttttaaaccctagttgaagataaacgacgtcagtaatcctctgcgttttactctgtttttgagcttgtctttgttccagttctctgtttcgatgttcttttatctttatttatcatcatcagctaaagaagttctcaagactcatgacctagagacatgcactcgacctaag

SEQ ID NO: 9758 - DNA, 3000 bp, Unknown
  misc_feature (1)..( 3000): cDNA_ID_2185638_gDNA_ID_1972178_Annot_ID_180111 3000 nt of promoter + ATG
tcacaagcaatacatatttctctgaaactaaacacaaaatcaaagagttttgtggacagaattcatttaggcatatcatcgaacacttggtatgcaatatataataagctttatatcttgagtcaaaagctaatgaatccaccattgactatactacaaaagctaatgaattgataaaaagcagtttctaaattccaacttctacaatttcaacattgtttgtaaacgaaaattacataactttacctattagagaataaaatgcttcgaaattgagaagatgatgatgttggagacgattacggagagagacgacggtagtggcctcaaaacaacgccggtaactatgagatcgatgaagaaacgatgctcgtgagagagagaccacagaggggaataatgttttttgcgtttcataaatgaagaaggaaagaaaaacccatatattatatgcacatatatttaatatgtatgtataagtataacctaacatgtaaagtctaatacttcttgactttttagtcgatcagattttgacacattttttgaagaaaagtctatacaatctctcaagtcccaaaagtcaagaccgaaacttttgagacaactacacgttacgagtttttttttttttttggtaaaatataaagtatttatatcattttcaaagtttcgacaaaaattacaaagagtacaagtagcgaaaaaataccagaaatctacagaaagaacatacaatgacaatcgttggtgtcagttttgtcttccgttgttgcttgtttgtggctcctcatcaggttcccttttctctgttacagtggttcgatgttggtgttttgattttgtctttcagtttttggaggtgcatgtcttgtctgagcggagatttcttgagaagaatagaggcggcgttttggtctatgtggcattgcttatccgtgagagctggtttttatcgtttttataagaatggcgaccggaggtggtttctctagttttccgtagatgctcttataaccatcggatttgtgattaagtccattgttgtcatcgcgtttttgcgttagtttgcggagaagctgtatgctcttgatccggagattttgtggacgggcctctagttgggtttgctcgtgacaactaggatgggactccagctcctttgaattgtggaaatcacgcaaattttcgagtttggcatttcggaatcgctgtttcttcttttgtttccgctctgcacgttacgagttatctctctgaaattttacacattgcaagagaacttgcgactttctaataaaaataaatcgataatcgcttataaagtcaatatataatttttgaactgaagtacgagatcctaaaattttcatagattcgtaaagaaacaattgaattgatattgtttatataacgcagacctcgtcacgtacaattttttcgcgacgttgtttgaccaacgactccgtatatatggggtaaacctcctcatagttccgtacaaatgcatcctttttaaaacgtttaataattgataaaatcaaaaactaattaaattagtatcaatatcgcattgaaaaaaatgaaccgtaggttacaaaaagtgataaattggatcaatttggaatttaagaggactatcaaagtagctgtctggtggttgagcttcgttaatggagtaatagatagcaataatacaacgagtttctatcaaaataacataaaataaaataaaataatggaacgagtcttgtaatgattttttttaaggttaattttctcatccatcaatttcagataacgatcgaatattcatatacagtacatcatagagaactatccaaatatagttgtactccacaaataactgttaaccgtttatatgttgtgcaacaaaaaaacagtaacaaaaaatgtacgcaaccgtctataaatagaatgataaacgataatcattggcaactacttttgtatatatagtttctgcaaaataaaaatactatggtagtatatgttttcatgatgataatctacatttcggctaggttttcttatacataaccaaatcatgtcccttgtcaaaactacatttaggagattagatttaactacaatatggtttggttggattttcatttgattagatatatatatatatatatatatatatatatatatatatgtctatgtaattttatatattagaaaataaatctgctatattgatttaaaaacaattatgccccaagtacaataaagttagatttgtattaaaatcagatatttgttttaaatttttttttctttcaataatatccatttaatcagattggatttccgaaaatagtaacataacaataacgttaactcaaattattaaaatatgattttgtttggctaagaaagtatgctttgtttttagtttggatttgttgagtatctcgattttagtcgtcccgccagaattgttccaacaggataaaatgtgctgcacttcattgggtctataaatgttgaagattgaaatttaagacttttaccaattacaatacatttgaaaaaaaaaaaaaaaacgtttgcgtttctcacaccatcaaccttacatatggctgttatatgagcctcgagagacttggctttcttcaaacacaataaatagatctgaacgaaaaaaaaaaagatgtgaacgagttaactttattgattcaaaataatattcagagtcggctaaaaggctttagataatgacaacttcttcttctaccacattcttctagctaggtattaataatattattccaataataagtgagaagttttgttggtgaaaaaaagagaagagtaaaataaaaagaaactttgaagggaaactttgatttggtcaaaagccaacgacatgcattggctctatatatatgtgtctttaagaactcatttattactcttcacttcaatcaaagacaagaagaaagttagccagaaaaaaaaacagataagaaa

SEQ ID NO: 9759 - DNA, 3000 bp, Unknown
  misc_feature (1)..( 3000): cDNA_ID_3032855_gDNA_ID_1972178_Annot_ID_180108 3000 nt of promoter + ATG
gtttttttatatattaacaaaagaatttattataaagaattaaaaattccttaggcatctattatttttcaaaaaaaaaaaattataaaaagaaatagttggcaagttcggaacatctagttggtaagtttgttgtcaccaagtgtgtaaggggtttgcgttccaaaacataggttcaattttttcttttcgaggggtttttattgcaccggaaagatgtatgagctccgtccacaactcatcaattaaccccaaaaaaattgttgttggattgatttttaaggtttgtatgttgagaaaaataaacaagttattcagccgtatttataattttttttgaaaaaatattgaagaaaatattaaacttaagtgatgatgtaggaagaaaacatcagttgattgatggtttaataatctgcctcgtgatacatggtgttatcttaaaatggtctctcaattagtctttgtatttgtataaaataaggcctaaaaatatcatcaatggggtcctgttaaaaacaaaaacagatacacctttcactaataaaaaaaaactgttaccgacaagtcaaacaatatctgcggacaaaaaaatgaagaatgtttagtaagaaatagaagatgtggtaaagagccatacacacatgcaagtgtttttcaatgaacccatcttaccaacccactacttctttgagccataattgtttggttcggagaccctttacatttccgtctcagctttatttgtttacgcattgatttgtcttaaattatgttagatattgttttttggctatttattagcagcaatcaagttaaaagagtggttcgatatcaccatcgaactctcctttagatattttctatataaaaccaaacaaaaacaaaaaaattggtccgatcatctaatatacaagttagacgatttcacgttatgttattacaacctacaacaaaatagactatgatcgaaatcatattgaatcttttacctttcaacgtaatacaaatctggctttacaaagcaataattcatgtttgtttgtctaatttaaatttccctgttttttttcccctctttctgtttcccatttgaaagtaaaagatcatttaagcacctaactcaattttattttattttaaacacctaatgtcatgctccttggctccttgtaattagttgatcgtttcaatttagaccagcaaaacattttagtatgttcgtaaatattgcgtacatgccatttcgtttgtcatgcaaacggtgtgtgtttctttacttagcttctagttggtgtatattgcgtcgcattaatatcggtttaccttcctcctgtctacgtaatgatatattctccaccacaaatttaaattcttattgaaatttcctaattttttaggtagctcaaggtctcaagtatactacgtaccctatttttttgaatatctatctatattataacaagagtttttctgagctagttaatgagatgacaatattctacataaataaatgaccctcgaaagtttcaagtactttaggatctgaccaaatcggggtaaaacattttgaaactaattacgttcacatctaccatcgatgattgacaagcttattgtcaccttttatgttaaagtgacatggtcttgacgttaatttgcatgttattctacatctatagtccaaagatagcaaaccaaagaaaaaaattgtcacagagggttcaatgttacttagatagaaatggttctttacaataataaatttatgttccattcttcatggaccgatggtatatatatgactatatatatgttacaagaaaaacaaaaacttatattttctaaatatgtcttcatccatgtcactagctcattgtgtatacatttacttgcttctttttgttctatttcatttcctctaacaaattattccttatattttgtgatgtactgaattattatgaaaaaaaacctttacacttgatagagaagcatatttggaaacgtatataatttgtttaattggagtcaccaaaattatacaaatcttgtaatatcattaacataatagcaaactaattaaatatatgttttgaggtcaaatgttcggtttagtgttgaaactgaaaaaaattattggttaataaaatttcaaataaaaggacaggtctttctcaccaaaacaaatttcaagtatagataagaaaaatataataagataaacaattcatgctggtttggttcgacttcaactagttagttgtataagaatatatttttttaatacatttttttagcaacttttgtttttgatacatataaacaaatattcacaataaaaccaaactacaaatagcaactaaaataattttttgaaaacgaaattagtggggacgaccttgaattgactgaactacattcctacgttccacaactactcccatttcattcccaaaccataatcaatcactcgtataaacatttttgtctccaaaaagtctcaccaaccgcaaaacgcttattagttattaccttctcaattcctcagccaccagccacgactaccttttcgatgcttgaggttgatatttgacggaacacacaaatttaaccaaaccaaaccaaaaccaaacgcgttttaaatctaaaaactaattgacaaactctttttgcgactcaaaccaaattcacgttttccattatccaccattagatcaccaatcttcatccaacggtcatcattaaactctcacccacccctcatacttcactttttttctccaaaaaatcaaaacttgtgttctctcttctctcttctcttgtccttacctaacaacaacactaacattgtccttcttatttaaacgtctcttctctcttcttcctcctcagaaaaccaaaaaccaccaacaattcaaactctctctttctcctttcaccaaacaatacaagagatctgatctcattcacctaaacacaacttcttgaaaaccaatg

SEQ ID NO: 9760 - DNA, 3000 bp, Unknown
  misc_feature (1)..( 3000): cDNA_ID_3032866_gDNA_ID_1972178_Annot_ID_180106 3000 nt of promoter + ATG
ccgggaagtaattgtgtgggcatgatcttcttaagtggatacctcaattctgaaaatgatctacagaagtataacaaatggatgaaagatgtcgacgaactaaattgctttgattttggattattttttgttttctgcataaaatattttttttataaattaataatttcgaaaccgtgaaattctattaatttatcgataaataaatatatattatcagtttgttattgtaaaactaaattagtacaaagaaatgattatttttaagaacatctataacaagctaagcattcaaaccttcaaatttgaaggtttttttaactccaacaaactctcaaacccttattttttgaggatgtgaataatgaagtttcaaatttcagggtgcatactattcacacattcaaaatctcttctaaattttattttagtccttatacttaatatatcttacaaataattctattacatttaattatgacaaatatatgcatataaattcaaatatattaaaatattaaaaaaataaattaataaatttatacaacaataatattacattgagcatatatgaaagcattatagacataattacattgaatatttttgtaattttacatgtaattttataaatcattttaatgttttatgttatgtttcttttctaatttatatttaattttatataaaaaattaaaatattatttaacataattattttgataatatatgttttatatttatttatgaaacttttatcattatcagtgattattgttactattaaagactataatgtaaataaagaaataaaaaataaatttgagggagtatcatcggtggagatcaccctcaaaccttaattttaagggtttattaccttcgtagataacgtttttttattttgtttttttcatctattgccttgttggtatgaaaggacctggtttaattgatgtcaagaaaagaacccggtttaatttaatttcggtcagattcaccaatctcgaatccattctctcgccgtctttcaattctccgccatcgaacgaaacacagaatcttcaggatgtgacaacactggattcctccgccgtcttctccttcggtggagaagcgattcgaattggaagaatcggttggcttgacattgattcaacgatgaggctccttcaagctagtcccggtaatgaaaaagtccttattgctgcatttgcataataaattgttgcctgatatttcttggagatttggttacttgctttagctttttgatgcaatgatctatagtagttagtgggaatttggtgaaagaatgtatctttcttttacttgcttggttagttcaggggatacatacaactaatcttgaagtagctattgtagtactttaaggaagaagctttactggtaatccaaagcatggcgaaaactaactgtaaagtactaattttaactacacctaatttccatactttctgtttatgaactcactcttatgagtgttaaataccattcattcatcacatgtgcacacctcaagtcttatcaaaaacatatatatacttaggattacatcacaaaagcagaaaacataggcttaatatccgcttcatcacatcacagtctttacatatactgatatacacacatatacacgtcttaggagctcctttgtcccaagtcatatcttttttctcgtgttgctgattctaacctgttccatcttctccaccaccaccacctcctcctccgtttgcaccccaattgtcaaagttttgtcttggaatgttatggtggttgtctactcctcttgttgatggaatggcggatctgtccttctgaacatggtgaagcctctgatcttttgtgtatatccctctccctcctccctccacagttaaagagctcataaccaccattattaccagcaccactaccaccacgacatgccttgtctgaatttgcatttttgttttgtcttgtttcatgcaatagctttcctttttatagaattgagaagtaaggtttaggtatgggaaatcttgcaactgttttctgtgtgttccactaggaaaagacaaaacaaaagattgattgattagcctttaattgatgtgtttgtttgttattgttgtgacttgtgacgatgatacaaaaatcaaaagaaataataatcactcatccaaataggaaagttccaccgttaaagtggtgaagacgacataagaatcaatgagaagaattggttagttgcccgaataggaaatttccaccatttctagtggatcacctttcttttaatcatagacttttatatttgtttgtgtaattaaaagtcaatgggatggtaacaacttacataaagtaaaatttcaagcaatttacataattttcattcaatgatttcattcttctttctaatagcatgcgttgatagccgaacaagttgatgacaagtgtcttttaatctaacccacaaagctaccatctgaattatctatggttaaatgatcagttacaaataattcacttcgctaattacatcaaaagatttggtagagacaaatcattcagagaaagtaaccatcatgatcatgcattgggtctttgttgggctgcttaaagctcgtaatgaagctctgtcaattgctcttggggcttaattttattttggaaacggcttagtattatagtgaagaaaatttatatggaatgtaatgtatttttcaactccttaatatgaggataaccatgtgagtttcttcgtctatctgaacactttttaagcatagtttgcagagtttttaatgtttatgtttatatttaaattgatacccattgattaattacaggtcatctatttctactgctgtgacactcttttgacttcatcttcgtcttagcacattgcatcacatgccttgatgtctaaactataaaatgactttgaatcatcattacatttgatatttgcacttaatgtcttcctcgaagtta

SEQ ID NO: 9761 - DNA, 3000 bp, Unknown
  misc_feature (1)..( 3000): cDNA_ID_2185586_gDNA_ID_1972178_Annot_ID_180091 3000 nt of promoter + ATG
gatagttaaagagtttaaagaatgccttactcaagtgctcattgctaccgatgtcattgcaagaggttttgaccaacagcgggtaaatattgtcctttgagccttttcctttcttctcgttttacctcaaagatgcttcgtagttaatacctcttgttggttatatacaatacttgcaggtgaatttggttgtcaattataatcttcccactaaatatgaaactggagagccagattatgaggtgtaccttcacagggttgggagagctggccggtttggtcgcaaaggtgagttttgattcttctttttttctttctcaagtgtttccataagttcttatcagtttctgaactatgtatttgtattgtaggagcggttttcaacttgctgcttgatgatggctgggataaagaggtgatggagaagatcgagaagtattttgaagcaaatgttaaggaggtattataagatttctgaaaactgctatatatctttcaagtgtttgttaaaacagtatccaacgattttaaactttgctgcagatcaagtcgtggaactcagaggaagagtataagagtgcattaaaggaagctggcctgctggacgagtgaggaagagagacagcatgtgttcaaaccatcttaaaagactatgtcgtctgttttcttgagattgttttaagaaagaaacttgtatacctctttgaggttttcttgtaatctttttatctgattgctgagagtttcagactttgtagattttttgttaagggaaaaggaaaacattttttatgtcaatgtcaatcactttagtatgaacctaaacagtaaacagcaaagcattttttttacaacaatgggtaagagtcataatacacaaccaaagtctcgaattcaatgtgtaaagctttttaatctcaaatgtttgacgttttagcggcaagatggatcaatgctcgtcgatgataggtagtacgaagcttcttgtatttctgcacaaatgctgctgtatcaatctccttctctaggaacttttcttgcagggcttcggattcttcatccacctgattcatagcctctgcaaaacaagtaaaaggtgtttagaacagtagagaaaatgagacgaggggagaatccattgcaatggtaaattgttaccttgaagtttatgaagaagagaaccaggggagtagaatttgaggatctcttctttttgcctctcaagctcattaagcttttcttgcgcagttgcgagctcagttgtacggataattctgcactgtaaaataagtaaagactggtaaatcagagatatcgaaaaggtataacatggtaaaactgaacaagaaaagttggttcttgatacacacttggtttctgagctccattatctgtggctccttctccaagttgtctcctgttacatttgatcaaatggaaagttctagatttctggattgaactaaagtttcctgtagaattacatgaaccatagagtacttactagctagctgcaatgtttctctacggagctcatctttgatctgacggacagaaacaaatcacgaaaaaattaacgtccagagactataacaaggaaccagaaagctgatgacatgatacaggctttatcaaacaatatcaatgtatagacttgaaagagcactaatgaattatatcaacacagaactaaagaagctacatattcttagagctacagataagaccctcggttatccagaaacaaccgactgttttagagactataacaaagaaccagaaagctctaattactggcaacatgtagaagatgacgccatgataaaggcttcctcaaacaatatcaatgtatatacttgaaagagcaccaatgaataatatcaacacataactaacgaagctccattcttaggactacaattaatagtaatactcttagctatccagaaacaactgactgttttagagacttacattattctggactttgacctggtcaagagagagcagaaattgctgatacgcatctttgtcagagagaagcttcctgagttcatccacgctacagaaaagtatacactattcaaaaagaagacatacaaaaaaaacgcacactcgagagaaggataacaaacaaacaaacaaaaagagcaaaccttttgtctttcaagaagacgataatgccagctgcttcacccggtgatacttgtgctgaaatctgacctgaactttgaggccgggatgagcttggcgagctaactaaagaaggcgagtaccatggcgactgtgaagaagcttcctgaggacgagattgcccttgttgttggtcttttgatccccttcacgtacacaacaaaaaaaagaaacatcatcaactaactatctcagcttccaagttaatataatacatcacctcataaacttgaaaggtgcatttatacagcacatcattgtaaacctaatatcagtaactatgaaccctaaatcagtagctgagcaaaatctacacttgtcaattcacctcaaaaacctcaaatatatcattatagctcaacaaactacacaacaacaagatttccttaatcgctaacagacctaatgtctggatcacgcaatttcatcaataacatatgaatcagatggcaaaaaattcgcaaaatcataccagaaattgaacatcgtttctagaattcgccgactaacgaaaggaattgactttttcttgttctcttgtacttcttcttcctaccagatcgacaaaatttaacaactttacagaaacagagtttacagagtttcaaagaaaattcgatcttctctgtttcgtttcagattttgctacttgcttttaaaaggcccaaatacgaggaggcccatattaagttttgattaacaaaacgtagtcgttttatgcatcgtcgtccttatccacgcgtaacggttcgcgtttctacacagagtcaaatatttctgcacggaagcttcgaaaagaggtcatca

SEQ ID NO: 9762 - DNA, 3000 bp, Unknown
  misc_feature (1)..( 3000): cDNA_ID_2185598_gDNA_ID_1972178_Annot_ID_180095 3000 nt of promoter + ATG
tctggaacaagtctaatctcacccacacctgtcaatttagactcttctgctggtccatcagtaaatgaagtcatccccattgatgcaaaggtcagaccaacgccgttcttcttcacacttctgttaaaacgctgcgcttgaacagcctgaaacaatacaataaacagaattctagttaagtttttgtgcttctaaggaaaaatcgttgaggtgggaaacagaggttttttctttagaagaaaccaaaaaaaaaaaactcacacggcatctttgttgtccagatgtatcaacccaaataatgcgtacaaaagaactactatcttcttgaacatcaggctcctttatcttcaatttgggagatattatattttgtggactagaagaatctgtgtctatattaagcttataaaatccaatagaatttcgtgagaatatgtctttagctgcatcaatagcttccatgagtgagagatcaccactggcacaagcatcactcagaactaagaagataacctcacgtgctttctttgcacctgcaaaaaacagcgagctatgttcaagactgaagcaagacgatttcaagtgccaaagcttagaaacaggattggaacatatataagtatgttacaaactatagaaaagaggtagaaacttgagctaacctaaatagtaggtctcaggagatgcatacccatcagtgctgaacataacctgcaataatatcttatggttactcatgaacaataacaaagataatgcaagtaaaataaattttaccttctttattgatgctaagtcaaggagctctttaactgaagaaaccataccatggacactaagctttggaaccgccaagccgaaatcaaggtaaaccttaaggaacaagaaaataagttaatgactaggcatgattttacagataattgaaatgggatgacgaaaaacctgaggataaactgaagacagaaaggatgcttcctttgagaatggataagctgcatgaagaagaactatacgacactttccaaatcttttgtcttcaagaagggttctaaggtgaagaggattcgacaacctcaaatccaaatccttgtcaccaaaactggctcaaacaacaaaagaaaaggagaattttcattactacaaacctctgagcatgagtttctgtttctgtgtaaggtttgtttgataaaaagatcagactttactaacatcaatcatatagttgatcaaatcttgcatacccggtgtgaatctgcaagggcaagtcgcgacgcacagcgacctccaaactaatggtaaggatgtagtcaatcaagcccttgtttcctatgcggacaggctttccagctgcagcaatattagattttaaggtgatcagacaacaactatgttacttcttgatagaccaagcacaaccatcttacctcgcaagacttcaacaaggccattctcagcaacttctttactcacataagtatcaatatccaaaccgctacgatatgcagcaatagttttcaaagcaacaatctctggaacaagcgtgaccgaagtagtcaaggttaaccaatactagtgagtatagtcacaatcattaagcgtgtattaaaaaagcaaagataaaaggatatgaatttaatctttcaacaaaggttttggtgaaagaatctaaatcccaaacaggcggttcagtactctcagaaccatagaaataaccaccaggacactcctcttcgaggatttgctcggcaagagtttcgatacgcaacactctaccaacgaatggaacaaagtttctatgccattcaatatcatgtttcttgtctagctttaatccatcatcaatgaggagagcagagattcgagcttctttaaaacacttggaagtaaaagaatccaaacccgaggttttacgatgttcctcaaccgcttctaaagatacttcagtgccataaagttgagcaatctccctcaagttcctctgtttcattcatacaaccaaaaacattcataccaacttcacgagattcctaaacaagtcaacatcttttgagtaacactcgaaactttagttaactaatacttttgagactaattaggaaactttaagctaacgttttcattaattagaatctgattcaaacgaaaactaactagagcaaaaacacttggtatcgtcgtgtaccttgaaggagagagaatgaggagcgaaggttaaagcgtcgccggcagcctcggagaaagttccgatgaacggaaaagatgagtcaagagagacaatgttgtgtgcgtgagcatcaacgagctctatcttctctattgcttcctttaactcactaaactccatctccgtctctctctgtctaaagtcaacagttcgatgttcttgattcgtgttaatcttcttacaatcttcacagtttattacaggaacggttttaaagcataagtgaagaagatccaatcaaatcgttgacttttccttgtctgatttggtcggtggccgatgtctctgacctttaaacttcacgacggcgtttagaggagagtgatgagcacgtgtccacgtgaaatacattagcctccacgtgtcctaactagtgtggataactttcaactgtgttcttggtttttcattttccaaattccggttccttgccaaggacaatctcgttttaacaaattcgaattcaaaattaaattggaaaaagctccatttggttcttccttcatcaatccaatcctttaaaccggacaagaaaaaactgattaatgctaaatttttaattttgtaaatccaaattaaaccggcatccaaatcaaaactaaaaccatttcattatattttacaaaccgaagagaagctacaccaaaccggagaagaagaaaaaaacgaaggaaaaacaacggtatcgtcgtcgtcttctagctctgctttctacccagaaaatttgcagtttctttttctccaccttatctttctaccatttttcttcgatg

SEQ ID NO: 9763 - DNA, 3000 bp, Unknown
  misc_feature (1)..( 3000): cDNA_ID_2185602_gDNA_ID_1972178_Annot_ID_180096 3000 nt of promoter + ATG
tatagctacgataaagttttagatcacagtttgttttgacccgtctaaagagcctgcgtaagaaaattatattttactttaccaagaaaactttgaattgagttttggttctagacagctgtcccaacctatacgatgaaaacaaatccaaaatatacagacacaatatgtgataatattttctaatacatgtgaaaaatagaccataacatttagactagtgatggcttttattacttacattgactggaatcattacgttttctccccaatgctgatttggttatttcagaaccgacccaaattctcattagtaatggccatgcctctcttgggatcttgctaaccaacgctccaaacacctgaacaaacacttaaacttacaagcatgtgtctccattttatcttgaagtttagagtaaaaataacagtttataacaaaaaggttacctcaagtgattctcttagttggaacaattcacaacttctaaattccttctgcattagatttgctcattcacaaactaaagcatcactccgtaagcctcttcttgcctatatcttaaaacccagtaaaggaagaatagttcagaaacaaattcaaccaccaaatagagctgcaatactcaagatatatctcttatctcagttattatatttcttagaggatatctaaattctcaccagaggaaatcatttgtttctcgagttcctggactgcatcgaatatcccatgagcagtataggttttgatcatagtagcaaaagtgattttatcaggcttacattttctctcttccatttgtatgtataattctttcattgtagccaaatcaccagcctgaccatatgcattgattatgcaattgaagaacggtgtatccagtaccacatctgaattcacaatttgcctcaaaaccgaatctatcttaacgacaagacctgctttgctatacgcgttaacaagcgaacaataagtgattgagtttggtttcactccttgatacttcattttcctgaatacatcatccattttctcaattcttccagcttttccaaacgtctcaatcactatattgtaagtgacagtcgtcagggagaagaaccttttctccataaaatccataacagagcacatcttcttatacataccagcttttccaaatgacaggatcagtatgttaaatgtagtgatatccggttgcacccccatcagctggaaccgactataccagctctccatcttcctcatgttgcgaccatttccatatgacccaatgatcgagttaagcgtacaaacatccggaagagaatctccgtcctcgatcatatcagccagaacactttccatttcctcaaacattccagcctttccatacccatcaataatagtattgtaagtaaccgtgctgcatccaactccaagatacgacatctcaagaacgatacttttaaccagatcaaaccgacccagtttgcagcaacaactgatgagaacagtaaaggtgaacacatctggcttgcagtcactaacagatttcatatactcaagtgtagaaaacgccttgtctagaagctcgcttttgccataaacagagataagagaggtatacacatcaatggttggtttcaatccttcagataacataacttcgaaaagcaagctggcttgatcaggctgtttacaattcccaagcactttaaacagctttgtataagttttgcatcttggttcataccaatgctgcttcctaagaagattgaaaatctataaagtagagaaacaggaaagtgaattctatcgaatctatgtccaagtatctgtaagaatgaagaaggattaaagagctgtaccttgagagcagactgccatcgattctctttgatagcttcgtcaagagcttctagaacagcttttggccataaagttaagtacttttcggaattggctttcctctcaatgcccttcacagcagcatctgttctcagaatccgagacaattctttcttaggatctacttggtgtcttgttgagatcaaaccagaattcattttctctgtacgttcgttggggacctttgtcgaacacattgtgggcgttattgaaatagttggtatacaccgaaaataaacaggggaagatatatgttgctgaaccacgcttctgcaagaatgagaaacagagaaagatagatttaatataaacacaactgaagaattaaagaaacgtaaaattcaaaacagtatgattgtatgaaatatgagaatgttaccgagaaaaaccaagttgtgcgatctcattggcgtacgcggaagtagttccttgaacaggattttgtatcaatgccatcgaagaaaaatggtagaaagataaggtggagaaaaagaaactgcaaattttctgggtagaaagcagagctagaagacgacgacgataccgttgtttttccttcgtttttttcttcttctccggtttggtgtagcttctcttcggtttgtaaaatataatgaaatggttttagttttgatttggatgccggtttaatttggatttacaaaattaaaaatttagcattaatcagttttttcttgtccggtttaaaggattggattgatgaaggaagaaccaaatggagctttttccaatttaattttgaattcgaatttgttaaaacgagattgtccttggcaaggaaccggaatttggaaaatgaaaaaccaagaacacagttgaaagttatccacactagttaggacacgtggaggctaatgtatttcacgtggacacgtgctcatcactctcctctaaacgccgtcgtgaagtttaaaggtcagagacatcggccaccgaccaaatcagacaaggaaaagtcaacgatttgattggatcttcttcacttatgctttaaaaccgttcctgtaataaactgtgaagattgtaagaagattaacacgaatcaagaacatcgaactgttgactttagacagagagagacggag

SEQ ID NO: 9764 - DNA, 3000 bp, Unknown
  misc_feature (1)..( 3000): cDNA_ID_2185612_gDNA_ID_1972178_Annot_ID_180102 3000 nt of promoter + ATG
ttaattcttgatattatttgtatatttctaacagaaaagaaagaccggcgatgaaaatcagttttctgattcaattcttccttcttggactcgttgggtatgatcttgtctttatatcttggagtcaagatcaatgacaaaaaacttttgattacaatactcatttttggttatagaataacgttaaaccaaggattttacatctttggattggacaatacctcaccaacattcgcatcagcaactgaaaatgttgttcctgctgtttcattcctcatggcagcgttgctcgggtatgttcttgattctttattggagataacttgggaaacaagatgtgtatcttgcggaccaattattgtggaccctcaaagtgggctctgataccactcatatctcatttttattatgacacaccaacaattgtagaatagagaaggtggaatggaagaggaaagatggtatagccaaagtggtggggacaattgtatctgtcgcaggctctttggttataacactctataaaggaccaaccatttaccaaccgagtctgaatatagtgaaccaaactattaaacctgaagaagcagaggaagaaaacaagaactggacgttgggatgtctctgtttgatgggtcactgtttatgttggtcaagttggattgtgttacaatcaccattgcttaaaaagtacccagctcgcttctccttcgtctcctattcttgctttttcgcagtgatacagttctttggaatttcggcttatttcgagagagatctagagaggtggaagataatatcaggaggcgaattatacgcgttactctacactgtaagtgtttgtttattttcttagattaagactcttttgaatggtgtgattgattttggtgtgagtttgaatatatttcagggtttagttggttcagcaatggtgtttgcaatacaaatatatgtagtggaaagaggaggacctctgtttgtatcagcgtatttgcctcttcaaactttgattgctgctgttttagctactttagctcttggtgaacacttttaccttggagggtatgttatctatatgttttgactcattatgcgttttattttcatatcttatagttaagtttcttacacattttttaatgtttgttttggtcagattgataggtgcaatactaatcatgagtggactatacttagttgtgatgggaaagagttgggagaatcaagctctttgccaacaacaacaacacatgatttcttcagcagcatcagattttggtgatgaagaagactaccataataataaaccaagatctcctattagtcaaccattaatttcttcctaaattttgttagatcctatttatgtcttaaattcctagttcctactctcttcctcattaaaatcgaaatggacccggttgacgaaatagagataaaaataaatttggttaaaatcggtttagaattaaatcgattggtttgggtttagtgccacagtggttaggtgagtagagttgtggttcggttcaggttatgatattataacctggagggatcaaaattggcgcttttaaaaaccaaacaaacaaaaacagagaggaaacaaaaaaatgagaaagcaagaatcagagggagcgaatcttgaattcgaatccaaatcaaatgacaatggaaatgtgaaaatcgcaccaaacgaccaaagtttcctcacaattcttgacgacataaagtcttccaaatctccggttcttacacacgacaacttatacatttgtacacgtttttaagaccgaagctggttttttttcgtaatctgactgttcttcttgtttttgctttgttatattcaggctgttattaactatggagcttcttggtacaccttattctctgtttttacgattacgcttttcatgcttataaagtgttcgatgaaatgcctcaatgagaacggttttgttttgaaactttcaggtgtggagtttgtagccagattcttcctgcattccgaaagctcagcaacagtttctcgaagctcaagtttgtttatgcagatatcgacgagtgccctgaaaccactcgtcacatccgttacacacccacgtttcagttttacagagacggcgagaaagtcgatgagatgtttggagctggtgaacagaggctccatgatcgtctttggcttcactcttgaatatgttcatcaaatattaactatgaaaatctgcattccttttgtgatactttaaatgccaacacaaaaaatacttggctcttcgacaataatcccctgaataagtttggactttggtagattaatgttagggataaacttacagaaacatcaaaggttaaacagaggatggagctaacattcatgatacaactcttgacaaataaatatgaacaccgagctcctcacggcggctctttccctctcaaataatttggtttaaccgggtataatgaccttgagaaacattgaagtctctaaatcacactcttgccaatctcaaaagcaccaagcttcacctctaaacggttttgttttccaggaatgaattgggttaatgtaactttctaatttgggtcaggtttgagattggacggtcttccaccacaaaaaatatcaaccattaaaacttttattgttgcccattaagaccgaccttcttttcgtaattttttttttaaaacgtaactttgttgaatttgtaaaaaaaatctcttgtgaaattatcacaatgtttattcaaaactaaataagaacatactagaagcttttctaaattggaagatgtataaaaaaaaaatagaagaaaagaataataataatggaaaacaaatactataaaataaacgtttctttgataacaagaaacggatttgtcttctatataaataaaacacacacctgtctatttatttacacttctcgaatcttctttttcttctctgcgaagctctctctctctctctactcgattatcaaac

SEQ ID NO: 9765 - DNA, 3000 bp, Unknown
  misc_feature (1)..( 3000): cDNA_ID_3032876_gDNA_ID_1972178_Annot_ID_180098 3000 nt of promoter + ATG
ctcattcaccgatactaatcctttgagcatctctatgatgattgttggatcatttggttttattgtggactttgtgtcacatgaagggtcgtatttgcaaaatacttgacataaagatgtggttcagaaaattaataaactaaatttcatatttcgagacgcatgctcatgctggagtactatttgtatttcttactttttcgtcccatgctttcaaaagcctcaagaatatacagagtattttcaataatacggagtagttcttaatcatttacatttgtctatgaattgaatttgactactaatactcggaaacaaaaaaatgattgtagtattaggagcgcaaataccctttaaccattgttctttccatgttcttagtccggctattgttatctaggtaggtgcctgatccctttttttcaaatctttcttattcattactttgactaattaacctatttaatcatatttaatctccctttaatctgcaaactaaagcacatgtttttttttatgaaagaaaaggttagtatgacattcttttggtaaatctcatcatattatttatttaattttaagaaattggagtttaaagtgtaattaagttatgctacctagctaatttccttaaaatatgaacgataagtatagaaattaaagtaaagattaggtttatacggtacgcttattatgctcaaacaagtggacgaacaaaatccatctccatgtgactatggaagagaacttattaataagtccaaatttttttcttgcaaactttatgatttcattcacactagacaaattaattgttcgtaagaaggtatacgtacaacataatgagcttttactgcttccctttgcaaacgaatcagctaaaactttacagatttatatgttcaagggaaactataactaagatttgaaggaaaaatctaacctttctactacaacaataaaagtcaatgcaaggtcctttgaaaagaatcttgttgtcgcatgcatgtacgtaattttgtagtcaaatgtacgaatgatagatatatggggtcaaaacgttaaaatccagcctaagaaagacagagatttactctaaatcttccaaaccaacgttatcaattttgttgttaacattcaattgactttgctgttaattttggattgtagaatcgaattaaaatgaaaatacaaggtgaaaacgagacaatagcgtgaaactgctttgcgtatatatcaagtatcaacagttttgtttcgtttttgttggtttgcgttgggataagaaaccggcattttgtacatggttcaattttgtaatacctaaaccaatttccggtttaagtggtttattaatatgataaaataaaataaatattttttacaaaaatacatagataggaccatgggtccatgacgctttgacaagagccaataaaggatttactgtaaaatcagtaactttattgacaaacaaaaaatgcagctataagttgtccccaccgtatattacaaagattcgaatactttaataatacaagctaaagaataaagagcaagagcctttgactatttccacttataagttttcctccgagaccgagagagatcagagatggagcagattatttcaccacgctccggtcaaatatatatttcttctgttttaggcctcagcaaaaaccacctccatagttgttatgttggatactacgacaatttagtgaagaagtggtctcaatctaaattatcattctggataatgacaaattgataaaagatgcatactattacaaaagttgagaaaagaagattactttacgtaatgtaggcgttttaatgaactccttaatttcatcgttcgtggaaaataataacacaagcaaagcaatgacttttatggacactatgattggttacaatgatcttattgaacatgtgaggaggcaaagtgtatatccttatatctataatgtttttttttctttcttctccaaagatgtcgcctaacatcacgttatttaacactacatttagcttacattagtaatctaaaaacaactttaataataatccaacaatcacgccttatttaaccaatcctaatttatgaaaacatactcatgtatgattgtttgtgcgcatgtgtatatgagtatatggacacagtaggtttctttccttggttggatagatatggttacaaacttgcaatagtggcaggtagttagacctgcggttcctaaactccgaataaatacgtgcggttcaactgcaatgcagttctaataataacgaatatatatatatatatagataattttgttactattggaacatgtggttaggttacaatttcaaaccctaattattgattttggtaatttggatgtattcatattcctgttggttttggtctactcaaaatgttagtaaatctcttatgggatgtatcgaattaacttaaaactcttttttctggtccagaaacccattaatactagcattcatattgtatagcactatagctcgtggggttattataacgtcacatcacttttttgtaataaaagttgaaaaacctgacaagaattcaaatattaaagcctatccttagttaaaatctgttaaggcttatgaatatccttatcttatgtgagtaattaggttaattagatattagtacaataaaagaaaaaaggaaaaattgaagaccgtttcctcgagacaagcagattctcaatcctcgagactgtcagtggaaaacaacttcactctctctcttcaaaaagaaaaacaaaaatacaaaagccaaggaaagccattattacaaaagcaataacacactgtaaaaaagccactcacgaacactcctcagtaaccagagagagaagaagaagaacaacaagccatgtcttaactcttaactaatctcttcttctccctccatttcaccaaccaaaaaccctaaaatccttaaaatcacaagtttcttcagca

SEQ ID NO: 9766 - DNA, 3000 bp, Unknown
  misc_feature (1)..( 3000): cDNA_ID_2185582_gDNA_ID_1972178_Annot_ID_180090 3000 nt of promoter + ATG
atatacaatccctgaaattgaaaatatcagcattagagaaattggaatcattctaaacaaaacagacactctcattaatctctcgagtgtgagaacattggcatacattggtggtgtgtatggttgctcctgtggtcatgctaatggtctgatcaggaaccagctcaacgtttaaccgctgaagaaacaccgcgagtgccacaattgcctccatcaatgcaaactgatcgcctacacattttctaggccctccactgaatgggatgaatctggtgaaaaaagaaaatcatcttttaaattccctaatcaaaaccactaatcttgattcagtagtttgtgtcaaaagatgtgttctactgagtttacttgaaatcagtgtttgtttcgttagggattgcgccatctatgtcgaatcgttcaggcagaaattcctcagctttttcccatacctttggaataacaaacaacaaacacataagaaatgtgggcatgaatgtaatactaggaatgtccactccggttagatatccgaaccacacaaagatcattgaagagaaggattaggctcccctatgttatactatggacgagagaaggaagagaactgtacctcggaagaacgatggatgttatagactgaaatcataatgtcttgtccggtattgaccttatagttcccaggaagaatgtcaggaacttgagctcttcttatcaagacctaccaggaaacaaatcaatcagaaaatttagttcatgaataattagagagatgagcttgattgcttacaggaggatgaggatagagacgcattgactcgtttatacaacgagtgatgtacttcaactcctttatatcctcgaaagccgggtttcttccttctaacactctgtctacttcttcttgtgctttccttaatgcagatgagttctatgaacatagagaatttgaagaggtaaatgagaacagagaagctcccatccaagtaaattctctagcatagcaaagtagaagatacattaaggtaccttacttaggagataaagtgtccaagtgaggacagatccagtggtttcatgacccgctacgagcattgagagaagatcatcccgtaactgcacacttgatacctgaaaaccctcacaatgcaacatcagcttcgattatgcgataatgaaaggccaaatttgcttataaacttaaggaaaaaagtttaaacctcttctctgcttgcaagcaagaaacgcaggatacttgggtcagcatcatttacatactcctcatcattgattctttcgccttctctttcgacaatttctttacacttagcaataaggtcttcaacagtttcccttatcaaagttacagccttttcagctttcacctgtctcgggactatcttacacaatgcatcgatctgaaaaaaacaaccaaaccctctcaattaacaagaatccaattgttccacacaatcaacaaaccacagaaaaaacacaggaaacttgccttccaatatggcagaagatcagtagaacgaagctcagcttctttaagagcagtgtaaacagcttcaatgacaggactatcagtagtcaaagaatcgaaattgtagttaaaaagagacaacccaatgacatcaagtgtcatctgagagaacttcgcttccatattcacagcacttccgtcttctgcataaggctgcaacttctcaacaagcctctctgcacatttgcagaatactctctccacaatcacagacaaatacctcctgtgaagcgatggaaccaccgctctacgcctcgcctatgtaaaaaatcagacttcagctaagcccaatagagaagattggaatctaaaccctaaaattagagttacttatcatacaagacagtcacacattacttccacaattccaaaaacttcaaaattgagataggaggagatgaaattactgtccaaagaggtccttcagcgatagcgaaacccgaaccaaatagaaattcagagacttcagcgactaagcctttagcgtactttggataattcctcaaaacatgtttagctatcgctgggtcgctcacaattacgaaattacgaggaccagcagcgagacggtaaatgggtccgtactcattcatccatttgtagagaggtaagaagagagcacctccgaggagatcagcgacatcgtcgagcttcgcgttcgcgattggtatacctgactcgtcgttttttcctgaggaaagggtacgagtgagtgttgtgagccaatcgggactgacccatgattgggatttcgatgaattggtctcgagtttgggtttgggtttctcaatggaggatctgatggagaatgtgaatttgggttttggtgataaaagacgcgtaggttttgcagtgaagagagaagagtaagaagaggaagatggagaaaagagtgaagactccattgatgacctcttttcgaagcttccgtgcagaaatatttgactctgtgtagaaacgcgaaccgttacgcgtggataaggacgacgatgcataaaacgactacgttttgttaatcaaaacttaatatgggcctcctcgtatttgggccttttaaaagcaagtagcaaaatctgaaacgaaacagagaagatcgaattttctttgaaactctgtaaactctgtttctgtaaagttgttaaattttgtcgatctggtaggaagaagaagtacaagagaacaagaaaaagtcaattcctttcgttagtcggcgaattctagaaacgatgttcaatttctggtatgattttgcgaattttttgccatctgattcatatgttattgatgaaattgcgtgatccagacattaggtctgttagcgattaaggaaatcttgttgttgtgtagtttgttgagctataatgatatatttgaggtttttgaggtgaattgacaagtgtagattttgctcagctactgatttagggttcatagttactgatattaggtttacaatg

SEQ ID NO: 9767 - DNA, 3000 bp, Unknown
  misc_feature (1)..( 3000): cDNA_ID_2185574_gDNA_ID_1972178_Annot_ID_180088 3000 nt of promoter + ATG
aaaatctttgacagtttcgttaaaagttgccgagaaaagaagaacctgttgaaaataggtcaagaacacaagcacacaatcaaatctagcacgagaaagaaagaaaaagagtttcctttgaattgagattaacagccataaatatagtgaaacacaagcagtcattagtacagctttctgcagtgaagatattcataatcattttagcacagacatatatgtcatcttaagatatgacggctctaaacaacagaaaaaaacacagctgaggtgcttctatttactaagagcttctgaacattgaaacaagtataactataagctcagtagactatcttgtgccccctagatatcacgatagatatgccactagatatcaactgtcatcctacttataattcaagaagcatgaccaaatcagacactagttaaacagacctggaaattgggattaactctcccaatgtctttcattatcttcaaggaatcatccctaaacccatcctgcaacagcaatgaattaacaattatcaacaacatatgaagggaaaatataatcacattatacagaagttaaatcattacagttgagaaaataacaagaccaagtaaaacagaagaaagagcataccgtagcaagcatatggtcagcctcatcaaaaaccagaatcttcaaatgatttagacctagtctcttaaatgccatccatttcttaagcgttccaggggtgccaatcacaacatgagcagaaacaggagctcctcttgttgccgccggtgcacctctcgttgagtcaggcacagccaactcagcagtgatcccagtaaacttccccatcttctgaagaacttccatattctgtcattcaaccattaaaagaagtcaacaatcagattactctcagatcataaccaaaatcagagtaactaaacaaacctgattagctaattctctagtgggacaaatacagagagcttgaggctctctcaatgtgggatcaacacgactcaacattccaagaacgaaacaagtcgtctttccagatccgttatgagcctgggcaatcagatgcttgtgtggcggcgtcattatcataggcaaactaatagcttggatcttgctaggcttttcgaatttcatctcaacgtacaagcctttcatcaattcaggtgacaagttcaagtcttcaaatctacttgctgatgtatatggtgtgtcaccagaagtaaccttcaaaaaacaccagatttcaaaatcaaccaaacgaatctggaaaatctaataaccctagactgtaattaggatcaaagagagagagggaattgaagtaatacagctttgatgttagaatcttcaggttcctcaagaatagaatcaggtttctcttcttccttaatgctcaatgaattaagctccgatacagcttcttcttcatcatcatcatcttcaacatcgccccactttttcttctccgtcgtgggctcagtcttctcggcgctattagatgcttcaacggtggatgatgaagatgactcaacaacggtgggaactttctctaccgtatccgccatagctgtagccaacaaaaaaccaatcaaattagaaacccaaattcatcttaacttctccattgattcgtgaaagagctgagattctgagagaagtagaacctttgaaattcgcgaatgagagaatcagagagagagaaggaagacgatgaacgatttgtgttatgtttgaagtcggagacaattttggggaaaaagtgaaaaccccaaataaataagagttgctgctttactttgaagctactagtcaaggattgtaaaaatcactgacgttaatttcaagctgctagtaaaaatggaaatttactgatgttaatttataagctacacgtgattaaaccgactctagtctatgttgtttttgtttataattcggtttatctttctgttttctctaatttcaattcggttcgacgtaagaatatgaagcttaatagtaaaaatgtaaaataattgaacttaatttcatgctagccacaattgaaataacataaccgactctaccaatgattttttaatagttcggtttattctagacgacccaactaaatcattttgggctttaatttatgtataaacaaaacaatatggcccaacagtccaaatttgttacaaaagaagccattttctactaatttgggtcttgtaccaagtagagatttttacttccatggtggtgatatggcccaaactcttgttttttccttgtaatattcttcataagtttttttaaaaagcttatgacttttctatgtacaagaaaggaaataaaccatgatggcttaagcacaatagaagaaagaagaaaggaaaagaaaaaaccatgatggtttaaccacaatctttgaggtggatgccacattacccaatacattattacaagaacaacaactaaaagttggtggagctcacactttgatttcctcaaacatatcatctcttatcaagaaaactgtatcctatcagaattttatattcatgcctccaacggttcaacagaaaccaaaattagattattgaagtattgagcaatcaatcaatcaagattagatgatttccccaatacccatatttttattgatagagctacccttcaaaccaaagcctccacgcgtggcccgaattgaaatttcgcgatatgacggaagtttatgttcgaggatgcaaagatattactgatcatggtcccatgatcaatgaccaaagagactgacctcataaacaatttccacctactctattgcactagcaaatgcgttttctttatcttaaacataagcatggggagaatgattatattttgtataacatgcatcatcttcttaagtctccattttctcaccactactctctatttctttctctctgcttctctctcttctctatttgtcctaacgacctgattgcattagacaggaacgaaaaggaatg

SEQ ID NO: 9768 - DNA, 3000 bp, Unknown
  misc_feature (1)..( 3000): cDNA_ID_3033021_gDNA_ID_1972181_Annot_ID_180130 3000 nt of promoter + ATG
ttgtcacagccgttttcgatgcacatgatccgacaaccattttggttgtaatgatcctgaaaaccttcacactctcattacataacgtcgcaaatttactatacaaccatttcttgacaaacaaatcggtcactagctattcttctgttttttttatttttcttgtaatatttatatatataacgagtgtgacttgggctttgacaatgttagtatagctttaaaacgggggaaaaaaaaatactagaacattaagttttgagggtgcaaatatgtaacatatgtgttgtagaaatactttttaaaatttcaataataaccttggtttagtttccattgtttgaattggtattcatatctgactaccgtagaattcaatttgttagtgcagaatctgaaacagaaattgtgttgtctgtatattctttttttgggctctcaaatatttcgtgtatttttgtggaattttatataaagttggtgtcttttttaggacttttcgttgcattcaattatgttgaatgtgtaaaagtagtggctttccttggtcacatttatcaaacgtgttttcgcctttctttaattttccgtgttcaagtgaattctagctaacttttcggttttacgttgtatgaaaataattggctgtcgtcggtcacatgatcacatagagtttatttgattcaaatccatttaatatatgctgtatctttaatgcatacatagagatatattattatacgttatcttttaataggacattatattttgtttatatgaaagaaaagaatgtactgtatatgcagttatattatgctggtttatgtcaaagatagaagttaacgcaaattaatttctttatttcaattgtgttttgcgttacgatctgttttttttttttttggacaaatgacttaagattttattacttcatttgatattaataaattagtatgggtgatgcaaacgacttgaaggctagggttggtaccacggctgctaaagtctacttttggttggatctgtggtcggaagatcttgacgtgatcacttctataattgaggattgtgtgttgctgctactctcctctcacgataactcacgtggcctttttcttgtttttctttcttcatattttcacaaaacaaaatagtcagagatcttgagagattttttcagaagcatattgggcccaaatgtggacaatttcatgtggttgaattgttaaatttcagatagattagacaactaatcttgttgacgtgcatgcggtgaggatattaagtcgctatacgtcatatacgtgtatacttaaaatctcgtttgatatttctttcttttgtttttatcttcaacgacaattattgcctcaggcatgtcagcagaaaacgacaccgttcatattcgatctcgttattaatatgtttttgaagcaaaatatcattattagctatggagtttctgcagtagcctaaccggaagtctcaaaaagataacgtttatgccggttataattaaatccgataaggcgataaataagtgaacccgtaaagtctaaaattttcacatatatatgaacaaagaaatagtctatagatctccatgcattcttgtacaaacatatttaattttttattttattttctttatataagagttggtgtatgaaactttacattttgtaaatactaacattacatcataatgtcagaaccaataattctagtggaatgatataatctccactttaaattcttatgtctttatccaaagagatcatgaggaacttgagcaaaggaagagggcaccgtttagtagtataggtgaataacgtggcggacacgaggctggtctcattttcaaataaagagagatagagagaaaatggaaggaaaaaaaagctattggcgatgttgatatttgttcgtcttttagtggagacgaccaagagattttgaaaggtcgtcgaggagttagtttattatcttacaattattatggatttcttctgactaaagttttagtgcaatagttttctgagttattatatatttttcgaaattcatccaaaggctaaaactttgtaaggtattctgagtctattacgctagaaatagacacgcttacgtttttaagtcattttaatctgatatatatatatatatatatatactacaattttataaccaattatctttgtttcagacaatttatataaattcatataaactatcagaaataaagagacaattggctgtaaaattgtattattttgcatctatgaaatttttatttctctttatcaaaattgaagacgagttgaaattctatttcttttttaaaaaaatttatatatgggagtgtcaaaaaataattttcctttgtaagagaatattcgtatttggacgagtcttgatttgtgttttccgttagcgttccacattagttgtaaagagcgagaaagatttaagtgataattaaaaagacaagatatgcattttgaatatactctagatattaatcttaagcatttttcatattggttatattttatggtcgaattttgacatccgaaaaatacatcccttattcttcaatttatattgaatacttaagtttttgatagtaaatatgtataaataaattttaaacaattgtcaaaaagacattataacttatacggttatagttgttaaaaaaaaaacttatacggttataccaatagataaactgacattttagatttgagttttttttttttttactttccatgtagatagcgtggaataatacctcatttatatgtatcgttagttgaaataattgacaaaaggaaactattcgtttgctgttctagataaaagcctttaattgagaaaaagaaaatgcctccagctttgacccgttttgcctataaaaggattctctaagatatggactttcctcatcttctcgggtaaacagaatcaactagttttgtttttcctctttcaaaaatg

SEQ ID NO: 9769 - DNA, 3000 bp, Unknown
  misc_feature (1)..( 3000): cDNA_ID_3033006_gDNA_ID_1972181_Annot_ID_180142 3000 nt of promoter + ATG
ataaaataaaaatattatataattagatataatttacaaagttttatatatattaattttaaaaaatgaattgtctccgcggtgtacatctgaaactcatcaacattttctataacagacttgctttcgtctatcctaaaactatgcaacttttgtcttaagtaaaacctcttatgattccaaaacatttgagaaaaccaataagagatgttatttcttctcttaactgcttatgctctattcctcttgttctaccttttattttctttaaattatctttagaatctcttcctcatactgtaaccaagatccagcatcctatcgataggtaaagttgagttttacacttgccaattgccaaacattagaataaaaaagttcaataggttactcggattcgaacacgaggttacatgaatttgaagggctggcctgagtagccaactcgttaagcatctcacgtctctttcccaacttctcgagctcttcagatccgatgggttttgtggagagagttgctttcttcaagcatcttgcattcttaaggatgtatgtagccactgctttctcatcttctcgttgccactcatatcttgtccacacaaatgtctcaagatgaaacaacaaacattcaggaacacatttgggtcgactccattcccagcccaccgaacaatcttctttaggaaactgatatggctgagaacaatgcaattaaaatatttgaaagtagagctcactggaagaaaaacaaaatttagttgactaatgaaatggcttacatcgacgagcttaagaatttgtaatttgggagaactatcgagcatgaaccaaagtagattccaccactcatagctatatgcacgaagctccagcgataaaagctggtagaagattttaccagtaggatactttatctgtgcatgaggcaacacagaacattaatgttagcccaattacagataaaccccgtgaaaatcttaaatcttaagtttaccttgaaaggtgctaagtgtaaggaaagacatttggctgaagttagagagtccataatgttctcattggctatttcaaaaacggcactaattttagcctccactagctctggcgccttctcaatcaaacaaaactcaagaccattaaacccgtcgatgttcaagtatttcaaagaaggagcatttatcacatagcctccaacaccttctccatagtaatcatcatatatggttagtctctgtaatgatggcaccgcaatagtataactctccacatcggtcgtgctatgtctatgcacgaccaaatcttcaagactagggcagccacataaaaggttgcaaacggattcttcgtcgttaaatctcacatggtagagatacagctttctaagagacttcaaacaaaccagagaaggaaaatctaaaagaatgcaatacttgagttccaagatttcaagtgtatcattacaactacaccaagcactcggaaatcttacaaagctttcctccagcaatgtaattttcagtacaaatttacgcatatggcgggaaaatgcaattccaatcaatatcccaacatccaaagcatcatccttatcttcaactttcaaatgcaaactatctagaacaggagctttatgtgaaatcaaagacctgaaaacattatctgaaaacgtataatgataatgatacttagaatcaaacttgagatttggcaccaacttccaaagagatttccattgtttagacaaaacactagtggcaatcacagtttctgttggaagtgacgacaatatgagcagaagcaacgcttcaggcaactcactgatcctgtcctcctcattcactaaacctcgatttctcaaaccttcaccaccgattttgctgtgaaaaaaaaagtcagaagaaaacaatgaaagggattccgagaaaaaacatagacgaaacaaagaaacataccatttttgttccattttcgtttaacagagacatcaattttgctaaaaatccttgagattactaacacttcaacctcaaatgcaaacgcagccgaacacacagaatccagctagagcttagatatgataatggtgacgagattcatcttcaaaattatatccacttgtgtttgattagtaaaagaatcacctaggctagatacaaaaccctaacagaataaaaacagtgatcaaatccgagccggatcgtttttttccaatgaaaccaaaatccaaacccaagacatttacaagcccaaagaataaaaattgattttttttttttcggcccaccggcccaataacgaatagttaaactgagtttaggtcttcactatttaaagctcgtaaaccctagacttggatatacttcagtctagagccgcgcaagaagacgattctctctgtgagttttcgctcctctctacttgtcgtctctctgattatcttcgttgctactgtctcgttttgtgtataagtagggttcttgcttgttttctctcatcgtgtgttctgctgctagctcctgtagatttttctaagttccttgttttgttcatttcgagttttattgatctgatataaatcgtccgttgatttgttattttgttatgctttattgattttgcagaaagtatcgtccttggaatgagtaatattacactttcagtgatgaaacttttcgtttatttgattggttttgataacatccttactgtattacgactgttaatgtaatgtgcatacaaactctcgaaactttgattctttaagagtttgagattgtcacaagtctcacctttagtatagatttaataagagtgatctttgaaatacttcaagattcgtatctgttttactctatttatgttctctatatctttgagatggtcttttgtttttgaagtttgaggttttatcatttgatttccttgagctgtttaaagtttcatcatttgatttaaagtgtgtctgattgatgttttttggcagcttgagttgaagaa

SEQ ID NO: 9770 - DNA, 3000 bp, Unknown
  misc_feature (1)..( 3000): cDNA_ID_2185743_gDNA_ID_1972181_Annot_ID_180146 3000 nt of promoter + ATG
tacaagcatggggattatcatcgctaaacatcgaagccgcgatctcatctccagccacagcaaccgagtaatccgcgggagtgtggaagaaagtgtggacaccaccggtgggatccgtacggtgtgcatcagagtaatagtggttggtcacgtaagaaggatatttatagaaagaggcaaaatggctattacctaaccggtatggccacagttcagctgccttaccggcacgtcgtaccgctttcaataccttcttttcctctaaccggtatcctcgagccgtcactttttgggtttccatctctacttccacttcttccactcctgtacgtaaaccaataacaaccggataaattagttaaaccatctgaccatgtgaaagaaccggaaagttgatgttccatttgaatcggttcattattcttaagaatttggttgagatgttaaatttagatatctacaaaaatgaaaataaaagcataccaaactgaaaaatctttaataaaacatatattggcttgaaaaattaagaaatatttgataaaaataacagatagtttaactttggttaacatcttaaaagtcaaaaccaaaccaaaatttgtgtaagcactcaatacttagattgaacgaagaagaagaaacatatttaaaactcaaaagctttcaatacctttaagcttgagtagagtcttcctaagcttagaagcacatccttcacaatccaagtttggaactcttatctccactgtcatctacaaacacacatttcagctattacaaattcaagctctatatctattgaaatatttgtgtgaattgtaaaccgagggcaataagtaagaagaatggagtgaggtagagatactcacagacatgatcttaaaaactcaatcccttttagaaaaataaccccctccaagcttatacttggttatagagaatgaagcagtgcacaaagtctcctaagtgtgtgtgtctatatatataggtcgattatgtatatgtgtgtgaataaatactactaatattttgattagtattttcatattttatgatagtataagttattatggaaagggttcttgggttgtgaaatagggagacaaaggaagagcatagcacgcgtgaaatagtaacaaaaaaggtgtgagtgtgagctttaggttttcttctctgccccaaatcatatcgctctcactcccttccaattactttctattttatttgccaacaaatataatttaagttaggcatcaaatttataaaccgataaatggttaattgataatgataatagaagcagtccctactataaagcaaactaatatgaaaatacggatttatgcaaagctttcgtgaacccttcacttttttagttcaaatatcttatcatgttttaatatactttagtaatgaaataattgagaaatctcatttaggaaaataacaaaaatcgagaaacctataaactacattatctttttggtttattaaattaaatgcaatttcttggaggcatgattcatgaatcatgatgaaataatttgataaagaaaattatatatcaaagatcgtttcgagtaactaaattttccgataatacaatgaactttttgaataaccattaaaggtttttttgatacatgatgaggattcggtttagaatttgaatttcgatacttgactttcattgatagtagtattatatgaaattaatcaacttttttgtgaatattattgtgaaaatgtaaaagcaagagcgtatagtcagatttttgatgtgaagttgtgattaaggtagggacatggatattttctgaagcatgagctttaattcaaaaatgtcaaagaggacactcctaaaaagatttgttaatccatcataattggtattagctgctttttcctcatcattctgtttccatttgattaagaagaatcaagacgatgatattttcaaatgacgagtacatattcctaaatatatgagacctataatgatccattaactttgaaattggtaacgaatattctcacacaaaaatgattattgtgatatattaagcttccgcaccacgaaagcctaaaccctttattgaacagtgaactccgaccaagacagctctatatatgcaaatgtcatgtcgtaacaaaatcgtcgaaactatatgatatagtagaactaatcacttaaaaaaagggataaacaaaaagggtccattttctctaaatcacatgtgtgctttattgtggtccaaatcaatgctcggtttgttagttgttgtcactttttaaaactgatatttaaacatgaacctaaccggaaaagaagatacatgattactgatgtccctatgtcaattatttgattggttcggataattacgatagattgtctatctttgcctcaaaatgcaatttatttcaaaactttattacaaaaacctctatttcgggcttgggcttagtccttgatcttggcgtcgtcctaggccttttattttcccaaaattcatcttatttataagtttttttttaatagaaaatgtcctttatagtacttttttcaaaaatactacttatcaaatatatcttaaactttttcgaatcttataaatcgtgtaaagcaataaaaaaacaggattttatagtaacgattctgttattttcctttgttatttaccgaataacttacaaaaacaattagaagagttgcacttgtgtgtctcacatttcacctagaaactttaaacatttattcctggtacacacaacatgacacacccatcaaaagtcttgcaaacattaaaacactttagttataaaccaaaccttttcctattctggttcacatgattctctgtcctttccttttctcacacacaaaaagctctccttttctctttctctctctctctctctctcacatctctcttcttcatctttcgtttcacgatcattgattatcaaattggcatgcaacagcaaggagagatg

SEQ ID NO: 9771 - DNA, 3000 bp, Unknown
  misc_feature (1)..( 3000): cDNA_ID_3032992_gDNA_ID_1972181_Annot_ID_180152 3000 nt of promoter + ATG
atctttcacgtcattcgatattacaacactttctaaccaacggtctttttcttacatcattttaccgacgttaaatacgatattaaacaacgtgattagccatctttttgtagtgaatttcttacttcaattttctctttgacccatcttatttgatttatgcaatgcctagagtttacagtttttaattccaatattaactagtccctaccttcaaacatgctcctcttgctattaccatgcattgctatatctacccgtacttgcgccgaaactacttgcagaacttaaaaacgaagtttacggttttgaagtgtcatacttaataggcatttcaaaactatttagagagaaaatacagtgattggtttgcttatactttaaattttggcttcaatcaaaagaaatgaatttgtatttatagagtataccacgtcaagatcagataccggatcctaggctaacccgacgtaagttattgattggtttacctgttctcctcccatcgagagttgggttgttgttggagagaggttgtacgtacgtgagtcgtgacggtgagcttgttagtcattttccctttattctgccaacgtgtacataattcagttttggtatatagtaaattttatgcgaaacaaaagctgaaaattaacatgtttattatcaaaaaaatgtggctgaattctgaaatatcattattagttaggtgcgttttaggaaatcagtaatgaataatgatcgtgcacaacaataaactggacaaaatagcatttgttctttttttctgtcacgaataatttcatttaagaaaaaaatatagaaagtcatttatatgccaacgagagacaggacattgctaaatccagctcaggacattagaaagttattctcacaatctctataaaataatccatgtcaacaaaaaaaaaacctctattaaacattaatcgaatttctaattcattatgaaatataatcagaagagtcctcatcttattgatcaatcgtaatacacaagaaaccatgactttagaggagcagaagaaagtcataatgcccgaggccgtcgcatcggagccatcaccaccatccaaggaggagaagtccgacgattcgaaagctattgttctcgtcgtcgctgcaagtaacaaatcttttaaatttcactgaacaagaattacatatttaaattgcaaaaactacttcaactatttcatattgttcgttttctctaattttcttcttcttcttcacaatatagtttataacacttgttggtataattattgtttatatatctaatatattttggccatgtaaacaaaatgtttttttttcttttggctaaattaatactgttatattttcggcaaagaactgtaaccttttcaatttttgttgttgttgcagaagaacctacggaagacaagaaagtaggttcagttcaccgaggtaatcaacgttatagttagatcatgattgatacataaccaggaaaacaaaatattttaactttttatttgatttttttacctgataataatagttaatatcagtgaagtttatccaatatctaacttttagccaaaaatttcacctgcggaagaaaaaatattaattaagtttatctaatttcagtaatttacatgataatattagttcatttttctctagattttttttttctgataattcatggtgtgtgtgtatgaagatgctgttttggttagactcgagcaagataagaggatatctctaatcaaagcttgggaagaggctgagaaatccaaagtggagaacaagtgagtcctaaagaagtttatataatccattgttttgatgaatttccaaatttttagttccatgatatttttttttgtgttccctatatatttgtatgtaatctcatttattaactttatgaaacagagctcagaagaagatttcttcagttggagcttgggaaaacagcaagaaagcttctgtggaagctgagctaaaaaagatcgaggtaaaagtgtaattctttattctttcaattttgttgttttatttttaacttttacatgaaatgctttccacttttcacattattctaatttatccgctggaaatatgaatgataacaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctgatcggagaaatggtctttgatgttgcattgtggtttcatttgttattaacttgagaaagaagagattattggtagttgaagtggttggtgtgggtttcatttggcaacataaaaagttacatggccataatgtaacgtcttattatgtttggagtaatgtgttttactcatgtgtaatttgtacagcttaaccttgagagacttcttttgaactttctaaacttaaactcccaattatttcgtttcaagttttcttcttcaatctcatggtccaagtaaaaatacaccaataccaaaatattgttacatttaagtttagtaaaaacaattaagaaaaataaccaaaattttgcactatttaagattagatttttaatatatatttaaataatattattgttccaaaaacaaaaagtaaaacaaaacacacccttaccaaaattatgtcaagtcaaagcatcctcgttttagggattttctatacttgggcctaaatactaaggcccgtaattaaaggcccaataacgtttgtggtattgtacaattttcatgtagaaaatgtcttatataaagaggtcttgcaaattagggttttcatttcagtaatcgctgccgcactatcgtctcctacctcctttgcctacaagctttcacgcgggagctcaacatcagcc

SEQ ID NO: 9772 - DNA, 3000 bp, Unknown
  misc_feature (1)..( 3000): cDNA_ID_2185753_gDNA_ID_1972181_Annot_ID_180149 3000 nt of promoter + ATG
tctcatatatttaggaatatgtactcgtcatttgaaaatatcatcgtcttgattcttcttaatcaaatggaaacagaatgatgaggaaaaagcagctaataccaattatgatggattaacaaatctttttaggagtgtcctctttgacatttttgaattaaagctcatgcttcagaaaatatccatgtccctaccttaatcacaacttcacatcaaaaatctgactatacgctcttgcttttacattttcacaataatattcacaaaaaagttgattaatttcatataatactactatcaatgaaagtcaagtatcgaaattcaaattctaaaccgaatcctcatcatgtatcaaaaaaacctttaatggttattcaaaaagttcattgtattatcggaaaatttagttactcgaaacgatctttgatatataattttctttatcaaattatttcatcatgattcatgaatcatgcctccaagaaattgcatttaatttaataaaccaaaaagataatgtagtttataggtttctcgatttttgttattttcctaaatgagatttctcaattatttcattactaaagtatattaaaacatgataagatatttgaactaaaaaagtgaagggttcacgaaagctttgcataaatccgtattttcatattagtttgctttatagtagggactgcttctattatcattatcaattaaccatttatcggtttataaatttgatgcctaacttaaattatatttgttggcaaataaaatagaaagtaattggaagggagtgagagcgatatgatttggggcagagaagaaaacctaaagctcacactcacaccttttttgttactatttcacgcgtgctatgctcttcctttgtctccctatttcacaacccaagaaccctttccataataacttatactatcataaaatatgaaaatactaatcaaaatattagtagtatttattcacacacatatacataatcgacctatatatatagacacacacacttaggagactttgtgcactgcttcattctctataaccaagtataagcttggagggggttatttttctaaaagggattgagtttttaagatcatgtctgtgagtatctctacctcactccattcttcttacttattgccctcggtttacaattcacacaaatatttcaatagatatagagcttgaatttgtaatagctgaaatgtgtgtttgtagatgacagtggagataagagttccaaacttggattgtgaaggatgtgcttctaagcttaggaagactctactcaagcttaaaggtattgaaagcttttgagttttaaatatgtttcttcttcttcgttcaatctaagtattgagtgcttacacaaattttggtttggttttgacttttaagatgttaaccaaagttaaactatctgttatttttatcaaatatttcttaatttttcaagccaatatatgttttattaaagatttttcagtttggtatgcttttattttcatttttgtagatatctaaatttaacatctcaaccaaattcttaagaataatgaaccgattcaaatggaacatcaactttccggttctttcacatggtcagatggtttaactaatttatccggttgttattggtttacgtacaggagtggaagaagtggaagtagagatggaaacccaaaaagtgacggctcgaggataccggttagaggaaaagaaggtattgaaagcggtacgacgtgccggtaaggcagctgaactgtggccataccggttaggtaatagccattttgcctctttctataaatatccttcttacgtgaccaaccactattactctgatgcacaccgtacggatcccaccggtggtgtccacactttcttccacactcccgcggattactcggttgctgtggctggagatgagatcgcggcttcgatgtttagcgatgataatccccatgcttgtactattatgtagtcttttagtatacaaaaatatgttttcagttcatcttcttcgtccaaatttgatttgatgtgattttttttgtacaactaatgttggaatgagaaagtaaaatatatatgttgtgttttagtctgaataaattggatcaacatgatctaaacaaatacaatccgattcaaaatctctttcatacgattaaaatgatttgtagtttttcaagatccgaaccactacgaaactgaaattacaagaccgtaaatgatttctaagcctctctttaagtgtgctaaaccgaaattagattacgcagggaaggttttggttcaattcaagtaaaaaccggtacaagtgaattagagaggcaataaccaagttggtcagggaattggtggaagaccgattggtttcctaacgacgtcgtttcagaagccaataaaagaagctcatatataagaattagaatttagggttttttggtaacgtgtgagagaattctcttttctctacgagttgtctcgggtgagttctcttctctctttcagggtttttgaagtaaataagaccgagcgatcgtattattcgttttcgacttcatcttaattcggtcttccaagtttgtattgtttctgtaattctctctctctttcatgattgcatcagtgtgagtctgtgataatataataagcgtttttctgagttcattgatcggttgtgtgttctgcgttagaatttcattaattgatgagttttttgtttgtttgtggtgtgttttgctaacaagtcacacctttactatagttttaataagcgtcttctacaacctgaagatatttctattttctaatctgttttttcttgtttgatgttagcctagctatagcatttagatggcttttagctttgtagggtgaagtcataccatttaacttctcttgagcgtaatggtttaatgcagcactattcacatgttggtggttgttgattttgcagcttgacttgaagaa

SEQ ID NO: 9773 - DNA, 3000 bp, Unknown
  misc_feature (1)..( 3000): cDNA_ID_2185766_gDNA_ID_1972181_Annot_ID_180153 3000 nt of promoter + ATG
cttattgaaataattctcttatttaataacttttcctgtgtataaaatcatcaatttcatattagagttttaaggtgccatatagttttgtatttttgttaagataccaaaaatatattaagaaagagctcaagaaagttaagagtttgaacacaacactttttctgctgtgtaataaaaaatattgcttggaatttggaaggtttcaattggatacatcaatgtcattgattcaatgaccatcaccagtggacaattctttttatatgcatgcctaatgacaaaacaaaatgcaccaataaaaacgaatttatgagagactctttccaaaagagacacttatcaataaataattaaagattattttgctaaaggtcaataaatatttttgaagaggtgtatacactaagtgctaatttaaagttttgttttacgagtttattaattgagtttgatgattagtttagtttggatgtggatctaataaactcttgtttacaaaagaaaatcaaaaaaaaaaagtacggtgacatcactcattagtggtgtaaagtatgtttataattaaaacatgaatggggaacaaacaaaattaacgtttgaaccaattgtttagcccacttaaataaataaaaattagattagtgacgggtttttttctttgtaaagttttctctataatagacagtctattggattaagtaacccaatcaaatattgattcttttgtatatacactgtatttgattgttgatcattatcagaaaaaataaaccatatcttacaacgatgtgatataatcccatctcaaaaaagaaaaaagaaaaacatgtttggtagacaacaacaaaaatgaaaatacatgattggtccacgactttgtaatacattgttgacttaattatactttgcgcaacgtggaattatataagctggttaggcgagatttatttataagttcaagcaaagctatcagtatttaaccaaactatattgtcactgttttaatagaaccagttctctgtttcttaattagatttttcttgatagatacctcttcttggtgaccaaaaaaaaggaaaaaatatgcataaacctcttactatcacaatttatatattttgttcaattttctatccgcaaatgggggtaaagagttgactccaaacaatagtatttgttttatgtcttcaataacgatttttcttttcgttaatagataacgaattatttgttattatagatcgttaaatgataatttatatagttcacaatagacatacgtaaactatactcatatgtcaattatacttaattaaatccacaaaacccttttgttcaatactagagctttttgtgtgcctataaatttcctgcaaatgattgacatgatatatatgattgacatatgatcatgtaaacatcagtactagcatatgcaatatgtcattgtgtacgtgtgatatgtcaatatgtgattgtgtgattcagtgattagatccgaaattcgcctagtatgcaatagcaaaaccatgctaataagtcgtagcacagaaaacgatattggaatcttgaattaaaacaaataaagtatacaataagtgtcaagataactaatccgcagctaacgtcatcacagtgtcggctgccaaggtcttttgctcactgaagtctgaaggcttatcaattatcaatataatcagtagagaggcattgtaaaaattacgtcattttaaatagtaattcactaccaaaacaatccataacatgttagataatcttcccaaagtttccaaacggatttgtatttgtaggacgttttaagaaacgtttcttacttttggagagcttcgtaaaccttgtactatgttttgtgaaaattttctaacttagattatattttttcatcaaaatatagaaccataatattgccacagcattacacccttttctttgttttttcttttgtagaacttggatatattaaggtgctgtgaatgttttcgtcaataatatacattttgacataatgacgagacctataaattattaagttatttgtagttgtcaaaccaataatgctattactttaatactgacataaataaatataaacaaatactatgtaaattaaatttatataaagaacaaaaacaaaagctaattcaccaataatttatcgattttgttttttacaagagtttttcttgaggaaggcaagtaggctttttataagttgcaaaagtcttcttcaactctattcaatagaaaattaactaacttgaacagttgaattagaatatttctactcataaacaataagaataattcacaatatcacatgctagttatttagtttaagttttaccaagacaaagagctggtggattactgtgaaaatgtccacttatgcatattaaaaatttggtagattaatcgactagttgctaattgttccataatttcacaaaaaaaacaaaaaacaaataacctagcccagtcaccactatatcattgtggcagatttattaaagttagccttagcccccaacataatttgaaaaggcaagcaaaacaaagacaaacttgcaaaagtctaatctttctgaaacaaaacatataaattaaaatattaatttgtttatttaaatgcaatgtcgtattgaaattatgacatgaaaattcaaagggtaaggctccacctaaaatttataaagatgtgatgcaatgttccaaattatatctacaaaatatttgtttcgtgtggaacaagccctctttcatatgaatagttctacacaagcatgaattagatattactaattaaactattaaagaactcgacctacaaaactgtctatatatttccctctttcgaattacgtatctgtgtcaaagattgtcatcaccaatctacatatttttattcatcagtaccatacacgtatatataatatatctatttcaaatataaaaaaaaactttggaaaaataaaaatg

SEQ ID NO: 9774 - DNA, 3000 bp, Unknown
  misc_feature (1)..( 3000): cDNA_ID_3032999_gDNA_ID_1972181_Annot_ID_180145 3000 nt of promoter + ATG
gtttacgctaaaatattcggttcaatgagaaacatcaacaaaggtattcagagctacatcattgaaaaatgtatgattacaagattggttatggtacgaatgttgataccttcccctcagtgatgttgctattgtcatctgctaaagatgaattggaatcttcttcgaatataagtggaaaccttattgcgtcaactggagttgctgcttcaacaacttgttcctccaaggtttctggttctttaagaatctacaccgttccaagagatttattaatatcgaacagaatagaaataatatcaaaactgagagtcatgtctctgcaatttgtaggtctgatatatcagaccatgtataggtataccaaacaccagaaagaaattatcaattaccttggcagctttagcgcctcttctctttgccggctctttttctttgtttccaagaacaggttcgggagaaggaatgcgctcaacaaaacgggcagcaaccaatttctgaagagaatctctgattgcttcagaacctatcgtatttcctgaatctgatcatgtatgaagaaaacatatataacagcatggaatccattccgctcgaagcattactgtaatcaaaacgagatacacaaaggccaaaagccaatgcctacgatgacgagtgtaaactgtggtaacataacataagaggtacatatgatatcacgactcacctctatctctttcaataaactgtcccaaggtaagcctaccgttactaagtaaaccatcaagaactgcaccgcactaaacatataaatcaaacaaaagtataagattagcattagagtcttgaagcataaaccaactaatcaaaacactgaacagagagaagaagaagcacgattaaaccttggagtcaagttcttcgtttacaatcctcgaaaacttgttatacctcacacgatgcagaatgttgttaaacaacacaatatactgtacaatagctttgctctcagaaccatctacaaagtaaaaaaaaaaaacatacaaaattactttcattgagttctctatttctgtgtgttgctactaatcaaacaatatagagactaaccaggaggttcaatggagaaagcttgaacacaattgtgctgaatcaagagatagagaatatctttaactttgttatggttgatatctgattcagctaaacgagagatgtctcgtgaggaaagaggtcctttacgtagaagacattcacaaactttctgcaaccaaaaccaaattcgttatacagagattataaattcaacacaagtctcagaagggtttctcaatttaccgagacgacggagccgaattggacggtgatgatatggatggcgtagacaatgccaaactcagacatagacatgagaatcaatcaccaggaagtctctcaatactgatgaagcagcctctgcagagcttgacggagttatggccgatatagagatgtttgccaatcgattgtagcctactactactaaaaagcgaagcaatcgtaatctagcgaccctaaagtttaatttttccagcgatccacacgttcgaatccaaaatttcgataatctaacatgaacccaccaatataagtataagaaaacaccaacccagggctagggcttttgttttttataaggactcgggccggccttaaatatttagcccattttaacatccctaattgtaggttattaattgttggcctagagaagtttgggcctatcaggccctaataaattgaatgtatggtttgacccaagaaaaaaaattagtgatggaacgaaatgtacttgagaattttcaatgattgggccagatgacaatgctctacttaagaagaacaaacacaaaccaaattcttctattgtatttgtatgtgacggcttacatgaagaccatgtttttacttagttaggagaatggaaaatgactttttcagcttcatgaatatgacttatattttaaaacactgtcgttttcatctatacgagatttttgtatttctattcataatcatatacataattttaatctttaacaaataacaaggtaaactaaatctttgattagtaaattctactctgactctcttctaagctacgcatgtttagtggtttaaattagtttcattgttgaataattatccaaatccactattgtttagttagatagtgtgcatgtatcaaaccaaataaaataatataataatttgtatgtatagacaaaacaaaattgattacttcaaaaagatatatgtctcattatatttagtcttctactttttttctataaataatatatttattcttatcattcaaagtcatttttaccatttcttattttaattttacatttttaccttggtcaatttaatttattaacaatcaaaataaggacgttatcttctatttataatataaagtataaacaacgtcaagcatcttcgaaacgtgataatcctagtcaaagacacatgtgcaaaggccctaaaagtgattaaacactcataggctatttttttaatgaaactattcttttgtttgataatacatacacaaactatttcaaattcctatgaaataattcataaaccgtaaattactatcgcatgcttgccgaaaaaaaatattttcaaaagttaattaactagccgtttcggttcagtgtttgtaccggaatcgaaattaaaaaaaccacctcttcaaaaaccgaaacgtcggtctaatcgtaaggatatatatcagcgactcccaccgttaacaaaataattaaaaatgaaaacattatgaccacacgatcaatagaaaatccgctacgatgataacacgtggcatcatcttttagccattttttgcttccacagatactgtagtaattgaatataaatttataaatatcgcatttgctctcttctctgctttcacattctctccttcctcatcatcgttactctcgtgtttatctctccgacgtaacc

SEQ ID NO: 9775 - DNA, 3000 bp, Unknown
  misc_feature (1)..( 3000): cDNA_ID_3033009_gDNA_ID_1972181_Annot_ID_180140 3000 nt of promoter + ATG
ctactggtaaaatcttctaccagcttttatcgctggagcttcgtgcatatagctatgagtggtggaatctactttggttcatgctcgatagttctcccaaattacaaattcttaagctcgtcgatgtaagccatttcattagtcaactaaattttgtttttcttccagtgagctctactttcaaatattttaattgcattgttctcagccatatcagtttcctaaagaagattgttcggtgggctgggaatggagtcgacccaaatgtgttcctgaatgtttgttgtttcatcttgagacatttgtgtggacaagatatgagtggcaacgagaagatgagaaagcagtggctacatacatccttaagaatgcaagatgcttgaagaaagcaactctctccacaaaacccatcggatctgaagagctcgagaagttgggaaagagacgtgagatgcttaacgagttggctactcaggccagcccttcaaattcatgtaacctcgtgttcgaatccgagtaacctattgaacttttttattctaatgtttggcaattggcaagtgtaaaactcaactttacctatcgataggatgctggatcttggttacagtatgaggaagagattctaaagataatttaaagaaaataaaaggtagaacaagaggaatagagcataagcagttaagagaagaaataacatctcttattggttttctcaaatgttttggaatcataagaggttttacttaagacaaaagttgcatagttttaggatagacgaaagcaagtctgttatagaaaatgttgatgagtttcagatgtacaccgcggagacaattcattttttaaaattaatatatataaaactttgtaaattatatctaattatataatatttttattttatagtttacaattgttattaagtaacgtcctgccaaacccgtcccgccaaatccgtccacaaaaaaaactatttattttattaatgttgatcttatttataatatgtttatgaatcattgtcaaaatattttagtcgttccgggacgttgtatccacacatttttcgccaattggttaatatatgttcatttttaaaatttcgaatcacaaaatatgaccaacttttttttgagattttttaaaactctatatattatataatgatgttaaatatttttgatatattaaactttttataaatttaaatattaataatgttttatgaagtttaaatatataaataataatatttaaaaattaatattttttgcattttaggtaatgatataataactctaaaagcaagaatttagaagaattaaatctttaattaaatatttttattcttaaataattaatgttagtaacatgacattgtaaataagttcaaatacatgatctatttatttaaacaacaaacgtttagtaagaacaatatttatttaaacaaaaaactttgttttaaaatattgttaacaaaatacgtttatgctaattttaagggattgattttatacgaaagcaagtctgttatagaaaatgttgatgagtttcacaatttttggttatttgtttcagtgattaacgactaaaattgttttttgaaaattttaatatttttaattttaagtcaagtaatcaactttgttatcaagtgaacatgaattttgtcgttacttttactgcaaaatgatgcatttcggaaggtcaagttgctagatatagtagtttaggtcatggcaaaatacggtcaaattcgatttcatccaaaaaatacgtatatccgtaactctacgaagcaaaaaaaaaaaactacaaatgaatatcagttaagaacagagcagattaaaaaaaaaaagaacttacatattaagacacatacaagttgctctgctttggtattaaaattatgtaagttaatatatatgtaagcataacaatatttagatgtaaattttaaatattgaattagttatttaaatattgaattagttatttaaatattaaattttaataagttaaaaacaaaaattgttttattaaatattgtcaatttttgcagatgacataattaaaccactaagcaaagtcctagaagctttttgtgggtttgagcattactttaaaactagattttaatccgcggtatatcgcggggacaatttattttttaaattagtatatataaaagtttacaaattaaatctatttatttttattgtatagtttacaattgttattaagtaacgtcctgccaaacccgtctcgtcaaatccgtcctgtaaaaaaaacccgcggtacaccgctaatttaaatatataattaaaataaatttttacgggattgcaattgtattttggtttgtcaaacaaatatttgttttaaatagttgccaaaatctagttcaaattttggagaaaaaagatttattggatagataaagaatgtatttaggtgtgttttgctcattttaagggattacaattatatttttgtttgtcaaacatttttttgttttaaatagttgctgaatactgtgtgcgtgacatatgagattggaatatttttagtttgttaatcaatttattgttcgaaaaaaatcaataattaaaagccaaaaatggctgcaaaaatgtatatatagattccaagtagtaagcccatgagaaaagactactctgcttctgaatatgctggattggatttggttttaaatcaaccctaaaaagccatcggtctctcatacgtaaagtcactcgtcgatagtcgtccttctttttcaccagatcacgtgctggagtgtgatgtctaagtgttgttgctaatgcattagttttgatactctgttagggtttccactttggtttataacacaagtcattacttttgaagctgaagtcgtactgcgatagccgatagcactgggaaggcattaaatctgaaggattattagagactagagagtttttttttaaatctctattaacaacaatg

SEQ ID NO: 9776 - DNA, 3000 bp, Unknown
  misc_feature (1)..( 3000): cDNA_ID_2185698_gDNA_ID_1972181_Annot_ID_180134 3000 nt of promoter + ATG
ccgttcttcttcgaacttctgcaactttgtttctcccaaatctgtgaatctcaagtgttcgtcttcaccatcatgctctctcgtttattccttagacattcgaatctccgtttcgtaaccctagtttcatcgaaatcaaattctcagatcttctcttcgtttattcgtccgctttcgactaacagtagcggcggcggaggaaatggtgacgggaatggtcgtaatcggaatgatgttccgtggagtttcactggagtaaacgatgataagtctggacctttctcttccgatgattcttttggttcttctggagttgcaggatctggtttacctggtggagaggggaaatggccggaggagcctaagagatggaatataaaggaggaagaggaaaaagttgtgtttgatactggtggtgaagtaggtcaagggattgagactagtcgcgagaggaggggtaatgaatgggaggagactaagagatgggatatgaaggagggagaggagaaagttgtgtttggtggcggaggagatgaggtggatgggtttggaatcaggggagaggtgaaatctaatgaatgggatgtgtcaaagccatggaatttgaaagaggaagaggagggagttgtgtttgatactggtggtgaagtgccgtttagctttgagaatagcttggaaatggcggaggaagagcgtgtgaagaaggagttgattgagaaggaagagaaggagcttcttgaggttatcaagggtgagacttttttaatttgttttgctgattcttaagttttgatcttatatgcaatgcaccagtagtttcgatatgtgtctagttttggaatgcagtgacaaatgggtagcaaatttgatctcatgactttccttgttaaggttagatttggatttgagggttaagtcaagtagcaaaggttgtgtaatcaatctatttataggcatgcttgctgagtggaggatatgatagtttttggagtaagctcggatgttgaagaggaataagcatttgggtagaaagacttgtgtttgaagtggatagttttgtgcttactgacgctaaggaacagtttagtgcttatgtgtttttgctattaacaatgttcagcacaataaattgaagaatttgttattttgatcacattggtaatggattctgctgctagtaaaacaagcgctagaagtagagtaattgatttgaaacttactattgcaggtcctgatcgagcatttggagaccttattgctaagtcaggtataacagatgaaatgctagatagtttaatagccttgaaagatttccaaggggtcgaaggattacctcctctgactgagattgaaaacctgcgtcgtgagaaaagttcaaagaagtcatcaagagctgagatagaactccagatgcaagaggacattgccaaagcacgggtgagacaagttgacgaaacaggtagagcctatggaactggaagaagaaaatgtagcattgcacgtgtttggattcaacctggggaaggaaaatttcaagttaatgaaaaagaatttgatgtctatttccctatgcttgatcatcgcgctgctcttctacgcccacttgctgaaaccaaaaccttgggtcgttgggatattaagtgcactgttaaaggcggtggtactacaggtaaaacctctccacaatcacttcgttttcttcgacgattagtcccaaagttctctatttacactagcaagtatgatttatgcttaagctagaggatttggtcataagttaacaaattagattgccatctctttacaaaaatcaacaattatccaagcatttccttctaatcgttgttaaccatgtactcaaatatttggtttaaaggtcaagtcggagctattcaattgggtatcagcagggcactgcaaaactgggaaccagatatgcggacatcacttcgagctggtaagcaagatactacaggcatcttagcgttattaaatctgtttagtcttattgatgttcattagcagagatacaacttattgtctgaccaacgttgtcatttgatagccggtatgtgtgttcatgtctgttgaatggattggtcttgatctcgatctttttcatcttcgatatgtttcagctggtttcttgacaagagactctcgagttgtggaaagaaagaaacctggaaaagccaaggcaagaaagagcttccaatgggtcaaacgttgaatccgaaaatgcgtactatatcttctcctttttgtctctgtcattttcattagttcgtctacttatcccgggtttagaagaatcaccggcaaataacttgttcttttggttcaatcccgtagttatctttttgtaccaacacattcttctcttacggctctactcttggaaacttgagtttcgttggtttctgagtcggacacatatttttgtatgtttttttccggcaaattgtcatgtttcttcaaaaggttcattgatgtttaaacataatgatcaactccttatatggattatattattaggtgaattttgattcttttgatcaaaatgttaaggaatgtccaattctcatagactttacaagagttggttacatttgctatatacaaaaatatctaattggataaactctattataccatccaaatatctaattacaagagtttgtgtaaagactttccataacagagcaatggatagattttgacgttatgttgataaattttattcacttgaaggttctattttgtgttacgtgcaagcatctactcattgaatttcttcactcctactacaagtactaacaaaattatcaatttcccaacaaatccatagatatcctttctctagcaatcgaagtaactattttagtttcattaaaataacatatcactcttaaggactatataataacaaattaccttcttgttgttctcagtttcttctcccaataccaaaaatattttgcttcatccaaggtcttgaag

SEQ ID NO: 9777 - DNA, 3000 bp, Unknown
  misc_feature (1)..( 3000): cDNA_ID_2185701_gDNA_ID_1972181_Annot_ID_180135 3000 nt of promoter + ATG
atgtactcaaatatttggtttaaaggtcaagtcggagctattcaattgggtatcagcagggcactgcaaaactgggaaccagatatgcggacatcacttcgagctggtaagcaagatactacaggcatcttagcgttattaaatctgtttagtcttattgatgttcattagcagagatacaacttattgtctgaccaacgttgtcatttgatagccggtatgtgtgttcatgtctgttgaatggattggtcttgatctcgatctttttcatcttcgatatgtttcagctggtttcttgacaagagactctcgagttgtggaaagaaagaaacctggaaaagccaaggcaagaaagagcttccaatgggtcaaacgttgaatccgaaaatgcgtactatatcttctcctttttgtctctgtcattttcattagttcgtctacttatcccgggtttagaagaatcaccggcaaataacttgttcttttggttcaatcccgtagttatctttttgtaccaacacattcttctcttacggctctactcttggaaacttgagtttcgttggtttctgagtcggacacatatttttgtatgtttttttccggcaaattgtcatgtttcttcaaaaggttcattgatgtttaaacataatgatcaactccttatatggattatattattaggtgaattttgattcttttgatcaaaatgttaaggaatgtccaattctcatagactttacaagagttggttacatttgctatatacaaaaatatctaattggataaactctattataccatccaaatatctaattacaagagtttgtgtaaagactttccataacagagcaatggatagattttgacgttatgttgataaattttattcacttgaaggttctattttgtgttacgtgcaagcatctactcattgaatttcttcactcctactacaagtactaacaaaattatcaatttcccaacaaatccatagatatcctttctctagcaatcgaagtaactattttagtttcattaaaataacatatcactcttaaggactatataataacaaattaccttcttgttgttctcagtttcttctcccaataccaaaaatattttgcttcatccaaggtcttgaagatgggtataaaagtttcatcaaagatcaaaagaattctcgcatccacaggttatattcctattttcatttttaaataccgctattatttttattttttctactgcaaatttgcaagaaaatttgtaaccaagaaaataataattttgaaactttcctcgattggtacagcttcaggtagttcaaatcccaaagatggtgctgacgtggatgtccgagaggaatatgcaaacgcctttcgtacggaatcatacaatcacttttggacacgtgtcgtacagctaagccgcaaaaagtccgcagtgtcttcttcttcttcttctccaccaatcgaatcatcctccacgtcagctcgtctcatgtcttatcgcctattcgcgcacaatcttctagacccggatctgaataccattactcggatactagatgtatcccgggtcgggcgacacacccgaactcttctctctgattacttcttggagacggcaaacgctttcttgctttgcacgcaattactaaaaaacattcatcatcttcgttctaaatacgagtctttgaaaccaaaatttcattcggaaaatcataattcattggctttaatagaccaattcacggagatatcaaaatggttcgacccgtttatctcgtcgggttctaggatccagctaatcagatccggctgtttatacttgctaaaacggctagagtcgagacgagacaagacacgagccaaacttaagcttatcaacggactaactcatagctcagggcttctcgttttggctctaaccactacattgattgtaaccatagcctctcacgcttttgctttgtttctagccgctccgactcttttagcctctcaatttaaaccagccggtttaaggaataagttaacaaaaacagcggctcggctcgacgttgctgccaaaggtacttacattttaagccgtgatttggacacgataagcagactagtgacacgaattaacgatgaagtgaaccatgttcgagccatggctgagttttgggttggtagagggtcgggtcgggttcgaggcagtgaagaagttgctcgagagttgaagagatgtgaagaaagctttagtgaagaacttgatgagcttgaagaacatatttacttgtgtttcatgactattaatcgggcaaggaatcttcttgttaaagagattttggattcggatgatccacctaattgttcattcgctcccaaatccaaaaaaaaattgtagtatttctttgtttcgttttttttctcatgtcaatttttattatttcttttgtttttgtctactacggtatgtatatatatttctttttaccctcaattatataatttttaattcctagaaatattagtgtcggaacatttttatttctatttggatgatattcggattctattagtagtcataaaaatgccaaatgcaagagtcttttatttttgggcaagccaaatacaagatagtctaaattatggaatttttaacatttgtcaaaagaaatcccaaaatccattacatatgtcggaaatgtaggaaaaccgattttaacaaatattttagacgacctctttgttttgggtaggagagactattcatcaaaaaatgaaccaaccataacatttttttttcctatatcttctaattaggtaaatcggttgactcataaaccgagtcagcaactcgtccgaaccataaaaaaacgattccaattcgacggaatctcacgagtttccacttttatataaagtcacttttgcaaatcgaacaaatgcttatagaagaaagttatcaaatctagagatagagagagtgaagagggcgaaaaat

SEQ ID NO: 9778 - DNA, 3000 bp, Unknown
  misc_feature (1)..( 3000): cDNA_ID_3033013_gDNA_ID_1972181_Annot_ID_180137 3000 nt of promoter + ATG
ggatgctgctatgtgataaatgccccttctttgaaatacttgaacataagaaggttcaagtatcttaactcttgtctgattgagaaagcgccagaactggccgaggcaaaagtcagtgacgtttctgatatagaaaatgagaacattttggaatctctaacttcagccaaacgtctttccatacacttatcacccttagaggtaatttttagattttagtttttcgacatattttctatgcaattgagccagaaatgttttgtgtactgattaatgttacctcatgcacagatcaagtatcctagtggtagcatcttccatcagcttttatctttgtaactacatacagataaaaggaagtggtggaatctacttacgttcatgcttgaagcttctcctaagttgcaaatcctcaagctcaccgacgtaagcaatttcactagtcagctacctttttttgtcttttccaaaacttcacttttaggtactttgttgatctaatattacataaattgcactgttctcagctaaatatgtcttctaccaaaggaaatcagataggccaaaaatggatccagcctaaatgtgtaccggaatgtttgttattccatcttgagacattcgtgtggacaggatacgaatggcaacgaagagatgagaaagaagtggcgagatacatcctaagaaacacaacaagtttgaagaaagcaactttctccacaaaacccatcgaaccggtaaagctcaaagtttttaaaaagagacgtgagatcctcaacgagttggctagtttgggcagggcttcaaatccaagtgattttgtgtttgaatctatttaatctctcgagcatatatatattatatatggtttgttgaccattgggaaatgtaaaactctcaactttatcaatcgataggatgccaaatcttggttacattttgaacttatactattgtagatatatatttttctaacaaaagctgaacttaggttttgaatagtatggactttctagaagaaatgatatgaattgattgcacataggctttttctaacaaaagctgaattggcaatttgctacttaaatgaatttgattgcataatttattgtagtgcttgaaaattctgaacttgcaagttctgtaataggaaacacatcacaaaataattgcaattggtcccaaaggcgtataaacttgttttcctttccatgactcttttgacctctaggtaatagtaaagccagtagatggaattagcagctaccaacctaacttaaatgaatttacagttgctatatatgattttctttttaatatataatactaaattagaaccagccaaagaaaattaattgagaattattcaaaagccattgtgattttctgtttgtcaagaaaaaaactacttccttaattttttttcctacataaaaatttagattgaaatctacattaatgttcagaatttacagttacaaacagttacagtagaaactctataaattaatattcggtaaattaataaacacgataaattaataaattatgtcgattccaagtcgggtcaatgtaaaaattaaccaaaatcgataagataataagataataattttttttgaaatctctttgtcaaaatatggtctcaataatatcataaatcaataattactaatcttaaacatacttttaaaggtaatctagtacaatatgactttagttatatttgttttttcttaaagtttgaatctttctgaagttcatctctaattttctttattgcatcaaaaactcttggtgttgtctttttgatatgcatccaaaagttgtgaagagttttagacgcgataattgcttccttacgtgtcaatatttaagaaagtttcacattatcgtcttcaagttcttcaccaacattataaacagaaatcacaatttcttcgaaaaactctgaatttttgagtatgcttcatttgcacctagatattcgagtaggctattgacatttattctattccgaaagaagatagtgttatattttgcttaaatatttctataaattaataaatattaatttatcctgtaaaataatatttattaatttatagaataaattaatttcactataaattaagaaaatttcatggtcccaacattattaatttatagaatttctactgtatatggaatctattcaataaaataatatgactaatgaaaatcaaccactatttattttgactaaacaagttacacaactactacaaccaccaaattctcatttttaattgtaattgtgtaatgttgatgaactttttcagtctaaatctagaaacttgggacaaattaaacaaaaattaacactaattatctcgaaatttaactcttaaattaataaccaaaattttgtaagaaaatagtattatttatattttatcttcttcacacaacacaacacagcaagctccaaagtagctctgcaactgcaagtttaaccccaaagtcactgccacaaataaagaaagcaaagctaacacgagtccagcgagttttgaatcttccttctatggcatgatttccatttcctcttccgttttccacgggaagacacttcccttctcttctttatcttctctcaaattcttcagttccttctcgaaatcattgatcttgatttgagctttagagaagagaagaacaaaattcataagagaacatagaataagtagtgagatctaatcctcttcccatgtttttgtctataaagtagcaattagaacttcaatcttcaatttcatttccattaacattgtttcccattcacaaagttgacttttttttctttggttttagcttcagttcaagattcttcagttgggtgtactaaagttttgaaatttctttgtttaaacattaaaagtttatgttttgatcgttaggtgtgctgcttcattggtctatgatgatgaatgtgttgttataactctgtatctgttcatg

SEQ ID NO: 9779 - DNA, 3000 bp, Unknown
  misc_feature (1)..( 3000): cDNA_ID_2185690_gDNA_ID_1972181_Annot_ID_180131 3000 nt of promoter + ATG
gttaactagatgtccttgttgtagtcttcttgttttcattcttgtccattcttattatgtgaagtatatatatgatagatttatttctacttttcctttaacttagtgtctcaagttcaagacagaccaagcacaagaagcgaagaagatggagaaactgaataacatatttttcaccctcatggccagaggacctgatggtaaaaatttcattttctgcatatctaacttaaagaaagaacatgcatcatctatctcttagtgtttgagaaaaaaacctcctttgttttattgagctatgaggttatttctattatgagacaatgtatcacatcgtcaccggctattattttctcaaaacatcgcttttctcctaccaatcttgaaagaatggaacttgaatgtgcatcatctcacaacctttaaaaggaaagctccttttgtgctgtgtaacattgggtgtattatagcttactttgtttatttatgttggttgtataatgcagtcgatctctcagaagtcaccgggaaagaacagatggagacacagcctgccaagaaaggaagaggaaggaagcaataagtctcaagatttgttttccgtttgtcttggtatcaagattttgatccatttttgtttgatattttgagatggtagggttgtcaagattcgttctaaagcttacgacttttttttacactttgatcgattaatcacttttggattagcctaaacccaaaagctaacctttttaacttggattttgaaagttggccaactccttatagcttgattagtaagaagactaaagatagtctttgaaaagagaaaaacacctggtcaattatgatggagacagagaagaaaaacgagatgattttcttaaccgatgatctatcagcaaatatcatatcgagattaccgcaaagaatcatcaccacttccaaactagtttgcaagcaatggaaatcactcgctgattctccgtattccagccaaagtaccatcaaaactcgcattcatgactgtcatgtacacacactcacaagaagaggtcatgggttactatgcacgcaagatttggggacttccacaaaataaattaagtatatttagaaatgtaagaattgtgggacccactggtaggggcggttggggcgatacaatacgattcgagaataatatcagaccttagaacttaagctttagttgacaccctacatacaaatacattttgtgtcacaacgttagtgcaaaatataatattaaatctggtatctatcttatacattttgaacataagagaaagcacgtaggaacatccattgattgttatatgaagcaatatggtatttcatggggaaaaagcttaagaagagatcaaaatcatggcatttgattcaaggaagagtcttaattaatcaaagaactaatgacgagagatcactcttttccttttcctttccctatcgtcatgtgattcctaaacctctcgagggtcgtagaagttttctacaaagagactgacattttcacacatcctgagttgatgaaacatcacgttgtttcttaattccttaacaatacatctcttttgatcagaactatacgactatgcaagttctttttttagtttctccgtttaatcttttatgttgtgtggaaataagcggttttcttatgtgacaatgtgcgtttttttttgtctgtttcgaatcctcaatatgacgaagattaatacatttatggttgtgtttcttttgtgttgtataaatatgtgtttgttttattttcaataataagcttggtttggtttccattgtttgaatttattgggtatacatattagaccaattagaattccacttgtaaatgcatattctggaacaataatgttgactatactaataattttttcttgggtctaaaacatttagtatacttttcttgaattttatgtaaagttattctgtttttaggacttttatcctcactgaattatgttgtgttaaagtagtagcttatatggtcacatatctcacacgtgtttccattttttttctatctaagttttcggtttttacattgtatacaaaaataaatggcatgccttgggccttggccactgattcacatgatcacgtagagtttgtgtgtgattcaaatcctagatgagaagatcatccaattgatctaagatgtgtctttcttatatcacacgttttattttaataatactcttcagttgggtttgattccatttatgatttatctatgaaaacagaatatgtcctcatgctgattatttcgtttgtggttgcattttaccatctgtagttttttttgtttactgacaaacaactaagattttatgaattcatttgatgataaatagttaatcaaatatattattatgagtgactcgatggcgaaagctggtattatcttatggctgctaaagtctacttttagaagaagaaaaaaaaagggtctgttgcattaccctgttgttgcgactctcctacaataactctcacgtggcccgtttcttggtttttgccctattttcacaaaagtaaacagagattttcactagcaaattgggcccaattggagacaacttcatgtggtttgaatcgtatatttcagatagattagacatctagtcttctttgatgtgcggtgaggatcttaagtcgctataacgttgtgaaaaaagaaaagaaaaagtcactataacatagatcgcaactaaacaaataaaggacactatacatgtacgtaataatattcatttattttcaacgacaatgttccctagggtggtaacccaagtatttttcatagatattatacttctagcgaaaagccatcaattgagaaaaaaggcctccacgtttgacccgttttgcctataaaaggattctttaagatatggaccttactcatcttctccgttaaacccatttaaatagttttcattgtccttgtgaaaaatg

SEQ ID NO: 9780 - DNA, 3000 bp, Unknown
  misc_feature (1)..( 3000): cDNA_ID_2687287_gDNA_ID_1972187_Annot_ID_180166 3000 nt of promoter + ATG
agcatagatcatgctaaaatagattttacaataagttcaaaaaaagagaggaagaggcttcgatcagtatataaaaaagttgcaagaaaacgacaagacacaaaaaatcaagatgaacacgttctcacgttgtgctcagccttcgtgttctattgcgaaagtgaaaatgaagaaccttttgtgaactcaattttctgcaagtaagcaaagaatgtgagaaataaaatggacaaaaaagcgtgtggataagactcacacgtgcgtggggtcttggtgaaaaaaagaaagaaaaatcatcttcggtatcttccacctttttaatcttccatctccttaatttcagagaaaaagctacacttcacatgacatatttcagacggctttgatttttgattttttttttttttaatttttgttgattaaatattcatatgtttcaacaacaaaattcgtaacatccaagaaaaacaaaagaaacatgtaaatttaccacagatcctgtttctagagtagtaaaaattgatttgttcgaactagaacactagaaatttattttaaacgtaggttattaaaaaatcgaaaaataacaaatgatgggtacatgcatgacaggtttgtaattttatgcgttggagggtttctcatgaatgtgcatgaagatttgtaagcctatgcttgaatatatgtatacaaaaatatatgtcccttgtccattgtaagtctttttcgatacacatttgtctcgaaatgacattacgatgtcgatattgttcatcatccacatgctgcgtctgcttgtagttgccaatctctatcctgacctaatgtcgttcacattattattatcattaaaatttgtatagtatatagtaaaatttcgaacaatgaaattattaatataactgatttgaatactttagctcgaaacattgttttaacaaaattaaagatatgtaagtgttcattaattattggcttaatttaagttacatgtacatatatgtcttaccaactaaaaaatatatgtctagtcttacaaaaaaatgactaatgtttcaccaaaaaaaaatgactgatgcatgattatattcaccaaaaaaaaaagcaaacaatacctggtagtgagacggccagagaagaagcaatcacattaagggcactgagcgacctcaaaatgtaagcaagagattatcagagaatcttgatttagtgaaatcacattaataatttctgagacggccagagaagaagcaaagagagtatgtttattatttctcaacttgttttaaattcttttatctgggcttggcccaatatatttaaaccaatgatcgcatatgtttagaaattccaaatattgttagtgggccttcgttcagcctatcctaaaaacatatgtttgttgtagtaggtaacaacccaaatcctaaaaacataatacaacaacacccatggcttcctttggtcatcttctcgttaattattcaaatatccacagttttttggacgttaacaaaaaaaaaaaggcagtggaacatacaacgttattcgacaatcttgcacgtaatattacagtacaatccgattcaagacaaactcaaacttcgaaaagaaaattgcatagcttaatttaggaacttaattattacaacacgtcaacacattacaaatcgaaggcaaaccagcaactattttctgtttacaaatcacaactacaagttattgacaattttatcctggaatgataaaacaaaaaggagaatcgtactcattatttgtcacatgcacaaaaatatacatttcacaacaaaaagtagttaaaacaaaaacttaaaaatagataccacaattgtacatataatctcttgaaaatttgaacaatacgaattacaagaatcgaacattcatttaggtggaatatttaaagacgagaaaatggcagcaaatggacgagtgatcataatagcaatgctaatggtggctatggtaatgaacatgacatggtgtgtcaacagcaaaggctttgttaacttaggaattagtcctgaagaactacagagttgcatcaagacttgtattccggaacaatgcatgcccgaggctaataatctgaccgtgtgtgagaaagcatgtcacaaatattgcaaccgacctgctatgtcgttcaagcccaactatgtcgttcctgtagatggaaatgatgttgggtttataaaagctgctttttgcaagctatggtgtgaagaaaactaattctttctttttaatggtgctaaaatttaattaaacctcttcttatcaatgagctcaacatctattattttctttaattggatttggtgagttttaatatgtgacaaaatactgacttgtatatcctaatgttgagtgtgttttgtcatcatcgtattattgatgattttgtttagtttatgccaatatatatttatgttattggtcgtatccccagtgagaaggggtctaaaagtaatttggggatagttggggtaaatatgataagactaaacatataaagggtgtgaatgaaaataaactcttaaaaaaagaaagagtagctcaatggccgtccgatgaaggtttcagttacacgtgtaatacgatgaagcaaccgactcaatattgaaaaaggaaaaaggaaaaggcaaacacatcagtcggcggatagcgccgaccaataatcatcaacatcgttttctttcttcgccaaccaattttagctttttaattaattttttcatcttcttcttcttattcctctgataataagatccaagatcttgttttcttcttcgtatcgtcgcgaaactcgcgatttcttttttgtttttcttcttcgattttgagtttcttccgtttctgttttttatctgatcggaagattctagctttcttcttttttttgttctttagatagtttttttcttactcagaaaaaccattggagctctcgttaagagttttatagtgttataagccatg

SEQ ID NO: 9781 - DNA, 3000 bp, Unknown
  misc_feature (1)..( 3000): cDNA_ID_3033212_gDNA_ID_1972187_Annot_ID_180191 3000 nt of promoter + ATG
cgtccgcttccgttctgcagatctcccacatgttcgaatccccatattataggccttcgcgttatcaacactcgtgtgcggtggatttccctccgtcggccatcccgtctccgccaccatcaccaccacgtttgcggcgttgatcttctccaacgccgcattgaatccgtcaaccatcgcctcaaacatattgttgtaatacaaatcaccgtctatcactaccggtgtattggatttgaaactagcgtaatcgagtgagatgtgatatggatctgacgcgtatgcgaagtacgggtagatattcgtcatgagaggcgaattcgtctctgagagtatcgatgtaatctccgtcatgatctcggttagatctgggaggaatgttgcagcggaaggtggatatgtattggtcaacgcggtcatagctaaaaccgtcgtgacagagattcctgtgacgccggaattcgttagcgcgacgttgacgttttttatcgcggcggcaacaaattgagcgatttctccggggaagacttcgttaccaattgtgatccatttaattgcaacgtcgttttggtaaggtgtaatccaggtggagacgaaatttgttgcggcggctggatcgtgagctagggattggatatcttcgtttcgtggaccaaacgcgactaagagacctgagccacgaagcgcttcgagcatgtctgcgaagggctcgtacatacggattgcgtcgatgttgttgcttttgtatagagcaactgtatctgccggcgttgggagattgttgccgttccggccgtaacaatctccggtgatgtcccctgcaacacctagaaggacacaaaatatagtaatcaaaccgtactcggttattgtttggtttaaaatatttaatcgtttccaaaaaacggagttagactgaaccagattacatccaaagaaaatcaaaccatgagataatgctttttattaatttaaacatagattgattaaataaagttgagtttttgttgttgttattattgtgaggttaattgtgatgaaaacaaaataaatcaataaatcagtttttacccgctgtgcaaaagatttggatggacaggagcataatcacaacagcgaaacggattagtttggaatccattgatgtatggtgcgtgtaaatgaactatttaggagagaattgatacgagattattctattgtgtttgtgtatgtttgaagatcttaatattggtgaatgtggaatgtatttaagggtggtttttttttttaggaagcatgcgtaattactactctaataataataggctctcaagcatgaattatttatccattaaatgaaatttaagtgtacctagttttgcaactgataaactatacaaattcgtgctacagctttgtcattaatggatgatcaaccattttttttttgtttaccaaaacatcatattattatgccacttgggttgggttaaacgttttctcttttggtggtttgcgaaaactctttagatcataggacttactcactatttttacattgtgtgcataaatacgtaattacctctgaagaaaagttacaggtgaagttcatcccctataaaaatgaagaactgtttggtaaaaacgttttaattaatcaccttcaaatacattctatcaatcggcgatatattaagaaagttaacaagttattaatttgtttactagatcaagatttcaattgtttactaatttgtcgttttgtgcaagagttatgcttaggtattaaaaatcaagacaaaaatttcattctacaaattgatttccacaagttttgaggttccagcttcgtaaatcattaggtattaatgcggtagttttatcatttcacaaaaaaacatttgaaataacattatacattaatacatccataaataattcaaacatcatgatctccttaattatatcaattaatctagttttttttttttttgctactcgatagttttaaagccaaaacattgtaaacaacggattctagtttaattggtgggcacaaagagtcattttcataataatatagaacatgtacatcacatgtaattaatacatacattctctttctgccaatcaatcataatcaaagcaatatttttttaaaaactaatatagagcaaatctaacaataaaaaagagagagtggtatcatcatcataaacaataagaaggctccaaaaaacagaaagttaaaaactaaaataaaagaaaatctaatttggatctaaatgaacttctgaaaaaagtaatgacctaatctccaattactacaaaaaagaaggatcaataaataattaaagaatcgagaggtaaaaaaagcattatccgtacgaatgaattaacgtggtcgtatctcgtgagtcatccaacgagtaaaaataaaacacgtgtcgtaacaaaggaggtgcacgagtactagcctacgcctcacacctctctatcatattctcttgaataaaaaagctgaaaaaataattaaaaaaaaattctggcaaaaatgaaccgttcctctgttgcctgcaaataacgcgaaaatctctctgagaaaaaataaaaataaaataaaagaaaccgaaccagtcgtgggaaggatccgaaagaagatgaaccagagaaatttgaagaagaaaccctaatcttagcctcgcttttattctatcttcttcttcttcttctttcttcgttcttaatctgagaggcgccaagattggtacgggcggagctaggctagggttaggattttaggctcgggaaattagggttagggttttgattttattggctgtttctttctcctgtggtttgggaggtgaaattgaaaggcggagttgtattggaggatttgggattttagggttagggttaagtgttttctcgttttttcatgggaggtgtgggagtttatggtggtggtttgtgtcggttatgaacgttgaccaatgccagtggcggaagaagatg

SEQ ID NO: 9782 - DNA, 3000 bp, Unknown
  misc_feature (1)..( 3000): cDNA_ID_3033216_gDNA_ID_1972187_Annot_ID_180190 3000 nt of promoter + ATG
tcccaggaaaattcaagatgggctccatttttttcaagtcttctatatacacctcaggcatccacagagaacaaaacagatgagcaaactccgccggcccaccattctcagtttttgagagaacaggtttaaggatgccacccttttttggacaaagcaagcatggtctttcagaatcagcacgaccattctccagctcacaccaagagcacaaccaaggtttacctgaatcttcaagcaggccatagcattttttgtgaactgtagctttgcaggaagtgcaaacaatcaactgatgatgaccagtgcagcaaaaatcacataacaacgcattcccttcacaaggagccgcaaccattaatttccccaaacctgcatcactaccaagaagcttccgctttttggagggcctttctgatgtcaacaaaatcctatttctattacctaaaacccattctaaactaccagaatagtctgacccagaggagattccattccctacattgtcaacacccattggcttaacaacatcctcttcttttcttactgtgccttcagatatatctttagtgagaaggttcttaatttgttccagaacaacgccatctccacaaacaacatcctcattctttgcactcgcatcagtttccctctgttgaatatcaatagaatcgtattccaccgatggaatggaaaagcaatttctagaagataaagatcgtagagatgctaaatcagacaaagtttctaaatcaggaaaatctaagcgcctaaagtagtcctcatgttcaagccagatactcccacttctcaacttatccccttgcctagaagacttcttcttcttcttatccgcaccagaatgagacttcttatgccgtttcttattatccgaatggttcttcagcaaattagctaaagcaataggtagagtaggcacacttaacacagaagtagaaccatcttcaggaacatcaaaaggagacctctcagatagatttttgctagcttgagctaagaaatcgatttccaacgaacccatatcctcatacccattctccttatctaacgcaaccctacgaaatggtcgataaggcttctcttcagcaccacaacctccgtccactcccctacccatcatcttcttccgccactggcattggtcaacgttcataaccgacacaaaccaccaccataaactcccacacctcccatgaaaaaacgagaaaacacttaaccctaaccctaaaatcccaaatcctccaatacaactccgcctttcaatttcacctcccaaaccacaggagaaagaaacagccaataaaatcaaaaccctaaccctaatttcccgagcctaaaatcctaaccctagcctagctccgcccgtaccaatcttggcgcctctcagattaagaacgaagaaagaagaagaagaagaagatagaataaaagcgaggctaagattagggtttcttcttcaaatttctctggttcatcttctttcggatccttcccacgactggttcggtttcttttattttatttttattttttctcagagagattttcgcgttatttgcaggcaacagaggaacggttcatttttgccagaatttttttttaattattttttcagcttttttattcaagagaatatgatagagaggtgtgaggcgtaggctagtactcgtgcacctcctttgttacgacacgtgttttatttttactcgttggatgactcacgagatacgaccacgttaattcattcgtacggataatgctttttttacctctcgattctttaattatttattgatccttcttttttgtagtaattggagattaggtcattacttttttcagaagttcatttagatccaaattagattttcttttattttagtttttaactttctgttttttggagccttcttattgtttatgatgatgataccactctctcttttttattgttagatttgctctatattagtttttaaaaaaatattgctttgattatgattgattggcagaaagagaatgtatgtattaattacatgtgatgtacatgttctatattattatgaaaatgactctttgtgcccaccaattaaactagaatccgttgtttacaatgttttggctttaaaactatcgagtagcaaaaaaaaaaaaaactagattaattgatataattaaggagatcatgatgtttgaattatttatggatgtattaatgtataatgttatttcaaatgtttttttgtgaaatgataaaactaccgcattaatacctaatgatttacgaagctggaacctcaaaacttgtggaaatcaatttgtagaatgaaatttttgtcttgatttttaatacctaagcataactcttgcacaaaacgacaaattagtaaacaattgaaatcttgatctagtaaacaaattaataacttgttaactttcttaatatatcgccgattgatagaatgtatttgaaggtgattaattaaaacgtttttaccaaacagttcttcatttttataggggatgaacttcacctgtaacttttcttcagaggtaattacgtatttatgcacacaatgtaaaaatagtgagtaagtcctatgatctaaagagttttcgcaaaccaccaaaagagaaaacgtttaacccaacccaagtggcataataatatgatgttttggtaaacaaaaaaaaaatggttgatcatccattaatgacaaagctgtagcacgaatttgtatagtttatcagttgcaaaactaggtacacttaaatttcatttaatggataaataattcatgcttgagagcctattattattagagtagtaattacgcatgcttcctaaaaaaaaaaaccacccttaaatacattccacattcaccaatattaagatcttcaaacatacacaaacacaatagaataatctcgtatcaattctctcctaaatagttcatttacacgcaccatacatcaatg

SEQ ID NO: 9783 - DNA, 3000 bp, Unknown
  misc_feature (1)..( 3000): cDNA_ID_3033187_gDNA_ID_1972187_Annot_ID_180172 3000 nt of promoter + ATG
cgaaaaaggggaagataatggctaagaaccatatgggtacaaccacgggtaatctagccatggctcttttgaacatgctcttcgtctcatgcacacctatcaatttctcccacacaaaatataacggtgtagacgcgaatccgaacgttataaattgatgaatgagcatgaggatcactgcggtatctctaaaaccagtcttagggagaagagagagcgcattggaatgagttagtagcttatcgccaaacgcccaataaaccgcagacgcggatggtagcgttagcgttagtacatatatggtcgctagtagatatatcgccttgaacttttgcggtttccacatagcgtgcattatctccctattatattttttcaaatttccaatacataattagttaagccattaattaagccattttatttttccaaacaaaaaaaaaatacttacactgtgacggcgtggccaccaaaggtgtagagaatgttggtggctccggtgaagtaaagcaccattgtggttggaccagagtgtttcacatcctcagccttttttatatgaaaaataaatatattaaacaacaataaccaggactatatgtctatatcttataataatcaaaacaagatttgtgttaattataatgacctggccatgaaggagtgaagcaatggtgagataccaagaagtgtaagtggtcatagcgagtccgaggaatgaccaaattctataattgtggaaggaaggaataaaaacagttgttgcacagcacgccccaaatatgtatgtccatgtcctcttgtccaatttgtcattaatataatatatattgctgcaaatcattttttatattaattaattttcaatatgaaaaaaccatataataaagaaaatgaacattgattattaatttacctagcacaagcaatgagctgaataacagatccaaagagaagaaaagtgcagttaaagatcaatccaaggttcctccaatgtttccccaacaatccatctaacacctcaaaccacttttttacacaaacaaaaaaaaacaaaaagttaaaattcaataataccaccaaaaaaataaaaaattataacgagtcacaagaattagaggtggaataaaacctgaataacgtggttacggaaatcgaatttttctcgttctttacgagttcgatattcaacgtaaagaacactaatgagataagcagtccaacttcccattaatccataaaagagttgaaacaaaattcccgacatcatcccaagttgtgagaacgagtatggtaatgtcaacagaacttgtgccacctgccatttttataacaatttagctatagaagacgatacatacacatctatatataagactaaatctgtgggaagtacatacctgatttgaagcacaactaaaccaagcatcgtagacagaaccaccatgccagaagaaattagagagttttgttttagttgaagatttcttgttaccacttatgttttcttcttccctctccatttctaagtaattccctgcgaccactgtctctattttctctgccgccatttttctcttcttctctcagtttctttagcttctttacttccactctttaaatagactagtgaaaagctttttcatttatttatttgttttatgggttttgtttcctttcttttgctctgtgtgcaattattgagtaacgagtgtcgggggacgaagtctttagtcacagctcacgagttgtcatggggatatcggtttatgattggttggtgactgagttatgtcacctacttgtgactgttactgttttcggcgagcgtggcgttgtttttttaatgggcttgatttgattgttgggcttatgggccatatttctggagcattacacgaacgggtaggcccggtttgagattgttaattatatattgaccccgataatatgcaaaaaaagagggttagctaattatagattttaaagtttaaagtagtgagagtagactaattgtaaattgaaaatagaagtgatgacaatgatgttttttttttttgaaagaaaggctaaactattattatcattaacaattatttgaatcatgatgattgtaacaactagaaacaatgaataaaacatattggtcctttcctccttcttgtgatgaggatgataacgatctttatgtagaataatcaattatatttctaagtttttatgttttgtccgattatattacatagctgttacctggaactcgaaattacataaatttatgcctttgtctaccatatggcatcgcacatccaaacgcttgatttagaagtagaaaaacttggttaaaagagaggaagaaatagtgatttgtgaggtaatcgaggattggagatggatccaatggaaagaatgattgctaatcaggtgggattagtggtaaacataattaccacacgtgtctagctgtctaagctttatttaactcactaatttcttagaaatgtctcctttttagccccatacttttacaatggatcgaattattaatgagaaggtatcatcattttagatctttatagctttttaacccggccaaaatggatggcagcggaaagaagactcatcgccaattgacattaaaatatgcattttcaaatgtttttttttttttttttttttttgtgattcaaccttatttaggctattgagatatctccaaaagatataatattgtcgtccctaaatagagcagatattcagatatcattggtaataatactgaaaaaatggcgagtcattgtagttaaataatttgacatcttgaaaccaggaactcgattctactggatggttacagatggttcccataacgacaaagattgtgagatttgttttgattttcatcaatttatcttcgtcagaaaatctgtttaaccaaaaaaaggatcatgactatacaaatttattaatggtgtaatattcaaaaagcagaatataaga

SEQ ID NO: 9784 - DNA, 3000 bp, Unknown
  misc_feature (1)..( 3000): cDNA_ID_3033181_gDNA_ID_1972187_Annot_ID_180176 3000 nt of promoter + ATG
cttttttatggtgtggtcattagcaacatacaagtagaaatcaagctccttgttaatgaatgtggtgttgtgaatgatgtcaggaaacgtttttctgaagcacggatctgaactaagattgatcccgcgtgatagagttggagctgtgtttgtgatggatccatagatgatgtgtaagcaatgattaaaaactcagttccaaaaaaaacataataatatactgaaatgcttatgtacaacttcgttgaataaatatgtaatcgtcacaattgaagtgagttgaatttggtcaagttatatgtctgttataattcatatttagataacgtatgtgcactaaaaaagagtatggatctctctgtatatgctaactcttgtcaatataaatatttatcttgtaatatagtttttttattaaaatatatttttaacttttattttattttaaagttaaaactgtaaggttttttatattttttaaataatattttggataaactatttttttgaagtgttttaagttttatattttgtgtagactttggatacaacatccaaaactaagcggtgttttagatttaatatgctttacatataaagtttttaaaattcgaaccaaaaacttgaatattaaatttacataataataggaaaaacaaattgaatgtttgggaatcgctaacgactgactaaatgatggattcaaatccggttagatttcataccattatgtaaatttagtatacacagaaacaaaaaaaatttaaaaaacatacacaacgaaaaaagcttttaaaaattcgaaacgaaacataatcaaagttttaaaaactatttttaaaaatccgaattaaaaacttgaacattaaatctacataataataggaaaaacaagttgaatatttggaatcgctaacgactaatgccggatccaaaaaccgattagatttcatatcattatgtaaaattgacattcaaataaataaaaattgaaattaataatatatataaaaatttagtatatgattagggtttaagttttagggtttatatatattaaaagctattaaaaaattatgaagggatagaaattgacctgtttcttaatgggtaggtgaatgggctttttgttgggctgaatatgagaatccaatccaatctcctccaccatcgtgtctgtcaccatacctcctaaaccagagcattgaagattcgacgtcttttgatgtcaaacaaaacctcctacgacgaggaagagtgagagaagatatcaagagacgaagggagaataagaattagaagcatatcttcttccaccacgccacgaagtttgaagatgaaatagaagcacgaatcgagaaagaaaattttaaaatcatcgtttgacgtttttggttggatacttaagaattttaagaagtcatatttactaaaagtcaaacgccgaatgtaggaagtaaaatatacgatgtataaatcatacgatagtggttaaaatatacgatatacgataatgattgttattaacccagagaaaaatgcgctcctctacggaacctaaacgctttaaaactccacgattgcaaaggataggatgatagtgatgagtatttaacaacctaattttataatcgatttttaaaaattttaaaattccgtaattttgtaaaacgcagacacaattatgagtatgtcacaaaacaaagctgaaacagtgaaacgaaaacagagagctttgattttctttataaaaaaattcacctaaatgaaatctacttgctgccagaaacagtatttacataagaaaacgaaacagtcatgaacaaataaaattaaaattttatacacacagtctcggctataaaacagaacaggggcaaaacagagagatcatttgtggaaacaaagcgtagcttatctagacaaaagcatcaatacgtgaaagtagctaatctagatacggagcgtgtgtcaagtattaacaatattctatatagcaagcaagataagtaactaaactctaaaatgtacgaattcgtctattcgaaagaaactaatataattaggaagagatcaatcactaacgaaaacatgaagattataacggaacaaaaagagatgggaacggatcttacggagttcggttttaaaatcagagttggatcgtcgtgtttctgaaacagtatcttcagtcctccggggaaaataactgcaaaagagacaaaagcgattcatcactagctcgaactaagaaaccttaaagatcaagagaaaggatctgctatttcagtggagtttacctgaatgattgttcgagcagagcatgatcctgactgactcatgagtaggagtgaaggaagaaagagagaaacttgaccgagagatggtgacgacggtgatgtctctctctcattatcttttctatgagcagaagaatagttgaaatttgtaaagagaaggaagaaatgtgttgttggtaatgagattgatagcgtttaagggagtatttataggaatcttcaccaacggctatcttcttacgaaaagcttcaccaacggctataataagttacaacgttcgactgtcttctcattgatttgacaaaattagccgttgcattagtattactgatttgtaattttgtaaaccaagccaagaaaagagcagtactatgtgatgggccaattagcccaaaaacgcacatagcgaaggcccaatggaccttaaatctggtatcggattgaattctaagaaagaaggagaagcggcaataaggagttcgaatctcaaacaaatttctgggttttttctttcctccaaaatttttaaacaatttctgtgtctgtggatttctacttggacggcgatggcgagaattggggctaaacccagaaattgaggatttgaattctgctgctgcggcgtctctgtggtggtttggtttctcgtttctgaaaatctacggtgtagtaagtcggagatgcagttgagatttagca

SEQ ID NO: 9785 - DNA, 3000 bp, Unknown
  misc_feature (1)..( 3000): cDNA_ID_2034611_gDNA_ID_1972187_Annot_ID_180178 3000 nt of promoter + ATG
acataacaatataacatatcattctagaatgtcttatgattcatatttttacttgtaaatcaggatatttgtaagttgtcttaaaacccatgtttttctgtcggagaaatataaacagtcagtaaatttcagcaaaatttaacaagttcaaattatgtttttgaccgtcgcacgtgtgcaacaaggccattgcacgtgactagtcagagaaaacataatcttcgttaggatcttgacgccaggccgccccgaaacaggtggttcgctttagattttgatgacgtggtttcaatcttgaccgctcaagttttcaccacgtggcaccgtctatgtcgttggattcttcgtagacgacggtattaggtgggccgtgacagcccaatgttcaaaagtgggtccacatatgtgccagatcagcttgatcattccaactgtagaaagatgtttataaaaatataatgacgcgtaattagatttaattatccgtaattaaagagtcatttgcctctcttgtcatatatgtctttaatttcttgttcccaaatcatggcgaatcaaaatctacgcgataaattatttttaaatgacaacgtcgcttggtcatgcgatgatattgatataatataagtatatagtttcctgaattattaagatgtgtattattatttactcgaattaaaaaacacaatcatttgaatctaataaccaataacaggctattgatatattaaattaaatagatctatctgacaaagtgatatcccaatcttatttgattatttggtgagagagaccaatgcattgtatatagtataaggattaggctctaataaggatcttcaacgatctctttgttatgcttttttacgttgaataaccttcgtactttataaaacatgaattcaatagtaaaaaatttgaccacagtaagcaaaaaaagataaaacggatacaagactacagtaatcctagaagaagcctcattttcaaaacactgttttttttgtataatcattacctcgtgctcttcaatttaatgacagcttcttatatgattagatcgaggcaaaataatgtatactctacaaaagaagtcaataactttccattagattaattgggattcaaccatacgactgtacgtgttatgtatgttacacttctatattcgtatagtatattaatcacatattcacacgatatcaaaatgaataactagcgagttaatctaagatagattcaacgaattaaattgaatatcaactgtagaagaactgaaactttgaataccgaccgacgaacgtgacataataaaagccacacagtagaacaatttcttaaaaaaatatcatcatgtggttacaaaacattatcacctggttcattacttaatttcattcgcgatgacgattatagttgatggtcgatcacagttaatatacagatacaattaatttggattagtactagtatagtttttttttaaagaaggagataaacataactaatcatttggtcttttacgtgggtatcacattaaatccatacaacgtagtgcacgccggtacaccttttctaaaatattataaatatatttaagaattactatagtctatataggctcaatcaaatgtgtcgatcgcttgagtccttttgttttttaacgttactaaatagtactagtagtaaattcactcttacaaaaccgttaggtgaatttacctttattctaacaataactatagtttaaacaaatttcaatgatgaaaagcggtcgacgaagtttctaactgcaatttgcttctgaaaaaatcagagtaaccaaaacagaattcgttaatttttacacgcacgcttaaatgcgtgtcgacgagtaaacgagcacgtatacatcaaacttgccggattttttttgttttgtgatgagttcacatgtaaacgatagtgacctttttgttataccgaaatagatcatagaccaattctcaaaccaatctctaaaatggttaatggtagccaatatgtcacattcctagatttcatatgttcaacttttaaacgctgttaacatataacgtattcatattttcaagttatcaacaacgcaatatacatgtttgattatttatatgtggctaatcgtgttacttctttttttttgttctaaattcaaatatgaagatttttagtggaaagaagatattggcccttgacaagttgtttatgatctattaaagttttgtttttccttttaattgaatttcctctatgtttatcacaaaataaagaaaatgaggagtaaaaacaaattcagcagaaaatagtgaaacaaatgattcatttccatatataaccacaaggaaaaagaaaatttccctattctaatagttttgttcctcctaattactctgattacatatatttaaactaaaactgaaaagtacacatatagtaatccggtcaggtgattactgtctttttttcaagattttggaagttttacccattttaaagaaaattttgaatgctgttctattatagtattaacatctgtttagtgaagtcaaaacattggtcataacaatgtgattaaagttaacatctgtttagtattaacatttttagggctggtgggctttttgtgtccacttcccgatggttactgcaactttaattgaattttactattttaccctacccaatattaaagctttttatttatttctctgcttctctcttttgctctgtctctttatcctttttcttttgatgcttcattctctcttttcttttttttcctctgtagcgtttctaggaatctctctccaacgtttaggtttcttctcagatttagaaagtttcttctctatctgaagaattttcatttcgatttcgcttcttccttcaccctaatccgtaatcgaatgccatttcgaagattgtgttgaagagtagagaggaagaagaagactaagaagctagggtttctctgatgagtag

SEQ ID NO: 9786 - DNA, 3000 bp, Unknown
  misc_feature (1)..( 3000): cDNA_ID_2034597_gDNA_ID_1972187_Annot_ID_180186 3000 nt of promoter + ATG
ttttcttatttgtctgtagtaaaattaatttcaaaaacaaatctaaaatggtaaaacatatgaatttcgtttagtttagaataatttttttttttttttggaattaaattattcttggggattcagtggtttaccgttcatgattcgtgatcacgtgtaacaattgccaaatctccatatcaaatttagtggtcgccattactctagctaaatgaggacaagcttgaagcttatatacgcatatgttggagttaagctatatgttgccgacgtcaaaaagaattaagctatcttgtcaatttagttgtgaattatggggcagaaaatcagaaaacagatatatattgtgcattctctgattcataaaaagagtttttcggatcttatatatcaaaaagggtcaaatactcctagatctttgtagacaagcatttaatcaaaaaaagtaaattaatatgtgagaaaattcttgtatttgatgaacaagtggacgcatcacaaatgaatgcgtagtctttggactaaatttcgagagcttgaaattcatttcacctcccatttgcttattagaagccaaacggttttgaataagctccgccctttccataagcacatgcagcttacttctaagtttccggcttttcagtgagctcacgctttcatttagcgacacatggccgtcgacttcataaattttgaggtcacgattttggtgttaacttcggcgttttatccatttttcttggatttttttgtgggttcattttggtagttcgggtatatagttcactttaacatgacttgcaagataatgcgctactgaaaatgtcgttatgacatgataattataaattctgtgcaaagttgattattacttactagcataaaggcttaaaaccaaaattgactcttgaatttatttcattacaccggatgcaaaagataaaagttagcgggtccatacgttcttacacatgtatcatttataattaataatctaataatcgaaaatccattttagtagaaaacaaaacaaaacagaaaatcgaaaattcaaacaagtgacaaaaataatattacgacccgtccctttgtttggttgccccgttcgtgtatttgcttggccgttggtgttcccatgcgccacttagcctccaaagtcttctctctaaactccttttttataccataatctctgtttagtttatacttaattgcgctttatcttcttaatcgtcatgtaatccataaaaatcttcgagatatttactttctcgacttaattaattaatacaatttctctatattaaactagtcaacaatatgctcaatatcatatcatacatatatgttttagcccacaggattctcactctccattttcttattattacactgacgtctaatttgacgttgattttaagaaattgaagtcaatatagacaaaatctatctgtgaatatgctgattaatacccttttatgtaatatgtatgtacacgtgatgtacttttaatcttgagtcatacatctatgatattttgcattcattaacatacaatttcccaaaactatgagcaagtttacgtgttacttttgtctttaatcatcattcaatattatcgaaaagttcgttgccatatcatatatttgtggaataaaactaggtaatattgttcttgttttacattaactaatgcatttttttttggggggcacacattaacttatgcatattccaaataaataaactattttgtcgccgtgacacattgataaaaaaaacattctagtgcttcgattgaaaattcaagtttctccaaaatttactctccgctgcatccgcactttacaattgtaaaagagaatacccagtattttgcatagacaaatctattttttttttttttgatgggtattttttatatctatgtcgtaagtacgttacgttagctagctagaacattccctagcaagaactagtagtgagtgaggaagagaaaaaagaactcagcattgcttatacaagagtccatgtttgtggatccaagggaaggtttatctcagctttttttcctcaagagaaaggtgtatcttgcccgtggttactcgattgttgttcgtattcaatttattaaattttatagcttcaagggaaggcatgtgtttcttcttttttaagtgcaatatttttgtttattacataaagtacttcctggaagtttcgtatagactccaatagggtttctctgacttttccaatttcagtgtcggagtacattaactctaaagaaataaacatgcatgaacatgctttttcatattctacatatattttgcagtctataattggtttttccactgtggtttacgctaaaataaataatatgttcttgttaaatggccacaaacaattccgacaccataaatgtgaaacttttaacaaaactatattatcaataactagctaaattatgatcaagaccagtaaacatttcaacacttaacgtaaagaaatgaattggctattgacgatataatttttttccatagaaaactatgcatatgtttgtcacaatttttttctttctttgtattaaagttaagtgttgagtgagagaggtatcataatcatagtaccctcccacgatattgcccacggatcgaatccttagacccgcattttatttttaacttcatatcgcattagtatttaaaagcaaatatatatatcctatgaaataaaaatctcccgccttaaaggccaaaccttaggatctaggtaggtgggtccctctactcagcgaccacacaaactcacatttgtcaatttctcctctctcttaatttattaattattttatttactcatctctgtaacgccccctataaatacaacctctcatttactcattcagaaaccaaaaaatttcacaaaccaaaccaaaaccaaaaaaatagcttatctctctcttatcaccggttcaatcactaaaccatg

SEQ ID NO: 9787 - DNA, 3000 bp, Unknown
  misc_feature (1)..( 3000): cDNA_ID_1031898_gDNA_ID_1972187_Annot_ID_180184 3000 nt of promoter + ATG
tagttacctttaaaaccatcaaaaatatattaatagaaaaggaaacttcctaaaagaacaatttaataaagtggataaaaaaagataagaaggtaggcagaagaaaacgtatggccgcgactcgtaacaagggacgtcccgaccactgcggagacggcgagacgctgactgattttttctttttcttttcctaaagaacgttgtttcgtgcttacaagggtcaaaaccatatccaattgttctgcctattattatataactaaagatcccctcttgtgctttgtctttattcgtgatatataatctaacttaaattagttctaaaatatatatgtcctacctatgtttctactgacctcagtccctagttagctatatggacatatgtgaaaatgacgcccaaaatttgaagagttcctcttcctgcaactaactcttatcttactcattgagctatgttaaatattgaatgttggcactctcgtattaaatatgccagttgcacctagataaaaaaacatgatagacatttagtttaaaacttgaaatgttatttgaactctttggattacgtggattgttgtatggattaaattttgaagatatttatatattgaagatgtttatatatattagagtttatatagcagaaaatattgatgtagatgttgtccttttgtagttactcttttttgttgcgtagtcctttctcctcatcctcctatgaagaaaaatccaaatagtttaaggaaatttttgtgtaattcatagtctttttcgtaaccacagttctatgtagctatcgtcatcatattcctctttgcaacaacaaaaaagatcgtttttgtaaaatttagtagggcactaaagtcgtcatttgttgtcctgtcgaaatctagcgttctgtcatccacaaataagttgtttgattcgagcttccaagattataatcttttttagatgggtcatgaagatttctaacttcgtatacgagtgtatccatataatttctaacatatacgtcttgtttttggtaggctctgcgtcttttgagaccacccccttgctaatgttttgttgcaccttagacaatccataatacgttacgtgagtcgaagttgcaccaaaatggtccaaatataatttaaatttggccacaaaacaacattttacaaacaaattcaacaaacatgcatcgtttcaaattttatttattcaatggcgttatttgttcattgtaaatattctgtttaactcactgacgaattttttaatttttcaaagaagaacatttttgatataaataacattttatggaaccaccggttaagctcgatgattttgagttttagttttgtcgttttgtgaaatcattaacgacctacatttgatccctcattactttaataattaggaatcaaacatgatgattaagttcaccaaagacgtctcttatggctattaagagtcagacgcaaggatgaccggggtcattaagacgtcttatattcaaccattactccactaattgctaattaatcagattaatttgtttaatacgataatgtattttgattaagtagctctcagccaacaggcaaaggataaattttggattattcaaagatttgtgggcttccaaaagcatagggaatggctccaactacattgggaaatatattatttaaatctccattcccatttgccacagtcgttggagtttattttttttttccaagtggaagaatcaattataattgtcggaatttctaaatcctacttgttggaaaacaaacccaagcaaaattagtttagaaatgtacggaaatctactatagaattatactaaacatatcaatatagctttgactttaaaattaaaacaattattgtgggcaattagttagatattttaccagggaaataagcagcactgttcatgcactctcttcttaattactatactttgaaagaacttatatgtcactgtattgccagttgccactaatatataaacaacatttcacttgttgacatcgctgtaaatgaagtttggaacgaccctcttaacaactaatagggttaattaaccactaaatttttccaagttgtcattttgtcttaatgtgagacgtaatatctaatacgtcggtctaacctaagagttggttccgatcacaaatttttgagaagtacctttcaataaaaaatttgttgttataatttcaccgtgttaagtaaaaacttaattaggagctattttctatttgatgtgaatttgaaaatgtcttcataaaaatagtatggaaaagggaatgtaattaatatagaccacagatacaaaaagatgtcccgtgcttaacacgtctgagtcattgtcgtacccttttgccaactttttcaagtttctttcgtgaaaatgactacactttttaaaataaattgacagatgattgttgcatgcatataatattcgcaaaatgccaaattctacccttaaccaaataatgtggtaatggatataaaatagttaacataaacaaaaatttggaaattttgaaaaatagagagtaaattgattttttttaaaaagtttgaattgaagtgaaaaaatatataaataaaaataataaacctgtagtttgatatatatagttagatagctcaagtttgagtaacttgaagtcttgaattactttatatgtttttctcacagattatattattttcgttctatcccaagaattgggataatattctctatattcgaggcctctctcttaagaagtcggtgtataatcttaagcccttacttgacacaaggcctctattaaaaagcccaataataatttttcttttcaaagcccaacacgtcaagaggagaaagaagtgcgtttgcgtttggattgaaaacgtggcgggcggttggaaactgaatcttaaacccttcactcacattcatcttcaccgtcaaatctctgaaactgagcttcgacgatg

SEQ ID NO: 9788 - DNA, 3000 bp, Unknown
  misc_feature (1)..( 3000): cDNA_ID_2034624_gDNA_ID_1972187_Annot_ID_180170 3000 nt of promoter + ATG
accagaaccatcgctgcatactaacttgttgtcatggtacgtgcacaccggcttcttcctacacacaattcaaaaacaaagaccaaaaaatataactttatttctgcatttgaattacttttacttttgcatatgaaattaacaaaggatgaataaagtatatcatgtaaatgtaaaagtcatggtctagtatgaatgaaacttgattagaatcataattaaagtaatcatgagatgttgttaaaaacgtaaaaaggacaaacctggaggaacagaaagaaatgacgtaatcagaggcagtgcaagtcataatactggtcggatcatcataagcataactataagcagtaggacaagcttgtttaaagatctttgagtaataagttggttgacacacaactgggttcccataaactcctctacaacaatactcatctctatcaaacacatcacaagcactcctacacgatatgactttcccgtttgatttcactgcgagctcctgcggacaatgtggcctcaaatcagctacgcaaccggcgacgctgcagtttccttttccgttcatcggagtcaccgacatcgggagattgaatccgtcgacgaggctcacgtcgtagaaatccaatgcggctaatgtgaattcagctagtgaagctggtggttttccggaggctgaacattttagagttgatccgcatgaaccggtttcgcatgttccggttccggttgagtcgaatttacaaccggttcgtccccaaattctgcctgaccagcctactggtgcgtggaatacgatggattggcccggtttgagctcgaatcctcctccgttgaagttttctcctggagttatcgccggccagatcgtttggtcacatgagtttatgatcgtgaatactcgagctgattctgaccattttgttcctgtggagtaattcacaggagttctaatcgttatccaaaccctaattaattaatacctagacaaggaaagacgtttaattacgatcgaaaatactataatgtttgaattattttacctgataatatggtgagaaagagtaacaagatccttggtgacaaaccgaaacgaattggcatctttactagaaaatattttaggatcaaatgtaatgttattttctgatcttgaagtgagactggctttttaagggaggaagaaagaataacttgcatggagagtctatcggtacaattataataatcggttgtagtactatatgtgttttcaaataattaaggttccttgttttggaatatgggaaagagttagttagtgttattcgtttcctgatgtttcatgcaagtattctttgggatgctgttaaggtaatcaaagtccaaatggccaaggatctatactgtatgtggctttttatctgtctatttgtatcttctattattgaatttggataatcttgttgatattgattattttagccttcatgtcatgggtcaattcatctacctactgatatattaggcctaattaatgaatcatatggcccatttatgtcgaactcaatctcaattgttcggtccattcttatattctgctttttgaatattacaccattaataaatttgtatagtcatgatcctttttttggttaaacagattttctgacgaagataaattgatgaaaatcaaaacaaatctcacaatctttgtcgttatgggaaccatctgtaaccatccagtagaatcgagttcctggtttcaagatgtcaaattatttaactacaatgactcgccattttttcagtattattaccaatgatatctgaatatctgctctatttagggacgacaatattatatcttttggagatatctcaatagcctaaataaggttgaatcacaaaaaaaaaaaaaaaaaaaaaaacatttgaaaatgcatattttaatgtcaattggcgatgagtcttctttccgctgccatccattttggccgggttaaaaagctataaagatctaaaatgatgataccttctcattaataattcgatccattgtaaaagtatggggctaaaaaggagacatttctaagaaattagtgagttaaataaagcttagacagctagacacgtgtggtaattatgtttaccactaatcccacctgattagcaatcattctttccattggatccatctccaatcctcgattacctcacaaatcactatttcttcctctcttttaaccaagtttttctacttctaaatcaagcgtttggatgtgcgatgccatatggtagacaaaggcataaatttatgtaatttcgagttccaggtaacagctatgtaatataatcggacaaaacataaaaacttagaaatataattgattattctacataaagatcgttatcatcctcatcacaagaaggaggaaaggaccaatatgttttattcattgtttctagttgttacaatcatcatgattcaaataattgttaatgataataatagtttagcctttctttcaaaaaaaaaaaacatcattgtcatcacttctattttcaatttacaattagtctactctcactactttaaactttaaaatctataattagctaaccctctttttttgcatattatcggggtcaatatataattaacaatctcaaaccgggcctacccgttcgtgtaatgctccagaaatatggcccataagcccaacaatcaaatcaagcccattaaaaaaacaacgccacgctcgccgaaaacagtaacagtcacaagtaggtgacataactcagtcaccaaccaatcataaaccgatatccccatgacaactcgtgagctgtgactaaagacttcgtcccccgacactcgttactcaataattgcacacagagcaaaagaaaggaaacaaaacccataaaacaaataaataaatgaaaaagcttttcactagtctatttaaagagtggaagtaaagaagctaaagaaactgagagaagaagagaaaaatg

SEQ ID NO: 9789 - DNA, 3000 bp, Unknown
  misc_feature (1)..( 3000): cDNA_ID_3033189_gDNA_ID_1972187_Annot_ID_180168 3000 nt of promoter + ATG
catatttgtggtggtttgggtattcgtagttgggttcgggtttggaggatgggcaagtatggtcaactttgttcgccagatcgacacttttggtctctttaccaaatgctaccaatgccctcctcacaagccatgatatacaaatttgccattcaagaccttctagaaagagagtttcatataagggggttttgatttcgagatctaatatatataagttactacatccaatttttttttagtatttattaaaaatcacatctctttgtaattgtttgacgacaataatcttttacctcgggtttgtttaatttgttatgttgagttatttttggtaaattgggttttttttgttccttagttaaggtgtgatggctatcttaggccaaccctattattatttagtgttcttctatagctcaagaaagtttcatgtgtgttttgtgtttaatgatctcgttattctcttttactgagatttaatttcatcgtcatttgaagtgcactgagtttttgatgaaaattgactataaattctgcgatcagtccaaatgaaatgatatggaaatacatgatttaaaatcatacaacctcgtgcatctatactctatagtaaaataaatttatgtgggtaagattatgagagttttattttagaatacattagattatctttgaagcaatcaaatattgatctaaattaactttttttcttctgaatgtgagtgatcccgatctgaatccatcatgggcaaattagcatcacatcacaaaaagggaaatgaaaggcgtatctttataaaagaagcaaaaggcaatggcaggctctgtgtcagtgttgttagtacataattaggcagactttttacaccaattgattcaatggttggtgcttggtaaagtcaaataactgatcaatcacatatgattattcgtttagttagatcatttttaaataaaaccaaaattggttacaaattttgatagatgtatcacaaacaaaacaaaaataaagatgaaatagtaattcatcgcgatatcatcattgaataaaaacaatcagagaagtaaacatatattagaaaaaaaacttaaagatgcaatagtcatagaaaactctaaaagatcatttaaatgaaactagtacttaatacactgctcttgttagttcatgatttgaactagttttcatatgacgtaattaaggaacaaggtagacaacaacaacaacataagcgatatatcgatatagctcgtaataattaagttggaacaaactcactatcatagtaccatgtctacccgaaaactgacatttgggttgagtttgcgagatggttacatttgactaacaacttcatattattattaggtactatcgaaaatgaaacctttttgggggtcaaaatccaaaaaaaatgaaaatcagtttttaaaaaagcatttaaactcataaaaatatttcatttattgccggaacaactagacttattaccaaaaaaaactgattccgacgacgggacactaaataattcaataggcataagttgtgatagatatataaatagaaattcatgattcagagtgtcaaaagttaatattctaacaaaccttttaagcgcttttatggatttgccaatctagtaaactgctttttgactagctttctaacttccatgctccaatcaatctcatgggaagttgggtcatcactattctgccattttctttacctactaaagatatagacaaaataatacaaaaacaatatggccaaaatgaactaatacaaaaacgttatcataatctatccttgaatatatatttaacctaatttgcttgtgctctgtgagatattacaaaagaagaagttaagtaggaaaaggacgaatttggggataattttggaaaaaaataattaaacgtatggtctaatattcctttgattcaaagcgttatgaaaaaataaatatgtaaatactatttactttacatttaatcattattataaaaaaaacaaatacgtgactactgttttattggcggatactgtatcctacatgcatatatttctataaatatgaatatactgtatgtagataaggtcctattgacattttgcttgtgaattgctatcgacatacatatagctaagcctagtttacaaaaaaataaataaataaaaaatacatatagctaagcctaattaagtacttagttcttaacaaaaaaaggcactaagcacgtatagtttatgacttttttttggaacataaaattccaaaccaatattgggatacaattaaataagattaatataagagttgtatacttagtagttagtacgaacatgtattatttattcaaatcatgatattaaaaatccgacaagatcaaactttaaatcagcatagatcatgctaaaatagattttacaataagttcaaaaaaagagaggaagaggcttcgatcagtatataaaaaagttgcaagaaaacgacaagacacaaaaaatcaagatgaacacgttctcacgttgtgctcagccttcgtgttctattgcgaaagtgaaaatgaagaaccttttgtgaactcaattttctgcaagtaagcaaagaatgtgagaaataaaatggacaaaaaagcgtgtggataagactcacacgtgcgtggggtcttggtgaaaaaaagaaagaaaaatcatcttcggtatcttccacctttttaatcttccatctccttaatttcagagaaaaagctacacttcacatgacatatttcagacggctttgatttttgattttttttttttttaatttttgttgattaaatattcatatgtttcaacaacaaaattcgtaacatccaagaaaaacaaaagaaacatgtaaatttaccacagatcctgtttctagagtagtaaaaattgatttgttcgaactagaacactagaaatttattttaaacgtaggttattaaaaaatcgaaaaataacaaatg

SEQ ID NO: 9790 - DNA, 3000 bp, Unknown
  misc_feature (1)..( 3000): cDNA_ID_3033369_gDNA_ID_1972192_Annot_ID_180206 3000 nt of promoter + ATG
atatcaacatgaagcattaatagtaaagagaataataagtgtagaggaagtgattagtgccttaatgacagtccaattctgatatgcaccaggagaccatggattaggactaacaagacgtcttggtatcccttgaggaacacttttccaaggtatgtatgatatacaagtccacactaccaccattactggaacaccataatctgctataaacccacgtaaccattctgcaatgacaaggataccgatgttcctgaggttcttgcttggagaagtaaatgacttttagacagatttttttggtttttgattcactgtttgaataaatatcaaggttccttaccagcaccaaatctccaagaccttgcttttcggctttttagtccagtatagagaagtccagaagacaaaaccaaaccgaacattccatttgcaaacacccaagcaggttgaaactcagctgatcttggatttgttcttccggggacaccaaactcatccacaatgccctgaaaagtagagtttcaacataaaggaatgcctttggtgcaaatgctagtataagttgtgaatgtaattgataaagaaagctcttttacttactctaatggcttcttgcatgaaaagcatggctattagaataccaaacagttccccagcaagtcgagtgaatcgattgatgaaggtgcaagcgcctaatacagctaacaagaacaacaacagccccgtccacaagcaaacccttaaaaagaaatcatccatgaaaaacaaaaaggacaatgcccctctcataaatttttgagactttaaaagcttttgaaaggaactgagctatgcaaagagaaaaacttgagtttaccatccggtccacgctagaaagagattagagcccaaatccgttctacttttagcaaaattgaacatgaaggtgtacattataacagtaggctctgcaacaccaagaatcaacaatggttgtccaccaataatggaatgtatcactccacataatgcagtcgaaactaaggtttgaacagcggtaatcttcccatcttgttgcaaaagaaacaaaacacacaagttttctgttactctcacaataatcaaagacagattatttgaatgagggaacaaaaagagttatcatataccagtatctctttccaactgttctccaaatgtaatcaccggaatagcggatgcaaagaatatgtaagttgttggtgccagaatcctataatatttttgcataaattaagttactatcaaagctcaagcatcaacatttcctgaaaaatgaatatacctaaatccagctctgagaccactgatccaatcttgcttgtagcagttgagtctccctttgacatctttctttataccctgaaacgggacaaagctctctgcttcgtccatgtagatttggtgtgttcaagttttcagtgtcctacaaaacaacactcagttctgttaaaactcaaaacccaggattatgatgcatgattaagataaagcatgtagtaaccaagataggaaatctgatacaactagaatgatttagattgaaaaaaattccaatagtgtaaccaaaataaacaaagagtaacgaataaatcttaatacccttttaattactaagaaactcagatccgaatacaaatatttgcaggaaccttaaaagaaacccaaagaaatgtcttcaaaagcgttaattgcggaggatgtctttaaaaggagttatgtagatttgataatgggtgatttggcaaacaaaaaggtgagaactttacaacacatttagtacggaaagctcatagaaaaatcaaaagctggcgagaagtaaaaaagtcatgggatctctgagcttggattcaagaatgactgagagagaaagaaagaaaaacacttaccagagacaaatcagctcaaaatgactaaaggaacacaactttagaagactgagagaaaatagctttcgttttctaggcttgacctctctagtctctatacaagagccgtgggagattttttatcagttaaaaactactgctggaggagaaaaaaacaacagtaaaattggattttaaaaaagggaagagagtgtgatgtgttgagatctgatgagaggagagagatgtctgtctctgtgtctctttgactccggtttcagacaatgctcgtgattggttttgtacacttcttccgcctaacacggcgtttaaatgtctcttatcactcttttaccaatttttctataaatgagattaagttaagagtcaagttggttcatttatctcattctcatctcttccaaactaagacatttttagatttttgagtcatacatttttctcggattgatgaattggaatctttttccaaaaacatgtcacattttctgacaatgacgatttacttgatttaatgggtttttagttttttacaaattctttggacgaattttcctaataaatatcttctatttactagctagtggcatcctaatctacagtactaatgggcggtgatttccagcactcactgattagaaaatactagtttgctaaccattttttatagtattcatttttctcgcataatttatactataattttaattcactctacaaacatctttttttttttcttttgtaatacactcttttgtattttattaagatacgaaacacatacatcaagctaaaaaggtcatagacaacaaactagccaaagcaaaacataaaacctaagacttttcaaaacgaaaagcccaactatgaagcccaacaagaagaaaccgcatcagaagagatatcaatcttattcttagcccaacacattaccaaaaagaaatcttattcttagcccaacaagcagagagagagagagactcagactaccttagggatccgtttttcaactttcccccaatttctctccagaaatcgaatcgaactttgttcttcttcttcgtccaagctttagaatcgaaaatcgatg

SEQ ID NO: 9791 - DNA, 3000 bp, Unknown
  misc_feature (1)..( 3000): cDNA_ID_2991799_gDNA_ID_1972192_Annot_ID_180209 3000 nt of promoter + ATG
aaacagttgcgctttgcattctcggggtaagctactagtagtttacacaaacatagaaactatgagatatcacttcttgccttgtcttggttaatccctctctgatggatgtttctccatgttgatacagaccaaagtcatcccagcaaaatacataatgaagacggatgatgatgcgtttgtacggattgatgagctcctatcaagtctagaagaaagaccgtctagtgcccttctgtacggtttgatctcatttgattcatcaccggaccgtgaacaaggcagcaaatggtttatccctaaagaggtaaaacttctcaatatttctcacacctctgtgggctctaatcctcttagagactcatatatggctttctctttgtgaaggaatggcctttagattcataccctccatgggcacatggccctggctacatcatctctcatgatatagcgaaatttgtggtgaagggtcaccgtcaaagagatcttggagtgagttttgtagtttcatcaccatagagttaagatataacgaatcctagatatcataagtgacgttgttcttatgttgtttgttgaaagcttttcaagctggaagatgtggcgatggggatatggattcaacaattcaaccagacgataaaaagagtgaagtacatcaatgacaaaagatttcataacagtgattgtaaatcaaattacattcttgttcattaccaaactcctagactaattttgtgtctttgggagaagctgcaaaaagagaaccaatctatttgctgcgaataaatctctcgagcatgtacgtatgtaacttttctggttctgtttcacacttcaggaagaagttctcccagttaaagacacactggctcgagtatgtcagagtatattggctattatctgtctttgtagattctctcaatcagcatatctacaaacatattcgaaccatagtttataggccaggagcgtgtcaaaggtgccattagtgtcttattcattgtcctcgtaaacgttgttgcttttgttgtatcggggcacacttatccggatttatcgattatgcaattgccctactacatcacattattatttaaatttgtcttcaagtttttatttcgcatagcacatatataaagaaaacgcttcgttcaaactcgtctgtgaactccataaaacttattaaaaaatccgtccaaaaaaatatatagtatagtttggatcgcatgaaaacatatctaaacataagtctttgttaggggtcggattgggcccttctcaagtagttcatcagctcgcccttctcaagaagctcgttagctcgctccacttcgtcaagctcttcagatcgcctttaagctcttcaaactcgactcgtcctcaagctcctcagctcgtcttcaagctcttcccatcactcagcgaccatttcctcgcctagctgtcagctagtcagctcgtccaactcctcgtctagctatcagctcatccctcgtcaactacctgccgacctacctccaatgacggcctagctcacttattctaatatgaactacgtgtggcttgatccctttctaagggtacgtaggcaaccttttacaaggttcagctataaaacgaataaactctattcttcctcggacatcaagttcgtcttccggcctcaagctcgcctttcatctacaatcagctcgttcttactccatctatgctcgttgaagaaatcatcctttgtaatccgtccaattcgcctaagtcgcaggctcgtctttaatagaaagattcttccttccctagagatcccattttcgtacttgtgtgattcgtgcatcaacagttggcgcgccaggtagggggatagctcgaagtggcttgatccctttctaagggtacgtaggcaaccttttacaaggttcagctataaaacgaataaactctattcttcctcggacatcaagttcgtcttccggcatcaagctcgcctttcatctacaatcagctcgttcttactccatctatgctcgttgaagaaatcatcctttgtaatccgtccaattcgcctaagtcgcaggctcgtctttaatagaaagattcttccttccctagagatcccattttcgtacttgtgtgattcgtgcatcaacagttggcgcgccaggtagggggatagctcgaagatatctctcaaaactacgaccccgcgacgaagcaaagtgataacaaacagactacatggagcattcgataccgactcgtcaggctctggaagtaaaacgacaacgtcgatccccgggagagccagtcactcgacctcttcattcgatatcgcagcatgttctccgacaagaaaaggacttcaaggaactatcgaccccatcatcctaggcgatgacacttccagcccggcagtcaggacaataacactgaccaacgaggaagtgccgccgatcaaagaggaacatcccataacctcattaaacataccgacctcgttatcactcacgcctaaccaagaacaagaggagaagtcatcaggcgggcgtcacttggagaacctcgacgatgacactcccagctcggcagctcggacgataacgtcagcgcacgggaagacaactcaaataaaggaagaatactactcggtatgtaaaaaaattttattattactttttcaacctagttatttgcaggtaaaaaaatcattactttttaaaaaggctagcagacgaatcaacacggtatgctattaactaaaaccaaaataaaaataaaacttagtggttttccaaaaataaaaaacagtgagcggatgacagttgtcaaaagcagcacatggttttacttactttcccggtttaaagaaagaagcaaaccctagttttagagcatctttctttctttctttctttttcccgtcgcttttaaagcatctttcttatccgtcgcagttcatcttcctaactccatctctataaaagaaaaaccccggcaaca

SEQ ID NO: 9792 - DNA, 3000 bp, Unknown
  misc_feature (1)..( 3000): cDNA_ID_2025043_gDNA_ID_1972192_Annot_ID_180216 3000 nt of promoter + ATG
agatatcttcgagctatccccctacctggcgcgccaactgttgatgcacgaatcacacaagtacgaaaatgggatctctagggaaggaagaatctttctattaaagacgagcctgcgacttaggcgaattggacggatttcaaaggatgatttcttcaacgagcattgatggagtaagaacgagctgattgtagatgaaaggcgagcttgaggccggaagacgaacttaatgtccgaggaagaatagagtttattcgttttatagctgaaccttgtaaaaggttgcctacgtacccttagaaagggatcaagccacacgtagttcatattagaataagtgagctaggccgtcattggaggtaggtcggcaggtagttgacgagggatgagctatagctagacgaggagttggacgagctgactagctgacagctaggcggcgaggacatggtcgctgtgatgggaagagcttgaagacgagctgaggagcttgaggacgagccgaggagtttgaagagctgaagagcttgacgaagaggagcgagctgatgaactacttgagaagggcccaatccgacccctaacaaagacttatgtttagatatgttttcatgcgatccaaactatactatatatttttttggacggattttttaataagttttatggagttcacagacgagtttgaacgaagcgttttctttatatatgtgctatgcgaaataaaaacttgaagacaaatttaaataataatgtgatgtagtagggcaattgcataatcgataaatccggataagtgtgccccgatacaacaaaagcaacaacgtttacgaaaatttaacaagtccaaaagtaacagacatgataataatatcctcattacaaaactcaacacacgatcaaaataagtgaaacataacataaaccataaaccctcaagtttcaatacgtatcaggagatttaatgggggggggggttaaaatcatatactcctccttgccgaactattaggggtcggattgggcctacttggcccaatgcccaaacccaagtcaaaagcccaaaataagttccaaaccaaggaggagtattaaggcgaagggtagtttcgtcaaatccctcgatgaatgccctacacgcgtagtgctataaatacggaatagcatgtcatgtcgaaggggggaattccgcctgacacgcagacacagagtagctcgcctttctcaagtagctcgtcagcgagcccttctcaagaagctcgttagctcgctcctcttcgacaagcttatcaactcgttctcttcaccaagtccctcagctcgtcttcaagctctccaactcgtctttaagctcttcaaactcttcagatcgccattaagctcaacaagctgctaagctcgtcttcaagctcctcaactcgtcttcaagcttctcagctcgtcttcatgctccactcaacgaccatctcctcgtctagctgtcatctatacagctcgtccaactcctcgtctagctatcagctcatccctcgaaaacaaaactcatctacctcctcgcctagcggcagttcgtccattgactgcatagtccacctatctcgtcgtccagctcgtctagaccttcagcaaacaactcggtttatccaactcgtctctctaccacggttcatccagcttgtcgcacatctgccggctcgtcaactacctgccgacctacctccaatgacggcctagctcacttattctaatatgaactacgtgtggcttgacccctttctaatatggactacgtgtcgtctcgcttgactatcaccgagacagcacattgtcagctcgcccgtctcacgaagatcgtccgtctcaaatagctcgtcagctcgtccttctcaagtagctcgtcagcgagcccttctcaagaagctcgttagctcgctcctcttcgtcaagcttatcaactcgttctcttcaccaagtcccccagctcgtcttcaagctctccaactcgtcttcaagctcttcagctcgccttaagctcttcagctcgcctttaagctcttcaaactctttagctcgcccttcttacaaaaacaaaaaaggatatcaattatgtagatcaaaacaaaaacaaaaaaggacttacaaggacgtagatatcaattatgtagatcaaagaataagcagtccaaattccagcgttgatgaaacgaactaacgatagccaaaacggcatgtacttgaaggtcttagtctccggcggcattttgtcctaattgtttcacgcattaaaaacttatcaaaaccagtttaatagtttacttatctatatattcatcaataagtgagagccagagagagagagagagcttactatggtaaataaaagatagatgataacaatgttgtaaacgttgcaaacaacaccaatgaatgtatgcttgccggccggataaactcccaaatccccagatagtcatacaatagactgttgccacaaaactaaactccaacggaagcaatagataaaagagtaatatctgcacatcaacatcgacatcatcaaaatcaatatacaatatttttctggatttgttttttttttctttgggatatttctatagaatttagtcaagattgtgtttgtttgttaccaccttttgtgcaccagtcaccaatccttatttttattattaaatctatttttgatactataattcgtgattttccttttagttttatatatatatatacttacagagatgcgagcttcatattattatttttatctttttgaacaccaaaaaaatagcctcgtattatttttaaatgatcaattatgtgatcatatttaaaaatacgatccggtttttaagggatttgaacggatcaaatgtgtttccggttcggttatataaaccggtattttaccatatccaaccgaaatgagtatcgacgggaattatccgtaaacagagtgacagtgaggtgtgaaggaagaagacg

SEQ ID NO: 9793 - DNA, 3000 bp, Unknown
  misc_feature (1)..( 3000): cDNA_ID_2034426_gDNA_ID_1972192_Annot_ID_180218 3000 nt of promoter + ATG
ggaataacaaaatctccaaaagctggtcacatgtggctcattcttgtccaagtcaaaccttcttcacatcttttgtattttattttattagtacaataacttattaatattactcttaatttccgttgcaatatgcttttaatgctctcattcggctgactaattttcacttttcgactttacagaccaaaaaaactttttatttcttgccatgaagtgacatggaattgatactcatggtttggtttactaataagtttctcaaataaggtcttaaccaagaagacttttttttttgtcctcaatttaactcttgtattattcgcattggatatgaaatttcttttgtatgtgcaagatcttggattcttttaatattcttaattatgcaacgtatccaaaattccaaattgattccttcaatggcatcaatgcctatactaagaacctcggaaagcttatttgaaatcataaaacgcttgagttgtcaaaaacactcacataaaactctatatatatgtatgtaatatagttatatagggatcccataaatacataagaaattattatttttgttcaaattatgaaaatagtttttgcatagtaatataaaagatgtgcaaaactagtttatctagaaatatagttgttataccacaacaaaaattgtgatggatactatttgaaaccactgtataatttttttttgacctctattagggttgtattaaaagactacaacaaataacaaactaaattgtctctcttttgtttaacaatgttcacacatatatattatcggatgtaaacatgggtttattattagatgcaaggccggcccaataaattattggatcttgtgctatgctccaaatttttttacctaaaactctaaatatttaaaaaactagaccctgttttgcaattatttgaaaatttggaccctaaaatataaagaaaaaactgaataaagaattgggacccggtgcactagcacactcagcacctcccaagagtcgggcctgattagatggtgaccatactgaaacaaactaatatgatatgtcaatgttttgagtttaattctatttggtttctcattattcaaaataactctcattaaatggaacaaaaactcttattagtttaaatcttaactttttttatgaagagaatgggcttctttacctactacactcaatgagccctctggttcgtttggtcatcagttcaaatggacagtgactttggaatagatctcgaccgttggtcatcatcaccctaatgctttgtgttgccgttggattggtcatgtcatgaccaaaccaatttgacttctttatgtgatgtaaaagtcttattgctctcaaataatcttctaaaccatccacgcgcctgactaaagcaactgaacgtcagacgctacaatagatccaaattaagaaaatgggaatacaattttttttttttttggttgggaaaataatatctctcacttcagagttcagatatgaaaataaatatttatatcttcttgttaattcgacataaattttaccaaaaaaagagaaaaaaaaactatcgtactctttgttttaaaataatttaatcgcataaaatacaattaatttatagcattggtttgtaaataccatggaaaactcataaccaagaaggaaaaaattgtattactaattgattggtgagtgggtgaccaaaatcatttgtaagaaaggctttcgattggcatgttgttcattgttcttgtaacagttgcatcttaagtaattagtatatacgtgtaagatttatggaaaatggagtttaatggatggaaacaaacaatatcagtgacacaatactattttgcccatgctcaaatggacatcatgttctattttttcttgacaagtagagagattcatcgctttttaaaatcaaactttcattttgtagtgggagccttaattgtatttgacccataaatccaatttcttcatggacgtgtcgtggtccattgattaaaataaaaaaagtagaataaacaatcgcttttaattctttttaaaaacaaagaaacaatccaatgtaattttcgattaaaatcattttgattcgatgtgatattgtgtagagaaaacttcattagcaattaatttactaaaatatagtaattgtagtacaaaatatatttcctataatctaagtacagtattttatcgatactaaatctaacagtctaataatcaacgtccctttcctatacatgaatgtacaattaaacaaaaaatagaaatttatagactcaatgatttaaagtacataccaccaaatatggcagcctagtgattgttgtaataagcttttctaaaatatttctacctgattttcaagctttataatttgtatttcagattcttatttatataccaacaaaaatatctacgtaaaatttatcattttcttaaaatatattttggtatttaaaaggaaaagaaatagagaagaaaaaacaagaaataaaataaaaaaagagaagagagagaggagaggagaggtcactaattgtctatgtttggcgcgtatattaaccaccaccggcaaaacacccacgaaaaaggcgaccacgcataaagaaagatcaaaacttccccatcacttccaaaaagcaataacacacacacaaacttgttaccagggaaattataaataaaaatcgtagccgaaaattataaaaatattttatttttattttagttcaaaaaagttttcagctttgaaggcagagagagagagagagagatcaagcgactagtgagagtggtgttgaagcgaaactacgatcttcttttttccttttcagattttcacaatcacaacactcttctttgatcggagctctaacattccgacaaaagctcaaaaaaaaaaaaaaaaaagacttctttcttttgctcttttgagggatttgtctccctctgtagagattagggtctatca

SEQ ID NO: 9794 - DNA, 3000 bp, Unknown
  misc_feature (1)..( 3000): cDNA_ID_3033335_gDNA_ID_1972192_Annot_ID_180222 3000 nt of promoter + ATG
aagcaagtgaccaagcacgatgcaagcacaaagcaaagctacgaacaaattcatggagacgaccgatgcatgatcagaagcgaaaagagcctctgttttttccagcattgtgcttaatccgatcaccatttccaaatctcagctttaagagtatatttcctatatatatgtaaaaaaacacgaagcgtgatttgtggaatttagatttctgattgaattagtatctaaaattgtatagtttccttctttagccgccgagaaaaattcaaatcactaaaattcctaaataggggaataataaaacattccaaaatcataatgttccagaagaatcaaaaccctggaaaattccaagaaaatttgaaaattcctttagagtttgtgtcaggaaacatgtaatttatcaatcttcatcaacaagagctcaatttatcacctccatgaacagtaaaaggatctaaattaaaaagcatccacagaaatgtttttaagaaaaaatcgataaagcattcaaacacatattacctggcagagttatgacgagattcgaaagatcgaatgattcagtttggtcgtagagagggatgtaacagttctgttgaagggacagcaaagagacgatcgaagacgagagaccgccaaagatggcgtaaatatataaataaagattttttttgcagagaagccaagtggaatagagagaggtcaacggcttttaaatctcatattagctaatctccatcgtctatttatccatctcaagaactttattccaattaaacggttgagatgattttgttacaccgttgttatgaccgtaagtggaattagctcattggttatcatgttgtcgtgtaaaaggagtatcaaaaaacaacagaggggaacacgcttttatttttcttatgaccaaatgtaaatgatcttaggattattctctttttaggaataaaactgaataatatactgtttgtactgtattctttttatggcaccgtattacataatagccaaatacttccttaacagaactaaattacgtactttgaatgataaccagtttcataaactgaccccaaaatatttatttgaattatattaattgtgatagatgggggttgttctttcttatgtcattcgacgtttacttgataattaaatataagttggtcattttttaataaggtttccacgaatctctgatgaaaaataaataccaaatagagaatttcttggtaatctacatatgtactaattaataattatggactctttttttcttggtcgttttttttttttttttttgtcatgttttctatatgtactaatttttgggtcttgattaaaatattggatgtaaaaagagtacttattcatcttcatcattacaaggaaatagcttttgtaatatgaataattagataatactagtcgcccagatgtttgtttgttcgattttttctttcactgttcttattctttgcacttacagagagggcaaaagccaattctagtgtacccattttgggggtcaacatgattaagggttcatcattgtacgtctcgatttatcctttttcatcgtgtaaattcctttcatcttcattattttgttagagatgcaaaatttgtattctaaataagaaatcaaaaaccatcttgaaacataaaaataggtagttcaattgtttgaagaccaagaaacttagaattcaaggctaaaagttcaatttttcggtaagggtaagaaaaacatgtacagggcaatagaactagtataaattcttagattacaggcatctaacatatacacgaaacaaaacaatgtagttttatgattttttggtaaactattgttttcagtttattgtattaatatctatgaacgttgttaacatgtccgatccattgaaaagaaaagaaaaactagagagtttttcaaagctattgggaggcttaactggttggtcaaatgtgaatgaaccaatcccatggtacatggatattgaaacattaacagcagattagttatagtagtgggtcaaacatgtgaccctttagtttggcattttgaatgcctcgtggtctgcttttgtgtctctccgatctacattattattatctatttacttttcttttaagacgccacacatgttacatgtatatgacatataactataatacatgtataaataagtgttgacaattggaaatatttcagcctcatactcatacagtgaaaagtaacgaatctatagtttagctacttggattatttagttttgttttcttaagaaagaaagaagaaagaaaaggaatgtagaagaagaagtaacgaatgatgatagattgatagtgtaagacacattaatgacttccacattatggccggtcaaaagtatcttttgattttcaattttagctgttacacaacaacaacaaaaaatagattctgaattagtgatcaatggttaaaatattttggtcattcctcatctacgaaaatgaagatttgatcaccaccgaaacgtatacagtagttgtttttttcttaattttattgacaaattcgtgcaattaatgaggcggctttatctagtctagttttagtttatatagtagtggataaaactagtcaacggattatatgaaaaaataagtgaatttaagatcaaactcataccaaaaacgtcatgtttatcattttttgttgttgttttttccacacaggtttatcatccttatcctatcagcgaataatagaagaaaaagtacaaattctctaataaagcggtaaaagcgtttaagaagatgaagaagaaaaaggaaacgcctccaaatcaccattattgtccgaatcttcttcgcgtctctcaccaacaccacttctcctaccttcttcttcacaccaaatgattctctcgtataatattcatcaaacccagatcatgttttcatcatcaatcatctcttaaactcctctatagatctcaccgcatg

SEQ ID NO: 9795 - DNA, 3000 bp, Unknown
  misc_feature (1)..( 3000): cDNA_ID_3033331_gDNA_ID_1972192_Annot_ID_180226 3000 nt of promoter + ATG
ttgcccggtgtgattttttggtttgtggtgtgattttgtaaagccggtccgtttttcgttgtttgagtttgtggttttgttgaaaaattgtaactgtccatgtaaatagggactgatataggggtgacttgagtacacctagctcatatgcagacgttagcgtctgcgtttggagattcgagtttgcgttggtgggacgtgagcagattttttaatctaaagtttgtgtacactttcttgtacttcttatacaaaacaaagggacacgaatctttctaatgttcataatttattactgggttttgcaagaaacttgttgacaatatacaaataaactgataacttatatataaatataacttttgagaaatctaatcttatttttatgcttgcacgtatataaggacaaagtgagtgggtatcaatcaaccttatagtaacatatacaatctttcacgcataaaaccctataatgtgaaaacaagaaacgtcctttacatatttcttctcacctagatattattaattttaatattgagactttgaaaccccagaaataagataaagtgtgggacaagaaaagaaggcacctttttttgttgttgcttttagccgtgaggccagcatatgcagtaactcacatgcatgcgcctctaaccttgtggcattttaggaattatgcaataatgcactatacttaaatacgttaattcacaaagtaatacattcattcagttcataaacacgtctcaagattaagacaaaaataatcataaaaaactggtgttttacataaacttatgtcgaaattaattagtagtctacatataattactcaagtgttatttgcatgtaaacagtacaaatttttggaacgtttgattttgatactactataaactgcagtatactgtaaagcatgcatatgacgtcactttaatttgaaacgtaatttcaactttttcaaaaggttctttagcttagcgataaaaaaaaaaaaaaaagttagtgtatagtaaacgaacaaatgaaatgaaaagaagagaaaagtataagtcctcaaagtgtattgaatcacttaacggtaaattagtttttatttttatttttatccagagttcttaagttaattatgcatcaattatgtggttctgacgtaatatattacttgcgtttttcatctaaaccaatctaaaactgtaacaaaatgttaagtggagaacaataaaaaatacaaatagtaaaaaaaaattgaaaatcaaactaaatctaattttattcgttatttttaggggacaaataaactcatgaaaataatgacgtacgtggtctaaaatatatgaatgacctatatagctgaaacggcaagaagccggagcgagaaacaatagacggcggcgaagacaaagtagatgaaaactccgggagcttgagaagacagagaagcaagagatgaagccggaggagaagccgatggagcgaaggcgggatcaggatctgcggaaacgtcgtcgttttctggttcaggaagtgttgaagaagaagggatggtttgagtggaggagacggcgggtgaagggaggagaggagcgatctccggtgagatcttttcttcagagggagagattgtttgcgaagatgggattgtatttgtcgtcggcgaagagagagaaagtgaggagagaaagatgaaggtgatgagtgttagcaatatagatgaagccatcttttttggttactgtaatgatgaacaaatcaaagctgagttgtttttttccttaactgatgagagcgcattttgtgttgtaataatgatactgtctctataaaagaaaacttttagctctaatagtaaaatattataaattgattttaaatggaatttgtctcacctttttccaaaaagattattatttatcaatttaaaggatgtgttcggtggaaaagaaaatatatttgctgaattcttgaagatgggcgtagatcgagttttcactttttagtagaagctcttatatattgcacatattttcgaataaacatgtgctttactttttgctgaaaaatattatgttaatgcaaattatacatattgctaagtacgagtaaaggcatctccatccatgagaaacctacaaagtttctaaaacaaaaaaaatattaatattatattataatttaattatttgattaaaaaagtaattttgttaaaaaattgaatcaatagtgagatgagaattgtcatgatgggttgtagagaatatctcaaaatttttcaagtgagaaactttctacattttctctccttcattttcattatttttatttttttaattgtgaaaaactcttatgaaataccttcaatggagatggtctaattacgtttgttgttgcctcgttggatgttcaaataaaaagcacattttatattgggttgttcctaaacaaatattttgttgtcttttgtactaaagtttattggcgagttaagaaaagctttgtggtgtgtgggaattattattattatttattatttattgttctttagtttgctatgcaattcgagcccactaaagaggcttcctatgggcccaaaaaacgcagcccactattgtagtgcaaaacgtgctgagttttctacattgcatgcccaacaatggccaccagtgtagttaaagactcaagaacttgctgacctctatttgtttgactttcttttttgtgtgaacaaaatcacatattgttgatgtcatttgttctgctataattcttaacttcagattacagataacgaattttctcttgatgatttaaacaaacatatataattgtcaatatcagaaaatgaaaaggagatataaataatttttttttgcgcctaatcgaaacttcacctaccattttttagcgtataaaaacgttaaaaataccaaaatttagaaatccaataaaagttgtgaaaaaaagccgcaaagggtcgttgttgtttgtcgcctctca

SEQ ID NO: 9796 - DNA, 1470 bp, Unknown
  misc_feature (1)..( 1470): cDNA_ID_3015862_gDNA_ID_1972192_Annot_ID_180234 3000 nt of promoter + ATG
ttccaccaggttggtaaggttgtcctgaggagggtgatggattttgaaaagccgacggagatggtattctattaattggaggaacactgcaagcaaaaaccataataacttaggctagaatctaaagaagaagaaaacccgagagtagactgaaaaattaataattgaataagtaaccaacctaacatcatcattagacacatagaactgaaagagaaaaggaataaaagcaagccatacgattaagaatgtctaacctttgaaccccacctggtcggtaaggtttccctatagagagctgagggttttgagaagccgacagaggtggtgctcgctgaattgaaggaccactacaagccaaagttacgaaagaaaactgagcgaatttacgaaagaaaactacaacaagtagcacaataggctcttcctatggaggctcagaaacaacctaacatactcgcatagaaagaaatcaaagctgtagagctaaggttaatctaaccttcgaattccaccaggtccaaaagattgtcctgcaaaggctgaatggttttgagacgccggtggttgaattgatgaatcactacaagcaaatccaacattcgcagtgtgtaagaataaaaaagaaaggtacaatctaagaacaaaaagcaaagtaaagcaactcgcagcttctcctaaggaagatgaagaagcaaaacccgactgcctaagtgatatagaacacaatatcatagaaaattcaagatacttctctcattctcatgatcctaaacactttaatacaacgatagcatatatgtaaatttgacagttcaaaaaaatctctgagtataatagatccatagcgtgaaatgaatcctaaaaatctcaaaactcgaagaaaagtccgattgaagcatagatacatctatagagaatgaagagcacacctagtggttgaagaagcaccgaacggtgtaaacggcgctggcttagagctcatcggacctaagtccttcccgaaaggcctaaacgccattctctgagaaaattccttgacttgattatcgctgcctctcttctaattctccttcaaccttcgtttaattacgtcgccggctaaagtcgaaaccggagcaaattgaattttctgttctggtgacgcctcttccgtccggcgaggattattttacgtttaaaaccaacgacgtcgtttttatttccgaattttatgttgggccttttaagtaacaataggcttattatgggctttggtcaaggaacaagaataattgttcaaccaagaagaacgtgcgcatgttgtcaccatctcccttgagcctccttgttttaggtagaacatcaacttttcatgaccgttgacattttttttccctctttattttccgagaaaaaataaataaaattatcctctagttttcgatctcgatcatctggatccaagaaattactacgattgctataatg

SEQ ID NO: 9797 - DNA, 3000 bp, Unknown
  misc_feature (1)..( 3000): cDNA_ID_3033327_gDNA_ID_1972192_Annot_ID_180228 3000 nt of promoter + ATG
gtatgctataacggtgacaaaaattgttttttctctagagtagtgaacagaatcatacagattttatttttatttgttaaggtttgctaggcatagaaaaatttggggtgaatgatgtaaatcttttttacctgcagctgtacaattccgcacaaagaagctgcattgcaatgttgtgatgaagttgatccattggcaaaggtctgatttgctaaaaacagcagataattttgttcgcaaccccaatcactatcagatagcataaatagccatcctgcttcaacctgaatgtttacttttaatatcatacagtctataggagctgtgaacactatactaaggagaaaaagtgacggaaagttgttgggttacaacacagattgtattggttccatttctgctattgaggatggcctacgaagtaagtctatgttcacagctttttgctccatttggagaagtttcggttttagtcatggagccttctcctctgtttgttttttcaggttcaggtgatccaagcagtgtaccttcttcttcttcgccattggccagtaaaacagtggtggttattggtgctggtggagcaggcaaggctcttgcttatggtgcaaaagaaaagggggccaaagttgtaattgctaatcgaacttacggtaaaatacatgtccttaattggaaatttcgctttgtgaacaccttagattattctattaccggtcatgctcgaccttgacaatactcttcttctcctcgtcttttattggttataatgttagatgtagtaactgatgatatgatttgttttgttcctgatgttgtgtttctaaagaacgagcactagaactcgcagaagcaataggaggcaaagcgttatctctgacagatttagataactatcacccagaagatggcatggttttggcaaacacaacatctatgggtatgcaaccaaatgttgaggagactccaatttctaaggtaagctctccttgtaacagctcatccttttgttttctataggtaacgaaggaactgttctatcctttttctgttattgaaataccaaaagccagcttatcgcatgcaaactttgttgaaatcttaaatctataagacaaattagtaagctagcttgtctttgtttcccccaggatgcattgaagcactatgcactggtctttgatgcggtatacactccgagaatcaccagactgttgagggaagcagaagaaagtggagccataactgtctcagggtcagagatgtttgtcaggcaggcttacgagcagtttgagatcttcaccggtttacccggtaagtgacactaatactggaacaaaaccatgtgttgtattaaaatttaaacaaaagaagcctacttaatggtggtccctttgttgtgcagctccaaaggaactctactggcaaataatgtcaaagtactgagacatagcttaagtgtgtgtgtgtgtacttccatgaaaagtcgtcgattcaataaagctttagattgccatttgtatgttccgagaatgtccttttttgaggccataagccgaatgactggttctctctttgtatttatatatatgtataaactattaagcctaacattaatcttttttaagtttctttgatttgatgagtctactataaaaaagaagggttaagttgcatactagtcactttttaaaacttaattggaaaagtagtcactttactattcataatttgtaaaatagtcatttttcactgtttgattcgtacacttagtttgtacactatttttagtgtacagatgtatataaaaaatacacagcgtacactttacatttgcacactaaaagtgatgtacaatccaagtgtacgaatcaaaccgtgaaaaatgactactttgcaaattatgaatagtaaagtcactactttcctaattaagtttgaaaaagtgactattttgccaacacacccaaaaaagaactacaccaactatgactcggtgttctaaatactgttcttctgtaatgaaagcttgatttgaaactcaaaattgaaaatttcgtaaatttcgtaatttgatattattagaaaaccgaaagaaaacgcatcggatttcgagatttattaatttcgcacgaacgaattatttgattcccgccaaagcaaatagagcaaatataggaattacagtttaacccgccaaattgaaaatggattataaaatctcacaaaagaactttcggttcagttttctctgtcttattttcgcgggcagctcacatttctctccaccgtctcctcgtcttctctcaccaaagtaagcttttttcttcttttttttctttcagtttcatgtttccattattgattgattcaaaatctcaaccagcaaagaattaaaaaatgattcagaactgattctcaaccatagcgtttattgctctctctctatccacattcacatcacatgggcttcgtttctttgtacttcactttccattttgattttttctttcccaacttgaatttgatttgatgatgattcgtttagaatactctgcgtcatacggaggagtcttaattctaactaaaattgaaggtttgatatgcaattactttaaaatacgtcatcttttctaattaaccccaaagttgattaaatttactaaaatcatcaaaagaagaaattagatggcatttagtttcacattacaggcgtcgtgaactttagtcggattcattcctctccggtgagtttctgtaatttctctcactctccaattgagttacctcctatttcataattattcctctgatcgtataaaggttttaatttggagaatccaccctcctctgttttatccgctccacaattcgccgccggttttgtctctgctgttcgaattctcgattctccgatgagttcttcaactgttttgttttgttgagctccttacttttaggtttctttctcatttgctttaattacttccgaccaaa

SEQ ID NO: 9798 - DNA, 3000 bp, Unknown
  misc_feature (1)..( 3000): cDNA_ID_2033208_gDNA_ID_1972192_Annot_ID_180235 3000 nt of promoter + ATG
ggggatctttaacgacatatgtcaagtaactacagttgtcagttttgggtttcaatgtaaagcaactcattttccttctttctttattctactatatcgagaactattagtgtaacacctatgttttcaacgtcaaagtgctccgatataatatattttaggagctgtgtgtaaacaacatttcgacttgttcttctttctcgcaaacatcggaagaatccaccgggaaagtatcatctgccttgcgcttcctcgattcattctcctcagatatctccatcatcgaattatcatcatccgcgtttttcaatttggaatccatgttggagtaaacaaccctagatctacgagaaacgacgacttttgtagttgatctaagtcacgagactcgatcgcaactatttcagggggaaaaataatctattttcaaatttttcatcacaaaaagttgtattatatatttaacgtaagttgttttaatataattcaagttaaccagacgaaaaaaatcattctataaagcgagacgatacatgtaacaacaatcagaaacaagaaaatgaaactcgatcaagaaaaaaaaacttttaatgttacagagaaaaagaggagtttaaagtctttaacaagctttacagctacgtctgcaattcccagggatctctggagttccaaccatatactctggattctttccacattctccaagcactgcccatctctcacagctctcgtttacgtcagtacagttaccatcatgtgtcaatatcttatcgaatgagtccacgtggatccacttagtagccgaccatttctctccttcgatcactggacaacctccgtgaaggctaaaggggtctgggattgcgtcttgttggaggttgaagaacaacagagcattccctttcttcggtttcactaataacattaccaaccaatatcaaacacaaacattcttagagataacatggaaagaacaagtcatgattccttttatatatagctcaccagcgattcctttctttgcacaatcagaaagatcgtctttattctcagaaagcgagcggcgagagaattcctgcgcagaaatattcatcatacagaaaaagagtaaagacctatttgtccacgtatatagagaaccaatacaagattagcaattgtggaaatgtaagcggaaattggtggtattgtctgaaaaacaacaaacctgtgcatcggggaaaacagtttctccaccctttgtgacattggacagatacaagagaaccgttgctatgcggtgtccaccacgggcaatgttgactttgtcgtggaagtagtcaaagtgagcatcatatttctgaccgtgctcatatctcaatacctgaaggtcttccccgttttctgtgaccacaaagtgaagaacttaggaaacaataatatcttctgaaaaaccctttcaagaaactcaacaacagttaaggttccttgtcaattgacattgtgaaacagagagaccactattgaaaaaccattcagattgttaaagttaccttttgggagaaatgtccatgttgagagcttgtcctcgataccggaaacaataggatcctgtcattaaacaaacgaagcttcacattaagattgtaatcacactgagatatctaaatttctcaaatctgttcctaataatcactaagtatcattcatcatccttcatccatacacagaagtaaatttatgtctagctatcaccctaaaacctttttagtagtaaacaacaatcacaaatcaacacaatttggggtcaatttactaagatctcgacttatcaacatcattttatcaaactctgatgaccagttcaatatgtgtgtgaacttttggattgaattattctaaaatttctatttccatcagatcttgaggggtttgacttatcagatccattagtatcagaaatcacatcagagattcagagttcttgaggtcgagtgtcataaattagaatcaagatcaattccaatcaagccattcaatgagatctgatgtgccgaattaaaattgcacctttcctttggagataaaagtgccggagctggtacgaacatcactgacttgactctcgccattatcgttatcagcaaccgcagatctctgcagattctctttcgcctttccccaaaaaaaaaaaaaccaaaattagatactgaaactagcacatttaagccaaaaagtttccaaatttgagctcaaacccaaagagcaaaattcgcactcacaagagagattagatgatcacattccaagtccgtcaaaaaaccttcatacacaaatgccctgaagaaacagtcaatacacacagttggaggttcaaagtttccaaatttgcttcatttctcactaaatagacaagagaaagagtaaaatcaaacctgggcttcgacgaaacctgtttgactttagaaggattgatgatagaacttggagaactaatcagacaagtggaagactgaagcaagacgagcaatatagcgacgaacaacaacaatccgagccgagacatcgacattatagcaatcgtagtaatttcttggatccagatgatcgagatcgaaaactagaggataattttatttattttttctcggaaaataaagagggaaaaaaaatgtcaacggtcatgaaaagttgatgttctacctaaaacaaggaggctcaagggagatggtgacaacatgcgcacgttcttcttggttgaacaattattcttgttccttgaccaaagcccataataagcctattgttacttaaaaggcccaacataaaattcggaaataaaaacgacgtcgttggttttaaacgtaaaataatcctcgccggacggaagaggcgtcaccagaacagaaaattcaatttgctccggtttcgactttagccggcgacgtaattaaacgaaggttgaaggagaattagaagagaggcagcgataatcaagtcaaggaattttctcagaga

SEQ ID NO: 9799 - DNA, 3000 bp, Unknown
  misc_feature (1)..( 3000): cDNA_ID_2034408_gDNA_ID_1972192_Annot_ID_180223 3000 nt of promoter + ATG
gatttctctaagcagctcctccgggagctccgaccagctgaaagggtctgaactattagcggttgaggcggcggcgtgaactacacggtgtggcctagaccgcatttcctggagtaaacttcggaacgtcatgcggtgagatctatagaggagtttaagagatgattgatgatgaaaacatgatctgggtttgatgaatattatacgagagaatcatttggtgtgaagaagaaggtaggagaagtggtgttggtgagagacgcgaagaagattcggacaataatggtgatttggaggcgtttcctttttcttcttcatcttcttaaacgcttttaccgctttattagagaatttgtactttttcttctattattcgctgataggataaggatgataaacctgtgtggaaaaaacaacaacaaaaaatgataaacatgacgtttttggtatgagtttgatcttaaattcacttattttttcatataatccgttgactagttttatccactactatataaactaaaactagactagataaagccgcctcattaattgcacgaatttgtcaataaaattaagaaaaaaacaactactgtatacgtttcggtggtgatcaaatcttcattttcgtagatgaggaatgaccaaaatattttaaccattgatcactaattcagaatctattttttgttgttgttgtgtaacagctaaaattgaaaatcaaaagatacttttgaccggccataatgtggaagtcattaatgtgtcttacactatcaatctatcatcattcgttacttcttcttctacattccttttctttcttctttctttcttaagaaaacaaaactaaataatccaagtagctaaactatagattcgttacttttcactgtatgagtatgaggctgaaatatttccaattgtcaacacttatttatacatgtattatagttatatgtcatatacatgtaacatgtgtggcgtcttaaaagaaaagtaaatagataataataatgtagatcggagagacacaaaagcagaccacgaggcattcaaaatgccaaactaaagggtcacatgtttgacccactactataactaatctgctgttaatgtttcaatatccatgtaccatgggattggttcattcacatttgaccaaccagttaagcctcccaatagctttgaaaaactctctagtttttcttttcttttcaatggatcggacatgttaacaacgttcatagatattaatacaataaactgaaaacaatagtttaccaaaaaatcataaaactacattgttttgtttcgtgtatatgttagatgcctgtaatctaagaatttatactagttctattgccctgtacatgtttttcttacccttaccgaaaaattgaacttttagccttgaattctaagtttcttggtcttcaaacaattgaactacctatttttatgtttcaagatggtttttgatttcttatttagaatacaaattttgcatctctaacaaaataatgaagatgaaaggaatttacacgatgaaaaaggataaatcgagacgtacaatgatgaacccttaatcatgttgacccccaaaatgggtacactagaattggcttttgccctctctgtaagtgcaaagaataagaacagtgaaagaaaaaatcgaacaaacaaacatctgggcgactagtattatctaattattcatattacaaaagctatttccttgtaatgatgaagatgaataagtactctttttacatccaatattttaatcaagacccaaaaattagtacatatagaaaacatgacaaaaaaaaaaaaaaaaaacgaccaagaaaaaaagagtccataattattaattagtacatatgtagattaccaagaaattctctatttggtatttatttttcatcagagattcgtggaaaccttattaaaaaatgaccaacttatatttaattatcaagtaaacgtcgaatgacataagaaagaacaacccccatctatcacaattaatataattcaaataaatattttggggtcagtttatgaaactggttatcattcaaagtacgtaatttagttctgttaaggaagtatttggctattatgtaatacggtgccataaaaagaatacagtacaaacagtatattattcagttttattcctaaaaagagaataatcctaagatcatttacatttggtcataagaaaaataaaagcgtgttcccctctgttgttttttgatactccttttacacgacaacatgataaccaatgagctaattccacttacggtcataacaacggtgtaacaaaatcatctcaaccgtttaattggaataaagttcttgagatggataaatagacgatggagattagctaatatgagatttaaaagccgttgacctctctctattccacttggcttctctgcaaaaaaaatctttatttatatatttacgccatctttggcggtctctcgtcttcgatcgtctctttgctgtcccttcaacagaactgttacatccctctctacgaccaaactgaatcattcgatctttcgaatctcgtcataactctgccaggtaatatgtgtttgaatgctttatcgattttttcttaaaaacatttctgtggatgctttttaatttagatccttttactgttcatggaggtgataaattgagctcttgttgatgaagattgataaattacatgtttcctgacacaaactctaaaggaattttcaaattttcttggaattttccagggttttgattcttctggaacattatgattttggaatgttttattattcccctatttaggaattttagtgatttgaatttttctcggcggctaaagaaggaaactatacaattttagatactaattcaatcagaaatctaaattccacaaatcacgcttcgtgtttttttacatatatataggaaatatactcttaaagctgagatttggaa

SEQ ID NO: 9800 - DNA, 3000 bp, Unknown
  misc_feature (1)..( 3000): cDNA_ID_3033343_gDNA_ID_1972192_Annot_ID_180220 3000 nt of promoter + ATG
tgtggtctgtagatggtgtagtacttgtccaaaatctcaggaacgttaatagctttctctggattctttctgacaattcaaatctatctgttgtatttatttgtctttcatgcaaagaagcgtaccagaaataggctacgattacgtttttttctgaaatttacaaacaaaattaatttactttgctacaggatttagttcacaggaagagggaaggtttgttttttctttatatggaaatattatctacagtgagtcaaaaactccttggctgcagcattctcctcttcttcttggctgcagcattctcctcttcttcttcctctgctcgaagatcatcttctggtagcttaaactgactaaggttccggacaaactctgtgacggcatggaaatgatctggggaaaagaaaagtgctctcccattctctggtaagtgaacagatctatcgctgtattttcgtcctttaggttctctgtgatcctctcaaaaccgccaaggtttggttcggatgagttttgtcctgagacgatgactccgtgtttcttgcaacaagtcttgatgtgagcaagcaatgtctcagggctcgagagagatttcagtgattggtatatgaagagttttcttgaatcttaatttgttgtatatgaagaccgaattttggataaagaagttacatattagtatattacgcgacaagagatacacgaatgcaacttcgtactgtatatagaaacgcatgcttttacattaatataacataaacaaaacaaatcaagacacagacaaacacgtgtgaacaaatacacagtacagggaaaggatggatttataagcttttgttcatgttctcttggagagtgctgaccagatggataaaactagaagaagaagtgaagcaaatagagataaggcaagcgaagttgcgatgtaacgacaaaacttgtcgtagacattacagatcttgttccacccaacttcttcgtttcctttcaacgctatgtacgcaactcctcccgccgttcccgttgcagacgccaaaatccccagcatcacctgttcatatatacatattccggaattattacttaaaacaccctaattaacatggtatatggaagtttcaaagttccttgtaaaacaagttaccatgtctaacgaggctaggtaaatggagaactgtgcagtgaactcaggtttcaagagtagagagatggagacaagtgttgatatgagcgcatagaaactagctaccacgagagcaaccacgaagtatctgcatagatatatagccaatttaacacattaagtttaaactagaaaacattccatgattatgatcaaacatggaggaatttaattaattaaagagacaaacatgaaagcgggcgagtcattgaactcggcggagacaggagccggagacgaaactccagggagctgagtcatctctgtctggtcgctagtcaccattactataagagcagtcagagtggcggagaaaagcagaactcttgttataatgtctattttacgacaatctaggaaactggcggctgatgagggtggtggtgtagccgacgcgggaatcggttcagatttgccagtttcagggtcagggttctcagtagacgccatcagatgattctataactcttttgtggattaggttgtggttaagtttggactgtgagttatgaagttggccgctacatgagattatttgtgagtatatatatatagatagtcccggtgatgagttgtagttattacccacacgccaagaaacaaatttatatttatttacactattcactaatgtatatatacaggaacatgaatatcaattcatttaatttctagcttgcatttttcattgtttaaaatttcgaaatagtttttggaaaattcactagatgttgtagttttatttcaacgttaacatataatgtttgttacaacaaattttgcatgcatatctatttttgattaatagaaaaattaatatatttctataggtataagttatggataatgtagatatatacaatgggaatgtgttaggccaaccccgggaaggttggtgaggaaattgggcgacggtaatcaaaaacaaaatacaaaaaaggagagtaaagaacagtaggagtggttaaccaatcatctgcatgaaaaaggtaattttatacatgctcttaggtatcactttgctttctgcttgtggctgcaaatcatgtaaatggatatcttattttatgtaaaaacattaaactgcaagaaacaaatgtcccagtagcatgaccacttcagcacttctcaaacatattataatgttttaacatggataaagctatttcagatactaatccagtcgaaatagagtagttttgtcttagcaaaatcaccaaactttatctcttgataccaatacagagtgactgcacaagtctgagaacaacacaaaaaaagtcagacctaacagtaataatatatatgaactcatcatgatttttatttcatatcttaataatacctaactggttttagtaaatccaaatatataaaattagagatagctttaacaaattgggggcgatgatcaatcacaaagattaaaaatagtgtaactggagaatctttctcgagcagctccagcatagtaataagttggggaaaatatcgggcttgaaagtgggtcttatgggtcagtcaggcccaactatgattaaacaaagcccaaatcgcgaatgttccaaaacaactctcttgctcaggtggcgggtaattaattactaattccccgttcgatgaagcgactagttacatcgtagccatatatttattcagcttaatcaacggttacaaattaccctgaagcttcggtcgttttgcaatttgtatctaaagtttcactttttttttaaaatctttattttactttctcacaagcgaagcgaaccctcgatctcaaggcgaaagcagatttcgtagcttccatg

SEQ ID NO: 9801 - DNA, 3000 bp, Unknown
  misc_feature (1)..( 3000): cDNA_ID_3033351_gDNA_ID_1972192_Annot_ID_180217 3000 nt of promoter + ATG
caccaagtcccccagctcgtcttcaagctctccaactcgtcttcaagctcttcagctcgccttaagctcttcagctcgcctttaagctcttcaaactctttagctcgcccttcttacaaaaacaaaaaaggatatcaattatgtagatcaaaacaaaaacaaaaaaggacttacaaggacgtagatatcaattatgtagatcaaagaataagcagtccaaattccagcgttgatgaaacgaactaacgatagccaaaacggcatgtacttgaaggtcttagtctccggcggcattttgtcctaattgtttcacgcattaaaaacttatcaaaaccagtttaatagtttacttatctatatattcatcaataagtgagagccagagagagagagagagcttactatggtaaataaaagatagatgataacaatgttgtaaacgttgcaaacaacaccaatgaatgtatgcttgccggccggataaactcccaaatccccagatagtcatacaatagactgttgccacaaaactaaactccaacggaagcaatagataaaagagtaatatctgcacatcaacatcgacatcatcaaaatcaatatacaatatttttctggatttgttttttttttctttgggatatttctatagaatttagtcaagattgtgtttgtttgttaccaccttttgtgcaccagtcaccaatccttatttttattattaaatctatttttgatactataattcgtgattttccttttagttttatatatatatatacttacagagatgcgagcttcatattattatttttatctttttgaacaccaaaaaaatagcctcgtattatttttaaatgatcaattatgtgatcatatttaaaaatacgatccggtttttaagggatttgaacggatcaaatgtgtttccggttcggttatataaaccggtattttaccatatccaaccgaaatgagtatcgacgggaattatccgtaaacagagtgacagtgaggtgtgaaggaagaagacgatggcgtcaatgtctctctccttttcttcttcgctatgttcatccagaatccccgaaggtaagcgtaggtttcgtcacagagatgtgggcatcgttagatgcgttttggctgcttcgaaatcttctccgggaagtgttacgaagaagaggctttggaaagacggcgaattccccggaatcacggagccggttaatcagagaagaactccgataaagaatgtgaagaagaaacttgacaggagaagcaaagctaacggatgggttaacaccgtcactgaaactttgtccgatctcatcgccaaaaagcagtggttacaagctctcgaggtatttcgattttctctcttctcgttcatgtttgattgaatttgaactcaattttgaatcacgagtataatttagctgaaagatgattttgattgaattgggtattttgttgatgatcttaggtttttgatatgttgagggaacaaacattttatcaaccaaaggaaggaacttacatgaagctgcttgttcttctcggtaaatctggtcaacccaatcgtgcacagaagctgttcgacgaaatgcttgaagaaggacttgaaccaactgttgaactctacactgctcttctcgctgcttacactcgcagcaatctcatcgacgatgctttttcaattcttgataaaatgaaaagctttcctcaatgccaacctgatgttttcacgtacagcactctgctcaaggcttgtgtggatgcttctcagtttgacttggtggattcgttatacaaggaaatggacgagcgtttgataactccaaacactgtgacccagaacatagttttaagtgggtacggtagggtcggaaggtttgatcagatggagaaagttttgtctgatatgttggtgagtactgcttgcaaacccgatgtgtggactatgaatatcatccttagtgtgtttggaaacatgggtaagatagacatgatggagagctggtacgaaaagttcaggaactttgggattgagccagagactcggactttcaatattttgattggttcttatgggaagaagagaatgtatgataagatgtcgtctgtcatggaatacatgcgaaagctagagtttccgtggacaacatcaacctacaacaatatcatcgaggcgtttgcggatgttggtgatgcaaagaacatggagttgacatttgatcagatgcgtagcgaaggtatgaaagcagacacaaagaccttttgctgtctcataaacggatatgccaatgccggtcttttccacaaggtgataagtagtgttcagttggctgctaagtttgagatacccgagaatactgccttttacaacgcggtgatatcagcgtgtgctaaagcagatgatctgatagagatggaaagagtgtacataagaatgaaggagagacaatgcgtatgcgattcaagaacgtttgagatcatggtcgaggcgtatgaaaaagaaggtatgaatgataagatctattacttggaacaagagaggcaaaagcttatggatcgcactgttgctacaaaagagatggagaatcttccggcaggatgattgcggtttgtgtgtgaatctctctctctctctctctgcaaggagagatcgatgtctcacttgaaagagtagaataaaagagtttgtaatacacttgattgttcttgcagctatgcgtgttatatattttgatgggcccaaaattatgaatagaggcccatagataaactgtgacgtgcacaagaaatcggacaagtccaaaaagtggataagtgcgtgtcgtctttctataaataatctcttttctctcatcttttaccgtttcttctcgaacaatcaaaaacgaactaaccaaacataaaattgaacacatcctcttcctctgctctctgcaaacaaaaaaacaccgattcggtcaggaatcattcgtcgtgaaatctgta

SEQ ID NO: 9802 - DNA, 3000 bp, Unknown
  misc_feature (1)..( 3000): cDNA_ID_3033354_gDNA_ID_1972192_Annot_ID_180213 3000 nt of promoter + ATG
tcctcaagctcctcagctcgtcttcaagctcttcccatcacagcgaccatgtcctcgccgcctagctgtcagctagtcagctcgtccaactcctcgtctagctatagctcatccctcgtcaactacctgccgacctacctccaatgacggcctagctcacttattctaatatgaactacgtgtggcttgatccctttctaagggtacgtaggcaaccttttacaaggttcagctataaaacgaataaactctattcttcctcggacattaagttcgtcttccggcctcaagctcgcctttcatctacaatcagctcgttcttactccatcaatgctcgttgaagaaatcatcctttgaaatccgtccaattcgcctaagtcgcaggctcgtctttaatagaaagattcttccttccctagagatcccattttcgtacttgtgtgattcgtgcatcaacagttggcgcgccaggtagggggatagctcgaagatatctctcaaaactacgaccccgcgacgaagcaaagtgacaacaaacagactacatggagcattcgataccgactcgtcaggctctggaagtaaaacgacaacgtcgatccccgggagagccagtcactcgacctcttcattcgatatcgcagcatgttcgacaagaaaaggacttcaaggaactatcgaccccatcatcctaggcgatgacacttccagcccggcagtcaggacaataacactgaccaacgaggaagtgccgctgattaaagaggaacatcccataacctcattaaacataccgacctcgttatcactcacgcctaaccaagaacaagaggagaagtcatcaggcggacgtcacttggagaacctcgacgatgacactaccagctcggcagctcggacgataacgtcagcgcacgggaaaactcaaataaaggaagaatactactcggcgtcatctattgtaccgacctcgttatcgcccacgcctgaatacctagcgttgcaaaaagaccaaggagaagcttcacttagccgatttcatcgcctggacgatacggctaaagccaaccaacgcggcgaagaactactcaacatcatcatcgatcatttaaagcagcgcgacgcgattattaaccgccgcccaagagcacatacaagataaaattagccgcatgcacatgagtcgttattcgcatacccaacctacgcgaagaaattcaggttgtcttaaaccaacccagctcggcaattcctcagaccgctataaacgagataccaagtgcaagaccttcactcccaaatcaattgagccatctccagggtccatcaggtcggatgcgccataagagatatcgatgatccgacatcgacgatccgacactgacgccaatgtttagcgaataccgcaaagcaatgaccacaccaaaacgactaacaaaacacatcatgtcggcaggctacgagaagctaaacgaaagaaccagacggctctggacgtacacaatgacgcaaccaaccaaacgccatttgcgccatcttgcagagtgaaagtaacagcacccgctggagctaggcgaactgaagaaaagccaaactctccacaacagcaaaattcacatcgtcactcaaaacgtcggagatctcgttccaacgccatcccactaaaacgaagaaaacgatgccgcttagcataacgtcacgtcggacgaacgaactgacaagaactagggcagacattgagcatcgtcttttcgataattgtatcaacgaactcgaccgtcaaaactcgatcgtaccacaaactcttgcgttgagataagtaaaattttcgtttttgtcgtaattcaattcgtcagtattcttaaaaagggttccgctggacctcgtagcgatcgagctaatttacatcggtgtcctggcccggcattcgatcgataaacgaacgcacgaaccccttaagtatgccatgtatcggtaaaacggtcttggataaaacctacacttaagggagtgctaagccgagctccgcgctcgcaccgtttcgacggaatcaatagtttcgacaaactttggtttcgtcggacgacagattaagccgagctccgcgctcgcaccgcttcgacagaatcaatagtttcgacaactttggtttcgtcggacgacagattaagccgagctcgcaccacttcgacggaatcaatagtttcgacaactttggtttcgtcggacgacagattaagccgagctcctcgcaccgcttcgacgaaatcaatagtttcgacaactttggtttcgtcggacgacagattaagccgagctcgcaccgcttcgacggaagtttcgacaactttggtttcgtcggacgacagattaagccgagctccgcgctcgcaccgcttcgacggaatcaatagtttcgacaactttggtttcgtcggacgacagattaagccgagctcctcgcaccgcttcgacgaaatcaatagtttcgacaactttggtttcgtcggacgacagattaagccgagctcgcaccgcttcgacggaagtttcgacaactttggtttcgtcggacgacagattaagccgagctccgcgctcgcaccgtttcgacggaatcaatagtttcgacatctttggtttcttcggacgacagattaagccgagctccgcgctcgcaccgtttcgacggaatcaatagtttcgacatctttggtttcttcggacgacagattaagcctacttggcccaatgcccaaacccaagtcaaaaacccaaaataagttccaaaccaaggagtattaaggcgaagggtagtttcgtcaaatccttcgatgaatgccctacacgcatagtgctataaatacggaatagcatgtcctgtcacgagggggattcggccaggacacttagagacaaagagtagctcgcccgtctcaagtagctcgtccgtctcaagtagcttgtccttctcaagtagttcacagagcacatcgatg

SEQ ID NO: 9803 - DNA, 3000 bp, Unknown
  misc_feature (1)..( 3000): cDNA_ID_3033365_gDNA_ID_1972192_Annot_ID_180207 3000 nt of promoter + ATG
taataagaggaagtttaggcttggtgactgaaaattgtcgttttttcaaataaggctataggtttttaaaacatttgggcttagaacccatttcggtagggacttaaccaaagataactgaaacatttgaactcctaggccttgtcatctaacacacatttcttatttacataatggcttgtatgatttgaactacaagccaaaaaacttcaaaagggtgtaatctttttgaagatggatgttggtcttcatttcttggccagtaatttcttcgggagcttatcgaggggcgttgatttaagtaaaaatagcctcgcagctcgctctcgcaatgtccctctgcatttcagaccgcgtgactgaagctcagtcttcaatctctccatccccaaaacctccatatctgtggctgctttgaactcagcaaagttaagcggttcaacaggtttgcaacacactctttctttcgcagttcctcctctctttacgacaaaatcatcgtttccacttgatttctccaccttttcaagttgatccattgcatcagcaacagcaaaatcatccatcttctcttcgttaattctttgaacaaccgtgatctctcccttaactacatctgaactttggtgcactacaaagtcgttctcaccatcatgggatccatccaaaacagagcctgagctttcatcagtatccttatgatctgaatcaacttgaccaccaacaacagatttctcatcttcctcgtcactgctatcatcactgtcactatcttcaacagctctctttccattccatattttgattcgtttcgatttttcagattctgcagtacccatcttcttcccttttctcttattcccattcttgaaagtttcgttcaaagccaaatgcacagccaaaatacacttatcagatccccccttatacttgttgacattcttctgcgtagctccatctccaacaccttgtttagcattattggattgctccttcagatactcaagagcctttttctcaaaattcctcccttattcaccatccttccactcctgaagcctgttctcggcgtttacatctccgttcactcatatccctacacgaatcgaaattgtttgtcttcttctgtccagctttcataaccacattacgaagtaacgatccgagtccacctttgcctccacggagggacaggacaagattcatggtggtgtcagactgagaaatcgcggatgcgccggggatttggaatcctccgcttatcaatctctgtagatgcgtcggaatcttcgtttgctcgaagatccgctgcttgatctgctcgccacacgctatcggagaggaaaaggttagggttactgattttccgtcgagtagtctcacgaaaaactgcaacggcttacaactttgatccgccatcgattttcgattctaaagcttggacgaagaagaagaacaaagttcgattcgatttctggagagaaattgggggaaagttgaaaaacggatccctaaggtagtctgagtctctctctctctctgcttgttgggctaagaataagatttctttttggtaatgtgttgggctaagaataagattgatatctcttctgatgcggtttcttcttgttgggcttcatagttgggcttttcgttttgaaaagtcttaggttttatgttttgctttggctagtttgttgtctatgacctttttagcttgatgtatgtgtttcgtatcttaataaaatacaaaagagtgtattacaaaagaaaaaaaaaaagatgtttgtagagtgaattaaaattatagtataaattatgcgagaaaaatgaatactataaaaaatggttagcaaactagtattttctaatcagtgagtgctggaaatcaccgcccattagtactgtagattaggatgccactagctagtaaatagaagatatttattaggaaaattcgtccaaagaatttgtaaaaaactaaaaacccattaaatcaagtaaatcgtcattgtcagaaaatgtgacatgtttttggaaaaagattccaattcatcaatccgagaaaaatgtatgactcaaaaatctaaaaatgtcttagtttggaagagatgagaatgagataaatgaaccaacttgactcttaacttaatctcatttatagaaaaattggtaaaagagtgataagagacatttaaacgccgtgttaggcggaagaagtgtacaaaaccaatcacgagcattgtctgaaaccggagtcaaagagacacagagacagacatctctctcctctcatcagatctcaacacatcacactctcttcccttttttaaaatccaattttactgttgtttttttctcctccagcagtagtttttaactgataaaaaatctcccacggctcttgtatagagactagagaggtcaagcctagaaaacgaaagctattttctctcagtcttctaaagttgtgttcctttagtcattttgagctgatttgtctctggtaagtgtttttctttctttctctctcagtcattcttgaatccaagctcagagatcccatgacttttttacttctcgccagcttttgatttttctatgagctttccgtactaaatgtgttgtaaagttctcacctttttgtttgccaaatcacccattatcaaatctacataactccttttaaagacatcctccgcaattaacgcttttgaagacatttctttgggtttcttttaaggttcctgcaaatatttgtattcggatctgagtttcttagtaattaaaagggtattaagatttattcgttactctttgtttattttggttacactattggaatttttttcaatctaaatcattctagttgtatcagatttcctatcttggttactacatgctttatcttaatcatgcatcataatcctgggttttgagttttaacagaactgagtgttgttttgtaggacactgaaaacttgaacacaccaaatctac

SEQ ID NO: 9804 - DNA, 3000 bp, Unknown
  misc_feature (1)..( 3000): cDNA_ID_3033361_gDNA_ID_1972192_Annot_ID_180208 3000 nt of promoter + ATG
gactaaaaagccgaaaagcaaggtcttggagatttggtgctggtaaggaaccttgatatttattcaaacagtgaatcaaaaaccaaaaaaatctgtctaaaagtcatttacttctccaagcaagaacctcaggaacatcggtatccttgtcattgcagaatggttacgtgggtttatagcagattatggtgttccagtaatggtggtagtgtggacttgtatatcatacataccttggaaaagtgttcctcaagggataccaagacgtcttgttagtcctaatccatggtctcctggtgcatatcagaattggactgtcattaaggcactaatcacttcctctacacttattattctctttactattaatgcttcatgttgatattcatgaaagtgcatgatgaataaactgcaggagatggtggatgtacctgtgctttacattcttttagcggttgttccagcgtcaatgattgcggttctttactactttgaccatagtgtagcctcgcagctcgcacagcaggaagatttcaatctgagaaagcctcctgcttaccattatgatctgtttcttctaggtttcttggtaagagatgaagtgtatgtttttcttgactgatttattgacttgaccagttacgaaatatgaaaggttggaactcttcttttgtagacaatcctttgcggtctcatcggaattcctccatccaatggtgtcatccctcagtctccaatgcacacaaaaagcttggcaacactgaatcaccaggtttgattacatattgtagtgtgttttatgtaggccttcaattgtatttctcaaaaggcatttaaaaactggttgatgtgcagttacttcgaaacaaactcgtggcagctgcgcgtaaatgcatcagaaacaatgcaacaattggagaagtctatggaagcatggaagaagcttaccaacaaatgcagagccctctgatacaccaagagccttctcgggtatgttggtatcatctatatattagtttataatttgacctttttaactcatccctgatcaagcacggtgcaatatcagattcaaggactcaagcagtcacatattcaaaaggcttcaaacgccgatgcactggtcgatgaaacagtgttcgatatagagacggaagtggagaatattctgccagtagaagtaaaagaacaaagagtaagcaactttcttcaagctatgatggtggctggatgtgttgcagcaatgcctttgatcaaaagaatcccaagctcggttctttggggttacttcgcttacatggcaatcgaaagcctcccagggaatcaattctgggaaaggatcgtgcttctcttcactgccccaagtagaagattcaagtaaaaaacaaacctttcttcatcaatctgaaaatcttgttgttggtgtattctcatggtctctgtgaactttggtctctttttttgtgcagagttcttgaggataatcatgctgtgtttattgaaacggttccgtttaagacaatggcgatgtttactctgtttcaaaccgcttacttactggtctgctttggcatcacgtgggttccggtggccggagttttgttcccgttgatgataatgtttcttgttccagttaggcaatatgtgttgcctaatttcttcaaaggagctcatcttcaagacttggatgctgcagagtatgaagaagcacctgctatcttatcattcaatctcaaaccggtaattaattctcttcttcttctcttcaaaagcttaaggctttatcgagaacataccggtaatatactggtttcttcgtggttgtgtgcaggaaggggaagtgagccgtgcgacgtcgtttgcggatagtggagaagtgatggacggaatgtttacgagaagcagaggagagataaggaaagtgagcagcttgaagctaggcggtggaggaagtggatcgacggtaggttcgccggcgggaggaggagtggagttgatgagaagagtggtgagttttcagaatccaagggtgtcggagaaagtgtacattcggagcttaagtgatttcagaggaggtggagagattagtccacgatcgtccgctggaagagctccgttcagtccacgatccgccacgggtggtggaggaggagaacagagactttctaatttaggaaagtctgtttagtaaacagtatagtgtagtctctctctctattcatatttgttctaaccaaccaatcctatatagccaagttattccatttgcctgtcattatgagatttaagaaatgaaaagaagattatctctcggagaatttgtttatttcaggaaaatttgaaatgattttgatctccaagtacaaaaaaatggacaaaaaaaattattagagtcctagttagtagtccaagagtacaaaacaaagcaatacaaaaaagttaaaacgacatcgttttcattgtaaataactgacatcgtttcgttgttatataaaacaacgtcgtttcctatagcaacaagatgctctctgcttcagctggccttcgtcgtctctgcctgggctctgaaactgcatttggctgatcttggatcttcatgaattatgtacttgaaagatcatcgaaattcaatataaaacgggtaaagcttctcaattttacaataaacacaacttttcagctattgaaacagtgactaagctgtttttcttttgagctatatttctttgttagtgctaagtaatagtaaacaacaatttactatgatcttgcttctgggtctccttatatccattaaagactgatcctttctgcaccaattcagtttaatctttcttcttttagcttaaatgtctctggttagttatgtctgaagtatacaacaccggttccaaagttcgttgaccattgtttgagttcttcttttattaggattgtgagaataagaatcggattatgctaactctaattcgtaatctgcgttttactttaggttactca

SEQ ID NO: 9805 - DNA, 594 bp, Unknown
  misc_feature (1)..( 594): cDNA_ID_2185922_gDNA_ID_1974073_Annot_ID_180281 3000 nt of promoter + ATG
tccaatgaaaggcttctagtgctttgagtctagtgcaattttgcgttttcaagctgcaattacccttcttcttcagcaactaatcgagaaagaacttcaaaatcgtcttcgcttcatcactttggttgagtggatggaccgaaatttgtgaacaacaatttatgcttccatgtttttaacttttttgccatgggaccatttgtataggtttaaaatctttgattgtaaacctaaactttttcattttcaatgaaatatttacattcttagcaaaaaaaaaaaaaaatgcagcaagttttagcatcttgaataattgcattgttctaaaaattatctacaagactatacaatcaatgaaacatttccaggctatatgggctcatttaaaatgggcctgtagacgcatgaggccgtaaataatccagctggcaaagaaatgagcgggaacatttttatgtacaaaatcctcgaaacaaaacatcacacgtaccgcacgtgccattctcccgctccttctccatttgcccctcaaatctcaaattctcaaatccctagcttttctctctctccctcagattcacagcatttgcaatg

SEQ ID NO: 9806 - DNA, 3000 bp, Unknown
  misc_feature (1)..( 3000): cDNA_ID_3033507_gDNA_ID_1974073_Annot_ID_180293 3000 nt of promoter + ATG
atcttatggaagttgcacggtcaatgatgtttcacacaagtgttccgaagaggttttggggtgatgcggttctaaccgcgtgctaccttatcaatcggacaccaactaaagtcttgaatgacttatctccctttgaggaactaaacaacaccaaaccgtctattaaccacttacgtgtctttggttgtgtatgttttgttttagtacccggagaacaaaggaacaagttagatgcgaagagcactaagtgcatgttccttggctattcaacgactcaaaaaggatataagtgctttgatccaaccaagaatcgcacattcatatcccgagacgtcaaatttcttgaagatcaagagtatgataacaagaaggattgggaggacttaaaagatctagctcattcaacctcggatcgcgttgcaactctaaggtttctattggatcatttgggtaatgaaacaacaccaacgaccgagaatacgcaagaaacacattcaccaaatcaagaagacttgcatcaagggagtgatagtaatgaggaagagtatttacaacatcaagaagaccttctcaatatacaagaagatcatgaatccgtccaagagactcaacatgactcaagtgactcaagtgatgatgaaaaacaagaacaagtcctagttcttccaactccatcacttagaagaagcacaagaatccgtcgcaaaaaggaattctttaatgctcttgcggtagctcatccattccaagcaacatgttctcttgcccttgtacctaaagatcatcaagccttcctctccaagatttctgaacatcgaattcctcaaacgtatgaggaggcaatggagatacaagaatggcgggatgcggtggccgaggaggtgaatgcaatgaagcgaaatcacacttgggatgaagatgagttaccaacgggaaagaaaacggtgagctctcgatggatattcacaatcaaatacaagagtaatggagatatagagagatacaaagctcgcttagtagctcgggggtttacacaaacctatggatccgactacaaagaaacctttgctccggtggccaagcttcatactgtccgggtagtcctcgccttagccacgaatttatcatggggattatggcaaatggatgtcaagaatgcatttcttcaaggcgaactcgaagatgatgtgtacatgactcccccacccggcctagaagacacaattcaatgtggaaaagtgttgcggcttcgcaaagccatatatggtctcaaacaatctccacgggcgtggtaccacaaactaagtcggacactcaaagatcatagcttcaagaaatccgaatccgatcacactttgttcacactacaaagtccccaaggtattgtggttgttctcatttatgttgatgatcttatcatcacgggggacaacaaagacggtatacaaaccacaaagacctttcttaaatcatgttttgatattaaagatctaggtgaactaaaatattttctcgggatagaagtgtgccgctcgaatgcgggtctttttttatcacaaagaaaatatactcttgacttgttgaatgagacaggttttatgaattctaaaccggcgagcactccacttgaagatggctacaaggtcaatcgaaagggggagaaagaagatgagaaatttggcgatgcacctctttaccgcaagcttgtaggtaagttgatttacttaacaaatacaagacctgatatttgttttgctgtgaatcaggttagccaacatatgcaaatcccgatggtgtaccattggaacatggtggaaagaattctaaggtatctcaaaggcagctccggacaaggcatatggatgggaaagaactcaagtaccgagatagtaggatattgtgatgcggactatgcgggtgatagaggagatagaagatccacaaccggttattgcactttcatcggaggcaaccttgcaacttggaagacaaagaaacaaaaagtggtctcatgttcaagtgctgaatcggagtatagggcaatgagaaagcttaccaacgaactcacttggctcaaagcgcttctcaaagatcttggcattgaacaacacacacccattaccatgcattgtgacaacaaggccgcaatatacatagcctcaaactcggtgtttcatgagagaaccaagcatattgaagtcgattgtcataaagtccgagagaagattgtcgaaggggttacgctaccgtgttatacaagaagtgaagatcaattggcggatatcttcaccaaggccgcaagtctcaaagtttgcaacttcatacatggcaaactaggacttgtggatctatctcactcttgatctcaagttcccctaaccatgaacatcacactctttttcccttagtaaagttttctcccatgtggttttctctactacggtttttaatgaggtgatggatcatgtgttccaagcttagacttgcgtgagtcttacgcttgagggggagtattgagcaagacctaataaaaagcatccatccgtacaaataaagaaaagaggccgagtgttgtgtgtaagctacaaggtgttgggccgaacacattgagaagcctatagggagcttctagaatgagtgaaggcacacaaatatctcttgtagccgttgaagagaactcacgagtggtcttagcttcatggtcaaccaaggacctgtcactctcaccattaagaccaaggaatctcttctctcatgtctctttcattcgcatgttatgtgtaaacggctatgttccctttgtgtgtccttaaaatacaatgtaaacacacaaaggtaactaaccaattctagtaatatgttttggtcattctcactcataacaatgctctcttgttcctcatgattctcttacccttactcttactctttccaaactacaattccgcatattctttcaagaagtccctcatacgtattacaccgggtggatatatagag

SEQ ID NO: 9807 - DNA, 3000 bp, Unknown
  misc_feature (1)..( 3000): cDNA_ID_3033503_gDNA_ID_1974073_Annot_ID_180294 3000 nt of promoter + ATG
taacttcggccaaagatgtgaccagcataaggaacaatccttcaggtgaaggaacgagctctgcaggagacattgtctggtccacttccaaaccatgaagtatcatccagctatcctacgtcgatgagaaaacatgtcgctgctgttcccccatgccgctgcactctttaattatatcgtaaagagttaaagttgtaggcctgaactactcactggaacatctaggatgggaagctaattctctggggctgttcttgactgaattgttttgcttcagatctttgcatcaagggcctaaaataggcgtgtggtctgatggggacgacacctttcactgctgaccctgcacaattaaagatctgccttgactgaatacacaccatcacattgttaaattcctttcctggatccttagccgtctccacagcttatcacattgttaaggtaaccaggtgccggtccaacgttttcaagggccctactcgagattcatttttttctccttttaaattactacttaaaatcacacataattaataccaagtgttttgagaactataagagttagagatagactaaatgactcaaaatcaatctccacatatgaagaacaatatactaaccttaacaaacacatcctgcacatacctttaacgttacctcttttatttaatcacttattcctcacgaatcacaaaaaaataagtctctcgtagagtaattaaaagtgactctgcactaaactaaagaattataaagagttgatggttttataaagccataataataataataaaaacataatacaccatcagtcgattccactcttttttctttcttgccgtcttacaacgaccttgtgattcctaggaacatgaaggacattgagtaactacgaggcagtgaagacttatgggaagtagccaagctgcacaaccgtgaaacctctttgcctgaggtaaaatctcatcttacctctcttataaactctccattcatttgattgctgaatttgtgtgacataatacaaatgctctgttcttctttgccgccagcatatggattcaaataaaatggttttcattgttagtccagaacatgatataactttaaaatgtaaattactgataaagtgatttgatagatgatcgtgagagatgaattcaaatagatttttgtgttgttgtttcaggaattgtacgtgtcaaggtacttgaaggggatggagttgagaaaatggggcgaactcaacacaaaacgaagagagtttctagacgcaattccacggtcacttcttgaactcgttgatagatgtttgacagttaaaccaacgcaaatctaatattgaatttcaagaggatgctctcaagcacgacttcttccaaccagtacatgaaagccttagaaaccaaaggctccttaaactgcagcaaatgcaatcgcagccttcagtggttgctgacgcagtcggccaaactctaaagtactactgtacaatgtttgaacaagtaattttgggtccgtaatatagcccaaatcacgaaaatgcccgaaaaagtacttaaaggtcaaaatttggggtcgacaaaaagtcaatggaaaagttccattgtcctgcttctttcgtcggagggctctctttgggctttccgaaaaggtatcacatgccaagtttggcctcacggtctaaaagttatggagtcataaagttttaaccaaaaaaaaaaaaattaaaaaaaaagagggatgcaacacgaggacttcccgggaggtcacccatcctagtactctcgcccaagcacgcttaactgcggagttctgatgggatccggtgcattagtgctggtatgatcgcatccgttagtatatgcaatgcaatcgtatatattcttttttgaagacttgatgaaccattcgccgtgggtcccacccgctatgtagggataccccatctagtcttaacgagctttgatgcatgaaaaaattcgaaaacaatgcttgaacaagtaattttgggtccgtaatatagcccaaatcacgaaaatgcccgaaaaaatatttaaaggtcaaaatttggggtcgacaaaagaaaacattacatgaaaatattctctccactgtccacaccacacagctctagaaaactagatagtttgttgtcagtgttttcactgtattattagttgaattataatcctcataatcgatatacttattattctcctaatttccatgcatgtatgtacagtatgaataggaaaaccagacttttgatattagtgaaccttaacattgttaaaataaattgaaatcttgtttctgtcttgaaccactgacagccacaaaattttgggtcttcaaaaatatatgtggagaggaaaagtagctctcgaggaagtttctgtctattttgcctagaaattatcttgaaatcttgtagaatggctacgtctcatcatcatacataaattcagtgacgactgatagccacaaaattgacttatcgttatagagtagaagctttccaaggaaaggaaggggacgtttctgtatcacacaattatggtcttatcttgttagggatttgatttttcaaccactaaaaaaatatcttgtacagtaagtcttctatgcaagtcttctaagaaaggaagaccaagtttacgtattatttgccccaattgtcttgtaatgggatttgattttaaccactaaaacaatatcttgtatagtaagtcttctatacaagtcttcgaggaaaggaagaccaagtttctcctctctgttactgtgttgtattattgatatacttcaaagagttttcctttgagaaatttcgtctcttctctctcatcctctgccatggcgtcttcttgcttcaaatagatatacaatgttctcagatggatatataatgttttcgcgagcttcagtggagaaaatttcggcaaattgtttcgtggccatcttgtcaaggagctcgagctcgaccgtgaattg

SEQ ID NO: 9808 - DNA, 3000 bp, Unknown
  misc_feature (1)..( 3000): cDNA_ID_2185956_gDNA_ID_1974073_Annot_ID_180297 3000 nt of promoter + ATG
ttggcgcttacgtagggaatcctttagcttctgtaattgcttcaaattggaaagagatgcgcgagaactcatcctacgatcatgcttcaagcatgtggccttaccaggtggagaaatccctaagtatttcacgtatcgagcttatggagattccctaactgtcactttacctcagagctctctttctcaatacttctttccatttaaggcttgcgtcgtggttgaacctccctccgagggcaagggtttttatccatccttgaaggtaaatgttggcttcaatggcaaacagtatcagaaatcattttttgaagatgcagacctgcagttttgtaagacggatcatctgtttttctgttccttcaagatctggtctgaatggactttcaacgatgtggagtttaagttttgttgctccaataggatcaaagaatgcggtgtacgactcttgtatgtctatcaagaaacagagtacaaccaacagactacgagaagcgagaagcggatgggggtatcttttgacttttgattagagctgaaaattataaagctatcttttgacttttggtttgatttttcaggatcgaaacaccatagggacagactatttaatagaatcgatcgtttgatttataatgcagatgacatcggggacatctgaagaatatatcaacttaccctatggccaaattgtagcggactcaggattggccgctctaaatatggagctttcgttagggcagggagaagcatcatcatcaacatctctagagggggaagctttgtatgttgattacatgataactgaagaacaagatgaagaaattcgtatcttgtctactgattctggtaactgaagcatcttatcattctgttttactctgttttaggataacttgggatcgactatgactataatgataatgataattaactgcagatgatgaagatctttaggagaaccaaagtccgttacattatccagctctgcgtttgttttgaacatttcacttttcctgaaagaaaaaatgtttcagaaagccatactttagcatattctggaaaaacatctttggcatggttttgttttgtaaaaacatattctatttttaagaaagacattgaatttgggagcgtacctgcttgagtgcaggtactacccaaaatagtcttgcctttttaaaacatagatctcaatgtttatgttagtaaaggttgtttttctctttattagcaatgaataaatcagactttgggtacagaaaacaacaagaatgtgttggaaatattttacatagcaagtcactcgtcatcagcaacatttgcatatccgctgattcaatagccaaaaggcaaaagcgtttttggcctaacttcggccaaagatgtaaccagcataaggagcaaaaggcagatgatggagcactgacaactagaaaacttttatggttccatgtccagaacagcagaagcactctgttcttacttctctctgttttgcttctttgaaaaattcgctttcctgaaaagatgtaaatataacagtcttgtcttttgaaacacacatatctctctacgtgtatgttaccaaaggttatttttctctctttaaatcaatgaataaattcggtaaagaaaaatgtatttcacaagagaattatcaacaacaaaaaagtgttggaactaaatttttaaatagcaacctcatcagcaacaattgcatcactgctaccgtggcgtttcctacactcacagtaaaaaacagtgattacaacataactcagcaccaccactgccccatacatacaaaaccagcttccacccgtcctactcaccggccacaaccaccaaactcaatcacgaccctgaggtcaagtgagctagtcattgtcacatttaggatgtgaaagctaatttctctggtgcttattttagctgaattggtttgtgcaggtttgcttcagatatttgcaccaatgacctaataataataaataataatataatacaccatcagtcgattccactcttttttcgttcttgccgtcttacaacgaccttgtgattcctaggaacataaaggacattgagtaactacgaggcagtgaagacttatgggaagtagccaagctgcaatcgtgaaacctctttgcctgaggtaaaatctcatcttacatcccttataaactctccattcacttgattgctgaatttgtgtgacataatacaaatgctctgttcttctttgccaccagcatatggattcaaatatcacataaaatggttttcattgttagtccagaacatgatataactttaaaatgtaaattactgataaagtgatttgatagatgatcgtgagagatgaattcacatagatttttgtgttgttgtttcaggaattgtacgtgtcaaggtacttgaaggggatggagttgagaaaatggggagaactcaacacaaaacgcagagagtttctagaaatcttcactccactgtccatccacaccacaccacacaactctagaaagctaaaagagttttttttttaacaaactagatagttagtgttttcactatattattatgtgaattaaaatcctcataattgatatacttacaaattctcctagtttctatgcatgtaagtatagggaaacaaagactgaattccccactcaacatgtttacgataagctgtcctttttacaataagcaaagaccttggacaccaaaataaatctaatattgatttaagaggcatcataacttgtagttgagcggttgaatacttgaaatcaggttttaaatgcttcattggccttggttcgaacctcattacaaacatttcgctacatttttatatttatggcctatgggcaaaaaataagaagtttccttgcgcatcccacccttaaggaccggcctcacagtaatcactctaatcaataatcactgtgtattcgatttactgtacttatcttctcctcatcatattcc

SEQ ID NO: 9809 - DNA, 3000 bp, Unknown
  misc_feature (1)..( 3000): cDNA_ID_2185964_gDNA_ID_1974073_Annot_ID_180299 3000 nt of promoter + ATG
ggagcgttttgggtaagtaactaagtatgattaggcatgaaccttccacattttcaagcataacgatctgaaactgctgaaattattgctttatttagggggaaaaactgtataataaagcatcaaggctgtctcaagaatggagattctgattgcatcatccttgagcaccttgaacatgacagacctgattcattgaagagagaaatagatgtgtatcagctgcagtggtacggctactgcatgttcaaagctctatcgagtctgcataagcaggtatgcagattttggactgaattatttttagcattcatatttcaatcacgcaactaactagttctattttttctcttcacaatcttgaagggtgttgttcatagggatgttaagccaggaaacatcctcttctctaggaagaccaacaaaggctatctcattgattttaaccttgccatggttagcattttttgtcacccttctcttatcaaaattttcctggcgacggtttttggttagtgtttcttactatagaatttgaagtaaccgaaaaaaactgcttattcaattctaaggtcagtgtctaacagaggcactgaaaaacttgaggaacacaaacgttcatgttaaaatttactgttatgttcccttccccacccactgatattaatctcttttttttcctgcatggttcaattaggatttgcaccagaagtacagaagagcaggtaaacttctcccctcatgcatatgtgctgtacttggctataaaatatggaaactaaagctatctcttgttatgttctgtagataaatcaaaagcagcttcaggtcttcctaccgccagcaagaaacatcatacattggttaaatcactcgatgcggtaaaccgagggaccaacaaaccttctcagaaaactttagcgcctaatagtatcaagaaagcagcgggaaagacaagagctcggaatgacatgaccagatgggagagactcaatagccaaggggcagaagggtctggcttaacttcagctaaagatgtgaccagcacaaggaacaacccttcaggtgaaaagagaagagagcctttgccatgtcatggaagaaaagcgcttttagattttctgcaagagacaatgtctgttccaattccaaaccatgaagtatcatccaaagctcctacgtctatgagaaaacgggtagctgctcttccagggaaagctgagaaggaacttctttatctgaccccaatgccactgtgctctaacggtcggcctgaagcaggtgcagttctggtgtaatcattgacttttgtttttgtttcagagtttaatttaaaccttaagaagagtttttctgactttactaggggacgtaattgagaagaaagacggtccttgctcaggaaccaaaggcttccgagctccagaggtacatcaactgtaactatagctcacttctcttaatacgagttaaatatgaaaatcttgtgccttcagactaaagttgtaggcctgagctactcattagcacatctctgatgggaaagctaattctctggggctgttcttggctgaattggtttgtgcaggtttgcttcagatctttgcaccaaggacctaagatagacgtgtggtctgcgggagttactttgttatacctcataatgggaaggacacctttcactggtgaccctgaacagttaagatctgacttgaatgagtacaccatcactcggttccactcgtttcttctttcttgccttcttacaacgaccttgtatttcccaggaacataaaggacattgcacaactacgaggcagtgaagaattatgggaagtagccaagctgcacaaccgtgaatcctctttccctaaggtaacatctcatcttaccactcttctgtactctccattcatttatgagacacatatacttgctctgttctttttaccgccagcttaaatatcacataaaagggttttcattgttagcgttttgtgttctattgcttctactgcactcccattacagaacatatatatcttaataatgtaaattgatgacaaagtgattaaatagatgatcgtgagagatgaaatcaggtagagttttgtgttgttgtttcaggaattatacgagtcaaggtacttgaaggggatggagttgagaaaatggggcgaacgcaacacaaaaagcagagagtttctagacgcaattccacggccgcttcttgaactcgttgatagatgtttgatagttaacccgaggcgacgaatcagcgcagaggatgctctcaagcacgagttcttctatccagtacatgaaacccttagaaaccaaatgctccttaaacagcagcaaatgcaatcgcagcctacagttgttgctgacgcactaagcgaaactttaaactaattatacaattcttaaaaactaaaagagtaatttagcaaactagagagttaattttcactttagcaaactagagagttaatttaatttagcgaactaattatattttcactttagtatacaattcttagtgttaatttagtattttcacttatattatttgaattaaaatcctcataatcgatatacttattctcctaatccatgtgcatgtatgtattgggaaacaagactttgatattaaacaatcataagtacattcttacgataaaatgtcttgtacaaggacaactgacacccacaaaatatgtgtgtttcaaaatatctgtgtagaggaaacgaatgtaagtttctgtctaattgcctagaacttgaaatattatttctgtcttgtacaaagactaagacttatcataattaagtgacaaccacaaaaattcaatctctaaaaatatctttgtatgtagtgtaaaaaagctttcgaggaaagtaagacgaagtttctcctctctttctcacactatgtcttgctgatttacttctcttaaaaatcttcgtctcttctctgagttcgctctatcatctccc

SEQ ID NO: 9810 - DNA, 3000 bp, Unknown
  misc_feature (1)..( 3000): cDNA_ID_2185940_gDNA_ID_1974073_Annot_ID_180288 3000 nt of promoter + ATG
atcttatggaagttgcacggtcaatgatgtttcacacaagtgttccgaagaggttttggggtgatgcggttctaaccgcgtgctaccttatcaatcggacaccaactaaagtcttgaatgacttatctccctttgaggaactaaacaacaccaaaccgtctattaaccacttacgtgtctttggttgtgtatgttttgttttagtacccggagaacaaaggaacaagttagatgcgaagagcactaagtgcatgttccttggctattcaacgactcaaaaaggatataagtgctttgatccaaccaagaatcgcacattcatatcccgagacgtcaaatttcttgaagatcaagagtatgataacaagaaggattgggaggacttaaaagatctagctcattcaacctcggatcgcgttgcaactctaaggtttctattggatcatttgggtaatgaaacaacaccaacgaccgagaatacgcaagaaacacattcaccaaatcaagaagacttgcatcaagggagtgatagtaatgaggaagagtatttacaacatcaagaagaccttctcaatatacaagaagatcatgaatccgtccaagagactcaacatgactcaagtgactcaagtgatgatgaaaaacaagaacaagtcctagttcttccaactccatcacttagaagaagcacaagaatccgtcgcaaaaaggaattctttaatgctcttgcggtagctcatccattccaagcaacatgttctcttgcccttgtacctaaagatcatcaagccttcctctccaagatttctgaacatcgaattcctcaaacgtatgaggaggcaatggagatacaagaatggcgggatgcggtggccgaggaggtgaatgcaatgaagcgaaatcacacttgggatgaagatgagttaccaacgggaaagaaaacggtgagctctcgatggatattcacaatcaaatacaagagtaatggagatatagagagatacaaagctcgcttagtagctcgggggtttacacaaacctatggatccgactacaaagaaacctttgctccggtggccaagcttcatactgtccgggtagtcctcgccttagccacgaatttatcatggggattatggcaaatggatgtcaagaatgcatttcttcaaggcgaactcgaagatgatgtgtacatgactcccccacccggcctagaagacacaattcaatgtggaaaagtgttgcggcttcgcaaagccatatatggtctcaaacaatctccacgggcgtggtaccacaaactaagtcggacactcaaagatcatagcttcaagaaatccgaatccgatcacactttgttcacactacaaagtccccaaggtattgtggttgttctcatttatgttgatgatcttatcatcacgggggacaacaaagacggtatacaaaccacaaagacctttcttaaatcatgttttgatattaaagatctaggtgaactaaaatattttctcgggatagaagtgtgccgctcgaatgcgggtctttttttatcacaaagaaaatatactcttgacttgttgaatgagacaggttttatgaattctaaaccggcgagcactccacttgaagatggctacaaggtcaatcgaaagggggagaaagaagatgagaaatttggcgatgcacctctttaccgcaagcttgtaggtaagttgatttacttaacaaatacaagacctgatatttgttttgctgtgaatcaggttagccaacatatgcaaatcccgatggtgtaccattggaacatggtggaaataattctaaggtatctcaaaggcagctccggacaaggcatatggatgggaaagaactcaagtaccgagatagtaggatattgtgatgcggactatgcgggtgatagaggagatagaagatccacaaccggttattgcactttcatcggaggcaaccttgcaacttggaagacaaagaaacaaaaagtggtctcatgttcaagtgctgaatcggagtatagggcaatgagaaagcttaccaacgaactcacttggctcaaagcgcttctcaaagatcttggcattgaacaacacacacccattaccatgcattgtgacaacaaggccgcaatatacatagcctcaaactcggtgtttcatgagagaaccaagcatattgaagtcgattgtcataaagtccgagagaagattgtcgaaggggttacgctaccgtgttatacaagaagtgaagatcaattggcggatatcttcaccaaggccgcaagtctcaaagtttgcaacttcatacatggcaaactaggacttgtggatctatctcactcttgatctcaagttcccctaaccatgaacatcacactctttttcccttagtaaagttttctcccatgtggttttctctactacggtttttaatgaggtgatggatcatgtgttccaagcttagacttgcgtgagtcttacgcttgagggggagtattgagcaagacctaataaaaagcatccatccgtacaaataaagaaaagaggccgagtgttgtgtgtaagctacaaggtgttgggccgaacacattgagaagcctatagggagcttctagaatgagtgaaggcacacaaatatctcttgtagccgttgaagagaactcacgagtggtcttagcttcatggtcaaccaaggacctgtcactctcaccattaagaccaaggaatctcttctctcatgtctctttcattcgcatgttatgtgtaaacggctatgttccctttgtgtgtccttaaaatacaatgtaaacacacaaaggtaactaaccaattctagtaatatgttttggtcattctcactcataacaatgctctcttgttcctcatgattctcttacccttactcttactctttccaaactacaattccgcatattctttcaagaagtccctcatacgtattacaccgggtggatatatagag

SEQ ID NO: 9811 - DNA, 3000 bp, Unknown
  misc_feature (1)..( 3000): cDNA_ID_2185932_gDNA_ID_1974073_Annot_ID_180286 3000 nt of promoter + ATG
aatcgatagtttggtttattatacagatgtcattaggaaactctgaagaagatttcaacttaccctgtggccaaacagtaacagacacaggattgaccgctccaaatctggagcttccattagggcggggagaatcgtcatcaatttcatatccatgtctggagggtgaagctttctctgttgattccatgataactaagcaacaagctaaagaaattcccatcgcatagggacgaagattctgaggcatcatggtaactgaaacatcttactattctgttttgttttgttgcagcataacaagagaagcaatctttattgatctatcaaataacctgaattacaatgaagagaactgcagagtttcaggctctgaaacacaccaattcaatgattggataatcaatctctcacagaattagagactctctatatatatactttaaagactctcaacatttagtcataatgttgactctttgactttgttcttccttcttttataggtcatcagggtcagcaaagcctttttaagtctccaactctagagcatggtactctgttcttacatctttgtatctacttctctaaggcttccgcatttcctgaaataataaatacatgttttgaatttgtgagcttagggtttgcagacttaaattagtcctgaattttctaaaacacacatacattgcaaatggattttttaagcaattaataaatcagaatttggatcaacaaaaatttaaaacttgtgccgtgagagttgaccttctaaccaagggcaaggattggtatccattcttggaggtaaacgttgccttcaatggcacacagtattggggatcaatttataaaattgaagaacggcagttgtgtaagaggaatgcttatctgttttcttgttccttcaaattccagcatgcaaatcttccatctaaatcggctttcaacgaagtggagtttaagttttcttactccaggaggattaaagaatgcggtgtacgactcttgaatgtgtcttcataccaagatgatagtgatggaagctctgaaaaagagtacaaccagtctggagaaaaaggtgactttgtagtagagacatcagtaacatctgaagaatataacaacttaccctgtggcctaattgtagcagactcaggattgaccgctctaaatccggaggtttcgttagggcaggtagaagcatcatcactttcttcttatccatctatggagggggaagctttgtgtgtttattccatcataactgagcaacaagacgcagatattccgatcttgaacagactcattagctgtcatcatggtacctgaaacatcttcttattctgttttgttctgttttaggatcaacttgggattgactatgactatagtgataatgacacgagccattttttactgtagatgatggagagctctcggagaaccaaaatccgtttaattctccaacttcggagtctgaaagtgtttgtaatttcttttttatctgaatgcagaaatactctgtgtttgctttgaaaattttgcatttttcctgaaagaataaatgtttcaaaaagccacactttagtatattctggaaaaacatcttggcttggttttgtattgtaccatacttagaaaccaaatgctccttaaagagcagcaaatgcaatcgcagcctacagtcgttgctgacgcactaagccaaactttaaactaataatacaatttttgaaaggaaaaatgataacaatcgccatttattctgaattctttatgcaatctaccacaatcattcattccttacacatcataccacatttcgatctgaaatgtcagtattgccctcaccatttcttctctactttatctctccttcctcgaaatccgtgcgctttaaccatacatcattattttcccgaagacaaaacgaaacgcttttgtctctctctcacttcccctgacaacctgcacagattctctacatgtaactttcaattaaatttgtcccccaattttattcatcataaattctctgttgtatctagatcttgtccccgatttcatcatctttcaaaattatcatgaatccaacatcttatccaccaattgttatcatttaaggatttcatattttatttagatttttcaccatctattttggtcaatagattagttgagcattattgtcttcaccgatccgaatttattcatttttttcttctattgtaaaataacaaaaatatccagttataacatattatcttgtctaccattcgatctaaatttgtcccagatctaactctatcactcatttgatatgaacttgtccccgatataacatattatttaaataaaattatatgcaattgtaaacgtgtaggtgaagacaataacgttcaactaatctgtggaccaaaatagatggcaaaaaatctaaataaaattcaaaatccttaaatgagaacaattgatgaacaagatgtgagattcataataatagagcaagatgatgaaattgaggacaagacgtagacgtaacagagaatttctattcagggacaagatctggagacaaaaaaaaaagtttgtcaccaattgtcctttatctgacacatcagtctgtcaccatcaagggcaatttcgtccacaaatgtgcatgtgataatgaaatgtgatagattttgtaagagaaagctttttgttgtatgaattgtaagaaaacttcaaaaaagtggtagattttacaagattcccttcttgaaaactaaaagagtagttttttttttaattattatttatttttatttttttaaagagtaatttagaaactagagagttaattagtattttagtgttaattagtattttcactgtattatttgaattaaaatcctcataatcgatatacttattctcctaatccatgtgcatgtatgtattgggaaacaagactttgatattaaacaatcataagtacattcttacgataaa

SEQ ID NO: 9812 - DNA, 3000 bp, Unknown; identical to SEQ ID NO: 7836
  misc_feature (1)..( 3000): cDNA_ID_2036371_gDNA_ID_1974075_Annot_ID_180349 3000 nt of

SEQ ID NO: 9813 - DNA, 3000 bp, Unknown
  misc_feature (1)..( 3000): cDNA_ID_3033600_gDNA_ID_1974075_Annot_ID_180370 3000 nt of promoter + ATG
tctatgcaggatggatatctatggaagatgagcaacttcaatatttgtccatgatcatgttgcattcggcagacactttctctatgaaggagtcaccgcttcttctaactgatggtagaaacgccgaagagcttatggatgaaaatgctgtagttatgcaatccaagatcagtcaaataaaagacatattccctgagtatgggaacggtttcttagctgcgtgtcttgaagcctataaccagaatccagaagaagttatacagaggattcttgaaggaacactccatgaggatttgcagcgattggacacttcactggagacgatgccacaacctaaatctgctccaactcttagaagcaaagacaaagggaaaggaaagctcattgaatctgacactagtagctctgctagtgccatctatacagagaaaccgatcacacggccctcccttccagcttcatcagcctcatcagcaacagttggcagatttgtcagaaagccaaaggatgatactccaagttacaaaattctcgatgctagaaaagaatccgacagagagaggaacgcagccctacttgcacaatacgaatatgatgatgaatacgatgattcttttgatgatctgggcttgagtattgcggaatcaggtactgaagaaagcggagcgtttggtaacagagctggatccgagccctctgatgctccaaagtggggtagcagaaagaatcctcaattctatgtgaaggatggtaagaactacagttacaaagtggccggcgcagttgctgtggcaaacgccaacgaagcttcactggtaaatgaagcagagggagataagatacttgggttgggacgtggaggaaacattcctctaggagcggttagaaagttgacagagtatcaggcacagagagatgagaaaggtcagtctaatgtgaatgtgaacccaagcgatggaagagagaatgggagaaactggagaggagtaaggggaagaggaagaggagtggtgaacagagagcaaccgcaggagaagagtaatgagagtagtaataacaactcagaggttaatacagaggcggagaacggaggaggacggggtcgaggaaggggacgaagaggaggaggtggagggagaaatcataatcataaagatagagctatgaagaaacatattgctagtgtttctggcttctagaggtttaaaaagtaacaaaaagcacaatacgtttttgtgggtctgttttttcggatacaggggagaaacttaattacaaatcgatacttcatttgattgtaatgcttgtttctggtaattaaaagaagaaaactagcatattattattccctttggttttggttaaacaagtttcttttgtaacaggttggtatgaatctaataaaaaaatgaactttttgtgaaaaaaaaaaaattcttttgatatatatgcaaaggtaacaacaacttataaccattccaaatctccaattgaactcacattgtctaagttctatctttttatctttattcttcttcccgtaaaagaaagagtagttattacttcgagtgacagaagttgtaaaaatttgtaagcatgtaagccgcaataatataaaaagagaagaaacatttataaatgtgtgttatatataaagaattgtattttatttgaggtagataatgaatgatctacaatcaacaactacacggtttgtgattatatgtatccacgtgatttaatatacaaatagatttgttttctctgcaaaaaatacaaaaataaatacataaaagaaaagccaaatcctaaacgtaactggaaaataatatacgtatgagctaatttcaatttggattagacaaagaaaagaagaagagagagacgtaattatacaaaagcttacgagaagtttgttccatcatcacttgagagaaagatgatcaaatcatacaagagaaacacgaaccgttcaacgggagggaacgcggcagcactatcattcgctttggttcgtcgtgcagaatatttaggtacatacatatgttttataaattttatcatctttttgaatgcatcataatttacaatatttcgattacgagaaaactagatgaagagaaccttaaacatcctttttaacataaaaaagaacactaaactaacacaagttctacacattagtataatttcttagctgataaaaaacacaccattagtatttttccctttttggtaacgttttttttaagataatctaaaccataatactgaatcacaaagctcataaaaaaggaaatcgaaattataatcacgtcggcaagtaaagagccaacggtgagggatgagccacgtgtgaaaggatattccttagatgtgaatgggatctaattcttgtccgattaaaccgagaagagtcttggtacgcctctctatatataaaagtcatcactttcctcctcacgtttcttcctttggcatcgacgaaagtctgaaaactcttttctctccacctctttctctcttaccccaaacacaaaatctcctctttaatggatatatcgcctctccgatctcattcttcctcgtttttatctgccaaactcttattgctcttcttcttttgtagttttcgtgcttcttcgatttcttcttcttcagttgtttcccatcgtcgtaatccttctagctttcggtttctttgataattccctttgaattcgtttttcttcttctttcaatttccgcaaataatcagccgccgataagataatcatggggaggagtaagatttctcttcttcaatttttattctttaattgattcaatttgcaactggatttgtttgttttagggttttaattgattactaatttactatgaaatctcttatataaccaatttctgttttcgttaacgcttttataaatttggatgctttgattaacttttgctggaattgtttttttttgtgcagaatctcagcgtaagaacgcgaca

SEQ ID NO: 9814 - DNA, 3000 bp, Unknown
  misc_feature (1)..( 3000): cDNA_ID_3033608_gDNA_ID_1974075_Annot_ID_180368 3000 nt of promoter + ATG
aagaatatgttaatgtgtcgtgaaggaacaaagcctgttgttgtcgaccccacaagttgactgatcgtgttcatcatcatgcatggcttcgtttcacttatttaattaacgacttgttcacgacacaaatgattgtaccagtttaagaatctcttgatctctcttcatcatcaccaaatcttccttgagaaatattctctccatcatcaagtgtctccaacctatatatatatatatatagttgcacaagttcaagaattatcataacaacaaactaacaaacaacaacaacaacaacaagaaaggcaagagttgatcagttagagcgatggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagtaagtggaagatccaatatataatgtttactttcattcactactactacgcaataaactaaataaaatatcattaatttgtgggatataggagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcgggttagaaaacatactttatattacttcggtctcaaaaccaaatgacaatgagtaaagtcgttcttaagtgtgttatcaattgttgcagaaacgaagagagaagattaacgaaaggctcaagacactacaaaaccttgtgccaaacgggacaaaagtcgatataagcacgatgcttgaagaagcggtccattacgtgaagttcttgcagcttcagattaaggtatgtagattgttaaaaggattttttgtttttagtcagaatcttatcataactcatgttcaagttaactaaccaaaatgcatattttataaatgtagttgttgagctcggatgatctatggatgtacgcaccattggcttacaacggcctggacatggggttccatcacaaccttttgtctcggcttatgtgaaggacttacaagttacaatgtcaatgtaaagaaacccatttagaacatatatatccctatttgagccaaactaaagagatctacgctaagatcctaccattttcttcttgttgttcattctgatatttttattattcttaacttcttttgtctctttcgtcattatggttctaagaacttttggtactctttttcttttcttttttgtaattatatttttaaattatgaaaaagtcaactcagactaattaaataacaatcgtctttccttttgcaatttgaaaacaaagataaaattgtattattttatgccagggtttcggttatgtttcgtacgactccaaaattcaccaatcttcgaaaaaatatattgatttattcgaccgactttatagcaactcatgataaaagatgtatatcaacttttttttttttagtggttacttcatattgttgattatcattatcactttatcagtgcatattcagacataaggtgcatattggcacaaataatcttttaattcttgtgaatagcacataacttgtgtctaaaaagttaagtttttgaatacctaattaaacaagtgtttgtggaaacaccctacaatttcttttggccacttaattttttatgatttgagtctagagatgtgattgtgaatatgtgatgataccgcacaaatcgttctgctgtgcgacgatgtgatcgatcaatggaaaaaacgtccaataacaagcggatttgatatcattcgcaaagccacgtaccgtacgttcaaaagatgtccttcatatgaatatcgactaagaacgttttgatttttgatttattaacctttcattgcatttctttccgacatcttctctccattgtatttagaagatgaatttagtcaaacattgaaataaaatttgctatgataacaaattttgtgtcattcatcataaattttaaattaggtgttataggctaacacttatattctaggttttagaactcataaagttatcccaaacatctgactgtaacaaactaactatacatcccaatttatgcttttacacgttttacctcccaaactttgatctattaccattcaaaaaaattacagctcttcactaaacattacgatatattagaagctacacaattccaaatctctaactgaaatattgttttttcatttagtatactttgaatttttttattagttgtttttaattagatgctatatgtttttttaattaaagatgcaaagattcaaattccatgattttgaaaaactcattttttttttttttttttaaataccaaaactcaaaaattatcaaaatacaactattatatgttgacaaaaaaacaatttatccaaaatttttacttaaataccatcccttgaacacgttcctagtttcggtttggtttggcttgatgttctaaaaagcgattcggctttattagtcaaaccaaaccgtatcgtgaattcgtgatcgcctttagccaccgtgaagcttctccgcgagctagagggtcttaaacactaacaaaatacggaactgacaaacacagcaaccgagactctctcttctctctctctcgctctccgtcgctgcc

SEQ ID NO: 9815 - DNA, 3000 bp, Unknown
  misc_feature (1)..( 3000): cDNA_ID_3033596_gDNA_ID_1974075_Annot_ID_180372 3000 nt of promoter + ATG
acagatgcaggcttttacaactgtcatgtgatttgttgtaagagttccagttttgtcactacaaatagttgttgcagatcccattgtctcacaagcagcaagattgcgcactagcgctttgtcattcatcatctttttcatggcaaaagcaagacttaatgtcacagccaacggcagaccctccggaactgcaaccacaacaattgttacagcaacagcaaaatattctagcatcgccatcaattcatcagcagtccagatccagtgagaattatctaggcgcttctgattagccaatccttgaaccaaaacagcaaacgtaatgacagcaaaaaatagacctattttaccaatgatggttgccacaccattaagttttacttgcaacggtgtctcatcatcaccgccttcacttagtgtagccatcagtttaccccattgagtcctcattccaactgtagtcaccaacattttgcaagatccatcctgaaccttggtaccagagagaagaaacgggtgttccacactgacactaaccggttcactttctccagtcaagctcgattcatttatcagaacagaaaaccctgagataaaaagcccatctgctggaatctggtctccaatgccaagatgaacaacatctccagggagtagatcatatattgagattttttgcctcagtttgtctctcgtaacctgaaccacaatctttttcttctctgcatccaggtccttgaattgcagggattgcctataatcactagtggcagtgacaaacacaacaagcagaatactcgccactataccaagtccgtcatgggcaccaataggccacccttccatcagtattccaactataagtgaaacaaacgcacatgcagctagaatcataagtgttgtatcctgaagggcttcccaaacaaataaccaaaagccacggctggggctttctgtgaattggttgattccataaatttcttttcttacactcagcaggtcttcagatgtactaattccactagcaatagacgtggaaagtttttcagtgaggccctcagttccaccatgaattttcaactttttcaaatcatgaccttctacaattgatcccaactcatcaggacaaatctcaaaccctgcttttcttacttcttcaggtagtgtatactcactggacaactttaaacctgtaagcacgcaataccttctcgttaaggaaatcaaatacatattgaataacacaagggagtagtctattctcactattaatgaactgaagtgcagcttgtgaaactaagaccgccactcgaaatttttcctgcattcataaggttgacaaaggaaaatggtattagaacaaagcaccaatagcagtaagaatttattctcaaaggaaaaatgaacagaacgctttgatcgctctaattaacgcctccttcaatacaaactacaagaaacacaaggcttgaaatgggttgtttgctactaatgagtcatatttgcttgaacattcttactagcaaacaccacgaagaacctaaaaatctacatcttaaattagaaacagaacctaatgtaatcatgtctagtgataacaatccctaacctgaggataggtaactagaaaaatactaaaaacgagctcacttagatcccatccagtaagtacagtgagtcaaccaaacaaaaaactcggaatgcagaaagatcacttattagatctccaacagtatacaagcagaaatagaaagaaatgtttcagtaatcaaagtgagaagaaagaagcacctgattggaacgccgaatcgcctcggcctcggaacgcttagacagattagcagtgaatctaaatctccttttaggattcttgacgatccagcagagcttcctccaacgctgcaacgcctcatcggacgagttcttcggcttcacatcgccgaagttttcgttcaagtagctctccatttcttcagcttactactctcgaacaacgagtgaattcgtaactatacttcagatgagataagattagagaaagagagaatcaaggatctcgtaaatcgagaacgaagaagatatgatatataacaagaagtcctctcactggtaatgggtgcttttaacttattgttatttacctttatatgggtcaagatgaagacgatgctttgacgcgtcgtctcgcactaagtgagcttcgtcgaagtttcgtctgcctgttctgaaatttcctcatggccatggttttttttttttttttggaacactcatttattcggacatgactcggagctggtcaagaaagtcaaagctatttactgacttggactttatttcaacaaagtttttagtatattctaagttttgtgacttttgtccattagaaatttcacacaaataaattagaataatttactaagtatattttctaaagaaatttttacaaaagtagacgaaaaaagatttgctctcattgtttgtcaaagtgagaactggttttcacgttttgtcttttcattcaatttcggaccaaattaccctgggaaaacttaataatggcataaaccaaaccgtgcagcagttcgtatcggttaagttgacggcgtaaaccaaaccctacagcagttggtttcggtttagttgatgcggttcagttttgaaaaagacaaaaaacaaaaaaactgaaacgaagaaaccgagaaaacgaaaaagagaataacggagagattgagagagaatcagaaagcgaaacgaaattcagtatccattgcttcaaaattcgacataacttcgaattgttgggtagttgaattgtgccactgaactcccacatccggtgaagtgaaagttactgtttttcccggcgaagccaagagaaagttactgtttttcccggcgaagccaagagaaagttactgtttttcccggcgaagccaagagaaagttactgttttttccggcgaaatttgaacctccggcgagatcgcatctttagct

SEQ ID NO: 9816 - DNA, 3000 bp, Unknown
  misc_feature (1)..( 3000): cDNA_ID_2036339_gDNA_ID_1974075_Annot_ID_180371 3000 nt of promoter + ATG
gtgccttatccatagaagtaggtggttcccgcgaatcatgggaaggtatggtttgttctggccttttgccttttggatcaagggtagcacgtatctggtcacggacaaagtctttcatatcttcatgcatttgatacatttggtcttccagctccttcaaagacctcctcatttcaacaataaacctctcaggcacaagctctccaaaacaatcctcagtagtctcttctttatcacagtccatttcagatttctgttttttcatagcaggttctttagggctcgggcccggtgcatttcgtttcctcttaacatctacaatagaccagttgctgctattaattggttttcttctaggtgcaataccaaaaaaatttgtaaaaacatttatacttatacttacctgtctcttctagttgtggtgggcgcgactgctttggtactctagcatagcctccaacccattcatcctcctgccactggtgcccatctatcaacagtgcctcaatgtaatcaacccttggatcatcaacttcatcatcccatgaaagagatggaggacaaacattatcagctggtttcacaatatagttgacctcaacctacacaaataagtatgttaaccatagataatgtacatttacttattatgtacgtacatacacaatttaacacacctcatcagcagcctcacactccaaaatgcgagatgtccggattgctcgcagagaggcaagacgatggatagacctctcagcaaatgtcctgttaggtacatcatcaggtcctagcttagcaattgatgggattgtttcgaaagctaaaagctggagagctaatgggaaaccatggagtgcataagaccctacaagtataccccttattagtttctgagcatcgtaaggagtttggaaatttgctatcctccccaaagtacgggtaaaggacacccttccccatgggtatttgcagaaaaactccaggttcttagtcatctcgacagtctttgaagtaggcctgttggggttactgtgggccgctaccacaccgtcaaccaaaataataagagatagtgccagttggttccacccctccatgctttcctcctcctgcagccagctcaccaaatcagcaattgttggaaccgtgtccccaaacctctcatgaaacagagtattccaaacactctcacactcaggtttcacactgataacatcatcaacgtctttcttcttgggatacttcccacattccagcccagttaagatactaaattctcttaatccaaatctgattggatgaccgccgaatacaatccacatctcattcaccttctttgtcactaactgacggcatattagtccaaggacaagcttagcattgaaagatgccttgtttttgggtattttaaaaagtttcccaaatggagaatcgagaagaaactgcatctctggtttcccctttagtacttttgctatgtcagaaatgtactccggtttagagtacgcgttcatcttcgtctcggaagggtaccggtctagagcaaagagtcttggtggtaactcttcaactgtaagatcttcagtcggagcaacacttggactacctgcaattaaaagtcatatactgttgagcaaacagaagtagtgtacgtacacagacattttccagattataactcaaaatcatatttttggcggaaacagagatttccaattctacttctcaatttttcatcctaaagatatgctaaattccgacaaattctaacactttaatcaaacaagctttacaattctgatacacccaaagacaacaaacggtaaattagagattctaacccagttcctccgttgcctttgtcgcagagcgttttctccgcggggaaactcttaatacacgcttctccttccctggaccatgctgcttcctcgggacttcgtcgttagctttattcccagccatagctaaagatgcgatctcgccggaggttcaaatttcgccggaaaaaacagtaactttctcttggcttcgccgggaaaaacagtaactttctcttggcttcgccgggaaaaacagtaactttctcttggcttcgccgggaaaaacagtaactttcacttcaccggatgtgggagttcagtggcacaattcaactacccaacaattcgaagttatgtcgaattttgaagcaatggatactgaatttcgtttcgctttctgattctctctcaatctctccgttattctctttttcgttttctcggtttcttcgtttcagtttttttgttttttgtctttttcaaaactgaaccgcatcaactaaaccgaaaccaactgctgtagggtttggtttacgccgtcaacttaaccgatacgaactgctgcacggtttggtttatgccattattaagttttcccagggtaatttggtccgaaattgaatgaaaagacaaaacgtgaaaaccagttctcactttgacaaacaatgagagcaaatcttttttcgtctacttttgtaaaaatttctttagaaaatatacttagtaaattattctaatttatttgtgtgaaatttctaatggacaaaagtcacaaaacttagaatatactaaaaactttgttgaaataaagtccaagtcagtaaatagctttgactttcttgaccagctccgagtcatgtccgaataaatgagtgttccaaaaaaaaaaaaaaaaccatggccatgaggaaatttcagaacaggcagacgaaacttcgacgaagctcacttagtgcgagacgacgcgtcaaagcatcgtcttcatcttgacccatataaaggtaaataacaataagttaaaagcacccattaccagtgagaggacttcttgttatatatcatatcttcttcgttctcgatttacgagatccttgattctctctttctctaatcttatctcatctgaagtatagttacgaattcactcgttgttcgagagtagtaagctgaagaaatg

SEQ ID NO: 9817 - DNA, 3000 bp, Unknown; identical to SEQ ID NO: 7840
  misc_feature (1)..( 3000): cDNA_ID_2175516_gDNA_ID_1974075_Annot_ID_180351 3000 nt of promoter + ATG

SEQ ID NO: 9818 - DNA, 3000 bp, Unknown
  misc_feature (1)..( 3000): cDNA_ID_3033624_gDNA_ID_1974075_Annot_ID_180361 3000 nt of promoter + ATG
ttaggtgaataagtccaattcctgaaaaaaaagaatacaaaataaactcattagatgaacaattgatcatagaattattggggacaatttgaataaagaagtattataataatgtagaagaatggttggaaagagttggcgaggagagagtgagggcaggtgaagctgcactgcacagcaacgaccgggccaatataatgcacggttgggcgacgtacaccgccggacgaaactgacacgtgtaccctttgttctttcttcttttttgtacccctcaattactacattcattgtaatgttttcgaaataatagagtatatatgtattttgtctctaaatagtagagtatgagtgactagattcactatatgataactggagagtgcaaaactaatcatgacaaaaagtaagggtatgaatgattttggttattcgtttcgattctaaggtgatttgtgagttagatttggtactaattacagtttagctcttttcatcatattcttacatgttatatatttcaaaggaattatctagacgcaaacaagctttgacaagaaaaatgaaaacaagcaaaatcgagaatacatcttaagtaaggcaggggatgcggcccgattcaaaattctatgttctaaaaaattatttattatatatggagaaattaattcagacaatttgtgggttctttggatgacgatctccatctcttcttgacactgggagaagaattctaattcttactcgttaatttatatgcatttgatgatattatttttctcacatttgtctaattagtgttagtattaatttaatttggtatgctagacgggctcaattgggtgagtttttttaattagttccaatgaaagttgatgtgaaaaaagtattgtgagccaattagattggtaattagtaaaatttagaaaagtcaaatgtatggaaacactatattaaaacatctattacttaatattgttaatgctatagcattttattaatttataagaaattgttagaaactcctttttaattctatttgtttatgcagttcattctttttatacattcttttattttaatgactgttttactcatatttgaaaatattttagattaacaaaatgaaataataattttttccgtcaaaaatatttcgaaaataagtttctcgtaaaacaaatccgacaaaaaaaaaatctaccaaaaaattttcccaaaaaactttttcttgtcaaatttttttttccaaaaaattcatttcccccaaataaaatatttttgccaaaaaatagatttacttgggtttacttctttttttctgttttctagctaaaaccaattgacaaaccgataccataaatctaagataatagataaatattgttatgaccgaccataattgtaaatttgtttggtgaaaatgggtttctcggagctgaatcttctctaactgtggagagatgtggagaaaatatagacattgcagagctcacagacttcctttgtgctgcttcgatggttagagaatttagtgagtttcacactgaccctgaagatcgaaagcttagatatgacgttaagaaaaaaagttagaattgaaatatgagccaatgtcagttgttgatgacgagccggtttgcctaccaatgataaaatttggggtttcaaaagagacatgactcatcacacatagatcacttccggagttagtcacaaagcaactttttttctactatgagaatgtctttctcacacctaaaagcgtttgaaaaactatctcaggatacttgtttgatatcccacctaagttttttgactcgaaatatttatgtatttcagcacaaatcagcacaaagagaggtaacatccacaatcttccaatccataatagaatccatcaactgccaccgaaatacacaattcgtgatgcatttccatttactaagagatggtggccaacagactaggataaaaaagcccaagctaaactgcattttgatttgtacaaggagtgcccaattaactaacatgatccgtttagcccttgaaccttacaatggagaactaaaaccgcataatctttttctgacgaaataatttaatgaaactatagatgagcaatactattgtatctaatgaaaattgatgttaaaaaatattgtgaaccagttagattggtgattagtaaaaatttagagaactcaagatgttcaataatggaaatccgaaaaactattattactagagttttttcttttttctttctgttttctagccaaaaacaattgacttaaccaatgccacaaatctaaagacaatagacaaatattcaacttatgctttccaagaaaatatcatcaggaccatattgagtgatactgtagtttgttttgctctttctgccattttggatctgatttgtaaaaatgtaaaatcatcttagaattctgcataatttttactaatcataaaatgtaacggattagtaattccaatcatttagtaattagtaaggaccaaaatcacatgaaagatatcttataagaaccaaatttggttattccaataaaacccttgaatgatattttgccgttttcaaaacccttaaaagaagaaaaacaatcagagggttggcggtgttcccgtcagaagatcacgaggatcatcacattaaactctgttttgttgatctctctttctgttccgtttctctttccactgccaaaagttaaagctctctctctcactcaatcacacactcatttctcactatttcacaacttccttgtggacaaaattagtcgacttctctgttctctccaacactgtttcgttttcactacccaaaattcgaatctgggttattgaaaaagttccaatttttttatctgggtttttcgaaagctgatatctttttagaatctgatctatctcttctacttcatttcccttgcatttttttaataagttgtagaatctgtcttgttctggaaaaat

SEQ ID NO: 9819 - DNA, 3000 bp, Unknown
  misc_feature (1)..( 3000): cDNA_ID_3033620_gDNA_ID_1974075_Annot_ID_180362 3000 nt of promoter + ATG
gggaggatattggaaccataggatcattctttgatgccaatttagccctcacggaacaggttttcaccgactctttattgtttcatctccagtgcagggtggtgactcagtgaaacctaatcatgctatttgtttctgttttggcagcctcctaaattccaattctacgatcaaaaaacacccttcttcacttctccaagattcttgccacctaccaaagttgataaatgcagggtacaatatcttgaattcgattatcccgttgtttcagctaatgattcatcgatcctcatgttgtaaagtgtattatggaattgcagatacttgattccatagtttcacatggatgcttcttgagagaatgcagtgtgcagcactcaatcgttggcatacgatcacgtctcgagtctggagtagagcttcaggatacaatgatgatgggagctgatttctaccaaacggaagctgagatcgcgtctcttttggcggaagggaaagttccggtaggggttggccagaacacaaaaatcaagaactgtatcattgacaagaacgccaagatcgggaagaacgtggtcatagcgaatgcagatgtatgttttcaaagatctttttggttattttgaagaaatggttgtctgattttttgttgtgttgggttgtggcagggcgtggaagaaggcgatagaccagaggaagggtttcacataagatcaggcatcaccgttgtgctgaagaacgccaccattagagatggtctgcatatttaagcttttaaacctctctttaggagcagtgtatgtggcttcttgtgattttgtaacgagactagttacgttcgattaataatttaataaaacaagaggcacaaacgaatgacagttttagcaactttaaacgtgatcgttaatcttggtaaatcttaatgattacgtaaaacacagagagaaaccaatcacaaacagacgagaaaaaagcatgtgtaaaattcttcactctcacgatcacaagtcacaacacaagacttgagactcccatccatatatacactttacaaattatagatatttcattcgagttttatgggactataaaaagagtcataaaactcttgtctcttattgcagtgagaatgagagaataggttctgaagactaaatggtctgatctttagagaaggtaaggaccactagaagctacctcaccaactcaattagtgtcaaattaatccaaggccaacagtcctgaaaaagtctcctaactttttatgtctgcaactgtatatgggacatccctagttttcttaattttgaatcttgattcttgagttaaaacaaaaacccaaatatacaagtatgcatgaaacgtaaactttcagagaaggtttctcacattaagtatcctttgagttaagtatatagtccataagactgtttttggttttaattttagtatttgtgtgtttgggcctcccaaagattgttggcagaaaagttgtcattatcactggaccaaactcgcatgctcaatatttatcatcaccagttataattacatacaccgactgcttttttaattttattcattttatattctctcggcctcatggcaccgttacttcccgcctcacgttgacgatatatgagagaatattttatcatcatatcatagtgaagataatagcacaaaatcacaacacaagtttttggtaagtaatgatcgtccgctgtaatgatcgtccgctcaatagggttattggtaagtaagaatgaacctgagctataataacttgatatcaaaatcgtgtgtgattgtagaaaaaaaaaatcttataaatgattatttgtttactttttgtcaaacacttatatataaggtatttaaaactagatataaggtattttagactggtaaaacaaaactaagaaaacaattatatgaactaaatatggacgacaaaaaaaaaaaaaaaaacataagaaaagttatttttttttcttttgtcgtccataattatttttctgtttgaacacacaaaggcgcacttgagagtttagaagtaccatggaaaatggttatttgaggttaaagatgaaaatgagtaagaagcaaccatataaatatatatccattctaatttggtcccatgaatcaaattgaaaactccagaaaaggaagactatttttaataattttgtgttatgttgaccttttgtgacttatgctcatgctcatgcacaccctactcgtctatattgtatattgcttttagtaatataacacctttttttttttgttaaaatagtaatataacactcaattgctttgttttgactttaattaatttccatctctaagagcatgcctttcgtgttccttaaggctaattgctcactaatttatgctgcttttgaaataaagtattatatatatatatatatataatgattaacatattatcaacttttatgaaaaaatcaaaacatattaagcaactccttttaactcgttgttgtggtcacaaactgtaacaagttttcttcttatccaatgtggaacgagttagcccaaaaaaaagacttgagagaaagaagacaaatatgaatgttttatgtcttataaatggaatgtaaaaccatttcaatagaaaaaaataacaaaaaaattcttataccaattttcataattaaatcttatcccgaatcccatttgcctgtaataatgagacttttaaaagtttttattcgagaagcagtgattcataatttcaacgatgtcgagaaaaaaaatgtgtataaccctaaataatagccaaaataagaaaagaataattaaattccaaaagaaatggttaaaaaagcgaattaacgaattaaattcgacatttatattttgcaaccttcccttcgacgcaaacatttctctcttttttctctaatcaccaaacctgcgtcttctctctcacactactaacaacacttccttcttcttcttccgact

SEQ ID NO: 9820 - DNA, 3000 bp, Unknown
  misc_feature (1)..( 3000): cDNA_ID_2034746_gDNA_ID_1974075_Annot_ID_180363 3000 nt of promoter + ATG
taatgatgtcactgcagtcagtggcatcaatctcagggtatgtttacgagttgctacacttctcattttgaacctggatatagagaaacaataaaccaaattactttctgcatctgttctaggaagaggaaaaacaattattagattctggtcctaaaaagaacgatcgtgtttctaaagcatatcgaagacttgtgcatggagaggaagaaagaacgcttttgcagaaaattccactgcagagaaagctgacagaaattagtttgtgtttcaactcgtatcttagctgcttctttggtccttacttggaatcacttggagaagaagtttatgtatgctttcatatatgacagtgggaaaaagtggtttaaagcatatagaccatgatgtagagcggtgcttgtctctggtgagatgttaacaccttttcttggaattattagccttcaatttcctgtttttgttttcgtttttctcatggctttgcgcattcagtgtgtggaggagaggatgcgaggactactgtttaatataatacgaatatcaaagcaggtcagtctactttctcttctcatgcctccttagatcttgttgtacctaaatctttctgaagttacaagagcttttgcagcggactgatgcagagaagtgtagaaatcggacttttatcacatctgatatccggaaagaaattaatgaaatgaatcagaaggtgaaagaggaatgggaaaagaaacattctggagaagaaaaggtaatggtttgtcctgagcttaatatctatttgtcttagttatcagtagtaatgtctagttttttttttttgtatattcattgatgtagaacaaagaaaatgatactgaaaaagaagaccaacgttcaaacgaagtgaaggtatttagaacttgagccaactacctaaacctttggagatatacacatacgtacactgaaagaggtttattgatcacaagtcaggcaaataagaaggacgaagataaagagagagccaaggctgcaaatgttgctgttcgtgcagccgttggaggagatgataggttttcaaaatggaaacttatggctgaagcacgtcagagatcttctccagggccaggaagaaactccaagaaactttctggtaagattggtaatcccgtttctatgatctgaaagagtaaatctctcagttctgttgctggttattcttgtgtttcgtgctcctaattgcatattcgaactttatgtaggtggtacacaatttgggaagaaccaaggtttaccaaaagtagtccggtcaatctctgtgaaggatgtgatcgctgtggtggaaaaggagcctcagatgtcaagatcgacgctattgtatcgcgtatacaatagaatctgctcggatgtttgaaaccaagaaaagacataggaccaattctttatttttttttgtagaaaggttcttattccattaaaactaatgccattacaaactcctaaacatgatcaagatgctaaagtacatccttatttcttcttcctttcactacctaaagcaagctgcatgttttttctagtttttgcctgatcccttcgtgctgactccgccgtgtccatatcctcctccaccaccaccgcctccgctgcatgaacctccgcatcctccaccaccaccgccaatgatgactccaccaccaatacctcctccaccaccaatacctcctccacctgacccgtatcctggaccaccacctccgttgcctccatcccaacccaaaccaccacctgaaccatacccggcacctccaccaaatccaccaccgattacaacaccaccaccgccgccacctggaccgtatccaccaccaccatatcccgggcctccaccgccgtagccaccagctgtgagttcacccttaaatccggttacgtgtcggatactctttccaatctcactggagtgtgcttcattcctcatgagcttactctctcttccaatctcactcgagcgtgctttattcctcatggacgcactttctcttccaatctcagtggagtgtttttcattcctcatgagcttactttctcttccaatcccactggagtgtgcttccttcctcatggaggcaccttctcttgcagcctcggcaatcatatgaccgatgagacaaagatacgaggaaacaagaaaccacaagatcactctagccatgatggctgcttagtgacacaatttgtttgcttagaatctgaaaaaggaagtaaaaggacttgtgtgtttgaataatacacagccacaaacacacaccactatttatatatcttgggacataatacaacggtgatggttggcatgggcgtgccagtagagagagagagaggtgcatatatggtgactcaccagaaaggtgtaacaggtgatggttctcattcgcatgatttttcccacactttttgctgcattttttcattattattcattttgcagtctcaagttttttcttaaataaaagaaaacaaggagtgactcgtgtaccaatccattgatctgatttgaacatattggttatcacacatatgttccagaggaaacaatgaattatgaaactgtaataaaatgattataacatgaataaaattgatagataagtcataagtaatcaaaagtaggatcatggcatatttttttcctttaatcatactttcgattactagttcttttggtaattatgctgtcataaataaagcgttaaccaaaatgaagagaattagagattatggaccggtttattgagaaccacattgaataaaccaaacattaatagtactaattttcgcacgtgtgtgtaacgaaaggccgtaatttggctaatcgatgaacgaacgttccctctcttctctgaaatctttctcgatccatccatcttctccattttcctccatttctgggtttcttctcatcttccaaggattaggaaattagtttgttttttttcatctgctcaagtgatg

SEQ ID NO: 9821 - DNA, 3000 bp, Unknown
  misc_feature (1)..( 3000): cDNA_ID_3033629_gDNA_ID_1974075_Annot_ID_180359 3000 nt of promoter + ATG
gtgaaatagtgagaaatgagtgtgtgattgagtgagagagagagctttaacttttggcagtggaaagagaaacggaacagaaagagagatcaacaaaacagagtttaatgtgatgatcctcgtgatcttctgacgggaacaccgccaaccctctgattgtttttcttcttttaagggttttgaaaacggcaaaatatcattcaagggttttattggaataaccaaatttggttcttataagatatctttcatgtgattttggtccttactaattactaaatgattggaattactaatccgttacattttatgattagtaaaaattatgcagaattctaagatgattttacatttttacaaatcagatccaaaatggcagaaagagcaaaacaaactacagtatcactcaatatggtcctgatgatattttcttggaaagcataagttgaatatttgtctattgtctttagatttgtggcattggttaagtcaattgtttttggctagaaaacagaaagaaaaaagaaaaaactctagtaataatagtttttcggatttccattattgaacatcttgagttctctaaatttttactaatcaccaatctaactggttcacaatattttttaacatcaattttcattagatacaatagtattgctcatctatagtttcattaaattatttcgtcagaaaaagattatgcggttttagttctccattgtaaggttcaagggctaaacggatcatgttagttaattgggcactccttgtacaaatcaaaatgcagtttagcttgggcttttttatcctagtctgttggccaccatctcttagtaaatggaaatgcatcacgaattgtgtatttcggtggcagttgatggattctattatggattggaagattgtggatgttacctctctttgtgctgatttgtgctgaaatacataaatatttcgagtcaaaaaacttaggtgggatatcaaacaagtatcctgagatagtttttcaaacgcttttaggtgtgagaaagacattctcatagtagaaaaaaagttgctttgtgactaactccggaagtgatctatgtgtgatgagtcatgtctcttttgaaaccccaaattttatcattggtaggcaaaccggctcgtcatcaacaactgacattggctcatatttcaattctaactttttttcttaacgtcatatctaagctttcgatcttcagggtcagtgtgaaactcactaaattctctaaccatcgaagcagcacaaaggaagtctgtgagctctgcaatgtctatattttctccacatctctccacagttagagaagattcagctccgagaaacccattttcaccaaacaaatttacaattatggtcggtcataacaatatttatctattatcttagatttatggtatcggtttgtcaattggttttagctagaaaacagaaaaaaagaagtaaacccaagtaaatctattttttggcaaaaatattttatttgggggaaatgaattttttggaaaaaaaaatttgacaagaaaaagttttttgggaaaattttttggtagattttttttttgtcggatttgttttacgagaaacttattttcgaaatatttttgacggaaaaaattattatttcattttgttaatctaaaatattttcaaatatgagtaaaacagtcattaaaataaaagaatgtataaaaagaatgaactgcataaacaaatagaattaaaaaggagtttctaacaatttcttataaattaataaaatgctatagcattaacaatattaagtaatagatgttttaatatagtgtttccatacatttgacttttctaaattttactaattaccaatctaattggctcacaatacttttttcacatcaactttcattggaactaattaaaaaaactcacccaattgagcccgtctagcataccaaattaaattaatactaacactaattagacaaatgtgagaaaaataatatcatcaaatgcatataaattaacgagtaagaattagaattcttctcccagtgtcaagaagagatggagatcgtcatccaaagaacccacaaattgtctgaattaatttctccatatataataaataattttttagaacatagaattttgaatcgggccgcatcccctgccttacttaagatgtattctcgattttgcttgttttcatttttcttgtcaaagcttgtttgcgtctagataattcctttgaaatatataacatgtaagaatatgatgaaaagagctaaactgtaattagtaccaaatctaactcacaaatcaccttagaatcgaaacgaataaccaaaatcattcatacccttactttttgtcatgattagttttgcactctccagttatcatatagtgaatctagtcactcatactctactatttagagacaaaatacatatatactctattatttcgaaaacattacaatgaatgtagtaattgaggggtacaaaaaagaagaaagaacaaagggtacacgtgtcagtttcgtccggcggtgtacgtcgcccaaccgtgcattatattggcccggtcgttgctgtgcagtgcagcttcacctgccctcactctctcctcgccaactctttccaaccattcttctacattattataatacttctttattcaaattgtccccaataattctatgatcaattgttcatctaatgagtttattttgtattcttttttttcaggaattggacttattcacctaatgctttttagtcatgaaaattccacgaccgaactataaagaaatacgatatatccagtttgtttcaattattgaaccaattatagagtccttatatctctttataaaatcatcaaccaagtgattagatcgacaagtctaagtgaccatccactttattttaaaacactttatttcctcggaaaatctaagccggagttgcaagagagcttagaaaatg

SEQ ID NO: 9822 - DNA, 3000 bp, Unknown; identical to SEQ ID NO: 7841
  misc_feature (1)..( 3000): cDNA_ID_3436784_gDNA_ID_1974075_Annot_ID_180350 3000 nt of promoter + ATG

SEQ ID NO: 9823 - DNA, 3000 bp, Unknown; identical to SEQ ID NO: 5771
  misc_feature (1)..( 3000): cDNA_ID_2033485_gDNA_ID_1974077_Annot_ID_180395 3000 nt of promoter + ATG

SEQ ID NO: 9824 - DNA, 3000 bp, Unknown
  misc_feature (1)..( 3000): cDNA_ID_1582322_gDNA_ID_1974077_Annot_ID_180419 3000 nt of promoter + ATG
gtgtcgatttcttgaataaacaggtcctggagcgtcttgtttcaactctagatcgatgtgcatcacgtacatgctcattgcctgttgaaactgtagagctgatgcctgcccattgtagcagattttccttgacatgcttacaaaaattgttttccttgagcaggtaataacacgttgagcatgtcatgtccatgattatagcatagtcctttactctcttgactgcttcatctgcaaaggcactagcattttatacttgataatgtactagctcttgctcctcatatgagtccctaatcaactctagttgtgtattttgcatcaagcacacatagcaatatgcatatatatcatagagagagtccgcaggcacattgccatttctgctgcagaagattaggaatgtccatggatttggtacccattcctgctccctgtttaacatactgatatcaattaattttttagtttcagctctgaaaccgagaactggcactccacaagagcagaagtgagcaagatctctatcaccacactaatggccagatgtgaattcattttgagtagatttttaatcgacgaaaataatctaggtaaggctctccattttcttataaactccaacatctttttcgcttgccattccttaatcagtggttatcttttggcaggcaaccgtccaatcccaacagctagacttgaagagattatctttaccctccaagaactttaccgcctcagcattcatcctgaggttgcatctgttcttccgttgcaaccctacctgaaaaacgttctacgcgaagataaccgtgacacccgtgcacacctacttgtcctttttccctctctgtgcgagattgtgttatcaaggtaatataacttctacaattattgttttgtgttcgaagcacaaaagggtgacagcaaattctctgtatggaccctatcaagttaagattttgagagtttttttttcaccagggaaatgcgggtgagagagctggtgcaaattttactacgagcagttgctacggaactaggcctagaaaaggttagtctatccagttgatggcaatagatgggaatgtttctcagcagatttgagttcttacattagattcttgagaaattttggttttataccatataggttgtattctttgttttagcgtgttctgaattactctgtgtgctgtattctacaatacgccattctccgagattttatgttggtttggttcaacaaagtactctgttaactgattctgagaaccacggttcgatcatcaatacagtctagaccatcctaacctgccttcgtgtacttggtccattgacgatgtttggttaacttgtgctatttcattctgatcttgttgaaaataaatttgtgtttcaactcgtatatgcctattttaattaggtaaaattaaaaacttgagaatcttatatagatcaacatatatacatttgtttaagtttatataaacttgcttctcaataacaagaaagaagaattgcatcatttggactgattgatccgagcggcggcagcgacagaggcagccacaccggttgggtatgtagtgagatgaggatcgttcctcatctcggcgccagtcactccctctgcgtcctttctcgttgctgctttatccgatggtaatttgctactcgctccctttcataatcattgtttcccaaaatcgaaaaaaaacattagaacccgaaaatgaaagaaataaaactagatattggattcaagcattttatgtatcacgtcttatgtgctattacttacagtgagaacgtcggctagcgtagtcttggtatcgtcagagccgatacgagcattaagagtggcggctgattgagctgaagccgcaacaccgccgggcatgatattggtccgccccgtagctctaacctcggccgcttgaatggcggctgcgtcactccactccaccggcttattccctgccgtgagaaccgctgcctctagagcctctccaattgttatggttccttccgatttcagaggattagctaccacctttttctggttaacttctccctccgcctacaaatttaacgttctaattatacaaattatgatattaacacaacagcgatgatactagcacaaaccactagattatatagtcacaaatcaacctgttcaccggaggcctcggctacaacacctttctctttgtcctccgccgccttaatgcctccctccgttgtcgaaatcttctctgcctctccttttacatcagcacaatctataggtttctgcagctgttcttcgctcattttttggggtaactctttctctcttttcctttttttctctaggcaacaatatttataaatgtaatggtcagaatttatataagttttgcattagccattcaattctgtgactatcttacataaacaacaacaacggctctcctcaactttctctgattttccctcttaatttagccaataacaatcaaacatatgaatgattcggttcggttttcactgaaccgaagaaatccaatcgatttcgctttggttagaacaatcaaaccgataattgaaccagttaaatactatccggtttagctaactcaatcaatcggttagggtcttttaattagggttttaaagtttcagtctctctcacttcttctttcactcacataacaaaaaaaaaaacttcgttcacttgccgcaaagtcgccggaaccaacttacttagctcaccgtctcgccggagtttcgacaatcaaaggtttctcttctctccctgtttcacatctcacgacggatcaaattagggttttcaattgaatcagaatcagtgctggctctgtttgaatctattgttccgaatttgtgatttaatcttctaattagctttgttgtatccattttggagcaatcattcaatttcataatatctcaaataccttgattgatcaatagcgagaagaagcacgaaga

SEQ ID NO: 9825 - DNA, 3000 bp, Unknown
  misc_feature (1)..( 3000): cDNA_ID_2033414_gDNA_ID_1974077_Annot_ID_180420 3000 nt of promoter + ATG
ggtgaccttctagataaaggtcttgatgagcttaatactacagctgaagatggaagtgtcgatgaggtatttcggaatcttacgctaatttcgtgattctttctttaatggggactgataagttttggtttgtgatgctactaaaggtggcgaacttactagtagatttgtacgaagattgctgtaacggtaactatgaaatgcttgaggaactaagggcaacttattctcagacgagtgcaagtgttgtcaaggttaggttctttctactacttccgatactgtcttgtccctttcactgagtttgagctcatgtcaagtctactttggtttggtttttaacaatctagttaagatagtttccgagagttagaattgaggctgtttagtttcttataccaattatggtgtttcaggtttcaaacggtgatgacgaggaaagtgatgatgaagatgatgatcaaaccactgacatgatggtggatgcgtctaaccagaaacaagaagccatgcctgttgatgaaccagtagccgatgatggttggacggttgtttcgtctagaaaaaacaagggaaagaggaattaacccggttttgatccccaaggtgttgtgtaatttgaacagttttgtttgggttgctttgtttatttattttgataatattatgatagtatgacttgtgtaccgtcactttataaactaaaatcataagattgagttttcacatattaatctactctcacataataatcttatgatcccatctttgacgcctaaaaaaagactcttaccagttatcatctcctccgcttcaagataaatgtttttttttctttttaatagaatgtaaatattcatttcagtggaaagtttgagttacacaattaagcatagccatagtcaaatatggtcacacaaatatggtcacatgccaaaaaaaaaaacagaaagataaacagcatggaagcgtaccaccttcttacaccaaatgatcaagttggcttgtgggtcgtgggttcgtgtgctcttggggctcgccgagtaattttggaccgtggattggcttttgagagttgaatcttatggaaatattctattttggcaacaacttgggaatcactacaagtaacttggggaatattctaagaatattctctcgaaacctacctcctctactatataaagaggcattcgtctctcattatttctcaagctgtcaaacagaaaatactcttagttctaaattctcgcatctattatgtttcttaaaagtaagttcttagtttagtagttttttagaatatatcgtagattaagtttgtttgagcctattattgtgtgctcgggtataagtttgtaatcggttgtatctaggaattcataaaccgtgattgtccgaaagcacttatggtcgacgatttattgaattaagaaaaaagatataatatcttgtttatgtgatttactttttgtctttaaatacagttgttgtaattcgttgttcataccgttattttaataaaattggcatcttttctcaatttggttttgcattcttacaattttattatggccgattaaatgaattaagattgtagaagcgcaaaaacaaagttgagaagaaaatacaaattttattaagataacgataacatgaatgaattacaacgactgtatctaaagacataaaataaatcacggaggcaggatctgctatctttttctttaatttattaaatcggctgtaactactttcagacaatcatgatttatgaatcccaagatacaaccgacaaactaatacccgagcacatgagtaatagactcacaatgactggatctaaagacataaaataaatcacggaggtaagatctgatatatttttctttaatttattaaatcggctgtaaatactttgagacaatcatgatttatgaatcccaagatacaaccgacaaattaatatccaagcacatgagtaatagactcaagcaaacttgatctacgatataatctcgaaactattaaactaagaacttatttttaagaagaaagagagaggcgagattttagaactgatagcgttttttatttgagagcttgagaaataatgagagtcaagtgcttctttatatagtagaaggaggtaggtctcgagagaatattctccgagtactccccaaattacttggagtgaactccaagttcttgccaaaacatagaatatttttgtaggatttaactctcaaaattgggcctatccacgatccaaaaattactcggcaaggcccaagagcccacaagcctatgtggcccaaaagtcgacgatctgatgaccatccctcgtgcctagcttggttcgatttagcccaagttactcactttacaccctttttctcatataagtcaactccgtttttgatgtatgagtataacatcttgcagtactcattaccatatttccattgcacaattgatctgacaatttcgtttggcaggaattggcaggaaagccgccggaaagtcactttttcaaaaacagttccaacaaaaccatatagacaaaatcttagtcaaccaaaaagattaataaaattatacaagaaagagatataagcacaatctacatatactaattattgtacatcaaactggattaggcttattgtagcgttacacgcaatatactattttttcatgttttggtattttattagattttagtaaaatatctatatttatagtaaaataaataaatagtaaagtatactatatattaatacatatttatagtaaattaattttatatatagtaaaacatataaaaattaaatgaaaaatgtaaaaaatggaggttccttttcttgagattgaaatgcaattaataaataatagtcaacaatattcactatttcctctatataagaaggccactagctctaaccagattcaagttaatcaaaatgcttgtgtggaaaccacactagtgaaagagat

SEQ ID NO: 9826 - DNA, 3000 bp, Unknown
  misc_feature (1)..( 3000): cDNA_ID_3033733_gDNA_ID_1974077_Annot_ID_180428 3000 nt of promoter + ATG
atttataaggaatgccattgacattaattattttcaattaattaatgattctaattagtagcattttcttatataatatatcttcattaattctaattacttaaaaaaagagaaattttaagacattattaatatatacttgattaaaagataaaatattgtagttaattaaacttttataatatttaacgaaataaacgtttagaatatttataatatatgaaatctataaaattaaataatcatttgaaaaaaacttttaaattaagttgaattataaatcttttaagaaaagtattatttaaacaaaaaacaaaagaaaatatatttaatttcaccgaacgggattagatggtaggatgaatttataatatttataatatatgaacttttaaacaattaaataaccatttgaagtaaaaaaaattgatttaaattatatatcttttcaaataaagtattattaaaataaaaataacaaaatattttaaatttcatcgaacggggttaaatggtaagacagatttgggtatataaaatacaagacgctatactatgggtaaaatccattagatatgtttaatttcactgaacggtattagatgatatgacgggtttggatcgatagtaatacgagatggtataccataggtaaaatcctagatataaaaatcaaaatacaattatattatcttaaacactaaacaaaaaaataatattaataaaacaaatataattaaaatttgaattatttagttatagtctagattttaacttaataaactatgtgttattctttctatatttttaaacagtaaaatttaaacatagtaattgtacactaaataatatgtagatataagagttgtacatttagaaaatacagaaaattaaatcatatatattttaaatctactaaacaaattaaatttttatttttaaaaaaagatatagccccgcggtgtaccacagattaaaatatagtttgttacacacttggtaacattttttagaaatgtgatctgatttttggtaaaacaagtgcattcgtatttaattttatattatcatcgggtaaaatcttatagcaaaaccaagactagttctgaagacatgtagaaaagcaagtaatctttttttttaaacgtctaatagtaaatcaaatagaaccacaacgatttttgtagatggttaaactcaatcctaaatcttaatccacacactcttttgatcattgataattcgtgctttctttaaagaaaggagaggcaacatgcaagagggaagattcgggtaagagtggaagccgtacacgcgaacatttatgaatagtgtgatctctattttattgtcttatcttgaatcactaaaacaaccatgctcttttatttgtttaacgaaccatcttgtaaatttctacgaaaggtgacaacacttttaaggattacatgcatacagtctccagactagttaccaccctccattgtaacgtgtttttttttttttaataccaatagcaactgtaacgtataaacaatttctaaagtattcttaactttcattgataaagaaagataattgatgggtcaacaataatgggccatttgattcaatttttatttttttggtttattttatttataaccaactcacaccggtaacgtgcgtctctctcgttcaataattatttcgcataaatgaaaatagttatatattctcatacatgcatgtattcgcctatttaaaatatttgttcttttctcatacactttttgcattttattgttgtcatttttagaatttttgtgagaggtactctaatcattcttattagcactaggagtcttttggccaaccaaatatttaaacagaaaagaagaaaaagaatcttggtttgcttatatggtttaacttttatttatatgtgtcaacccaaaaaagatagttgaaattcagaaagaaattttataaacagattaaacgatcaaactaactccatttgtaatgactaagaagagtaaaagactacaatttaagagatgattcttattttccatatataactatttataagcctttattgcacattttttggcacgttttcgtggaagatgagtcttatctaccaaatgctaacgtgctcctgatcccatttgtgttatgagttagagtcatttgacttatcacttatccgattctattattgtgccatgtttatgtatctttttgttcatttttttatataataactatacaatcataccaacataaaaaaattcgacatccctattatatatggtctaaaagtttaacagttaaataatttattcaacatttctattatacatagtctaagtaaaaaaattcgactatgactgcctttcataaaattaaatcccattcgcaatccacaaaagattagattgatagtcctcatcgttactattgatagtggtttcttgctcatttgagttcaagttatctaattttcaagaactcatgcaataactaatttagaatattgtttttcagaactttagaggatttatttatatacaattattttttttatgactaaaccaatctgttaaatcgtttaatatatatatatatatatatatcaattaatatatagaattccatgtaacaatatataataagagaaaacaattaattattgtaatttttaaatattgtacaataaaatttttattagaaactttttttaaccattttttaattttaaacagtttcaaacgctagaaactaatttttgcgattaatgttttttttgtcaattttttgtgattaatgtgaaaattgccagtaatcacaaccgcacataaacgttgaactatgcatcataaattaaattttgataattcacatttctcataatacagaattctcaaactactaaattactttgaaattcagcatatttaattaagaaaacatgagttaacaaaaatgtttaaattagtgaaaaaaatcctcatg

SEQ ID NO: 9827 - DNA, 3000 bp, Unknown
  misc_feature (1)..( 3000): cDNA_ID_2033378_gDNA_ID_1974077_Annot_ID_180433 3000 nt of promoter + ATG
ctaacaaatagagatttctatttttcaggaaccattgaagtaaaaatagagatctctattttttcttctctatttacatgaaaaaatagagacaactattggagatggtcttagagttatggtttacacgatgattctctttcgcgatcttagggttaggccgcttatggttaaaaatttacttattatttattcaggaaaaacattatatggaaatttattttaaaaaataaagaagatataagaaaacaatctatactattaattggaaagcattggataaaatatcacaatcatttgaagaggcagattgtgttatatctttgtcaaactaattctagagtcttttcaagatagtataaatcaatagatataaagacgctcattcgtataaatataaaaagcaaggtaagggtaaaactatcgtattcgtataaatcctctatatattaatagagaaacatttttaaaaaataaccttacccttacgtgtggttaacgaaaatgccatgctgacgtgtcgcgtttacaaagctcatcaacccatttaattaattctccattttctattagaatatttacatcaatttgacattgttactactaacacttattttactcattaattaatccaaataaaattttaaaaatgaacttaacatagcaagacacttaacatgttatttttcaatcaattaattaaaaaaaaattacattttaatatatgctattaagagttattaatctttacaagatgaaacacctaatattttgtgtaacgacaactttatacatgttacagttatcccttattttatagaatctattaggactttgacattatttttaacagaaataattgtcaaaacatattccattatgtcatatgaaattaataatcttatttatgttacaaaattttctaatagttacatttttcaataatctttatctttataataatcaaaattttgtgtatatataaatgtgttttaccacaatctaatactttttccgtccacccaaaatttgaaatctaaatcatatatatgaaatatgaattatcgttaagatccttaaacagttgtagatgtaaaatcttagtaatattttgttttttttaatattccaatatttatggaattcttaacaaaatctagaactgaaaatattttaatggtataatcttattttcagtacatgaagtaaaatatataatgtcgacatatgtgcacatttgttaggcttttgataattatatgatatcgaataagaaatatccccactaatttaatatccaaagtatatttaaaaggatgaataatcaaatatctattttaaaatttgtaatcaatttaagaagatgcatatcgactaaatatctaaaatatggaatctaacaatattttataattgattgataattttaattctttcaccaattatggtatttgctaactaaattaataatcaaatatataattacctaaaaactatcatataattttacctataataatttacatgaatagttttatctcgcatatagtacgggttgttatctagtttgtgacaaatataggttaaaggtttttgaatttgcatgtcatgaagattaatgactacttggccttcccattgttgcaaatgaaaaaaaagtttaattgatactctagcctgaatggaacacaactccaaagaactttcctgaagaagaggacgcgttcaatctcagatgaggtggaattgacatttgtcttatgccacatggcacttagaagagagatttttagaactttggggagagtgctgacgtgacttctcgtaagactaaaacaatggtttgttgtaaaccattttacaactggcgaaaaaatatttccactataatagtgtgttgtaataaaaaactaggtgagacatggcaaagttagtgttgataaatatcaacacccgtgaaagtagaagagagaagataagtgtgacaagtattatattttgattggttgctttgatttttattttttttgtttcatctcaattatataattttacaatatttatacataaaaatataaaaatttatatcaaaatttataatttttcattctctataaatagagactatttttatttgatttggatacagaaaaaactgttttagacccaaaataataataatttctagttctcgtttttattatttgtaaaagttttttaaaatattttataaaaataaaaacaaatattaaaacaaaattattttataatttttttaatatttaattatttaaatttaatttgatagtaacaatgattaataatatgtaatcacaaaaaaacagaaacataaataaaataaaaaatatgaaatgaaaatggtggggtaaggtgttgtaattttattaaacaaagtattgtaatgatgaaaattgtgtaggtgttgaataatgatgtggaagagagagaagatgatgtggagtattaaaagtaaaaaagtggatgttgtaaatgaataaccaaatggattagccctgtaacggagccggatatccggctttttcagcgtataaccactatgtgttcagtttaagttggctcttcatgataagttgtctgataagttctcttactcgaattgttgctctgtgactgtgactgttgttgattatggtttcaattcatcttaataaggttttttaagcttataacatataatgttggacaagtcatgggtgcatctatgcaggtaatcaataaaattatatagataggtttaatttaaattggggtttagaacattgcttgagtttttttttcaactttatttcttcattgaagagctgatcctggttatgagagaggtgctcgaaggtttgtatttgatgtggttgcggctttaggagatatagataagataatatgtccaagcaaagactgtcgtaatgtgtaccaccactcaagtagtgatgtggtggtcatcttgtaacgagagggatg

SEQ ID NO: 9828 - DNA, 3000 bp, Unknown
  misc_feature (1)..( 3000): cDNA_ID_3033719_gDNA_ID_1974077_Annot_ID_180436 3000 nt of promoter + ATG
agagaaagggttaaaggccatctaagcccatgttattaggttttgtactaggagttctcatatatatatgtaatgtatgttatggattaatgtaaccaaggctacctctttgagcaatcaccctcaaacatttatacgaatcacaatcgaatttttttttgtttttgtagacaatcttaaagcttctctctctctttagattctttgcacaataaagctcttcatgagctattcaatttctcttctaataagctcaatgagcatcaatctattcttgtcatatttagcagatagcaagtaggatctaagtagttgtgggaagagaattcttcttttacatgggacagcttaggggagttaaacgaggtaaagaaaacacggactcttcgtgagacaaataggtcaaaagaaccttaaaagttctcacactaatgtctgattttgtggtgaagagatgctgctatctacatccaagtgatcttgattttgtatcttgctacatatgttgtctcacccaagtcaagccatccgaattagccagaaacttttattgctacctctgaagatacaaaatctagatcctttcaagacatgaagtgaatcttgtgaagtgcatgtttcttggtctcatattgctgctaataatccttcatatttgctgggttcaaaattgagactgattcgagaagataagagcacacatagattatgtgccttcattagatcatgcactgaaaatcaagctcttcgatcatctaagacaaacttaacaacgtcgttttcacacccgctgctaagtttgcggggaagtattagagcaaacatagaagcccaagaaatgattattagagaagtccatctatgcccatgttattaggttttgtactaagagttctcatatatatatatactagataaggcccgcctaaataggcgggtaaaagatataaatttattcaaatatttatcgataatatttaaaatttgaatagtaaatagtgatccacacactttttctaatatttaatttagtaatttttgaattaaataaaatttcaatcatacacattcaattttactatacattttaactatctctttcatcataataaactgctttttaattttatacactccaacttattgatgatatttgaattttaaattgtaactcatatttttcagtatttaatttagtatttccttaaactaaatttcaatcttacaaattcgattttacaatacaatttaaatatcttttttatcataatacaatacaatttagttcgattgtatacaattcaaatacaatccaatttttcaatacaaataaaatttaattctatacacttcatcttattgttagttttcctttttaattaaaaaaattataagttaaattttttagatatagaactataaattagtatatgtaaatatgtttttttttttttaaagaaacttttttttaacatatgtcaacatctcaatgatagacctgacacgtgtcatgatctcgtgagttagtaactccgtactttatataataagatatatatatatatatatatatatctatgatgttgtcatgtaaccaaggctgcctctctgagcagtcaccctcaaacatttatatgaatcacaatcaaaatcatttttgttcttctagacaatcttaaagcttctctctctctctttagattctttgcacaataaagcttttcatgagctattcaatttctcttctaataagctcaatgagtatcaatctattcttgtcttagaaatgtcaacaattaccatcaattaaccctaatttatcttctaaaattccctattcaggaaaccctaattttgataaaatctaacaataaccctaattaatcccgatatacacaattaaattgttagatctatatattcagaatttgattggaccatggcttgacacaaatctccaatttatgcacgttttctctccgatttggttcaccaaactcgtccatgttgaccaccgtcggttgagatgatgaggacagtggataagagacgaatttcgttgatattctcttccgatttgatgaacatgaacgcgtgaggctgatgatcatcagagaccgttcaatcgccatcgcaccaaagaagagaatagagatatccagaaatgagaaaaaccacaggcaactgaaaaaaaaatattgttttgtcaaaacacgcgtccaatgagaaatggacacgtcatcgaaccttaacaccaaaaaaaactctaagcttaggtcgttcgtaagtttatatcacatgtttcatttaaattttgtcttattttgctaaggattcttgataagaaattttcaatccccaatggacctgctctaacatgacaatttgtgtagaatcgttatgacgtggtaatatatgctaggattgaaggatgacatatgattgttttggttgaaatgaaaagaatcgagagaagatgtgattgcaatttgtcttatgccatgtagcttcctcttaaatatttttcatttaattgacataaacacatggaaaaactttaaaaacttcttgcagctaatcaatttataatatatatgtttatttgaattaaattaattaaaagaaaatttctagaaaataaaaatcaaaaataagtaaacaaaagattagaaataattatacagtatacaatgatattgtcgttcgttaatcaaataaaatatgaaagtatgtttttataacatgaatgatcaaaatagacaattgttttgtctttgtatatcaaacccgaaacaaactaatctattctctgggcatggatattgtaaggcccaattaaattcggcccatcaaacgaaaccaaccctaataatctgaaagagagctatatataaataatctagggtttagtgtgctcctccttccaaagccgctgcgaaactcgtcgattttcaaaaccggagctcagagactgatctcggaaagtaaatcgcagccatg

SEQ ID NO: 9829 - DNA, 3000 bp, Unknown
  misc_feature (1)..( 3000): cDNA_ID_2033385_gDNA_ID_1974077_Annot_ID_180431 3000 nt of promoter + ATG
tctaaacgtttatttcgttaaatattataaaagtttaattaactacaatattttatcttttaatcaagtatatattaataatgtcttaaaatttctctttttttaagtaattagaattaatgaagatatattatataagaaaatgctactaattagaatcattaattaattgaaaataattaatgtcaatggcattccttataaataattcaaacttgaggatttatttcataaaatagctgcaaaaatgtatatataaatattttatttaccacatattccaagtgaaaactaggaaggattcgaaaaattattcagtaaataattcctacctttttgcaaaaataacggatatatcaacatcgtcaataagttggtccaattatcgtgtttttatttttatttttatttttatataacatagatcttgcataacactacaataagttatttttatccgatgacattttattttacattataccaccttatttatgtaaatcatagaaagtaagttcagtagttacttacggctttacaacaagttctataaccaatttaaaattttgacccaacaaaataaaataaaaaaccagttacaaaaaaaattgattatgtaacaaataaacccaagaaaaaagaaatagtatatagcggaaattatcttgtaatttaagcatttaactgttccctacagaaattaggaaagtaatattgagtaactctcaattatgaaagagagttgtatctttttctgtcaaactataatctttattggttaaaagtctttatgtatttaacacataacaaattttcagttgaaaattatataatagaaataagaatccgattaaagaaagcaatgatcattctaagtattttattccattatgtcggcgaaagatctcataaaggagatacaccaatctatatcagaatgaaaagcagacaaatgacaagccatttaagccacttttaaatattaggttacaacaaaaactcaaacaaaaaaaagtaagggtaaaatagacaattccaaagccgatccgagccgtgattgaaactgacccggataaagacgtgcagatcctgcaagataaaaatggacctcgattcttaaattatttgtcgatttaatgaatcctggtccaaagtgataaaaggttttaaactctctcaggcacagttaccaatatcgtaaaagaagttactaacttttgaaaaaacagatcttacccactttttactactaaaagaagaaagtttacaaatttggtcaacgcttttcaatctttccggtgaactcttggtcgccggaggacatccgtggtgctcccaggtgagtctggcgtaggaggtgcccctcactctgtggtctccttgctttctatcttgaggtcaagagaacaacttctttattcagccctctagttccagacatcctcaacgctcctgtactacatttccaatggtgtatgctcatgctaggcgcccacctgtagcagtaatacttggtctggtaacttcctgcttactctcttgatacttctctctccctgaactatctcacttttgtgaagaactatcctttttttgagaacattgtagtgaaactttcagcctccgggcaagaactatctcaccttgtgtgaagaaccttttggaacgcttgtttacctctagtgaagcctttctccaactcctacgactcaaagaatggagagaagaatcccatactacctgaaaaggaaagaaaaaaagaatgagttctctccactccctcgaaagagaataagagcaccaaccttggataatgctgaccttatcagggagaactctctcatactcatgggaaggctcacaaacccagagatccaaagactctggtccctcatctctttcctctcaaaccgttggaacttgagagacaaagcaacaggttctgacctaggcagaggatgctttcaattccgctttgactatgaggaagatctacagaaagtcttggataatagaccgtatcatttcgaccagtggatggtgattcttcagcgttgggaacctgttatctctgcttctttcccctctcagatcccattctggatagagctccagggactacctatgcatttctggaaaccttatatgcttctgtcaattggatccgagataggggaagtcgtggaccacgaaataacaccagctgcagcaaagataaaggtcattattgacggtctcaaaccaataataaaggagacaatggtagattttgatgacgacagtgagatattagtaactttggagtataaaaatctcaagaatcatcgcctacactgcttaagattgtcccatgagaaaaaggactgtccggggcttcaatcctcaaaagtttctccaaaaaagagcctccctcctcctcctaaagctgcgagcaaagctaaatctcaaccctcttacacaccaagagattactctagaaaatcagtggcggggaaaagtcactactctgatcacatcacttatgaaagaagagataccagcagaaggggaaatgatgatggacgttacagaacacaaccatcttctgggacaaggcggtatgagccaaaagatctaccttatagaagatcacccccagatcctatgcatccaccagagaagaggctcacaagtaccctgctagatattctcacagtgactccagacaaaacttgcaatggagagaaaaaagcaaatcaagagacagccatagaattgaaaactcagattcatcaagcacaaggctctgacatctagagagaaacacaaaagcagaggttacccccccccccccccccctccaccttttgccagttcctactactgaagaagttatggggggaactgcgagaggttacacttcaatataccagttgtgctgatccaacagagagcgcaacacgaaaacgcagggttgtttaaagagaagcgagagatcttatggctgagactgcagctcaa

SEQ ID NO: 9830 - DNA, 3000 bp, Unknown
  misc_feature (1)..( 3000): cDNA_ID_3033750_gDNA_ID_1974077_Annot_ID_180421 3000 nt of promoter + ATG
tgaaagaatctaacagatttaagaaagtttggaaaactcaattcagcggttacgattcttttgctctatcagcggttacgaagaccatttttctttcagacgattataggacatgtgtgaggataaatacatcttgtgaatagtccttcttttatttgggagtagtacttatcaagtcttataaatagggagcgttacttatgtgatttatgacctttaatcttaaataaaaacaagtttaggaaaatcttgatttttaagaatttaatggatttaagaagatttggtaaacatgcattcggtcacttcagtataatcctcgtacgagttgtagattggtctgactatcagcggttacgaaactattttccttttcgacgactatatgacacgtcttgtgaattaagatatgatgaacatattgtaaaccgttcatatattataaaaccagaaaatttagaagaaaaaaagagagactcatgcatgttattaaaagggtttagatcagtacgatgttcaaaatttctttaattagtagctaagcttttgcaaaagacctaagaaatttacatggttttttttttcttttcagtctaaagaataaaggatatataaagattaagaagacatcagaaactttacaacatcattgacaatcaaagaaaagatttcaaaaactaaaccgatggatgataagatattttcggaccgtaaacccaaaagaccgatatgaatataatacataaccaataacaaaaagagataaagccgaaacaaacaagagaaatgaaactatagaaccataatctagcacaaaacaacatgcgtactaccaaaccaaatgaaggataagcttgtcaaagtagcgtacggaaagggaagaaaaaccacgagaacggagagcaactcttctactaacaaatgaatcctacctctctaagaaagaacgaggtattagtaccaacaagaaaaaatctagggcggaataactagaaccaatcacaatttctaaaaccggcgaaaatgaagaatacgaaaaaacaacgatcttttaactcttaataagaaataaatgataacttgaaatcttgatcaagaaaacgtcacaatttccaacaacggtgttagtcggaaatggcatatccgacaaagttctgacaaagtcaaatttgtcggaattttttggtctaaagatcggagcaatcggtaaggaaaactacgtttgaaatatcacttccaatcatacacttcatcaggtgcgcatagcgtagatcaggttgtattaacaaatttatttgaaagtgttgagattgatattttatgggtatatgtgacatttaagattttttgtaagagggggattaagcaacctccggttaacccagcttaaaccaaaaatggatcgaaaaaccagtaaactcagcccaaagatgtaagtctgatcagatcgacaccaacctacaagataaaggaaaagatagaggcaatctaggaagctaagttataatacaaaaagaaagaaaaagatagattttcgatagagaaataaggaaatcaaacatgtatatgttaaactaactatcactttcttataaatagagaagcacccctttgaaagggaaatatgtggactcatacacaagatcaaccaaaacacctagaaaaaacccttataacataaattatgaatgacttgatcccttatgatggatatataaacaacctacataaggtgcaactattatatatataaaatctcaatttgtcatcctacttttgttgttaaacttgaaccttgttgaaatcctccttaaaaccgacttgatttatcaccttgtttaccacaggtgatatctcaaatctacagatatcaacacggtttgtcaatatcgtataagtgatgactaccacatttgattaactccggagaaatagcttttttgtgctcgagtgtcaagtacatgtacctacaagagaccaaccatgtaggatcatagattacttcaaaataaagcgttgaatacataattttaatatagttgaaaatgtagtaagtctaaaatatttttttggtgggcaacatctaaattatttgttttaaagttttttcaacattatatatatatatatatatatatatatatatatattagaatggataaaaatatagattccattcattctcttgccaaaacagttgtagcagcagaatttcttttaagtttattcacatttttataatgactgaaaatttagaaaattactttggtcaatcaaatttattttattataaccactgacacttcacacaatggacagaaaaatatcaattttgttttgacgttttcatctgtaccattcgagcaaagaatgattctttgcgtgacaacttcgacaagtttatagaaagtactaaaatccattgcaaaagcaaaaagtttatttttctttgctcttctctttggacgttttcgccatattcgttgttattattctagcaaagactgattctcttgcgatacaacctgtgaaacctttcttaaatattataaaggttttaaaatactttaaaaccatgattgttataaacaacatgtcacatatggatgaacagtccgctggagatattaataaattgtatctatggatcttctttgattagttctcgaaattagctggactatgaaactaaaatctatccatcaaaatatatataccacataattactttaattcaggggataaataagtaatcataagaaaatcaaattcaagcacatatttttgttgaagagttaaccctctcaaagttgttaaataggtaaaatttagaattttctctattataacagatgatggtattaattcatgtattcttttaaccactcaaaactccaaagagattcaagttttatccaaaaatatttgtggagcctatattgctaaaaaggttagaacaatcggtgaataaatatggcagagaaggtggaggtgaccacg

SEQ ID NO: 9831 - DNA, 3000 bp, Unknown; identical to SEQ ID NO: 5770
  misc_feature (1)..( 3000): cDNA_ID_3593709_gDNA_ID_1974077_Annot_ID_180401 3000 nt of promoter + ATG

SEQ ID NO: 9832 - DNA, 3000 bp, Unknown
  misc_feature (1)..( 3000): cDNA_ID_3033754_gDNA_ID_1974077_Annot_ID_180417 3000 nt of promoter + ATG
tccgatctaaatgttagtgtcttgaagttgtaactctccttagtttctcaatgttatgatcgataatggtgatgaagcaaggttgcagggacgaagacgacgttatatacacatgtatatacacacttcatgattaggttttgttgttaggtttttgttgggcctataatgggcttagtgagaaattgagtctcacattgaaaccttatattacagataaaatcttagaattaatggatttgggtagataataatatggggcgctatactataggtaaaatcatataattaacaatcaaaatataaatatacaatcttaaacactaaatagaattatttttttaaagaaacacatctcaattcttttataagaagtttatacattataaacgtaaaatggtctctattttcccacgagaacgatcgtatctagccagataaagcccgatctttgacctttgtctgtatacacatgaaacggaagttaaatgcttatttccccaccaattgaaagttcgagagcttaatgtccatgaatcctggtttcgtcggtttagtgcgtaaacccgagacgaaacaatgtttcggtcgtaacttaaccaaaaaaaaaaaacagattacaacctattgtcgttgtcttcataaaaatcaaaatcccaaaacccccaaattcaaattaagaaccctaaaaagctgaattcttaattttgtaattgaaaaccggatttccagtttaggatgagcaacctttcatcgagttcgacgggatcaacgggaccacgtggaagaggaagagtggtcgaagtgccatcaagatgatggtgcgaggaactaaattggtagtcaacataaaattgaggatttaaatcaccaagtacatagttcatgctttaaaccaacgaaaatggtaaactaatgatttaaatgacatttttcccaatgtatatatataataactacccaacactatgaatcatgatagttccttttttctttgataatattaaggacatcaaggcactaacaaacatggcaaccttatgaaagtataaaacaatttacataacaaaaaggttaagaccaattagtttaactaaaaatgaatgttatcgaatttacaaaattatacgtgatttgaagtattccattatatacattttttttgggacaaattccattacatacatgtttttttttgggacaaattccattacatacatgttttttggggacaaattccataaacaaaaaatacttcactttttttctctctctcgggcaactttctaaatctagtttttttttcttctttttttttatttctttttaatcttcacttgaggtttacgacttcaacggtgaatcaagggggagcaagcttccttctccaacaacggtgatgtgtgttattcgtcatgtgacgcatctatggctctttcatggcggtttgagaagctatgatatcgttcgctctgattcgaggacggaggtttcatagacgagtgtctcacggctcatccgccctattggccgctgcgactagcggtggaagttatccgacgacttttttcgtgctatgtttgtcaatctcccaaaatatttctgtatctagattattcttttttggttcattataaataaatatatttaattttaaacgttcatagtgtattttaaatttggaaccaataaaatgggagagaaataacacatgtcaaataaagagatgacatatgtcacaactttagaacatatgttttgtgaaaaacttattttattatataagatatgttggttgtaacaaaaaataaaataaaaaattctacttcacgggttctctcctagtttctttaatgagttatccgaaccaaataaaaacttgattcgaatccggattttattcaatcgaactgaactaatcaaaatttcatcaaaaagtaataaatcttcttaatatatttatatcattgaaacatattaaaagtctataaaataattaggtttttaataaagaaatccagccccaatccaaaagaaaagaccaactaattcctcgccttttgcaatttcgtataattatttcccaatttttgtgtttgttaattaaatctctaaatgttcgctgacttcataaatttggattacgtaaaaaacgactttcattagtaaaaagctgaagaagagtggtgaacatattgtaccacgacccctcttgttctacacatctatcgaaaagcttagagactaacaatattttatgtaagaaagttgtttttttttattctagactttcacatgataacaaaaaatataacatatatctagctagatatttacataatgattccatagtagaatcatatttttgtttgtgtgaaatgattgtaatgttttcctcatcttgaagattcaaatcctttttttcagaagttgtacaaaccacaaccaaatatctttatcttccacctcaaccattgtttaaagaattagctacaaacatttacggttatcttccacctcaaccattgttaacagttagacttttatgaagtcaacaaattcttaaagacaattggcaaacgcaaaatttagtcattttatccaaaattctaaactgaaacggagccaaaataaaattcagttttatttggtgcctaatttataaaatccaataatacgtaacccacaaatctcgaaccaaactataccaaagaatacccaaaattaatatcagatttgaggcacgtgagatacgcctgctaagatacacacagctcgaaatctgagtccttctcttctttttcgccatcggaaagttcttaccttcgatttcaatttcttgctttcttctcagttcgtcacgatcggagctttttgtccgatctcaaatgcccaaactcctccatttagttatcttcccggtagcatctaagtagcttgaaatccctaatatcggagttgctctctcccagaaaatctcgagaggttcaagtaacgaaa

SEQ ID NO: 9833 - DNA, 898 bp, Unknown
  misc_feature (1)..( 898): cDNA_ID_3033995_gDNA_ID_1974083_Annot_ID_180461 3000 nt of promoter + ATG
atcctaatgaagctgtgaagaagagagaaagaacatttacgtttaaccaactcacggcgccatttcactacccgttttgcttagacatatacatctcgaaagagtctgtacgagcatgtgtgattcacagggtgactagtaaggttgtaactgtggctcattcgatttcaaaagacatgaaattcgatcttggttcgagaagaaacgttgcagcttgcgctgcggttggggcagttcttgctcaaagaagtttggaagatgacatacatgatgttatatacactcctaggaaaggagataaaattgaaggtaagcttcaggtcgtgcttcaagctcttattgacaatggtgttaatgttaaagtgaagcttaagcagaggaaacttaagaagaagactagtcatctaatgatggcctagaggactgaaattttctagtttgtaatatgggcccagaagatatgtttctgtgtggggcccaaaaaatgttatccgtttcatttctacgtttcttgtcgggtcaaagtgttgactttctaacaatgatatcatcgttttcttatacgtaacttctctgctcttccatagccgatcgacctttgttcacaattcccaccgatttttatttgctagatcgatatattttcaggtatgatgatatatatatcatggtttgtttattcatctggaaagtttttgatgcatcatgatcaggacaaagttggcgtgaaatgaaaagttttaaataagttttttttttttgttgttgttgtaaacctataatcagatgatgagatgatcctatattaatcgaatattttgattaattatacatgatatttaacaattgcattcatcttttttcttttgtgaaatctaagcagtgagcttgaaacatg

SEQ ID NO: 9834 - DNA, 3000 bp, Unknown
  misc_feature (1)..( 3000): cDNA_ID_2033794_gDNA_ID_1974083_Annot_ID_180483 3000 nt of promoter + ATG
aattaagatcaatatattatatcttattgctaagatttgcatcatctccattcgattacaaacaatcaatgcctattcaacgcttagagaagggcagagagcctgcattgcattcacaggatttagagacttgatactttctggttcttaaatgtggcaaacgtttgcaaaaactgtgaatgggggtagtatgcgaagaacacaagccctcatggtcatcttcttctcgttttcttgttgttgttacaggttgaagttctttagatgatgtttcagggagactagcggttcttaattcaattatcttcagctctaactatggtgaggaagtttcttactttcatttagcttgtgctgtaaagactccgatgatcaaaccatggctcttgtcaactaaagtttgaggtatggaaacaaacgtaatgcatcatttcacatgtttcggctcttgttcataacgagagaggaagtattgatctcaaattctctcttgtaccttttattaaatgcagtatttgattttaacttatcaggattcttgcttttcgtatgtgaatagtatgtgcgcgtggttccggtgtggatattgctgtcttctgttggtttcttcccattgcatatagcggttgaaggttggttcttctcatatctaacttgaaaagtttatccctcataaggtttcatgtttcataattaaggctagattgttgcgtgccgcctaaagtctgtcatattctataggatgttttgtttcatgcaaagtgaaacaagtctttgggatatctttttctatttgccatctctggctcttgagttttgaacccaaaacagttagattgctgccatctaaacttgatatttgttgagagagctaaatggtctgttcttcaaactgtgttctggaaagtaatgtttattataaaaggtaaagagatccaaaatgctctccgttggtacaacaaagcaatatcacccggagagtagggatttacagagcataaaatacatcacacaaaatcacaacgaaatgtgaataaatagggacaaataaagaatgcaatctgagtggcacaaaagcgtatgggaaaatagtaactcagaagattgccatgtaggaaaccgcggagaagaaggcaataagaggaaatgagaacttgatagagcttccatcagacgatgggggtccgtctccttctcctactggtacggttttcgatccattacctggtcctaaaataaattcccgatatggatgcattagataacataaagactgtattgaaattggtgtttcttctttatatctgttttaagtcatttacctgaagagtttggtgattctgcaggagagtcagaagtagaaccaccaccaccaccacctgcaaaaacagaattccgcgtaagattcgcaagaactaggattggaacaatcttcactaacctatgttttgaaagtcttaccggtattacagcgactgacaggaggagtctgaacattacaagccctaggcagaccaagagcttgtgtttggttaacattgatcccaagctgagagcctccaccgttaaggacttgacacaaacagtcaggagaagactggactactctactcaactgattacagcattgctgattaggagaggtagagtttccagttatgtagttgagacacggcgacatgctaatcaacgcgtttgtgcagcttgactgagcagagaccattgtagaagacatcacagccataaaaactgtaaggaacactaaacccatttccattttcatgttttcttgaagatgttgtgtttgaagaagaatccttttgagtttgttttgttggtttttgttatgtttgatttggatattgtggagtcttttgatggtataaataaggaattgaggaagcaaaggtggcttaatttgggtgaccaactctttcctacttttctaacagtttttggtttgttttgttcagattcggacaaaatgatgagtgttgtgttgtgaacagagaactggtccgtttgtaatatttggggtcggtggtctttgtgacggtctaggctttggttgttgaactacttcctttgattaaggtttatggagttttgctatatctacacaataatacataattgttttgtattattgacttgaccaataacaggtgtcgaaaattctcagttagtacatcatcttttacaagtcttttgacgttctagaccaaattatgttgatttttgaatcaatggtgagttattttagtcatctggttgccgtgttttgaaactaagaaaagttgaattatataccgtaaagaagaagataatactaaaaatccgaatacgacctacaatgaaactaagaaaatcagtagccaagaatgattttgagtcaatggtactaaatggcaaaaaacattacaaactaaataaatgacttttggtggacgtctaataaagtaatagcaatgaataaaagtaaagtttttgcaatagagtctttcatttaattgtaaatggatgtcttgttaaccaaacaatattttgattgttttcattgctatgtgctttattgagaggatgagagcacatgcatgtcttgttttgtaagctgtacctttttttgtcataactcaacatgatagtaatggaatggaatctctttgatctcttgttaagttaccaaaacagaacaaccgtgagagagtggttcatctaatacaataacaagacatgtatctaccacaatcctcacatacacatgtacgcatcccattggccaattcacttccaccaacgaccccaattaacaaaaaccaacatgagttagttattagtagttgacctatactcacttcttttatcttccctccactctctccaatctataaaaccaaatccaacaattgcttccttctcatcacacttcaaacacaaaaccacaaagctttaaacttccaaaagaatacaacaaacaatcaaagcttaatctatccaaca

SEQ ID NO: 9835 - DNA, 3000 bp, Unknown
  misc_feature (1)..( 3000): cDNA_ID_3033973_gDNA_ID_1974083_Annot_ID_180481 3000 nt of promoter + ATG
ggtaagctcttcttcttcttcttcttttagctctgccattagggaacggttttggttatttggtcttgtggtcatagaactatgcgagatttatgaatttatgtttttttatcttaagccttatgtgcctgtgataattgaatgttaaagcaattttaagtttgtaagaatgatattgtaaagcttgaattgaagcttccctctgtgatgttgtggttatgataacattaaggttgctgataaactcatatggcctttgctctggatttccttgtttatgattggctacttattattgatggcggaaaatttgagatatctctgtgtgttttctttatgctccattgaatcagaatccgtattcggtgaatatcctgatggctggctatgacgatgagtctggtgcatcactttactacatcgactacattgcaactcttcacaaagtcgacaagggagcttttggttacggctcctacttctccctctccacgatggacaggcattaccgcagtgacatgtctgtagaagaagccattgaactagttgacaaatgcatacttgagatccggtcaagactcgttgttgcaccaccaaactttgtgatcaagattgttgacaaagatggagctcgtgattacgcttggcgtcagtccgtaaaggatgtcacaactgctgttgtctgagttggttttgtgtttggttttcagatgttatgtgtctgtgacatttgcttttgattttaagtcgggagttagtgttttgacactttttaatcgttgagcatcaatagtgtttgcgattccataaaaatgatgatgtattacttcaacaacacaaaataaatctcactcgaaacagagaacagtatacacaaaagcttattccacaaagcaatgaccaaataaatggtttctttctataatcaacgatgcataaatcaaatcacataaggaatgcaaagaaacaaaaggaatcatcagtagaatttgagagctacgagggcgatgctgaagaagagaagagatggtgagagtgcgtaggcggatgaaggagtctcagaaggtcgactggtgcttcctccgtcgtctgatgttggagctccaccgtcgacggatggtgtaaatggtcgggttgtatcagactgtggtgtctgagctgccggagttggctctggaacaattggatccgtctctggtcctggagacatcgatggtccaaatgtagcagcaggtcctattaccaaaacagaattttttatatcagtttatcttccaagaaaccaattatgtgattaattgagataataatgtcattgattgtttaccaggagcagcagctggagcaatattggctgtaaaaagatggaagatcaaaacatttgttagataatagattcaagcaagtttattaaatgtaatgattagaggggaatgatttggttttatttaccttggcattgaagagggactctaggcatgttacaagcacggggaagtgagacagcggttgtgcggttaataggaatattgaaaggaacagttccagtgacaattagacaaagacatcccattcctccggtggtcaaagacctcagcgagttacaacaatcagacgacggcgaagttccattgctgctactgttggttatgaagcccatacaaggactcacggtggtcatcattgatggagtacattggcttagaggttgttgttgaccacgaatcggcaaagctagcactgcgatcatcgccaccacaagggaaataatcttcgacattgttggatagattaagctttgattgtttgttgtattcttttggaagtttaaagctttgtggttttgtgtttgaagtgtgatgagaaggaagcaattgttggatttggttttatagattggagagagtggagggaagataaaagaagtgagtataggtcaactactaataactaactcatgttggtttttgttaattggggtcgttggtggaagtgaattggccaatgggatgcgtacatgtgtatgtgaggattgtggtagatacatgtcttgttattgtattagatgaaccactctctcacggttgttctgttttggtaacttaacaagagatcaaagagattccattccattactatcatgttgagttatgacaaaaaaaggtacagcttacaaaacaagacatgcatgtgctctcatcctctcaataaagcacatagcaatgaaaacaatcaaaatattgtttggttaacaagacatccatttacaattaaatgaaagactctattgcaaaaactttacttttattcattgctattactttattagacgtccaccaaaagtcatttatttagtttgtaatgttttttgccatttagtaccattgactcaaaatcattcttggctactgattttcttagtttcattgtaggtcgtattcggatttttagtattatcttcttctttacggtatataattcaacttttcttagtttcaaaacacggcaaccagatgactaaaataactcaccattgattcaaaaatcaacataatttggtctagaacgtcaaaagacttgtaaaagatgatgtactaactgagaattttcgacacctgttattggtcaagtcaataatacaaaacaattatgtattattgtgtagatatagcaaaactccataaaccttaatcaaaggaagtagttcaacaaccaaagcctagaccgtcacaaagaccaccgaccccaaatattacaaacggaccagttctctgttcacaacacaacactcatcattttgtccgaatctgaacaaaacaaaccaaaaactgttagaaaagtaggaaagagttggtcacccaaattaagccacctttgcttcctcaattccttatttataccatcaaaagactccacaatatccaaatcaaacataacaaaaaccaacaaaacaaactcaaaaggattcttcttcaaacacaacatcttcaagaaaacatg

SEQ ID NO: 9836 - DNA, 3000 bp, Unknown
  misc_feature (1)..( 3000): cDNA_ID_2033838_gDNA_ID_1974083_Annot_ID_180468 3000 nt of promoter + ATG
tgagtacacaatttagggttattcctcatctctgcgctcaccactccctcggcatcttccctcgtcacagctctgtctgccgataacttccctgctgcaccctatataattcattcggttcgaaaacatttagccactactttaaaaggaaaacatcaaaaacattgatgaaaatgttttgaaaattagggtttaaccgtcaaaacatcacgaagcttgattttcctctcgtcacgatctacggtagcgttgtgatccgctgcagattgagctgaagcggcgactccagctagagcaatgacgttggtaccggaagctctcatctctgccgcttgaatcgctgcggcgtcgctttgatccacaggtttgtttccagctgtcttcacagttgcttccagtgcttctccaatcgttattgtactttgcaaagcttcttcgtccgtacgcgcagcagcgactacacgcctcggttcaacgtgttgtccaacgacctaaagcttcaccattactccaaaacaaaaaacggatatatgaaaagaagtactagtacttttcgaaacaacttgtgacctgtccaccgacgaattcggttgtgacagttgcagcagggaccgtttgctccactgtggcgcctcgttcagcgacaagctcagttttgtcatctggatggacaaagccaccgcgtatattggtggtggctgcagattgcatgaccgcagctggaccgcctttctgagtatggccgaacacatgtgtctccgcggattgcatcatctttgcatcctcaggtgctatgggcttatcagcgagttcaccggagacttcaaaaacgtccccgtatttgactggctctcttggcctccttggttgctcttggctcatctttgttttgttacgttaatgttctgttacaaactacgataactcctacctgaattgagtgtctattatataaagagaggtgcatgagtatgggatcaacgttctgagattttgacacttactcgtagatgaggtgactaggacactcgtgtcagtttgcgagtttgtagctaaaaagataaagcttagattgagatagggattttacttttctttttgtaaatttgtcatttagttttaagagtgaatgaaaaaggacatgtttccaacgttaccacatatgagtcgtataacattggacacgtttgtttcaatatttgtttttgttcttgtagacacgtttcaattttaagacaaacataacagaaaagtcaaatgttggaaacaaaggtcaccaatatgtcggaagtcaaataacaaatctttgtcggtctaacaaaactcataaacttcccctaactcttcggatctctctagatccttgtttttcgttgccttaattatctttctcttctcttatttcatgttagaaaacagagtatacaacagaaaacacaatcgtttatttttgttctctgtgttcccatacacaaaatcttccagcttctgtttctccgttttgttcaacggagttacaaagcggaagaacctttgccttcggcctgaaagaccaaagatatgggaactggtggaataacgtccaacgctcacgtggtctctcccacgtggcatcacaagcacgtgcctcctatggatgacgactctgttcttcaaagagacatcggagagcttctttcacggtggggcgggcttcaaatggccgtaaagaaccagtggggaggccatgattctctcaagaaatctcaagagctagctcacaatctttttcatctcatctctcaatcaaatggttcgattttctttttacttctttagattttatgttatgatcatgaatatattgatagtttgattccaacattatgatatgagcagtgattacggtggaagaaatagagaatttgctacatgaaagcttgcttctttctttcaacacagagattgaagatggcagcattgaagaggtacgtactatttcttgaaaatgtagacgatcaatttacttgtgaattatgtcgactaatctttcatcgtgtgatttcgtcaggtagctgaacaattgatgatactccatgaagaacatttacgtgggactctttaagcagtagcttgaacgatttatatcatttttggtgtataattagatcaatgtaagatacaaagaattgaaaattgggtggacaacaaaatattattcatcagaaatcatagaatataggaatacgtatcaaaatctatgtttatttgatgtaatcattttgtagttgtgatgaacagtttttcctaatgtaatttcaaattaaccagtaagacactccatcatgattaatgtggggaatatggaccgagtgaccgataccacgtagaaaatatatatctaaattttccaatataatgcaacaaaattcatattgaagcaaaaactccatgtaatttggattcttgacaattttattatggtcaaatcatgtgtgtaatatgcaaataaaaactagagagatggcaataacatcattagtatgaaccactaggctataaattggtcaaagtagaaatggtgcaaatgaaagactaatttacgtgagtgcgattacggtaaaatcggtcattaaagacaaaaagacttaccgtacaacaagtcatttacatgaaaaccaaaaaaaaaaaaaaaaaaccctccaaaaagggattgtccaacataagggcacaatagtcaatttcaagcgattcctcgtttattcgtgtttcatcttgatctcagctagaggaggaactaaaccacatctacagagtcagaaaataaaaagtagaagaagcagaagcgagagtgcaaaaaggttagatctgctttcaaaattgttcgtactgcttctttaccacataaagttcatagctttttacgtttctaccgataattttgcattccgaattctccattttctcaattttgcttaaatgggtgtttctcttctgcaggaaattaggttttgagtggtc

SEQ ID NO: 9837 - DNA, 3000 bp, Unknown
  misc_feature (1)..( 3000): cDNA_ID_2033821_gDNA_ID_1974083_Annot_ID_180473 3000 nt of promoter + ATG
aaaaagtattcaacaattaaaaatttatcaaatctatgtgttatataagttttgatactatattcgaataaagtgtaatataccttttcaatttgtattatttaactaatttaagctaactaatatatttgctaatcttatacctatcaaaaccgactatcgtttcttatctctatactatttttgcaagacttttttggtggatttgggtaaaagtgtattcgggtcatatggtacattcccctattaaataaaaatggtatactcctatgttattagctaaaatgtttagattataattcagagtcatattattaataaaattaatattaataaaataaatggctttttggcaagacggatttggagtgacgggtttttgaatcaacattaataaaaaaagttaaatataattaatataccgtttcaatacgggttaaatctttaatttattattttttaagaccactaatattaaacatatcaaatcatcctaatttagaaaagattatataaaaccaaaaatgttatggggtatgtataatgttactatatataaaatataaatgtattagagaatgatataatttgcaaaacttttatattcttaaattttaaaaattactactttaaaaaaaaaatcacgggacgggtaaagaaattatagaacgagttttattttgtaattgggttatatggtggatgtatttgaatcaatatttataaaattttaaaatattattaatatgctgttttaataggggttacaactttagtttttcaacaattgtctcatagattcgtgttatagccttacttaataacaattataaactgtaaaatataaatattttataaaaataaaatttgcaaattttaatatatattacttttaaaaaataaatcgtcccgcggtataccgcgggttaaaatttagtcaatttttatggaacaagaataaaacctaaaacattaaactttatggaccatagagtatgtagtagcaattaatagtgtttgtttaaagtaatgattatcaagtttgctcatacgaatttatcactagttttggttttaagtagtgatatttttttcgtgttatacatatataatataacaagtgtgtaatgtccacccaaagagactagccagctacgaaagcaaaagagatattcagttaagattgtgaaatatattcgtacgtatgatcgtatctcattccattacgattctgagcgaccgagtccacccacacttagctcccatgctaacaatatagtcatcatcaccaccacaacgtaccttaacatcattacacgagaaaaagtatatatgaaataatgattttaaaagagaaccaaaagttctcgtattcatcatctctatttgtctcccgttgaagaaactagcttagttcgtgtttatatgagttactcccgttgaagaaactgcggttaagagaaatttttgatggataaagttatacttatagtcacgataagaagatatgatcgataaatccatatacatatgtgacattattttactagcaaaggatctctttctgtctttcatatcccatctataattttagatgaaaatgaagtagaataatatattttgtttctacatttccatctccaaaacagtcttcttcaatatctttcttattcacaccttttaaatatgtaatgttatcacctaacagtaatagacaatttacttaatcaccatatgcaagtgagaagtacatttttcttctatattaaatgacatgcaagacgtaaacaactttgcaaacttctgttttgaaaacgttttagtacactataatgtgaatttctaatcaaaatacgaaaagttatataatactataatacttaaaataaatcacatatatttcaatatttgtgatagtacattagtactcctccattgatagattagtcgtaactagtacgatatacaacacgagtattattcaacttctttctcattaaatttctaaagttccttttctctaaaataaacaaataaaataatatagaaagaaaactataagaaaattccaaaataaaataaaaagacgaaagggtcagtagaaaacgacgtgagtggttccttggcataacccaaaaagcaaaataataaatcagcaaagaataaaaagacaaaattcctaaaatcaataataatttatacaataaaacgaatttaggaagtttcactggtgaagtggttttcttcacccactgatttctattgtaaatctctctccctctatatatgtgattcatataagtattattatttgatagagaagctaagtgtgtgtctctttagtgctctctgttttcttctgcttatgaaaaaacttcatggcgaattttgaggatatggaagagaatcagtggggatgttttgttttcttttctctttctcagttcatcgaaactataacccactaaacatacaaaaccaaattatttataaaaagcaaaagcaaacaaaaacaaataaacggatcaatttctttcttttgtttgtttcttcttcttttctccaatctctagtgtaacgtttcatgtcacttgataaataaaatattttaggaagaaagtgcgagaaactcgggagttatacaaaaaaataacatttttgtagaaaaaaagctctcgtcttttcagttacttttctcttttgtcacactttcatatttttttctctaatcatggaggcaacagaattgcattagcttcattttctctcatacttccacaacctgtaactttctgatcttccaggttagttcacacaattttgcatgattgagttacaaagttatgatttttatgtgttattgagttacatgttatgatctttttgtgtaattgttataaagttttgattgttataaagttttgatcttttttgtgtgtgtgtgtgattgagcagtgaattatgctaaagaagagatcaagaagcaagcaagctttaatg

SEQ ID NO: 9838 - DNA, 3000 bp, Unknown
  misc_feature (1)..( 3000): cDNA_ID_3034002_gDNA_ID_1974084_Annot_ID_180510 3000 nt of promoter + ATG
cttttgctattattcttaattcatcaatgaaaactattcagattatgatttgtgtttctattgtcatgtctgagtaatcaccttgttgggtctaggaagtctcaatagggatttagatggattagtagatcgaaaaccccttaggattactcttaaagttcttcatcttgattattcttaatgctagttttagattgatcacctagaacttgatattagataataggtattcccgccataggtatttgttatttgaaccatcatatatgatcctaggcatttaagaaaaaacaggtaggctcatagaagggctctggtttagatactaggtgaactaatcaagcttattaacaatgcatgctttagcataggatttctcggcttctccaggtatcttagttgtaagtatagagagtttcgcggaacgccaccggttactctagaattatattttgagtttgagaacggtgcgataacaatcctgatattagctagatctacaatttatctatctcccgagacaattccttagacctgacgctttaatcacttaactctacaactcatttacttgcttattagttttaaatattcaattacttcatttagcttagtaaacaacatcataagtctattgtgtgaacatcgagagctcagtggaattcgacccttaagtgctaacgacgatctcttatttgagggagtaagcttaaggcaatttgagctatatcagggacagtgacctttaagtcagggggaggcgtttactaactacgtttttctttttgattcttatttttactttttgagtcattttattgagtcaaaatttagttaggaattaggatctatattctttagattattgcctagttgattattgttgcaggttcaactcaatctgactattggcaaatccagatggcaaacgaacaaacttgagaatatcctagtttccaacacaattcattaaggctggagctaatctcactgatcttccttttacctcatcaaaacagttagtattcatagaacttgactccttacaaacctgatattgagaccaatgtgaaaaagaaaaatattcctctccccttattataaataaataaaaacaaagaacagagattgatatgattttcggtagtgtataggggtaagaatgtttctcatgaccctactattatacattattaggaatgatcaattacaaaggttagaacttgccgaggatgtcaatccagtatgcgagtactcctttgtttacttttcaaaaagaataagcataggggagagaaagaatgctaaaaagaataaagaatggtcaatttatcatggtatagtacatgaatgattctagaaggttcttgaatattagcttgcttgatgagacctagcgatgaaagactggtggatatagttaaggaactaaggtatggaatcaagaatgttgtgtaagcttgcggagatgtacatgttgtttaggatttgattacacttcctaggcatatggatttggttagaataaccacggcaatagactagagaatgttgggagttcctgcgttttcaaacctcttccacgagttcggcttttgtgttttgcttgagggcaagcaaaagctaagtctaggagagttgatatacctcaattttcactgtttttagctatgatttgggtatagattttagaatcttttgttatttgtagagtttttctagtcttttttaggtctttacatatgtgggatgcatttggagattatggagcattctggatcaaaacagacaacttaagctgcagaagcaatccagagacaaaaatctacgtatgtgtcgatcaacaccacccctggtgtcgagcgacaccaatatctgacggcaattcgattgcgcaacttattcaatttttgaagattttcaaattcggcccagaacgtttctaggaacttaagtatcaatttttaaggtcaatgtttagacctaacacttattatctattctttactagggagcaaaaccctgttgagactccctttagagaagatctttctaactctattctcttcttaattttattactgctttcttattcaaacatgttttgctcttttataatcatgtgtgagtagttctcttgttaggttttcgatctactaattcatctaaatccctgttaggataatatatttagaattcttcatctttgtttgttcttaatgctagttctagagtaattaactagaacttgattttaatataacatgtatacccgccataggtatctattactagaactaccttatatgagcctagtatttagatgcggactagcgtcgatttagatacttaggtaaacttatcaaactggattagaatgtttgcttacttctagggattatatgttgaacgatgtatttaattttaacgtggggtttgatgataactatcataagaatggtagttatcagaatgtggaagaactggtccgtaaccattcaaataaattctacgacttgttagaaggtgcaaataatcaattgtacaatggttgtcgtgaaaggcagttgcaattatccttagcggctcgggtcatgcaaaacaaggctgagtagaatatgagtgaaaagttggtggactgagtttgccaaatgtttaaagttttttttaccaaaaggaaacaaggctaccacttcacattaatagaccaaaaaggtgatgcgctattaggacttccatatcatacgattgatgtttgtaagaacaattgtatgctcttttggaaagaagacaaaaaagaagatcaatgtcgaatttgtggcgcacaaagatggaagcctaaagacaaccgtcgaagaaccaaagtacaatatattcgtatgtggtatctacctattggtgaccgattgaagagaatgtatcaaagccactagatagctgcgacaatgcgatggcatgctgagcaccaataaaaggagggagaaatgaatcatcctttat

SEQ ID NO: 9839 - DNA, 3000 bp, Unknown
  misc_feature (1)..( 3000): cDNA_ID_4254512_gDNA_ID_1974085_Annot_ID_180524 3000 nt of promoter + ATG
tactgagctccgaaagctcacgaaccagtggcctcaaaacccttctcatttcaggtgaccattttcttgattctctctcactcactgaattattgattggtgcgttcaatcacgagatcgagagtttaggcccattgggccttattagaatttcattttattatcctgaaagtgatttttttttatcatgtgtattggtagagaggtatgccaagaatatgcaagagaagttgagaagttagcttttaggctattggaacttgtctccattagtttgggtctacctggtgatcggctaaccggtttcttcaatgagcaaactagttttttgcggtttaaccattaccctccttgcccgaaccccgagctagcattaggtgttggacgtcacaaagatggaggagctttaaccgtcctggcccaagatagtgtaggtggattacaagtgagtcgtagatcggatggacaatggatccccgtgaaaccgatctcggatgctttgatcattaacatgggcaattgtattcaggtaaacgtagactttcggctcaaaaccaattagcaatgaacgaagttgcatgtcaatatatcttcgatgtattatattagagttgatgaatgaaaataagattttgtggagtaggtgtggacaaatgatgagtattggagtgctgaacatagagtggtcgtgaatacaagcaaagagagattctcaataccattcttcttcttcccatcacatgaagccaatattgagccattggaggagcttataagtgaggaaaacccgccttgttataaaaagtacaattggggaaagttctttgtttcaagaaacagaagtgatttcaagaaactcgaggttgagaatatccagattgatcacttcaaggcttagttaatcacattataattaaaccttatgttgatttctattcgttctttttatataagttagccaagttcatatttcccaaaatgcacgcgagattttacatgtttatgtttaaaataaacggtcatcagaatgttgtgtcatttgcgatcttcgtcatttttcatttccaaatatacgtagactgacctaatgttgataaatgcgatagttcttaatttcacatgtttaaaattcgaattgggatttaagaaaaattctcatcaaatatttatcattagtgtatatatatcagtgttttacatttgttaatcctaaataataaaccgatctgaaaagttgataaatgcgttgtcaaaagacaaaatatacatccaaacaaatcacgtgattgccttcaacttgccacggttcaaagatttaacaaatcttctaaaacaccaacttaacccacgaatacacaagcacagagtggtggtaaacatacaagttaatgagttattcaaatgagattttcaatatcattcttcttcagcccgtcacaagaagccaagattaagccattagaggaagtttataaaccgacaaaacctgcttagatacaaagaatactagctaatgtgtttcaacaaacttcaaattgacgatacgttacattcatattaatcacttcagagcttgattattcaaattattttttctactgtgatacatatatacacacatgttttgcttttctatgattctatctacattttcataccgttgaataatttatgtatgaattacgatgcaatttccttcattatgcttgaataaaatgcttttggacatgcatgcgatattggatctacttttggattctatttttaaaaatcagcgagtttgttgctttgtaatttttaattaggcatcaagaatttctaaaatgcacgcgaactggtgaaaagaggaatgtttacgtttacccctttattttcttacagctcataaggatactgtcagaagacagaaccaaggctctctgactataaattggaatccatttaaacataatgttatgaccaatgatggccaacggttagcccaaactaattaactacaagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagttaataaaagaaaccacacgagtgacctaccgattcgactcaacgagtctaccgagctaacacagattcaactcgctcgagcttcgttttatgacaagttggttttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctctttgtccttttattctccgtcgtcgtttcatgatctgactctctggtcttctcttcttcttcttcttcttctattttttcttacttcgtcactgttgtgtctgaacatg

SEQ ID NO: 9840 - DNA, 3000 bp, Unknown
  misc_feature (1)..( 3000): cDNA_ID_2186249_gDNA_ID_1974085_Annot_ID_180533 3000 nt of promoter + ATG
ctatttttattattataaatgcttcatatattaagaagaaaagttgtaggcttgtagcaaccgattcatagtggaaaatccttttttttttttttatgaaaatcagatcggccgcaaaaacaactttcaccatgcacgaagctagaaactgcattgatgtaccgtgtacgctgtttttaatataaaataattgcagttttattagttaggctacaaatatgaaatcaggagaaatataccaattaatgtacgtcctaattgcttggtatgttacataaccttaagttgtataatatttattaatttattttatactggagttgatagctttaaaagttgagagcaaagtaacttgagaccattttagagttagcaaagtaatggagaaaataagaaaaatcacacgcatgcagcatgatgtataattattggaaacatgtatttccaagaaagtaatcagttctctgtacgcctgaattcgattttcataaagctcacttccttggattgctagagcaaacatttatattgatatctgcgttaacatcataacatgtgggtttttagtaattctcaacagtatgggtatttttgctctctctagagagggtaaatttgtgattccatctgcaaattattcctcctatatatatatagaacgtgatgaatcaaatttcttaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcaggttaatttcttctccttcaccttgtaatttaaagttgttcctctctcattctcaaatcttgttgggtcttggaaacgcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtatgcaactttataatttttttatttattttgtttattctttcaactcctaactattttcctaattttttttttttttttcaggtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaatgttggagttattaaaaaaaaaaaagttaaccataataacattcttactgtacgcatgagtgatcatttatcacaatctattagagcaaccccaatgggtgggatgatgacagtccctaaaaaaccaaaaaataataatattttaattttttaacatagtttgacaactaaaaaacctacacatgtacatttaatcttcaggtcccttatataagggtttttggagcccttctctcctgtgtcccttccattttaattattttttttttttttatattgtaagggaccttaagagagaccaccattgctggtgcaggctgtagaaaaatttgtttagcttctccttcttttcttaattttgacagataagtctcagcctctctccccccataagggtatgtcttgacatttagattcgttgaatcaaaagtttttcatgtttgttcatattgtggtctaatcttcttaggcagatatgacctcagggaagaaagattattatgagttgctcaaaactacaatctttaaataaatatttgggtgatgaaacttctagttcttttttttttttggtctaaaatgaaactattacttctagaagagaaatatccaactcttttttttattccaagcaaatgataaccaaaaatgcaataaaggtgttaatttttatcataaatatattctaactatggtcgtaacttgtaatggaacacctaggcattttttatttttttggtgcacacctaattcgaggaaaaaggttgaagtaatcataattacataagtttctaactatggtcgtaatcgaacacatctaaggcgtagtaataattaaggaaaaaggttgaagtagcaaaacgacgaggttacgatttgtaaattccataaatgccctctctcattttcaacctcaaagaatcgtttttggctttcatcagccgcttcgtatttttgttttcttcagtaacggaaaaa

SEQ ID NO: 9841 - DNA, 3000 bp, Unknown
  misc_feature (1)..( 3000): cDNA_ID_3034037_gDNA_ID_1974085_Annot_ID_180530 3000 nt of promoter + ATG
tccctctcttctgaatcaaaagatttctcaactggtacatgttccttctcttgtcctccttgttcatcataatcttcgtcgtcaaacacagaagctctggaatttaaaccactcaaagcaaatgcagctgataagtactctctttttggtagtaggtgatcttcctcagtaactacttgaagctcaggcccatcatactcttcatcattgctcccataatctacacgacatatcatcacaagtcagtgaagctgatgaccgggaattggtagtggcaaatagtttcagtttgtaactgctatgggtgggacttgttgcgtatatcaaaatctcaaacataaaaaccttctatttaattaactcaaaacgctgagcaataaattatcccacaataagtagattatgactagagcaaaactaggagaatgcaatacactaatgaagaaaccatgtaagaaactgcaaatataacctgcggaagtctcgttgtcgttggactcagacataataaaaccctcgaatgcaaagagtggcgtgacaattttgcttcccaaatagcaaaggaactactgaaaagaatcaggagcaagaacaaatccacgactcaacgaaaacctacaagggaaacataccaccatcaaattttccggtacaattagggaataacaacgttcatacccaagtaccaattttcgtcaaattttgttgtttagtaaggaaccaagaacaaaaccctcgttgatatctaaccgagacgacgacattcaacgttatgtgggattggcggtttcctaattgagagtatgtacacatttagccggaggaagtgaagcggagctcaatcgggtgattggaagatacaacggaaagaagaaatcgtctgagggatcaaagaggcgggtattaacatcggagtggtaatttatagggaaaagtttataacccgccccgattctgatttagttgtcccgggtcccatttttttttttgcacttcaaagattatgtttattaatggtccacagaatacagcccaataaaagcccatttagttacatatcccgggtccaataaagtaaataattagtcaaaaattatataattaagtaattaataattttgatggaaatttggcaagacaagtaaataaataagagtaaaagtgattttctcgcatattactcttcttctagattttggcgcttttttaaaatttacgttagaaatactaaataaaacaaacaaaacctatgccctgttcgttttcctgtcgctggatccagcgacagcgaccaacgaccagcgacagcaaccagcgacaacatatattgttcgattgtctgtcgctggactcagcgaccaattacatcaacaatcgctaataattgtcgttgtgttgttcgtttgactgtcgctataaacagtcgctatatttttttttaaaattaattatttttggtactaatttatattttaaaatcaaaatgtaaatcatatatatcatacaccatgagaaaaataaattaatagatttatttattttagttttatcaaatttaatttgactataattagtttatgttatttgaatttaatttattttaacttaatttaataagaattattttaattaaactagaactcaaacctttcttgatatcgcagagaaaaatattataaatttatttatataataatttctttaaaacaaatctaactccaaatgatgcatattctaaatttcgtagttattcaatagtatatatataactaaccggaaaaaataactgtaaatattttgacagaaaattacaatataggaaggttgcaataaaagacacaagcgagaaaaaacaaccatcaatattttttacggaaagttgcgattaaaagacacaaccgttcagagtgcaaaaagacatttattttaagtttaatttaatttaattctgtttaatttaattatttttaattattctttaatttatattttttgatcgctaaattgttcgtttgcatgtcgttggatccagcgactaaaaccagcgactaatcgctgaaatcagcgactgatcgctaaaaatttcagcgaccaaaaattgcggtcgctggtcgctggcgattgtcgttacttttgatcgctatgcaaacaaacaacttttggtcgttgtcgctggtttcagtcgtcagcgacaggcaaacgaacacagacaagcaaacgaacacaggcaaacgaacaggaccctaatttaccaaaatgaaacaaaatataattatccatgtccaaaaagaaaaagaagaacaataattgtcatatgacaaaattaaaggatatacttgttacggtgtatattgtatagtctctttatttcattcttatagtaacagacccaaaccaaaccaaatcctacgcaaaattagtctattttttttattttatctcgaactttgacataagccgctaggaaatatatattttaatcacgaggcgagataattcgaattaaaatggaccctctctagtctctactgcttttttcaatgtcttagccgtttgaatatttttgaaaaaataaaagaaaataggtttctcatttacgaaactaacctctacaagcctactttattacgtgagaaagccctttccaaattcaaattcgaacagcgcctcaaagtacaaaacataaagatgcaatctcagccgtccatttcatcttctttcttttacattcctttctccgtcctgcttcactgctcaaatcatgcgaatctagaaagagagagggagtgagagagaaagagagagagcgaactctttagaagctcgacaaattttggattttgttgctcaatttactacacaggtgagatctatttcagcctttaaacccaacgagcttcttagctttagctatggattccaagtttctaaacttatcatttctcgtgtgtcgatttcataaattttgaactgggttttgtttcagattagggtaataca

SEQ ID NO: 9842 - DNA, 3000 bp, Unknown
  misc_feature (1)..( 3000): cDNA_ID_3034033_gDNA_ID_1974085_Annot_ID_180531 3000 nt of promoter + ATG
catgaataacctttggataactattatgtatcaaattatttaggccgtggtcaacgaagattccaacgaggatgtcctggaattacgccgtcaaatccgacttttaaaggcgtgtaacattttaaactgccgttaggtgctcgttatgtgaagctgtaataacgctaagacaattttttgtgtctgcggaacaggaagagctttccctcctcaagcgccagaacatatccagggcgttgtcatttggatcagcaacagccaacttcgcagaatcacaagtcgattcgccatcaagtgtaatgcatgagacaggacaacagcaggctggtaacttgcttgtgtatgaatctggaggctgtgtaaggatgtctagaaagcaggtatatcaacttgagaaagtatgttaggctttactgaggattcatatgcctctgtcttgggattccactaaaaatctgtatatgtttatatatcagttgaaatctttggagataacacttgctggctcattaagacgagaacatgtggctgatgcttcaattaagaagcttgaagcggagatagagcatctaaaccgtttggtaattctttttcacctacactgttcccattcccacttatgtttcagatatcgcctgaatccatttatgatcatttaactttaggttcgacaaagggaggaagatactaggagcacaaaaatgatgctcaggtttcgagaagacaagatacagaggctagaatcacttcttggcaaccatatatctgcagattcttttttgctggaagagaataacgtgttgtcagaagagattcagctgcttcaagctaaaattgataaaaatcctgaactgactcgctttgccctggaaaacataaggctactggatcaacttagaaggtgataaatcttcaaaaacatgtgatgccgacgttaaagataatgtgtgcttttttatatataaaaagttttgttattatggtacttgcagatttcaagagttttatgaggaaggtgagagagaaattctactgggcgaagtctcaaatctgcgaaaccaggtacctctagttagcacaacatcctggtatcgattcattcttcttttcgattgcaataccatccttaaccttagctattgctcatgcagctcttccagtttcttgatgaaaactctgactggcaaaaacatgttgatgatggaatagagccacaggttacatctatttacctctttctatatgttaatatctcttaatatccagcaggattgtgcttcattggttgcttgtcaataatatcttgttgtatttcgtatggcacagggtgcatcacgtatgagcaaagaaaattgttctctacaggaggaggtcgagtcactttctttctcttgtttcttgtgcatcacgtattttcaatttcattttcttaacgtcttttccattgcagttaaaaaagacctgttacgagcttgagaaatgcagaagtaaccttggttcttgcctggaagagaatgcaaagcttagtaggttagcaaatctgatttgatgattcttgggtttttcctggtatatggccaaatgagttctcattttccccataccctgatgagtcttctcgccattctcctgcagagaaatcaatgatctacaagctatggtcagcgatatcagagcttgcacacctgatgaacatagcagtgtgaacaaacaaaaggtttgaacaataagtacaatgtgatttactaatctgcccaaccatctgttttgttgtttctgcaggttaaccttgagcgtttcacttaacagttgaattttgtaaaaaaattgtaggcgctgttggggactcaaaattttgagccgcacgaaacacttgcttgtgagcaggccaattatgtcgaagaaatcatcaaactgcagcttgatctggacgtacaaaaaattatacttgatgaggaaagaacactacgtggtgatacagaggcacaagcagttcgcttaaaatttgatattgaagtgttgaaggaccaactacttttgataagcaagcagcaaaaaaatgtttatagcgagctgggggagacaaagtctgcagttgcagctctcgaatcgcagaacattatattgatccaagaagcagtggagttgaggagaataaaggagaactattttgagcttttaaaaaagcaagagcttgatatcccagcaatgaagtccaaacagtgcgatgagttcaaagataatcctgcagaggacagtgaaattgatacaaagtttaagaagatgcaagcatctcttgaaaaagctaagagattgaacatgctgtacaagagtgatatcgcttctaaggcatgtggagatgaagaaatggatgaagtttgcaagcaagctgaagctgcaactgctgaggtgattgtctgtttgcagaatgagcttgaagttcttcagaaggaggtcaatgatttccagtcaaaagaaaacgtgactgaaaagcaggtagagattttagaaactcagatggaggagctgcaggataaattacgagacacgaccatggataatgagcagttgcaagaacagctcagaggcaaagacatggaattactgatcatatcaaatgaaatggaacttctcacatctgagcttgaagaaattctgctgaatgggaatgaaggccttacagatgcgtgttaccaggctgatcttatttcgggttccttaccagataaaaggatatggatatctgaacaggttggaggattaataagaacactttctgagagggaattaatgattgaagatcttgaaagctgtttggaggatgccaataaaaagcgatgtgatatagaatccatgttgaagtctcttaaaggggcagcaatagtaatgaatgaagcgcaccagagagagttcgaggaaaaggagacagatgttctcctcctgaaatcgcagttgtgcacaaaaacagagacaatattaaggcttcaagagaagctgaag

SEQ ID NO: 9843 - DNA, 3000 bp, Unknown
  misc_feature (1)..( 3000): cDNA_ID_2186069_gDNA_ID_1974087_Annot_ID_180575 3000 nt of promoter + ATG
taaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttttctctctccaccaatctagtttattgtttcatttccacttcaacg

SEQ ID NO: 9844 - DNA, 3000 bp, Unknown
  misc_feature (1)..( 3000): cDNA_ID_2186077_gDNA_ID_1974087_Annot_ID_180577 3000 nt of promoter + ATG
gtttgtggtggtgcttgggttcttagagatgatcatgggaaggtgttattacatagtcgaagagccttcagtaatctctctgtcaagaaggatgccttgttttgctgtgtcaagtgggctattgagagtatgtctagccacagacagtctaaggttttgtttgcttttgagcctggggacttactgtccgcttttgccaggccgaaagcttggccctcttttgcttttcatgtttcagaactaactcattttttggagaagattggagattggaaggtctcggaggaaaaggtcgattctaacaggggagcttctcttattgctcagagtattgttaaaggagataggtttcaatcttatgtagcggttggacatcttcggtggctccatcaactatttgagggtgagagaatctcttccaaggccttgtttctttgctttggtttttgaccattgtcaatcttcagttcttttggggaattgttgtttgcccgactattcctgtaaccttaattggtctttttgtaaagattctgtatcccaaacaatattcatcaatatatcattattcagtgaaaaaaaaaaaactatattcactatgggtttggaagaccaatgtacacctattattagtttaacctatataatagtttaaaatataaaactccacatcaagcttttgattgacgagtgacgcaattttttcgtgtcgacattgtaaaaacagaaaaaaaaaaaatgtgtatggcttattaaatattcatctgaaaaatataaactaatagagtcaagaaccaacgaaaaatatttatagcagctataatacggtggattataaagtaaatcgaattgtattatcaaataaaataaatcgaagcaatgttcatgtgtcttgattaacggtgataaccggccggccatgtggcttgtcttacatgccaaagtcaatgccaaaacaaatgtgcttcgagtaatgccctccttaaacttcccaccttttccatatactatgatatactttttaatgtaattctatatttttctactaataaagtacatatatagattgatttctctttttttttttttggatacactgatttctctcaaatcaaaatttcagttacattgtcttttcagggtgcttgtaaattatgtaactgtaaccatcgcatttttcattcaaaagttctttatttcatgaattcgattttctctaagacaaccttgataagcatcaataagtttacatgcacatgggggcacaaatgatatgcttacaatagatataagtccgtgtaatatttagattgcttatatagttttatccataatgagatgtcttttcctgatttgacgctaccaatatgattattatctactgataatgtactcgtacggcaaatggatgcaatggctgtacaatggtttatatattaaactttaagaagtcagcttgtatctattaacaaaattaaaattgaagtagatagagatatataatatttaatataaaccacaattgttaccaattgccttgtatatatttcgtaaagttttaactgattttatcatttctacggtaagatttcgaccacaaaatacatgtgttctttgatttttcattcgtagttcctctaaaaactagacattgcagatagttaaatataatataaattggtagttatggttatggttggcataaatgtaaaataattaatctttcgaaacgtacgtgtactcattttagaattctgttaacatataaaccttagatttaattcatagaaattgaatttacgtattagccaaaatcacatgcttaagattattgtaagtttgagctgcatcacatttcttacatcaaaatataatatcatcaatactatatatgggtatatgcattgtactcaaatatactacattataccttttaacaaaacaaaaaaaagacatgcaaatacattaataaatgcatggcattatccataaccacgacgttaaaacttattataaaacgctacctaacctcaaattctatcaagtcggcgttttgattgaaactagggaataatatatataaagcatgaaaactagacgtggtatcatgtaaccatgcagtttgtagtacccgaaaggccgaaacaccgatgataagaaacttctaaattatgtaattaactataaagtaatctttcttcttattttttgtgtgcaaattctattagtaatcaaacttatctaatatgtaattaaacttatgtctaatagttaaacattcataatagataatgggatcactgtttcaattcttccattaccccttcgattatggttggtcgtcactgtaaacattttagagtaaaagaatatctgaatattgaatcaattatgaatttgctaaaaaaaattagtgatatttatagattttgccatttatacacagaaattttagtttaatattaatacagtacatcagtcatcgtaaaacggaggcataacactatacaccttcaattaacaaataaccatttactacaattaaagactttttagtggtatttatagattttatgaatctataagatttttgaaatgtaaaggaatttgataagaaagaactaattaccctcaaagtggctaaatacctcccaaacaaattaatttggtttaaagctggaaataatgttttgaagtcaaacaatgattcaatcacggaagcctaccaaaaaaataaaatgatccaatcacggaagacggcagttaacaaacgccgttaaagaaactgatcacaccgtaagactcgagccaaatataattaacggagttaggctgcttcttcacaccttcgttacttgcctatactctctctctatatatatataagcttaaatcttcttcagcttctccaagttaattacatctctttctctctctctcctcttacatttttcttcattatacacaataggagagagagctttgatatatccaacaatg

SEQ ID NO: 9845 - DNA, 3000 bp, Unknown
  misc_feature (1)..( 3000): cDNA_ID_3034093_gDNA_ID_1974087_Annot_ID_180576 3000 nt of promoter + ATG
aaccgagcggacaaaagccggaggccccaccgtcgtcagcagctacgaagagacaaaacaagtcgcaaaggaacataaacaataactctccgtcggcgaatgtggtggtcgcttcaccaacttctcaaactgttaaatgaaaaacagagacaaaaagaaacaatataaatattattatgtaccaaataagaaagagggcaaaaggaaaaaatggcagcgtacccgagtgtgccacttctcgtgcatgcatgggatcttgaagacaaatggagggtcatgattaaagctgtttggtcggggtccgggtttttactccattttttgctttttcttgtcgagtcggttcttttataactctttactctttttaccttcaggatattgtagagatgattaattctggaaatggtgtttgtgttatatttctggagagatgattatatagttcttttgttgttgtaattggttaatattacatatgtggctcatttcttgagtcgagcttacatatcgtttataatgtgaatgttttaagaagagttgaatgatacaatatttttacacaaacattgataatgataataaaaatgataattaatgtacaaaattatttgtaaatatggacatatggacaatttaagaaggaattgagataattaattttgtacattaattatcattatcaatgtacaaaattatttgtaaatatggacatatggacaatttaatgatagtaaaaatgataattaatgataattaatgtacaaaatgataattaatgtacatatggacatatgtacaaaattatccatatcattcacatattcacattgtaaatatttgtaaatagaatgtttacatatggacattttaagaagagttgttccttaccactttgattctatcattttcttgtttatctagttagcttgaaccctttgtattattgagtaacgaaaatctttggaggaaaaaaacaagtgaggtaggattataattttcctcatataagtgtgttgtttgtgatacatcattattctttcttatttttggttaaacccaaaaactggaccgcacctaaggaattgagatattcaaaaaaacaatgatctgacccgtgccaaatatccacaccacacctttctccattcaggccctactagaaagccgtgagacggttgacaacttgaaaacaaaagacttataatgagactatgagaaacaaaaaagaaagtggagttgatgaaataatctgatcttatgaaagtgaagttgattacaaaaggagcagcgtggtagttgaatagtttcagatgttgataaagacgtgacatacatagttgtctcagtaatctaatcaaggactcctcatgtttctaacttcttcttctataaagttgcatgagatttatatctggagaacatatattgctctaattatgtggtcttattatcatcaatatatgcctttttctacatatgaatatatgatcgacatgtatagatattttttgttgttcaaaaaaaaaaaatgtatagatatttttttcattttccaaaaggattgaatttcgaaatggtgtagccaccttagaggtatacaacaataaataattttcccgacttgtaacaaatgtttggaacaaaagtgtcaattagaatcaaagtaaccatcagatgccttttataaatttctttatctatgattattttttaaccaaattcagacacttctatattactaaaagccaaacttgatatctatttcaacaaaaaaatttttttttagtctgctgtgactcagtatatctaattgttttcacatcattcataaacttttactagtccattgtaaaatacagtatattagaaattgttttcctatctatatatgcttaggtttaagaaaacaacttttggccatgaatatttgagtttttaagtggttttggattatagattttgccaaaaggaaaaaatattgatttaaaattacaaaaagaaatctgcaaacaattatcaaaaactcattaaagtgggatttatttttcattttgtttacaaaaatgcgaactctaatcttgattggataattaaatgggtttttggaaaaccaataactatgctataaagtataaactactaccattcaagccttctatttttctatgccaaaaaatactacgcaaaaaaaattgagcgtgtttgatccaacaataaaacaaattactcaatcttgtttgatgtcaaaatccaaatccaaaatatgtttcggacacctgaccggtctactcgattgacacccctgaaatttcgaaatagacaatacacaaaaggacatagacaacataacttcatctcacttagatattcacatttcccatttttcaaaatattggctcttcattttctgtgtacttccaacaaattgtcttctagagaaaccaaaactatctaagatttctccaccttctccatcatccaccgttgattcactcatctcatgtctccaatgactcatctacggtcaagattcaaggagcatgaaacatcccatgaaccaaattacacaaaaacatttaccttgataaaaaaacatcattttattattttggcagaagaaaaagtcttaattcgaactttgagcgtgcttatagtttaatcaattaaagttataaagaaaagtaactttataaattcaggagtaatcagtagatttataccattcttgtccatcgctttaagccacacttgatcggacggtaagcaatcaatccggtttacactttctgattataaagattccaacttttggttatatcggacggttaataatcaatacggtttgagtttaaatcatagccgttgagatgtttgactaaagtgtttacaaagtagtcaacactctctttctgctacaaaggaccagtcttgaaactcaaagtccttacctttcccttctctaacctctctttctctttctctgtctctttgtgagaa

SEQ ID NO: 9846 - DNA, 3000 bp, Unknown
  misc_feature (1)..( 3000): cDNA_ID_2033914_gDNA_ID_1974091_Annot_ID_180587 3000 nt of promoter + ATG
tgattttggagtctttggtggcctctttagccccaggtcttcttcttcttcacccctccaccgaaacaaatggctttctcacaaagtcgggctttctcttctgagctccagcttcgaactaggcgatgatccattcagaagggactacattgtgcttgcccctcaggtcaaggtcaacaatgttaatacagcaactcccaagctttccagtgatccttgtgtcattgtggaggaaccaaggagatcaagctcatcatcccctatggatatcatctccacgtactctcgctccctctctgggcgtgagatggctctctctgaggactatacctgtataatttctcatggaccaaacccaaaaacaacttatatatttggcgattgcatcctggattgtgaccccaaggacttgggaaaagaagatattgagatacacgaagaaggggatgattcttttagcacagaaaaacctcaaaatcacaggttcttctggctccaacttacaaagcagcattgagtggtctttttaaccttgaactaattacatctctgacattttatttccgtgaatgaacaatagggaagtatcagcagaaaaggaaagtgagaacgctggtgctgaagaatcatgttacgaagaggaggatctgtttcctatggcaatgcctcttaacccgtaatgagatggccagagtgaagggggtttattgtgtgggcctctccctctttgagtgtgacatttagtgttgtaaggttaggtgtggggatttttgtgtgctcaataaaaagctttgattcgggtgagttttgctgtggcctgatgccccggctcatcccttttcttcgtcttgttttttttttcttcttactttgtatgattgcgttgttactactgatcctcatttgatggacacacttgtgttttctctctatatcaattgttttagtggctcacgttgctgaataaaaatggatattatcgatagggcatcttttattctattttgggatacaagaatgattgaaacacaatattggaaagaaaagctaagttgcaaaaaaaaaagaaaaaggaaaaaaagtcgaccacagtgggagtcgaacccacgaccttttgatccgaagtcaaacgcgctaatccactgcgctatgcggtcattcttgttacttatatcatgaacaacatggtaagccaaaacttcttctttcctctttcttctttctgttttctggtcgctcgttaccaccaagacctcgtcgaggtttctctctctctgaaaaagtgcttttgctgcgtttccatgctctcggaaggaacttggctgaatcgttggagaattatcgatctggcgtcgttggtgcatctctagctgcgccaattcatcggatccggtttgatttctccctttcgcgaatctagccttccgtgatcttaggtgggttttccgaattgatctgtaattgaggatgtaaatcgaaactagggatttcctagatctcgttagctgtgtatttgattattgcagcagagtttttgtttaggtagagatatagggaattttgatatagggacacttaaattttggtgtatcaatttgctgcagcagccatgttctatggcacagctgtatgggacccttggcttatcgttggccagattatttgcctccaatgctcttactatctcactcttggactcttcaccatggtctttcttggccttcgtgttcctcgccttagtcttgtctacttcttcgattacgctactctcactacttccaccttcaccggttggtctgttattgcctcattcctcttctcttcactcgctgggtattttgctttgccccctagtaatagtatccatccatttatttccctctttattactagtcttttcagattccttgtattcattttaattggcagggctgtgtacatgatatttttggtggagcgagcacggaaatgcttagatttctctgcaactctctacatcatacatctcttcttttgcatcatgtatggaggatggccttcctctatggcgtggtgggttgttaatggaaccggactcgctgttatggctttgctagctgagtacttgtgcattaaacgcgaacagcgagagatccctatggatcgcttccactcaagtaagatgatcattctttcttgaaatctctctgtgtgaacaagcatatctttaccttttactttctcaagactgacttaacatgaaattaaatttggctgcctatgctgctgctgcaggggtttgaagattggtgaaagaacaagtgatgaagattcttgtgggttagcagcgcgactcgtagagcctagtagagcctagtactcttaacaattgtgatgtacagagatgaaatcagaggagtagaatgggcgaaaggaagttcagctagccaagcaacaatgttggacactggtgcaccaactctgactgcaatttttagtgacttcaaatactaagactttggaatacgtttcaatttgttcttttgtatgaaaaaaacattagactcgaataggttattgatttcatgttgcttcttttttttgtttatactggattttctcttctatcctctacttggtgcagctttgtgtgttttaaaaccagtgtctcattcatcatactcttttaccaccaattgaatccttccaatttactgttttttgggggggaaaattactgtgtactaacaagtaaaaagggccgtccgtcaaaatgtaacatctcctatatacggtgcggtcaagttaaaaaaaagagcaaaaacgcgtgataaaacgacgtcgaattagagatcctactagacccagattcagatccaaatcgccaacgcgcactggaagtgggatcaccaccactgcgcttcttcttcttcgtcatctctgatcccccctgcgatcaggggccatttccgtcgataatccgatctccggttcagacattcgtttggacttgcaaagatg

SEQ ID NO: 9847 - DNA, 2258 bp, Unknown
  misc_feature (1)..( 2258): cDNA_ID_2034694_gDNA_ID_1974091_Annot_ID_180619 3000 nt of promoter + ATG
ttcattctttaatttacagccatatcacacatgtatatatggacttttttcatcactttgtcgaagagtatttaaaagaaaaagtgacaggaaaaaaaaaagaaaaagaaggaaaagtacaatactttatcaaaatgtgtatttttttgcaacttatataaaaaaataggatattggcaagaaaaaaaaaaaactcacctagataaactgcacttgatgagtcagcattcatcatccattgcacatcaccatcatcaaaaataccaaattaaaaaaatatatgaaaaagatcaagaatcaaatcaagaacagtcgaaggacaaagtctggtccgaagaaaaaggagtctccgagttcatcggaatccaatctaagaccaaaaagatctaacaaattcttgttagttgttaccaacatatacgtgttaagtgtagacaaaccttgacgtcctttcttggtctgtgtatcgttccagctgttcttatcccacaaatgcgcttcgtatctcccagtccatctatgcctattattattcaacaatcggaacaattaaattacctgataaagaacgatgtcgtttatggtattatgagaggagagagaccttgtgacgcctctgtaaggggagctgcgttgaagaggagcgtttcgaggcggcgacttacgtttgcgtttggatgttaaggcaatggacgcagactcagacgcagacgctgttttatcgctgatttcatcgtcaacgattgttttcttgctcctcccagagacttttgccattaccggtgaatgagaagaataaaagattgagagacaatcctgaaaatggaattatgaaaatgagagacagatagttggaaatggttgagtatatttatattaaatccgtcacatcttttttttcgtttatatatatatatatatatatgttaaaattttagaacaattttttggtttaaatacagattctcagccgaatattttaaattgtactgatcatatgataaagtcactaagattatggcactaattatcttgtatttttttttaatagattttatttccggtgatataaccgtgtctagtccactgtcacgttttcttaattagattcatatatgctaccatttttgcacttttcttagtcagattgattattaaacaccacggttaagaatttctcaaatcagaattaatgaaccattttctaaattgattatgactagcaaaaaagatccatatctgtattattgtttttatctgctcatttttgtcgaagaacctaattagccaaagaaaaaaatggagtgcctcaagttttatcgattcttggttgatctacttcttggtcggcccatgagagatgtgatgccgaactagcaagaaactttgttatattttttcattttttttgtacatatttacctgttctcccaataatttagcacttggtaaacaaatatgacgttttgatcataacagcacacacacacacacacaaacaggagaaattttatcacacaataaatttcataacttccaaaccattatctgttttattaatgtttgtatgaataaaagtcataatttattaaatataatgtgtctactacctgccctcatttttatgcaggtggaaggagttgtcaacaattatggtaaaagtttgccaattagagtccaataagcacccttcaaatcaaatgtatttggtagtgacaggtgaggaatctatgtgattgtgaaatttggccatctgaaatcataagtaagcatttaaataaatactttgtttattttcgcatgaaattattaggtattaacattgattctagaatgacaaagatgaacctatgacaaagtatcaacattaaagaccctcttactaagacagaggctttgcctagtttggaacagacaggacatgagccaaatgaagcccacaagacgtctacagaaacaatgggcccaaataagcctaccgaacgactaaagaactaatgggccacaaaaagcccatctactctaatgttctatatctttagaataagtaatttgaaaagattggaaccaaagtcccattgatcttgagtttgaaattccaagacatttttgtgtgcgtgcgtgatttcgtcatccgtgacgtcttcaaacattggttatttaacaagattctctgatttttgattcgtgtgctttctatatagttgggtaccaattcattagtcagatcgcttgttcgtcaacttctctctctaatg

SEQ ID NO: 9848 - DNA, 3000 bp, Unknown
  misc_feature (1)..( 3000): cDNA_ID_2033897_gDNA_ID_1974091_Annot_ID_180617 3000 nt of promoter + ATG
cagcttatcccaattactcttctttatcccaaattctctttgatttcttgctacttggtcttctccgattagatcttcgaatctgtttctctcctctccgggaaccggtggctacgtcatgtgtctttctcatattccggcaatcctcaagaggaaatctagaatcctccatacatttcttatttccttactagggttttgtgtgtgttggcaggtggaagctgacgaagaacaacatcatatatcattcaccaagtaagtaatgtaaagtaaagtagcagctctatttattttctttcctatgattgagatgaaaaattcgattgttgttgtgtgagacagtggtacgagaaaaagatatctgctgggaatacgcagagaaactagatggtaacaaggttaaatgcaagttttgctctagagttcttaatggcggcattagtagattgaagcatcatctctctcgccttcccagtaaaggggttaatccatgtgccaaggttagggacgatgttactgatagagttcgttccattttatctgccaaggatgatccccccattaccaacaagtacaagcctccaccacctttatctcctccgtttgatgctcctgcgtccaaactagtctttcctagttctcctcctaatgcgcaggacattgcagagaggagtatttctctcttcttctttgagaacaagattgacttcgctgttgcccgctcaccctcttatcaccatatgctcgacgccgttgccaagtgtggtcctggatttgttgctccttctcccaagactgaatggctggacagggttaagtcagatattagcttacaactgaaagacactgaaaaggagtgggtcaccaccggctgtactatcatcgctgaggcatggaccgacaacaaatcacgagcactgattaacttctccgtctcttcaccttccagaatcttttttcacaagtctgtcgacgcctcctcatatttcaagaactcaaaatgccttgctgatctctttgattctgtcatccaagatattggtcaggagcatattgtgcaaatcattatggacaacagcttctgctacactggtatctcaaaccatctcttgcaaaactatgcaaccattttcgtctccccctgtgcatctcagtgtttgaacatcatcttagaagaattctccaaggttgattgggtcaatcaatgtatatcgcaagcgcaggtcatatctaagtttgtctacaacaatagccccgtgctagatttattgagaaagttaacaggcgggcaagatattatccgaagcggtgtcacaaggtctgtctccaattttctatcattacagtcaatgatgaaacaaaaggcaaggctaaaacacatgttcaattgcccagagtataccacaaatactaacaaaccacagagcatttcatgcgtgaatatcctagaggataatgatttctggagagctgtggaagaaagtgtggctatttccgagcctatcctgaaagtgttgagggaagtttctactggaaagcccgctgtaggttctatatacgagttaatgtccaaggccaaggagtcaatacggacatactacatcatggatgagaataagcataaggtcttttctgacatagttgatactaactggtgtgagcatttgcattcacctcttcatgcagcagcagcattcttgaaccccagtattcagtataacccagagataaagttcctcacttccttgaaagaagattttttcaaagtgttggagaaacttcttcctactagcgatctacggcgtgatattacaaatcagatattcactttcactagggcaaagggaatgttcggctgtaacctggccatggaggcgagggattcagtttcaccaggtatggacaataaatacatttatattttctttaagtcatgactagtgaacagagatgtataggtagtctgagtcgggagaaaaataatccacttatctatgaccgcaattaaagctatggtcttattacacaactaaataagtccaggttgatatagcctggcacgtagtaaaccgaattgcaaaactagtagatatcttcccctcaccaggctattaggggtatggtctgggatctttagaattggtaacgaagcactagaagactagaagttgatgtctaataatggtttgcttagtaatgcaggtctctggtgggagcagtttggtgactcagcacctgttttgcagcgggtggccatcagaatactaagccaagtttgcagcggttacaacttggaacgccaatggagcacattccagcagatgcactgggaaaggcgaaacaagattgacagagaaatattgaacaagttggcgtacgtgaatcagaatctaaagttagggaggatgataaccttggagacagacccaattgccctggaggacattgacatgatgtcggagtgggtggaagaggcagagaatcccagtcctgcccagtggcttgaccgttttgggaccgcccttgatggaggcgacttgaacaccaggcagtttggcggtgctattttcagtgccaacgaccataacatcttcggcttgtgaagtcctggtaagaggttttcataagttggtccagcgtgttgagtgtttaaccacacacctcggttcgctatactgtacataatgtttgagtaattatcaatgtagaaaataaatattttgtgttcctcacacagtcacacgtcgatgagcttggtggtacaaagcatgtttcgttcatatttgggattcataaaacggtgagcttaagattgtttttgtttgtattgaagccgtaattatcagaacccatatgatagtagcggttattgggccgctagtgaggcccaaattaaagtaaaaaggaaaaatcagtctgaccggagctatataattaatatatatcaagaagactcgttttagttggtttaggtgattcagatcacaaagtacaccgaga

SEQ ID NO: 9849 - DNA, 3000 bp, Unknown
  misc_feature (1)..( 3000): cDNA_ID_4266219_gDNA_ID_1974091_Annot_ID_180598 3000 nt of promoter + ATG
ttggtgtaaggcgcaggagtcatgaatctgtagtagaaaggtttcatttcaggatcatcctccgggccagtcatacaactcccgcttgtactcatggagtcttcttcgcttgtactcattatggacttgttgctgtcatccatcgagtcttctctgccatggaacgaaaggctgcttctcttttccatggtcttttcgggttcgctgttggtcttctctgtttttggttcttcagtttccgtctgcttatgaatgagagagtctggctcaaatcaaatggaaagatgtatttaaagcagacaaagaagacgactcacatggacatgatgatgatgaggtggtgtgtacaatctctgctctaaagacttggcatcccattttatggagtactctctggcgatttcctgcagcagctccactttcatttcctttgacggcggctctgctttgaatctctctacaaactgcaacattcctccgtggagtcagcgaccaagtggcagagcatataaaaaaatatagtcaacaaagaataaatacctcagggttcacaaactgatcaagtgtgtttccgtatctctcagcaaataaagatctgaggtcgcgtagctcagggacttcagagactctagcggctgcatatacaagggaggagatggcctcgcggcactcatcagggcaccggctgctcaagcaaaacccaatatttatttagatgaatggaatccatgcaagtaaattaaacaagtttagggttagtttttacatggatttctgtaatagagagacattggatgcaacacagttgcagaattgctccaaaaactcataacaagccagcctccttttctcctctataagcccttctgcctgtcacacaaacacatgccatcagaaccatctctctatgtacttactcatgtgacttataacttaaaacaggggccaagaatttcttaagcaacaattcactctgttataaccagctggtgacagcatcagaatgaaatatatctatttctttttttttgcattgcttccatctatacccaaaatagaaccaattaacaaagatttaccgaaaccatcgtacgttgaccctctttcagaaaagaaaaacaaaagaaaaaaaaaatcattctgatggaaatgtaattgctttcacgttcggaaaaccaataagatcccgtgattcattaagtcgatagaggacatgaataacgtgtctataactccaaacaaacaaaaaagacgcaatagaggctgccatatgcatgtaataaatgggggtaaaagaaaatgatattaccctgccatatgcattgtaatcgaggctgttcttgagaagatcgacaatgtcgttcttgagatatttgcaaaccgagtttttcttcctcttcaccgtgtctactcttgtcttcgttatcttgaccaacgacttgctgagaaatataattaaaaacaatcaacgaatgaaaccaggaaaacggaaaataagcagagacttaccatttcgtataaaacttgggtttgaacagcccatcaaacattttgcctttcgaaaaaaaaacagacaaggttgtcttcttcttcttcttcttctttttttttttttttttgttgtttttttttggggggttttgttatctctctctctttcttcgtgcaagagaaagagagagacagagagaagaaatgtggtccttttgagaaagatggcgctttaaggtaagggaagggcttttataaggaagagagaggaggtaatgaaaaagaagagaagcgaccttggcttggctcggtcttacatgagatctgaagaaacggacttgtatcgcaagaaaaccatggaaccctgtctccccgcttttttatccacctctctttctctctctctacgtacatgtacatgtattgatttagagctgtaattactaaaacagggtggagttcccgcacgataagggtgttgactagggtttgtttcggtattcaattcttattttttccgttaaaactctttgttatttcgcaagtgagtcagtgatgatgacgaatcaattcaatcattatgttctctcatatatatggtttacttcaattccatcatctcattcattcattcaaaacatgtgaccattttatttgaaattgttaattgttatatataaccatggatggacacaagtgttggagaaccccaattgggcccataataaaagccaagcccatatgacaaggtatgcctgtacatctttagggggtttatatgtctctgatgagtacaacaaaatctgaatatggttgatgagcttgaattatatattgtcttaattccttcgaaaacataagtaaatcatttggtaacttgacgtctctctactcaacctttttttttgttggcgttcttgtctctttgtatagaaaaagatgttcatatgtttgtgtactctacgttacttcttcttcttcttcatgtgacgatgatggggattacgtgcaccccttcttccttaaacaaaatccattagggagttactttttgttttgatagtgtagttgtagtggagcactgagagttatcaaatgaatgaggatctcttgaataataaagaattggagtgtggaattaggatggatctaatttcattaattaaagaggagcatgattatcattttttgttaatttaatttaataatggttaatgtgaaaaacagaggaaactagaagaagagagttttggcaggagatgtaggtggcgggagtgggttgggcgagagagatgatggtgacggtgcagctccaaatcttctctaatcttttgacacttttctataaaactccccaaactgattctctctgactgcctcataagtcattataatagtttcccccggattgttttttctttctttttgctaatcatcatcggtttcttctaatcaaaaaaaaaaacaaaaaaaaaagagggactacgttcgtacaatcccatccttggt

SEQ ID NO: 9850 - DNA, 3000 bp, Unknown
  misc_feature (1)..( 3000): cDNA_ID_2034682_gDNA_ID_1974091_Annot_ID_180604 3000 nt of promoter + ATG
ccatcttttgttttgcggttggacttggaggtaccaagaatattagcaacgtacgactcgtatggtatcatttcctttgtacaaaaagtgaatatcaaaatgcattgtattaattatatataagttagtatatggagttagttgtcctcactgtctttatctggcgcaatctcctatgccatcattccctcttcacacgtacgtgtgcacactcgatgtcacatttgtataaacacgtttgcttttagcgtgagatcatcaccatattccatttttggtgggtcagttctctttctagatagttatttgtaaggacgtgaattaaaagggatcgtcgtcacttgttgagataaaagaaaagatatatggtcagtttctgcatcttggaatcaacttaagggttgtcttaattaattttgatagaccctactttaaaaattaattagttgctttcattggccctcaataagaaaagccaaaaaagaaagaagactggtcttggaagtttgccaacacgggtaatagattaatggtgaaaagggcgaatttttttacccaaaaccctaattaagtagaagtattaatcgagagcaaaaaagagagagagagtcagtagccaaaaggaatgaatggaagaaagaaaaaggaatctctataggcagcatatattcaagtaattaattaaagtagatagatagagcaaaaggagaggttaggaggcattaattaattatttaagagcatgtggtgaatgtaaatgtttatggttgcttccctctctatacattatgtatctacctttcctaactaacaattccctaggccgtacgacgactaacaaagaaaaaaacaaaagaaactgataaagcttttgaattgtagataaatcatctgctacagttataccattatatatcttattaaagacctaagtttccttcactatacgtcttcgtccatttacgtacgtattatacggacggtttaagctactatatctatattgttaacaatgtaactgttgagatatatcttgcaataatatgtcatggtgtatgcatacgataatatgaatcaatgtttgaaatcttgacgtgcccgtgatacaataagatgatcaaaatttcaaattttgtcaaatattaaaacaacatacacatacacatgtgtccaggtggcattataaaatgtatatatggtggatatagagagagagggagatgcgtatagtgaataggaaagtaagtaataaagagagggtggaggaattggaaaggggttggaggcaaacccataaagagcattcatttccttttaaggtcgctgaaattaatgagtaacgatcggtcaatgcctctcgctgacctttttctttttttacaacaacaaataaaaataaaataaatttcgacgtctctttccgctgctgaattacatttgttgaattaattttctctgcttacgtacgtcttctaaactttctctatccgaattcttttttaactttctaacttatattcaacaactcttctttcctgcctttaccgttagtctaattgttttcctaatactgctacgtacatacccctactatactagtcagtgtattagattcgattgggattaatccaggaatatagatatcccattagtttttataaaaatattggaagaggacaagtctcaagcaatttagggttccatgtagcgctgcaatatactgttagtaactctctcttacccatatattgtatatgctaattcttatcaaatatatatatatgcttctcccagagtcccagtttcctataatcctgacgcaattatactaatagagccaagtttacataataaagtatatatgattaatagatagggtttcttattaagccatatcttaaattaagatgtgatgatagcgttttgtataagttaccaattgtttgaaagaagagatcatcacaataataaatcataagtagtagtatatagtaataaataaatacacaagtcataataagagtaatgagaggataattaaggagggaagaagaaagcagaaaatgcggttggagaattaggtgctaaaagttagttgagtccatctcagtatctaacggtcaactctctctctctctagagaaaacaattaagaaatctgacatacacatatgtctctctctctctctctctctagtctatacacacaattcaattaaagaagagacagagaagttcgtcttttttgtttttatacccttaaatcaatcatgcaattgtaacccttccttcttattctcattccttccccccctgtctacagtaatctatagcaacgccattatgtactacttttaacggataatttgctcatgtttcaatatggcttcattgtatatatgttcaagttcttctcaatcctttatatcattccaacataattcatattaaagttagtagctgaaattggaaggctgatatattttccataattcaaatttgaattttgctcatcatatatatatgtatatattaaaaatcgaatattaagaagaaaaatgaagtcgatcgatggctgccaatgctgtagctggccatgttttaaactactcaattgtcggattgaagtatagccaaaatatataaaaccgtaaaaggactaaatataataatataataggtattaattaattaaaactaattaattataaaagaagcacctaaaagtcaagagcagtagagaaatggaagaaatatctgaaaaacgaccgcttatatatatatgtatcattggaattgaagaggctatatatatatatatatatatatatatcgatcttagcttatatattaattgaaagtacattttggtgtataagtaattaaagaagaaagaaaaaaagagagataatatataaggaagaaggagtgcgaggagaagagggaagagatcataattaagcaaagaagctagctagggacaggatttgtatgtcaatg

SEQ ID NO: 9851 - DNA, 3000 bp, Unknown
  misc_feature (1)..( 3000): cDNA_ID_4255108_gDNA_ID_1974091_Annot_ID_180606 3000 nt of promoter + ATG
cattgaccgatcgttactcattaatttcagcgaccttaaaaggaaatgaatgctctttatgggtttgcctccaacccctttccaattcctccaccctctctttattacttactttcctattcactatacgcatctccctctctctctatatccaccatatatacattttataatgccacctggacacatgtgtatgtgtatgttgttttaatatttgacaaaatttgaaattttgatcatcttattgtatcacgggcacgtcaagatttcaaacattgattcatattatcgtatgcatacaccatgacatattattgcaagatatatctcaacagttacattgttaacaatatagatatagtagcttaaaccgtccgtataatacgtacgtaaatggacgaagacgtatagtgaaggaaacttaggtctttaataagatatataatggtataactgtagcagatgatttatctacaattcaaaagctttatcagtttcttttgtttttttctttgttagtcgtcgtacggcctagggaattgttagttaggaaaggtagatacataatgtatagagagggaagcaaccataaacatttacattcaccacatgctcttaaataattaattaatgcctcctaacctctccttttgctctatctatctactttaattaattacttgaatatatgctgcctatagagattcctttttctttcttccattcattccttttggctactgactctctctctcttttttgctctcgattaatacttctacttaattagggttttgggtaaaaaaattcgcccttttcaccattaatctattacccgtgttggcaaacttccaagaccagtcttctttcttttttggcttttcttattgagggccaatgaaagcaactaattaatttttaaagtagggtctatcaaaattaattaagacaacccttaagttgattccaagatgcagaaactgaccatatatcttttcttttatctcaacaagtgacgacgatcccttttaattcacgtccttacaaataactatctagaaagagaactgacccaccaaaaatggaatatggtgatgatctcacgctaaaagcaaacgtgtttatacaaatgtgacatcgagtgtgcacacgtacgtgtgaagagggaatgatggcataggagattgcgccagataaagacagtgaggacaactaactccatatactaacttatatataattaatacaatgcattttgatattcactttttgtacaaaggaaatgataccatacgagtcgtacgttgctaatattcttggtacctccaagtccaaccgcaaaacaaaagatggatagttagttggagaggatcagctgatgaaaaccaaaagacacagttgtgagagagctactagctagtgagtaccacatatatacgtatattgggatatatatataccttgaatcttacacattttgcttacatctaaaatagaaaatgaaccagtaattagtttttgtttggatccataaatatcacatatattacttaattatttcatataatttatcactcaaattacatttctgtataccagttgtagtattttaatgaataactctactagtaaattgtaacattcaaacagaaataaaaatgaaaaatgtaaatgtaaagatataatcgtgatctgaaataggatggtttacaatacgtaagagaatacgaatgtacatcatgagtatcaaaacaaatcaagattcataccaaaaggaagagaaaaaacatatcaacatatgcataggttagcgtcttagcgagcgtgcggaaccgagggtgccttggtttgctggccccaaaatgggtgggcttttaggggcccaatattgttacttacagaggctaaaatggatcctactgttttccctttacaaaaacggagacaggccttgtatataaaaaattcagaccaaagccgcttagaatgaagtaaatgatatcaagacagaacgtttttctaatccgcgaaacgacgccgtttgtaccgccggtggccgagggaaaaaaaaggatttggattttgttggatctaaaaaaacataaaacacataggggtgggtctctctcctccggaattcgatcacgacggcaaggacgacgcatctccttctcgtaagccattgatgatcccaatagatagctctattctgctttatccaatcgcctcgtcttaataattgattcagtgatgtaattgggatctaaactcgattggttgattgttttccttggaagccacagggctggagatggatctggtccggtgatttctgagatttaagtcgatcgagtttccagatatatctctcaagtagagatggcttggttcagtggcaaagtttctctgggaggattcccagatctcactggcgctgtcaataaattccaggagagcgttaaaaacattgaaaagaatttcgacaacgcccttggcttcgacgacaagtccgattctgccgctgaaggtgttctcttcttctcactttttttccaatcaatacacataatattatcatccttcccaataatctgctgttagtcagctgggaatataggatttgattactcaaggcgcatttgttgataggacctgccatttttcttcttcttctttatgtaggatgtttagatcaataatctgctgttgcaataatacaatcttgcaagttatgggattctgtcttatttttcttagaactagcttagctagtgtgcttcagattctacccattgcattttattctgaatttgaaaaaaacactttgttttggatctttgcgtttacttggtgacagctttttctggctatgatttcaggggtattctgtgtttacctaactgtagcacaaatcattttcttctctagtttgtcttgagtttcttgtacctttcacaacaaaaatccttttgttctttctttttagatgcagcttcaagt

SEQ ID NO: 9852 - DNA, 3000 bp, Unknown
  misc_feature (1)..( 3000): cDNA_ID_3034190_gDNA_ID_1974091_Annot_ID_180616 3000 nt of promoter + ATG
ctcttccttctcccgtttgctgccatatccaatcttctttttttcacctagagcgtctgcgctaagctttggtatttataagcggtgctgtctgtgttgacatattcatgtgtattgtgtggttcagcattgccatctcacgtacgtgctcacgctatagcgacctagctctttacttactctttgttttacttttcacaacaatactaattaatgaagccactaattcacgtgctacattgcaactggatcctagcctttaatacaactcttctaaattggtatatctctctctgtattgagttcatgcatatatggggatatatacaaacaaaaacattatttattttttgtctgccgtcactaatcgatctcaactaaacttttgtcatttttttaatgaactgtaaacttggtgttcatttcgttctcattaatgtagtttccttagagattgcaaaaattagatacattttgtagcatgaaatctgaattatagaaggaaatcagataagcaagtgtgcaaatatacaaaaatgtgctattcgagctaaaagtgaagatacaaacaattacgtaccaaaagcaagccctcaagaattgtgtggaggtaagtaaaaggaactatatggatcgcagagacaacgatatataggtcacgtgtgtgggagttttgtctaaccacacatataagagaggaacaacatggactcgaggaagaccactcgtaatgaagttaaaagttgaaacttgtaaatattatcaatcccaacaaaaagaagaagaagaaaaaatatatattggttgttttaaactcacttttgcgataacttggaaagtgggaggacgctcacgtgcatgcatacatttcttgtctattatatgtagctgattcaacataactctatatatcttgttgtctatattgcattatagttacacttacattacatacgtagtgtgaaaacgatgcatagcattactatacatcaaatctgtgcatatatatacacgttacgtttcttgcagtgaaatactcgaaggtggatatgtgctcttgcaccacctaattaatctcgggttatgtaagaattacttcagagttcagagtatatatctatgtgattcttgcgcagtgtcaagtggattgggcatgagattgataaccgaatgggtgaggggtcaaatatcgttatttggatatagcgggattttaaactgaatgattgggccatgcattgcttgggaaaaaggctaaaattaaacaagattgagatacacattacccacttgtattttagtttccaaagaaaaaaaggaaaaaaggagcaacaaggcaacaagtatgtaatgatcaaggaagtaaaaaagggaagaggagtgtgagaaagagagcaaagaggagctgttggaagagggaaatggtcttcttcttcgtccttttggtaatttttctgcttgtgttgtggagagtggtagtactagtgtagagaaaggatatggaaatcagattgtgatgaagatctgatttgtaaagaaggggcctccccacaacgcccttgaatcttccgctccagccttgatctccgattgtgacgatcaccgcatcgggacgtggggagaaggagacccaacctcttttggagtagacgtggaactctgcatggcagaagttgagacatagagaatgtctttcgtcatagcctcttagcagcatccttatggcttcttcctttgattcgtttttaatattatgcctcttcacgtagcaaacccctaccccttccttttggcttcttcctcctgctcctagcttttctctcaccgccttccctatcctctctgcctcacccatcaactccctgcatcttcaaatcattacttactactttattttaaacaatatatattcctaatcaattactatatatagtaaattttgctgccttacctcaaatctgaataacaagccgtgtgatcatcagcattaatatctttattaaacacgaactcctccgtctcatcgtggaaaatggttttgtccatggcggctttcaccatagcctctggaacaccgtggttaacgagctgaaaacaaccgatggtggcgatggcatcaagcagagccgagagggagtccaaccggtggaaatcgaaggtgggagggttgagaaggaatgtgtgcttggggaagactttatcgggcaatacaagatttgggactcgaccacacttgtccaggaactccgagaggacgtcttcgttggccgtgaaggaggcacggcggctggatgctaccggggacggaggaggggctcggaagtcgggagaggaaactcccatttttgtttggggtcttactcgtgataatacttgtatatatgtagagcaaggatcgatcattggccaaagaaaaagtttttgttaaataaagcgagagcataatgatgagatgcaattctcttgtttgcttttattcattgcaacttttccttttccaaaaaccagagaggatgacactattcatcatattatggatggacccaagttgggccttaagcggccttttgtttacccaattgacgtggatcctcacaggatgggcatcgagtgtgacacaagtccaagttggaagagtccttttctgtcacataaataaaaaaataaatgtcaagtagagagggcaagtggtgaatctctctcataccaattccaaaccaactaaatctacttagtaccagtacattgatggtagttgcattttcgcttgaaattgtctgtccttttgctagtttgagtcacaattttcaattgaaaagaaataagagagagaggtcagagtcaacgaaaagttataatttagattttgtgggctaaaattgacaaaagcgtaccaatacagggaccggtgagcaatggcaaattggtaaataaagggagaagccaaggagtggagacgcaatttgggaagagatagaaaaggaagaagacacgtcaaca

SEQ ID NO: 9853 - DNA, 3000 bp, Unknown
  misc_feature (1)..( 3000): cDNA_ID_3034202_gDNA_ID_1974091_Annot_ID_180608 3000 nt of promoter + ATG
ccagctttcatgtctcagagcagaacagggccagttaagcaagtcacttgagaaagagaggcagagagcagcagaaaatagacaggagtatctggcagctaaggaggaagcagataccctagaaggtcgagcaaaccaacttgaagttgagataagggaacttcggagaaaacataagcaagagttgcaggaagtgctactccacaacgagcttattcaaaaggttctacattgctttatggacataacttaatctaataagagttagtcccatgaaaaatgccccatcagttacggaatttaaaggactgaagtacctagcgaattcaatcaaagtagtgctttcccaaactttttcatcctgagtagcttctattaacaaccgaactgttccagtttattactcttctttattgtccaagtagtttctcaatatggcctatttttttcaggacctagagagggagaaggcttcacgtttggatcttgaaagaacggcccgtatcaattcctcggcagtctctgaacagcttcctatagcaaggcaaaattctgcctttgagaatggtgatgcatctagatctatactactgcttaataagtcaggcattgcacatctgtaattcattaactattgcatcaggaagcttgcctagaaagctatcaagcgcaagcagccttggaagcatggaggagagctattttctgcaagcttctcttgattcttcagataaattttctgagaagcgaagcatgcctgaggcaactatgagtccgtactacatgaagagcatcacaccgagtgcttatgaagccacacttcgacagaaagagggtgaacttgcttcatacatgacccgcttggtaggtgtagaaaatatccaactgggacatttttgtgtaactctgttggtaggcttttggcaattggcttagtaatgggattgaggttgacatcagtccttacaatgggacactatgggtgtttggatcatgttgagaaattattggttagttgcacaccgtggttagccttcttttataagctggtttagaaggtttagctctactcgtcgaggtagtataggctggttgttagtatcatcgttatctgtagaatctaactgtaagagtctatttgcctttggacaggcatcaatggagtctatccgagattccctggctgaagaactagtcaaaatgacagcagaggtatgtatagcgctgagagtttagagttgatattatgctcagtgttatgatgatatttcgtctatatctggtaactgtggatgtagtgtgagaagctacggggggaggcagatagggtcccgggcataaaggcagagctggaagcactaaggcaaagacacgcggctgctctggaattgatgggtgaacgagatgaggaggtaagatatgtgaataaaatagtagtgtatccagcattaacaacagtagttggcattgagttaataaaaaagtgggtttgggtggtagttggaggaacttcgagcggatatagtggacttgaaggagatgtacagggagcaagtgaacatgctggtgaacaaggtaaggcaaacagacacaagtggagtcaaagtgttgacaaactcaggctaatgggtttgtgcaattttgggtttgcagatccaatgaggggcaagggaagatggtgttggcaagctcaggctcacgagtaggaccacctaatccttgtttccccaatattgtatagctctataagctaccaacctaagcccactatattcatttgtcgttttgtctctcaggtgttggttgaacttgaggctttttaaaacaaacttttgctgctcgaaagaagatttttcttacagtgaattcgatcgtaaattattattttggagacgagaataaacttttgtctgtgtgacttatctacgtatgtaacatgtattgtctgtgtagtagaaaaacggtggagagacccattaataatgggattcgttgatgtagcaatccatccatataggaaaactgtgtgactcgaatggacccgaatgagatatcaaaatcacagaaatgatagataaagaaaataaagaacaaaaaggcctccggccctcttgtaaatgttaataaaagcccaaaggcccaaaatagctctgcaatggcttctcctgtaatgaatagttgtaggctggtttcagcatcaatcaatagtcataaagcaggggagggatcctttcatcaaaagtcttgtactcttgtacatacagcattactgaattcatatataaatgtcattatttcattggtactagagtatagtttgctgagttccatgaaaagaacggtagaggcgagagcaggtgattaaaacccatcccctgtgaacggagtgagtgtaggtgtagccataaagttgtcgtcgctcctctgtaaaagtttcttctattcgacgattcctctcgacgttatcatatttcctctccaggttggtactatcatcatccttgttctctttgtttgcatccctccttccttccttgcttccttgtagatctgccattgccttttttaatccaaatcttatatttctgatttacattgcttccgtcagatccgacgatctcactttctcatcatctgtcgtcagcttttttgtttcttcttttatctctttttatttttaaaataaatatattgttgattctggaattttcctagtagctcacgtcacgttacgtcatgtgtgtgctttgaattttaaattgactcgcaaggctggttttgattatgtgtaagtgatcgctggacttcacacacactaacaagtagcacttgaatgaagctttcctttaatggattgattatttaataaattgcgactttgacgtctttgagcatccatccatgttgaagaatcccattattcgtatgcttttcttctatggccttgcatcagtcagcactcaacttgtttgaatgtgcaggagcgtgtttccagagggg

SEQ ID NO: 9854 - DNA, 3000 bp, Unknown
  misc_feature (1)..( 3000): cDNA_ID_2034666_gDNA_ID_1974091_Annot_ID_180595 3000 nt of promoter + ATG
tggaagaggaagaagttgaagttccggtcacaaaagaacattcagaggaaactactaagatggactctgacaaagcttctgctgaggcagctcctgcttctggagactgtgatgtaaacatgcaggacgccaaagacaccagtgatgcaactggtactgacaatggtgttccagagtctgctgagaagccggtgcaaatggaaactgattcaaaggctagtttctctcttaactgatactgcttgctattcgcttgtgaacatcaaataattatggatacttattaatggattgtgcaggctgaggctccaaagaagaaggtgaagaaaacaaatgtaccactgtctgaattggtctatggtgccttgaaaactgtggaggtcgaaaaggcagtggagaaggaatttgagatggctttgcaagacagagttatggaagagaccaaggaccggaagaatgctgttgagtcttatgtttatgatatgcggaacaaagtgagaatctttatttcgtcttttcattggcagtatgcatatgtaaagttgtgagtattgggtactaacgtgtcttgttttcagctgagtgacaaataccaggaatatatcactgactcggagagggaagcattcctggcgaatctgcaggaagttgaggattggttgtatgaagatggggaagatgagaccaaaggtgtttatgttgcgaagctcgaggagctcaagaaggtaatgcatgcatatgatgacactttatattgtgcaggaagaaatcatatttcaggataatgttttaacagaggagtgggattaatattttgcaggtgggtgaccctgttgaagtgcgttacaaggagtcattggaaagagggtcggtcattgatcagcttggttactgtattaacagctacagagaggcagctatgtctactgatcccaagtttgatcacattgaattggcagagaagcaaaaggtaataatttggctcaatcttggaagcacaaaaaaaatcttaaatttctcaggcttggggaaattgtttgatgttttgttgttgtgaaatgattaaggttttgaacgagtgtgtggaagcagaagcatggctgcggggaaagcagcagcagcaggacacacttcccaagtatgccacaccggctctcttgtcagctgacgttaaaagcaaggcagaggcattggacaagtaagcaaggctccttgtgtctttgtcttttaaaagaaatgctaaatctgataatagagagtgaaccagctatggatgttttacaggttttgcaggcctataatgaccaaaccaaagccggtggctaaagcagaggcaccacaagccaagggaggtgagcaggcggatgagggcaagagtgagccagagcaaccagcttctgccgaaccaatggagactgagaatcccgcggaaggtagtacctaaatgaatgacgagagagagatggtgttgtatcgattttgttcttaactctttttgatttacctagtggaacctctttttctggtttcgctattattcccggaaaaaatctatattgttaattcttccttttcgaaaacaatttttaggaagcatcttttttcttattgttccttgtggttttgtttttaatttgaaagtcattttttctgctcctctatataactattatggagtgtacacggattcgttctatgttggactgggctgtttttataaacagcaaatgaaatgcaatttggttctatatatattggagctttaaaaggcaactttgaaccccctaagcttaacatcttttctcttatatcttacgtgaaatcagtgtgacaaaactcgtcttcctcacttctcttccttaccattgttgtacaaagaacatcttccttgatgaagcagtcgtagcctttggcaacatctttgaggtcatccaggctgaagttgtatcgtttctccaatccaaacggggttaaacaaggatgaattcatttcctcgttatgagcacagaatgagtgcgactgctacgatatgtgattaagctgcctgcaccagtgaggacaatgaaaatctctaacataaatccatgaatcatctctgggcgccgcagataatggcatgttccagacaccacaatgcaattagttcgtgcatatcttatgtaccacaaattctgataacaccagccacttctctataataattttattaattttaaatacattgggtttaaataattatatgtagactcgaataaaaatatacaaaaacactgggataaaaaaaaaaaacctaagaaaaaaaaaggcaataaataaataatttaggcaaaaatatcacaaaaataaaaaggaaatgaaagtgtttttaaaataaaaaaaaaaaaggaaaggagaagaacattccagaggaacccaaaccctgtggtggtgtctgctccttaattaaaacctcttctctcttgctcttcctttataaaagaagctcttctcccttcctcttcactttttggctgcgacacgattacagatttctcaccttcacccagatttcggtggaagcttccagaacgcgaacccctctcgcgatccaggtatgctctagttgcagatcttctagatctgatgcttctctttttcctcacttttaggttttatttatttcttgttgccagattacttgttcctcgtacttgtgtttcaatatgaatcttctgctttcgctgcttccggatttgtattttagtttcaaactccaccaatcttcgttgtatgtattgttgatgtaaacccaaactggtggttttattttaggtttagtaatacgatggtttaaggctacctggcctgagttaccgccaattcgtcatctcctgtaatctctcgagctcaagactagtctgcttcgatcgctatctgatagtgtttttcttttttttgttctataaggttgctatcgaacacgtgggacgccccagtactgaagaacacaaagcctaaca

SEQ ID NO: 9855 - DNA, 3000 bp, Unknown
  misc_feature (1)..( 3000): cDNA_ID_2034662_gDNA_ID_1974091_Annot_ID_180594 3000 nt of promoter + ATG
gataaaaatgggaaacaatgcgctattctcttctgacgccgccatctttggagcctttaaactgagagattctattctgctgaaaggaaaagctctgttataatctcacaacatccaaaaagcttcaaggatacaaaattatcaataacatgaaaagctggatctgaggccactgaaattaattagggattctacatgacggagatcaacactaatagatctcggctaatctagtctaaaggtatatgaatccctggactcactttgagatcgacacaaaaccttagaaaacaaacaaacgaaactacgggaaggaagcaaaaccaataattggtgaaagaagatgaaatcgaacttgaaaggatattgtagaagaggaaatcgaagaagaagctcacctaggatgatagctctctataatcagagagatcgcgctgctgcagatcggcaacaaacggcgttgcagtttttttttctttatgcttctcttctcttctaatttctgatttctgattggtgagttctttcttctttacttgcttattcacttttctttaccttctcaattaaaatatttcgcaattcatttctctctttacatttttacgagttatttattttccattaaattagagtaattattaatagcaaagtttttatggtgaacgaaaacgaatttcccaaaaaaaatcacattttttataaattagaaaggaaaaagagaaaaggatatggatcaaagagggattatatgctctagagatttaatgtgatccagatattgtaatagggattgcaacaaatctcttatatgttctagagatttaatgtgatctagagattgtaaatagttacaacaaaatagagatttaaacaaaacaaatatttaatgattttaagaaaactgttttgttgtaactatttatatttcgaccagaaataaattgttctacttgcaaaatacatcaatcttcgttattattatcgatttaatcataaactgtctaattcaattaaatttataagagcatggttaccaatacttttttatctactgtaacgaaagctaataatgattttgaatgagtttggtatgatttggttattcgattcactaaaatagtcgttttaaatctagccaaatatcgtataattttacttgttttgattatattaaataatcagttatttgaaaactttgttgacatgttaatattatatataactaaaacaaaatatagatattaaaaacaaagaaaatgttattatatagctattatcgtttttcataccatttaaattttattactggctttcatattatgatattgttgtacatagacaccactgctaaaatgcttattaacttgagattttgcttgtgagatttggaggctaatttttttctcggttaagcatttctcgcatcatatgccttccacatagtttgagcttttgttcaccaaatgttcttaccactctcaagaaactggcagcacacgaatatgctttccacatggtttgagcttttctcttggacaaaaactcgttcaccaaatgttcctaccactctcaagaaactggcagcacacgcatatgccttccacatagtttgagcttctctcttggacaaaaactcgttcaccaaatgttccttccactctcaaaaaaatggcagcacacggtggagtttaccacatttgaaaacaagtaaataatgtcttacataattcacagtcactgctttcttcgatcattttcaagaattttgaccgtgaaatttgcaataccatatcttcaagaagacatctaaaaggttttcgcaatctggtgattaggttaatgctcttttgtaatacatttctttcattttatatatgatattaacatttataacaaaagaaaacaatcatagcatattgcatgtcattgcaagtttgctatatacagtagttttaaaccgagtaaacttaagatcaggtaggaaagatgcaaataaagaagcaagtgataccaaaaatatatgtaaacatttaatatagttcttcaatctaattgacgattagaaagtactgtactagatgattacgatccaagatttttgtccacactaagaatatttcacaaaataaggtttgcaacagtaggattgaaatgccagtaaacagtgacattatctcgaaaaaatccaactcagaaatcatttactagctaataatatttttcaaatagtttagaattattattgttgtttatcattaacgcatacaaagttagttgtataatctttcaacttataaataatttggttttggacggaagagctttacgcaaatgtattaatttggttttgataatttttatttgtagactcgatttgtttacgtaaattatgaaagagaggcaaaaataaatatcataagatatagtattagaagaaaaggacataaaagtagtaattaaaaaaaaaaaggaaaagaaagtgtgaaaagaaaaaaggaaaagtagagaggaacgcaaccctgggggcttcttaataaacccctctcgctctcttgtctcttccttacgacaacctctcctgctcttcgttttctctctacgacgataaaacccagatttgggttcaagcttccataactttaaacccctctcgcgatccaggtatgtttcccaatctttattcccagatcttccagatctgaagctcctcttctattttttcgtagatttgatttttaggtttgatctatttgtatgaatggctcgcgtgttctcccgtattggtgattgtaatctaaaatgttgatttgatttaggttcagtaataagactagttatctgacctgtgttaacaccaattagtcttctcctagtctgctttcattgatattccatccttgttcatctgatacttattttttttgcttttattgatctgagaaggttgctatcaaatacttgggagcccccagtattattgaataacacagcctgaca

SEQ ID NO: 9856 - DNA, 3000 bp, Unknown
  misc_feature (1)..( 3000): cDNA_ID_1024639_gDNA_ID_1974092_Annot_ID_180635 3000 nt of promoter + ATG
atatataaaccaaaaaaaacaatttaaattgaaatccaaacaaatctagatgtccgtataaaatcacgtttaaaaattctaaaagttatcatcaggtgtgacacatgtataatcaattgtattatccagaacaatgagttgatgtcaatgactcgatgctatgagcttatgagtagatcatacaatgtggacacgacaacctaaatttaacaaaggatataaaattgtgaactgtttttctgccaaggatttaaaattcatttagcgttgtaatttggtacacacatatacatattaataaaatctacggcatattattaacgaggtaatcaacatttagggtataaatggttgcaaacacgatcaatcatacaattaggttaaccggtttgtgacacaatgggcgactcaggataagacatggaggaggagctgatatgataagacgaagttaggtgatatatatagagatgtaccagagatcataatgcatatgaaatgagatcgatagctgtcttctcttaaactgaattacgacctctctatacttctggtcctatccgtgagtcatgtgctctctgtctttagtcataatatgattttgaattggctctgcaccattcaagatcatggcccattatggttctctgcacctgattctgtttccataataattccatttacctacaaggctatacatataatttattagtataataaccatattatgagaagattaattatactgttcatacggcaattaagatatcgatgcgaaaggattcgtgatctttatagagtttatattccgccgttgctagctaatcatgtttattttgtttctctagtacttaacgcgtttgtcaatttattaaattcgattagctaaaaaaaggatttgactcaatttcatctttagagacttacaaaccaatttatacaaatcaattttttatagatgttacattttttcgttcacattaatgacaggttttcttctttctatgacttaaatccacctaactccaaaattaaatccccaattcatgttaaagaagtgaatttcaacgcttcgaaaagttaataaaagacaatgaagaacatacatgaaacatgcttagcgcctagcggacgagcctcttaattagaaccaagtccttagaaaattacaaaattttaggtatatgccaaaaatcaaactaaagttgtcgataaccatgataaatgttgcgtatatctatctaagaaatatcacgcctaaaagataaattttggtacaactctcctcaacgttcatttttttaatactctgaaataccacaactatattccatatagatgaggtttgaggtttctaagacttttaaaacttaaagtcctagaattaaagaaacgtgtaacctttcaagtttaatatgggggaggtttggatcggcggaagctaaaaacagcaaggatcaggacaacaatggcctaacgaatgacacgtgatgctcttttcatgttgctcaacttcgatagcgaccgtttttctatttttatcactttcatattttacccccaagaaaaacaaaaacaagcgagtccgatatgtttaagagtcccaacctaaaatctattttcatcaccttccctatatagcccgcacaccgcacacaactaatacctcaaaatattaatttgtttgtgtttgcgcttgtttttatgttcttaacatcagggtaaaatgtatcttatgtgattagttttagtgggatactctacatagcattcacatgtctattagtttaaatacgtgtatgtcaatctaatgatacaattcagttcgcatgacttgcaaaacataaacgtaaaaagcaacacatatgaaccacttaccacaattttcgctacaactttttccaccatattagcaaaaaaaacaagggcgaataacattcatttggtataatccataacgatcaaattatcgattatcatcactacatttagctagagattttctagcctttctatttgccaaaccttttaatccattcttccttttaaaaaaaaaattatttatttcttttcaatttttatgaaaaccgtatctttaactaattgttatccttgctaatacatgcatcaacattttcttaaagtttttggtaaaattaacacataagaaataagaaatagttttcttctttaaactcgtccttatcacaaattttagattgtatgatattaaattcgatcttatcttaaatactttaaataacgttttatttactcttctcatattacaaatttactacactgttgcttttctatgttttacaattatatttaggagatcttttgttgtattatcaatactcttagatattcatttatgtagttaaaatttattaagattacttagattttattgagctttgaaatatattttaaaaaaaaacttttaattacacgttggtaaaaaaaaaagacacgtatgcaaaagcaccaaaaaaggtaaaaccggaaaaattctcaaatttcaaaattacccaaaaaagcctttaacctaaccaccttactttataaacaacctcaccgtctctcttagctcaccaacaatcacattcttctcccataagaaaaaaaaaataatcaaatcctcctcctctgcttcaccaccaaaaagcatattcttctctcgtcttctccggttaatcaaaatctctccgtgtgaatcgtttgtgaatggtggaaactaatccgatcggtggtaagtttacgctctccctttccatcaaaagggcgagcttttctcttcctctctcgacatcctctgttttcgctttcggatcttgcaaagaaggctggtactttcgctgccttggcctcgacccgtgaacgattcgcccctaaaattcacaacccggaaccctaatttcctaaaaagtggttctttttttattgattctgttacttgtgagatttgctctgttttttgttctctcgatttcgaag

SEQ ID NO: 9857 - DNA, 3000 bp, Unknown
  misc_feature (1)..( 3000): cDNA_ID_3034312_gDNA_ID_1974092_Annot_ID_180639 3000 nt of promoter + ATG
ctctcaattcaccatcatttctctcaccatttttactcattataaaaaataaaaaataaaatctcccataccattaccatttttctaacatgttattattatttagaaaactaataataacatactctaacaatcaaattctttctcaaaaataaaatgttattcctcaatttcaaattaagtgttaccactacttttttcatggaagtgactagcgagttattcttagttttcacatttttagaatcccaagtgagtttcgaaataattttcttcttttccgggattttggagagccattggtgtggaaagttaatcacatgttaaaggcttaacctaaaagcttagactgcaaaccccaccaccattttttttaatttttaaagtctctatattgattcggccgacgaatgttaatcattgaggtcgcttctcctttcttgttttcaatgataaaattaaaatcaaataagtacatagtataataaacatggtaatagaataataatacttcaatttttttgaattaatcgatttccatttactatatatttgcttaggagcgtttctcacgatcacctgtttaattctaaatcaacaaacgatcaagaaatgatgtgaaagttcaactgattgcatgcacctaccaatatttataccttagaaatcttaaaactacgatgaatatgtaaactccaaatcaaacaaaaattcggaaagattctatactataattaagtagtaaattattaggcaaaacagtgaggtgggagtgacctgtcattaaactttgtatgagccacggccaacaccacatggcccttttcattcacagaaattattttgttgctaaaacaaataatcgaaatcacaagtttccaatatctctctatggtatagtgatcgaatatttgatatggttaataccttcaataatattaattaattttctgacatagtataagtttaagtgggatatactggcccctttgaatattaattacttacatgtttaacatacatttggtgatgattatctcttcgcaaacacgcaaattataagttgacaaggccacgaggttcaaaaaacgacatatattgtaatgtgtcttcgaaaaagtcaatatttgtatgtccctatgatgtcaatgtgaaccattcggctaacgaagagaataataatattataacattcatacacaatgttgaaatgtcccgtcaatattttataaaaatggacacggtctaattaattaaaatgaattcggttttgatgtgaaatataaaaatgaagtggcacataatgttagactggtccattaactcttaaaaattttttaatcacaatttctttatttatttgctcatttcgaatatcgattaccttgtctacactacacacgttacatatgtaattgtttatgaatgatgcatagttagttgcatactttcaaaattggataccgccaacttttttatcaaccatgttttttagtagaagtgtttttaaacctcttttatttttaactgtggtctcctttattttggttgtaagctgtaacaaggtcttgtcctctctttatggttctccttacgggcctagttaaacttggtcaaaataatgaaagaagtaaagtggtgttcttaaataaaaggaaactaaaggaaattttgttacccaccttcttattaatcgattttcaattcattgtacgacagcataatgaatatgaatttttggggatttaaatgaaatatccttcacgaattggccaatttactttaaaaacccttagttaaattattaatagaaaaaccttttaaatataaaagttttaattataaaaaaagttagatattagtccatctatttaaaaactcctaactaaattactaatgagaaactctcgaatacaaaattctagtgaaaaaactctttcatataacttcatttaaatatattttgtttttaaacctcactaacattgatttaaaccgttattttacaccgttttaagtttctttccgctgaaaaatactatggtttccggttcaaaatgtgtgggcccttttacgcgcatgtgggtcagatgtatgggcccattctatttttttcctccaaagttaaaggcagagtggcggggtcatttaaaccacgtggcaagttttttttttttatcaactactgtttcttttgctgaaaaagctaaacaacataaataaaattcaacagtatgattgcgtcacgagcaatgcttaatcataaatcactcgcttgacgacaaaaaataaaatcattaatcagtagctttccgctacactaatccactctcctcttataaatttcaaaggattcatagtttttatgttaagtattgataattttttattttttaatatgttaaaactaatacataaaaaatatataactctgttaaatataatttgataaaatatgttattacttactatttatgaaaatacagacataaataataatctatatagactataacctaaaataggaaggtgtgttggcaaaaaacctaaatggaaggttaaaatctcaaaaaaaaaaaactgtaatcagataaaatcgaatccaaaacattgaataaaaatattaataactcggtcaaccagtataaacaataatctttttactagtacttaatttcttattttatataaactaaaacttaatatcaaacaactattgtttccattatatatacctacccgtaacctttaaataatttagtacatacataaatgtgttattatcctaacctttttttttctctgactcttagcttcatttccattttcatatatataatgttgtcaaattcaaattaaaataaaataaaaaagtgtcactaatggtcggtccgatttctccggctaacttacttaagctgacaagtctttctcctccttcctaacttcgtcccccacacaaatctctctatctctctcaagctttctttatcgtcgtct

SEQ ID NO: 9858 - DNA, 3000 bp, Unknown
  misc_feature (1)..( 3000): cDNA_ID_3034304_gDNA_ID_1974092_Annot_ID_180641 3000 nt of promoter + ATG
aaatccctaaatctctctctgttgttaccttcccatgggatggtcactaagaactctcataagagcaatctgggcatgacaaagtccatgaatttctttcagaacatcattaaacctttcaaacgcagctccaatcgaggtaagatccgtttgatttgttgattcttagtgtaagattaggtttttgtgaaatttgactaactttttcttcgttgacttaaaggtcttgaagatgatattgagcgaattgctgctatggagcaaaaagttttcccatttcaagttttagtttccgctaccaaagattttcacccgacccataaactcggtgaaggtggtttcggtcccgtcttcaaggtaaccctaattttgacatacccagagcttaaagtttccatttttagggttgtggttgtataattgtgtgtgtgtgttttcgtgggttttgttagtttggctgatgaggttgattggtgtgtaatagggaagattacctgacgggagagacatagcagtgaagaagctatctcaggtttcaaggcaaggcaaaaacgagtttgtgaacgaggctaagttgttggctaaagttcagcatcgcaatgttgttaatctttggggttattgtacacatggagatgataagctcttggtttatgagtatgtcgttaatgagagcctcgacaaggtcctcttcagtaagtttttcttctcaatgagattggtttgtatattaggataaatgatattgaaagaagatggttttaacatgtagtggttgcttcatttgaatgcagaatccaacagaaaatcggagatagattggaagcagaggtttgagatcataacaggcattgctcgaggactgctctatctacatgaagacgcgccaaactgcatcatccacagggatattaaggctggcaatattttgctggatgaaaaatgggttcctaagattgcagattttgggatggctagactctatcaggaagatgtaacacatgtcaacactcgtgttgcaggaaccaagtatgctctctctattgtttacccttaaaaagctcatttacatatcttcttgtgtcatttgaactctttttgtttgttggtgtttcatggtagaatgttatttaacgtccattgcttcttcttttcttatgcgcagtggttatatggcgccagagtacgtaatgcacggggttctatcggtaaaggcagacgtattcagctttggggttttggttctggagctcgtaagtggacagaagaactcgagttttagcatgagacaccctgaccagactcttcttgaatgggtaaagcctctagtctcatgctccattgtttatagggttgttgtgtgatggcctgacccagccaatattcttcagcgtaatataaccaatgctaaattctttctgaatgtgacacaggcatttaagttgtacaagaaaggccggaccatggagatactagaccaagatatagcagcttcagctgatccagatcaagtcaaactctgtgtacagatcggactactctgcgttcaaggcgatccgcatcaaagaccgagcatgagacgggtatctctacttctctctagaaaaccaggacatctagaagaaccggatcatcctggtgtcccgggatctagataccgtcggcgaacacaacgtccttcaggagcagcatcacttggaacattgtcgaccactggttccagcacagattctttcggttcaaacctgaacacaaacacgggaactggtgttagaggtacccccgcatcttctaaagcttcaactcggagtaatgccactagaagtgctggtcagagctctagctcagaccctcacgggaaacgacatatgagttattgaagtacataaaatctggtcataggtgattgtaaatagcgagctgcatatataatatttgtttcataatttatttaattttgcttttgaaaagtaaattaatttatttttttgactgcagtagtgatttagttttgtagtatgatttgttatattagcgggaaaaaattatgattcatttgttacatttgtatattagaataatcacttgtagtcccattatctaggtccccactattggcctcgtacgtataaaagcatattctcttgtacgtattaacggtaccttactttaaacaaaacataaaactaaaatgttttttatgcgttttaaattatttttcagttaaaatttataaaaagggtttttgtaaacaattattttgatagtaaaagaaatactaactgaaattagtggagaaaatacacaaacatatatttaactttctttaatttaaaatatacagattttgtttctttaattttttttttcaaattttagttttcatttatttttaaataaagtatgacatgtcataatgttgtattttgatttgtcattaaaaagggggtgaatcaaattggttcactctagaggtgaacttcgccaaagaatcacagaccgtcagtgttaatcatcagagacatcaacgtaatgttcctcttggttacttcttgctttaatgttcctcttggttacttcttgctttctacctgattcaggttcttcagttaaagtttctcttttcatttttggggtaatgcccggttgggcctcgttgttttatttaggttctagttctagggcctgcgtgtccttttaggcagttattgccatgtatgttctttgggccattcgtgcctctgtcggcttgttgggccttgtaatcgtttcggctctattggaaattaaaaataaaatatatatactaacccgttttgggtaaaaagttaggtccactaaaagacgaaaagagatcctaccaaaaaaaaaaacgaaaagagacgagccacacgcgtcaccttctcgtttagcctcttcatctcctttcctcagactcactgtgtaaaaaggcttttattttatcatcttcaggcttattcgattttcttcagatttgaa

SEQ ID NO: 9859 - DNA, 3000 bp, Unknown
  misc_feature (1)..( 3000): cDNA_ID_3034293_gDNA_ID_1974092_Annot_ID_180644 3000 nt of promoter + ATG
aaaaaccaaaagcatgcaacatggaaccacatataagagtacccttctttacgtcaattatctttaaagcaagtcttcgctcttcaatttatattttaccaaatcatcttctctctttctctatctctcaaaacaaaaagtaaccatgatcaagacaaagacgacgtcccttctctgtttccttctcacagccgttatactaatgaacccatcttcctcctcccccactgacaattacatatacgccgtttgttctccggctaaattctcccctagctccggctacgagacaaatcttaactccctcctctcttccttcgtcacctcaaccgcccaaacccgctacgccaacttcacagttcccaccgggaaaccggaaccaaccgttaccgtatacggtatttaccagtgccgcggcgacctagacccaaccgcctgctcgacgtgcgtatcaagcgccgtcgcacaggtcggagccttatgttcaaactcgtactccgggttcttgcagatggaaaattgtctgatccgttacgacaacaaatcgttccttggggttcaagacaaaacgttgatcctcaacaaatgtggacagccgatggaattcaacgaccaggatgcgttgaccaaagctagtgacgtcatcggttctttaggtaccggagatggatcttacaggacaggtggcaacgggaatgttcagggtgtggctcagtgctccggtgatctaagtacatcacagtgccaagattgcttgtctgatgcaatcggacggctcaaatctgattgtggaatggctcagggaggatatgtttacttgtcgaaatgttacgcgcgtttcagtgttggtggtagtcacgcgcgtcagaccccaggcccaaactttggtcatggtcagtcttcctctaaacttattttaactaaactagataaaaaaataaaaagtcgtaatcactaaaaaaaaaacctttttacgtaacctcagatgaaaatttaaatattagactgatcttaacaattagtctaatggtttatatatttgtgtacgacgctaaatttttaaacccataaaattgatagtgttgaccataaataaaaatatgaacattatacttgatggagaaaacaaatttattaaaaactttagaggtggatggatagttttaaaattatatatatatatatttggcagaaggagagaagggcaataaggatgataatggagtgggaaaaacattggcgataataataggaatcgtcaccttaatcatcttgctcgttgtgtttctcgcttttgttggaaagtgttgtagaaaattacaaggtatttttgatattgatttacgtttttttttcagttcttttatcgatcataaaatctaaattactatgtatatgccttttgcagatgagaaatggtgtaaatgaaaggacaaagtgggaaagatatcaatcaacaactcgagtcgagccacactgttagttgtatttttgtaattttttttgttctccctcataagatgtacgtagttatagtatattgataatttgatatagtattgatatgattgtatctccgaatcgatttttgtataattgtcggacttatataggccaaagcgatatcttcttctttgatgtgaatgaaaccttcgatttcttatcttctataaatgccatgtttttcgtctatgcaaaaaataacagtaattaaaagggtttgagcttcttttatcaatacacaaacaagttaaaataaatgaacgtgtcgagaataatggaacatattaaaccgtaaatcaggatggagatccaaaaaatgataactgtgttcgtcctattgcgaatgtctgaacgaatcttttcatcgtattcatcattatttattctcatattgtctaaagaactcaattgaagacttggcctaatgtcctttaatcattaaaaatgataatttaaaattgtaagctgactaccaaatcgttttaggactttgaaagaccaactaacgtctaattcttttccatattttttttaattttctgaaattcttaatgtactaccgatgattgcttcataaccaggttcttcttttaatttgtacatgagtaacatgactaataaatgacttgcgtctgtttgaaacattatatgaataagaaaaattggtctcaaataacaacatgatgtatcaaagattcaaaaatttcacgtgttatgaaatgagcttagcaaaagttcactcaagttcttggaggtctagtttggaatgcaatttagccaaatctgtacagttatactgaacagatttaatgtaagtcgggccgtaaacaaaattatgggccttagataagcaaatcaaacttctttcagcccattgagcattctcgtgatttggttattgtatatccaatacgtgacattacttttgcctcaacgaaagagtcttggcttatcatttcatttattattatagttgaaataattttcaaagaaaagaaaaaaatatgtgataaataccaaaccgttgcataagaaaagcaaccacacattttacatgtgtgtgtgagttcacgaagaaaatatccaatagccaaactaattaatccacctttgaaaaaaaacatgcactattataaactagagccaccgacggtcgacggatgtctaattgtatatggtcctcagaaatgaaaaaatcaaaagaataaacacgtgtgaattaaccggtttaaccagtagcaccaaccgtttgtaccggtcagaaaaaagccccacatgctttaatcaagcaagcctttaaaaacaggaaaggcaaagagttaaataagcctctccaaaagtgtgtctgtaacattaccaaaacgaaaccttccttgtggattcccacttctttcttctgttttcttcttcctcttctttaaattggatgttttgggcaagaaacagagagaaacacgttaatttgagagtttgtcattgaatatttggtttgcaatg

SEQ ID NO: 9860 - DNA, 3000 bp, Unknown
  misc_feature (1)..( 3000): cDNA_ID_2992216_gDNA_ID_1974092_Annot_ID_180646 3000 nt of promoter + ATG
aataccgtaagtcggcaatgcgaaacgatcaaaattatgcaatttttaactaatagaaacacatgaaaaattacaagttgtatattaaattactgatacgttaaaattaaattttaggagtaacgaataatgagaattcttattttattttttattttattaaaacgaggaaagtatcagccaaagcaaacgtggtgggtgaatgataagtataaaagatgtctaaagcttcccactcattttcttgtcttcgtatagaatcaaaaaaaaagtaacgacgatgcaaatatactatatattacataggcttcaccagatcatctcgaatcttaatcacattattaatacaattacatagaaggagcaattaaatctctatatataaaaggaagcgtgtgtttcgccttctcttttcaccattttcagttactttctctctttcatcttttaccattctcttcttcttttttttctctcattctgatcatggcttcctctatttccactggtacgtttttctaacattcatatttgtgattagtaattaattaccattaaatcgatcctaaaacgtttgtgtgtggttgtaggagtgaaatttgttccagaagaagataatttcttgcagagacatgtcgcttttttcgataggaacaaagatggtatcgtttatccctcggagacatttcaaggtacggtcttaaaaatgtcctaaacaaatctcgtgatatctaaaacctagatttgtattaagagaatatagatctttcattcttgtgtcttctctatgtgtgtgtgtgtgtgtgtgtggatgttatggtcttatcaagatcttttgatatgtttactaatttttattgtcgaattttaaaaaaattaaacaggatttagagcaattgggtgtggatatttgttgtcagcagtcgcttctgtgttcataaacataggtctcagcagcaaaactcgtccggtaattaatctgaaattatgttggtacagttaaaaacttaaaatttagtttcgtacgttacaaaagaaaaaaggaatcaaagatgtgtttggttacagggtaaaggattctctatctggtttcctatagaggttaagaatattcaccttgccaaacacggaagcgattcaggcgtttacgacaaagatggacggtatggtttttttacatctttagaggtaattaattagtgaatttgggaaatctaaataatttttttgtttttgttaggtttgttgcttcgaagtttgaggagatatttacgaagcatgcacacacacatcgcgatgctttgaccaacgaggaactcaaacaactcctaaaggcaaacaaagaacctaatgatcgtaaaggatggtaagtactaaaccggtttgattttgttcggtttaatttgctctatatacaacgcataaccggaaacgtgatatgaattatatatatgtgaattataaatgcaggcttgcagggtatacggagtggaaggtattgcattatttgtgtaaagacaagaatggtttgttgcacaaagacacagtgagagctgcctacgatggttctcttttcgaaaaactcgagaaacaaagatcttctaaaacttctaagaaacatccataaatccttatttaaatataatcaagctctcctgcatgcttgtggatctgtttatttttaaaactattacttcaatgttatagtgaatatttatggtgtgaagattgtaatgagttttaacaacaataaaaaaaacatgtaatgtgtttaatttatgttattgtttttcgtgtatttgatcaattacatacttgattctatttccaatcaaagaagtataattaaaattgaaggcaaaacttatctcaatttccaaccattttttttttacaacatcattgattcttttcttacaacacatttaaaaattgtaagccaagcgccggattagtaaaatgttttttgggtcaacagataaaaacttccaaagttataaaggaatatacatattgatgacattgatgtgacatgtatatatgatatatccaaaccagattgagaactagaaactataaattataaatgttaaaatgtagagatatccgacaaagaaaaatgtcgagataccaaattagagttttgttttttttggtgcacctaattagagttttgtatgtacttaaaaaggagaagaaaaaaaaaattaaggaccttatgtttttttccgaacttgcggaattatttattatagttgacctgggtccctataaaatttaaaggtacacaaacatgagtgacaaaaaatcaaaccaataacctttggttatacgtatacgtaggttgcgaatcgatttcaacaatgagatcatgggatgtctcgatttgttggatggaagaggattataagaagataagattaaacttatatagttatatataatttaaatgctataagatttaggttccaaaatccaaatgatgaccacgatccactaattaaattgagcgaatatggtatacaaaacaagtaaaaactcttaaattattttttttcctgactgaatttcattattctcttttaaaaatcacgtataagccatgtatttaaaatctatctccaacatagttgcattatcgccattcaccaatatttgaactcctttgccgataaggaatgtatatcactaattttgtacaaacaaggactaatcaggcccaatatgttcatatctagattcagtaaccttctcagtcttgcacgatatgtacacttttgtttttgtttattacacgatatgtttacttagataatgacttattataatatacagaacaactgtatataaatatatcgaccgcacgagatcgaatcgagtatttatcacattaattattatcatacaataacagcgtttcaccattctcttttcaatattttcagttactttctataagaaccattcacttattcttttttctctctatctgtgattatg

SEQ ID NO: 9861 - DNA, 3000 bp, Unknown
  misc_feature (1)..( 3000): cDNA_ID_3034283_gDNA_ID_1974092_Annot_ID_180648 3000 nt of promoter + ATG
tcgcaaaaacagtacaaatgggataaatcacttgtttatacattcttctttttcacttgtttatacattactcaaatttagattagatatatgatgttcaaaatcaaaaaaaaaaattaaccattaatcaagtaataaaataaacatggattatcattatacaaacatcaaatgttatttcccgattgattcctcttatatatcggattatctatgtggcatcatgtaataatatctcctcaattatcaaaacaaatatcaagatgtttaagatattgcaatgtgaaaaaaaaaattgatattgcaatgcaaatgttcatggtcgttgtgggcttttcaagggaccggttgcacaagacgagaggcctacgtcaatagaaaatatcaaatattttgtttgacaggagaaagaaatatagcaaaatatattatttgttttcccatttatgtttttttgtgtaaaagaaaaatacgaaaaaatatctagaattttactgaactacgataattatatcattttaaccatataagagaagaagaatctatattatagtacttttatcaaacaaacataatcttatttgttgtattacatgtgtgcatttatttaccatcacattattgtgttcaagaacatattgcttacctattaagtaaaatcaagcttgtctgcatatttgcctataaagtaaaatcaaaaatcgccgatggtcgagcgagaccggttaacataaatagtgtcgtatgggtccttcaaactccactcattttataacacgcgtcaaaatagtcctatgattttctttttgttttttgttttcatatgagagaatattccaaaaagaaaaaaattacgtcggcaaaatcttatttttcattggagcttttttgtaattaaattacacgacacacaaaaaaaacagagaataaataattttatacatatctacgctttacacactcctttgcattcttggaaaagcctctctctctatatatatcgattgaacattagttaattggctttaagaaaaacaaactatacaacaaccttctccaactccgaccttttcaactaagcataaaaaaacgatatggtcccaaatacaacaaccgtcaagttcctttgtagctacggtggcagaatcaccccacgttatcccgacggcaagctccgttatcaaggcggcgatacacgtgtcctctccgtcactcgcgccatatccttcaccggttagttagttaatcagttttttttttttttatcaccctacgaattctagggttagtgtagccgtctagtagcacactcaccggttatctgtttgataatattaacagagctaaagaagaagctcggtgagatttgcgggattgcggtgactagtctccgatgtcagttaccaacagatgatcttgacgcgcttgtaacggtaagatccgacgaggatctaaagaatcttatggaggaatacgatctcgctataacagcgcaagttaagattcacgtctttctttctccgcttaaatcaacgagaacaacagcaaactcgtctcctccaccttcaacgacgtcatcttcttcgtcaaaatcacgctctcgttctcctccatcgccttcaactccggaaacatgtcctagttgcgtagagagatctatacgtaacaatggatgttacgttcatagaagtccaagtcataaccaattatacttcatcaacaattgaaacaatctctctaaacattgtaacaatatagaagtcttgaattctcggaattatatttaataacgtgaggatcagtttcatatatattagcccaaaaaagtgagtccaatagatgtaaaagatcatcatgatgttgatgatgatgctagatttttttattttttttttccttttgtgattggtgaaagagtgtccttgggaatttttagtgttaccagtacacaatttctttcttttatgaaaatccaatgaatatgagccacgtggaaactcaataaagatattttttttcctctcttcttgaactgtacgtttcagatattttttttgttataaaccaagaaccaatttggtttagtatggtttaagatttacgtaaccggtttaaaactaactaaaaagcgcaattgaaattctgtttttaaccgggttttagtctttcagtctttcttcttcctctatacctctccgttttccgatgatggtgttgattctaatccttcttgtgcttatggttgttttgttttgtttctaccattttcttataaaatttcgccgctttcggagttgaaatccggtgaaagctttgcggaagaattcttatcggcgctcttctttgaaactagctcctcaaagtcttgtgctcttctacggcggcgggtggtctcttcgggaaacggcggtcctttgtcggcgatttcatgtggtcctcaatttcacacgtggcagtttctttcaccttctacgtgttactagtactacacgtgggttcccgagttgtttatgtataattgtataccataaccatgtaatgggattgttgataataataacatcgtttgtagattgggcctaagtggactcttatatgggccatgtaacaaacccacccaacaatatcgaagctgtaatagataaaatggacagaaagttcttttcatttccaataggaagtcaaaacgattgaccttctgttttcccaatacgagtttaacaagttctttggtttccaataaaaaatggctattacattttcttgtaatgaagttgcatataaataagtctcatgccttctaagaaattcttgcacttatcgactatggttatttcatagagagcaacaaaatcagtgtgtatttgttaagacaaatgtttatataagtcgtccatgcgttgtacatttaatcttaactaatacgcattgagtttcgttgctttctcgggaaaaatctctttgtaactaaacttttatgtacctactaaaaatctcatg

SEQ ID NO: 9862 - DNA, 3000 bp, Unknown
  misc_feature (1)..( 3000): cDNA_ID_3034263_gDNA_ID_1974092_Annot_ID_180656 3000 nt of promoter + ATG
ttcgataattagcactagagtcgacaattttgaagtcaacctaattaaatactagtagctttcctcttcattcaattataggtaaggctaaataatcatatcgaacctttccacgtgaatatcacgagtcacgacccttcaaaaagacatactccttaaacagttaaaactcgtaattgtttgaaacaaatagtagatgcattttagtgttatatgcacacttttccaaatttgttttattcgcggtatcgatgtaataatggttttgttattaaaatagtaatctcgtcaataaagcaatgataaaatcatgagtatgactatttatgttaacagttaactcccattaatgaaatgaatttagaagaaatgaaaaacattgacatctcttttttgtcaaccattgtccattgacaaagcctttaaatatagttttactttcatagagataaagatattttgcatcacttaagagtttagacgcaatttctaaaattgtcaaataggtttatagttccttcagatgatcagaaatatcatattctatattgtgtatttacataactttattggtaacttttcaatatgttttgtcagtgcctcattgtactaaagttttaatatattaagacattatattgtgttcgatttatagatacgcattaattgttttgtagagagcaaaaacacaaccataagatgatttgttttgagaaaatataaaatggtgtatatatcaaaagattatcattggatgcatagtcatcattgagcgggactctttgactctttgtgcgtatatatcaatacttggtccccggaactagtatgattaattgattatggatcaacgacttgaatcgtccttacgtaaaacaatatttagttcagtttagacggatacataattggatagagcgactctcacgtccacccacttttgtttcttggaaagagtcgatcaaatttcatagttgttaatatgatttcgatggactaatatcctccatatcgagggtatgaatagagatagtgttcaaataggtccatctaggaaaatgatatgtgatgatgaagtgctatggggatggagaattaattgtttaaattgaatggcttgtgacttcatcatttcctccaatctcctacgctttccaacttggtggtctcagtactctttttattaatttaaaagaaattccactacgttgttaaatgttagtgttgatggtttttcatggaaaaatatcccaactgccgatgaattgatttatattcaaatgacacgccatcaaaacaattgtatctaataaataaagataagtcattgtaactaaacaaattttgtccacaacagtatcaattatgttagataaacaacattcaacgtttaagattttacaatggatcattcacatttcactatgcattgaggatgcgtgataggacgcatcaaactcaaaacttggtttacaagaagccaagaagtaaaaaagttgtttgaactcttaagcatttactaccctcggattttcttcattgatgttcattcaatgtataggaaagaataaaccaacgaatataaagaaagaatcctacaagatttactctcgcccactgacaataaatgaagctgattttgaaaatgaaattccgggaaaagaatcaattttgaaacagaaaatgatatttttccaaaacgttacttaaattaagtaacttaatatatattaaatagatttggtatattagttatttcaaagtataccacagctcaccggtgaatttaccggagcagaaaatgttaattcaacatttggtggttacatcactagaagagttctcgaaggttaaaagcactacacatagtatacaaacctcttcactttcttgctaaaagacattttggataaaggtttttgaccacgtcaaagatgttacataatattgaatttatacttcatctgtttcatataaaataaaattaacaaaaactaaaaaaaccaattcatatcatacagagttttaaattaataatgcacaaaaaaaacattagttggtttcttaatagttaatataataaatgattagaattttaaaaaataaattaaataatatcactttctaaaactacaattttttggttcgttttcagtaatagccaaaaatataagttgacaaattcttaggaagcattttaaaatatcggtcatcaactcttcagttaaaatttaaaatgcaggaaaagaaaactctagaatcaatcatatatatttggtgttttctaactctttggtagtttggaatttattaaacatgttcatgttttaatctatttagagatttacgaaagcgacaaataagaatttttccgcatttggtagcgagaaaaatgttgcatagtatgcgacaaaaaatgtaaaaacaaataggatctttaaaagatgagaatgtcggacaaaaagtgcgaacatcagattcaaattatcagattcaaaacaaaatacgtaaaacctgatatttattgagttattctgttgtaatttttctttttagttttgtaaaaaaatgtttttgaaataagaaaatatgtgatttaataaaatcacttgtttaaaataaaaccgagggtacattttaactcatggcaattttgttaattatgtggtaattcattaccatcttgttattctttgttaaataggtattatatattgcgtggcaactattgctatttatttgctattttgtttattattgagtaattcttttcagaaaaatgtttacataattgaccttaaaaagcaaagatttttaattttaatatatttttctccatttaaaaagcagataccagtcttttttttagggaaaaaaatatattttactaataaaatattttagtaaaatatcgctttccttctataaatacacttcgacctacactattctctaatcattaaacactatacaaacgaccaaaccaagaagaagaagatg

SEQ ID NO: 9863 - DNA, 3000 bp, Unknown
  misc_feature (1)..( 3000): cDNA_ID_3034275_gDNA_ID_1974092_Annot_ID_180651 3000 nt of promoter + ATG
tttgtggagcctttttctgagcaatttgattgcttctatctgcagttcaaccttcaaatcccaaggaagcgatgaaatggttgaaacaatctgcagagaatggttatgttcgagcacagtatcagttagctctttgtttacaccatggtcgggtcgtgcaaaccaatctgcttgaagctgtatgtgccttcttctgattcttttcttcatgcttctagttgagattctatattgttttcatgaggtgaagctgttatctagattgaaagtagtatctagtcgtttatactaatggctgcactcttggtggaaactgataatcctatgtatagacatgtgcttagttcgtttgtggaaactgatactgctatgtttggatgggttattggttcatttgtggaagctgataatgctatgtttggacatgtgcttagttcatttgtggaaatgtgcggtttctgtttttcatctttctagaatcagtaaagtttgtatcgatatgatgattggattttttttctctttttcgacagactaaatggtacctaaaggcagcagaaggtgggtatgtacgagcgatgtataacatttcgctttgttattcggttggagaaggcttaccacaaaaccgcaagctagcaagaaaatggatgaaacgagcagctgatcacggccacagtaaagctcagtttgaacacggccttgctctattttctgtaagcacctcaactcaactactgcttctgagagtctacttctcttagtagtaatagggataacttatcgacttatgtatatccagaaacaaacatattacgcaatgagttcattcgattttaggttatgagaaggtttggatatgtaagtaatgaatgtaatgggttgatgcaggaaggggagatgctgaagtcagtgctttacttagaacttgccgaacgtggtggcgaagcagctgctactcccgtcaaagaagttgtacaccaacagctttctgcaacttttggtggtcaggccgtacaccatgccatacaccaagccaataactggcgtcctctaccagttactcgatgactcctatcatttatttcagtgaggtctagtgattggctagttacatgtccataacttaaattccaatttgacaatgtatcaatgacaaaaccttatttcagatttctacttttagttcgtactcatgttttaatccaaatggtgcgactgataaatttgtatccacacaataccaccaaaattgtaaatccgcgtttgcagtaggataataaatattacagattgtttcgattttggttttcttttgtgggtttgaaatgttccatggtgtagtgtacaagtaatgatgatttgaaaacacaaactttatatgaataacatgtaaaccaagcttatcccaaacatatgcgatatgataaatatcatacggtatatcatttctcatagcacgacactgagcgtaccatttgaaaaattcaacgatttcttcagatcttgcttgaaaataaagtttgaatctcaaaactccgttcaaaatagaagaatatcaaaaacacgatggatacagtataatatccaaacacattattttttcgtccaaatctatgtgactatgttgactccgttcaaatctatgtgacaatctgtactattgggaaatttgaaatgcatttccgcatatttacgtaaatacattactaagcaaaatcacattctagctgtttcaacgttacatataactaatcaaatgcaacaacaccttctcactttgatgacaatcgaacatccaattaaaaattcaacaagaacaatgcatatgtatggtagaaacaatcacaacgagttaaaaggatcgtaacgaatgaatcatgacagacaattaaaccagcatacgcaattataagtctgaattcggaataccaaacatttatcaaaatccaacaaaaggttcataaaactactaactttaaagagatctcgctctttccaaaatccaaaagacaacaaaagatgataaaactccatagaagattcaaaaacagagttaagcaaataaattcacctaacttaagcagtaagcacaacagcaccaccagcttccttaatcttcttctcagcagtcttcgaaataagcttcgccttcacaacgaacggcttgttctcaggcaaatgacctttacccaaaaccttgaagaaaccatgttgagtcacatcgatcaacggaacattgtccttggttgatttcgccttcacatcttcagggacgagtgaccaaagcttgtcgaggttaacgattgggcagaagaacttgttcctcagcttgtggaaatacctcataccaactttaccgaagtaacctggatggtacttgtcgaagaggatcctgtggtgatgcatacctccagcgttaccacgacctccgggatgcttacggtgcttaccgatacgtccatgtccggcgctgacgtgacctctcttcttcctgttcttcttgaatctggttgtcattttcgccgatctgctacactctcctccctccctttctctctttgcggctagggtttcttaagatatcactgagtttataaagacgataaggatttttacgtttcctattttaccctctagggtttacgacattttgggctatttagttataacgcgagatgggcctttaggcccgattatatcgtagagggggaagagagatcatctaccacaaccacatgattgaaccttcacgcgcctttctgacgcgccggtgttgttgttgttaccatgtggttcatgccttcggtggtggatctccgtgggttccacctcggtttattttggttgacacgattcttccttacgtgacgtctttcttcttcaatttcgaaacgacgcgttttaattcttcttctgcatttcatatgaaccaaggaaaaagcttgaagcgtcgtgactcgtgaagcttcttcatctttagtccaccgaacataaatg

SEQ ID NO: 9864 - DNA, 1668 bp, Unknown
  misc_feature (1)..( 1668): cDNA_ID_3034260_gDNA_ID_1974092_Annot_ID_180657 3000 nt of promoter + ATG
ttcacaattcagataaagatggggaaaaactttatatcctttactactttgggttaaaaaacttaaagcgagttggatctaactgtattatccaaaataaacgagaattgtcttcttgaggttaattagctattatataacgtcatgttgtgccattgtgccaaactcagtcataattttatttttctctcaatcataagttctctctggtcaactctgcttcggtattgagtataattaatcaaaagccaaatagaaaacagtatggtacaagactcaaatctcaaaagagacaaaaatctatatgcatgccatagtgatttttgaaagaaatggaagagaaaaaaaaatgagaggggaaaagctagaggagagcgatgacccattaagattaaatggactaacaaacgaaacgatcatcaatgtgtaagtgtccctacgaggaccgcacccacttaattccccaaattcaatacctattgaccctcttttcttataatgacccacttataattattatcgtatattgttgtatattgtcgttacaagattgtgaaatgttttatattttctatacacgacgaataacctggtcaagctatatatcgagattcaagtaagtatatataatcgcatgcttggttaaatcagtcctccatttcgagagacaatatgattatactttaaaaaatagagactctcgaatgtcgacaatcaaatgtcacaactcgtactatgctattgtaatgtttttcaatcaataaacttggtttgttttccacaattttatatatagttttattaaatttatatcaccggttggtgttgagcctaacaaataatatgcattattaatagtctactactactagtttgtgatatattctttttccagcttggagagaagattaagcatattttggtctctgattaaagagattacgtaccgtaacctcaagacttctataattaaaagaaaaaaatcaccatatttgtttgttagaaactccaagagattccataacaaaaacatttcattattctacaagcaacattgtgaacatggaccataaatttaacttgtacagtactctacataaacggtaaaaaacaataaagcgcttggaaaaagagagtaacaccagaaagcaaagagctttgaagaaacccaaattcaaaggtactcaatttcatctgactagctctgaccccatttcttcaaaccaaagaatgatcacaccaaatccaaaatttcccctataaattacctatctcacataaatataaagtttacttctcttacctctctttcctctttttatcatttacttcataaactttctagatatctgcaaagcccttaatttgaattcatcactaacccacatgcccaaaactttagcaacacacaaccctaataaatttttgttggagggttcgatgagttaattcattctttattgtttttgatcttctgtgttttcccttaagaaagtgattatgtgtttaataggtttgttgggagatgtgtcagtgacatcaagaagacgaacaacaattcaaaaccgtattaaatgttgtctttttgatcactcaagaagaaaacaacaagacagcagatgttttcatcattcttcacaacaagtttcgttcaagtctgatccgatg

SEQ ID NO: 9865 - DNA, 3000 bp, Unknown
  misc_feature (1)..( 3000): cDNA_ID_4266701_gDNA_ID_1974092_Annot_ID_180647 3000 nt of promoter + ATG
ctctgagcaaagagccacatatcatagtttttctaaccaaaactgaatgtatcatcaggtaatgaggaaggcaggacagacccaaagggactagtggtgaaatgttgcgtgatgtgaaaagaggtaatgaggaatttataagaatttaagagacaaaacaatgtatataaacagcatttgaagggctttgagattggcctaagaaccctttcttctataggccttcttaatcctaccatttgattatgtattatgtaatatttgagaatatattcaccaaaaacaggtgcccttaataaacctccactcttcttcactttttttggtcttttacttttgtgtgagtgtatgcggcctactttggaggacatagagattgaaggtcgtatcaaaagaagtgccttttgcatataattgataaagcaaaagttgcaggtaattactttttcatttgggaagaatgatgaaagatgttcgttatagtcacgtagttgtagacacattctactcttcggatcttgagaaccaaactttaagcagtgtggttagagaatatgcgaacaatttgaagtgtttagagatcgattagacagacatacagaacacgtagaacatgcagttgaaacggcagtggcaaatccgactgatagatttgacaaatagcaatactaaacaaggcaacaaatccgacttatagatatgaatatatgatactcgagtcgatgcatgcgattgttaagtagcggaatgattagatatatgtaactaaattctacaaaatagcgatgctaagtcgaacacctctttaacttaaccagttttactaaccatcaagtcatcaactataatggttggtaattcaaatcctatactatatatatgttaatgttgaattatattgtcaattagaagatttgtgattccttttttacagaataatagtgtaatgattaaaaactaggaatttttcatgagcgtttggattagaatctgaaagggaatgtttgtggtaatttgcagaagcaaactacctataccaagtgtgaatgtgtagaggaatttgtagtgttatcaatattccatcatgagcatttggacaagacaagagataaagcataaggaatctattacactcagctttacgcaatggcctttttgttacttcacatttccaatgcgtgtgaatattgataccgtgtcttaacgttctaaccatcttataacatttcccatttagattatagtttgcattcaaatcaagtctctgttgtaatcacttttagaaaatcacattaattaaaatgcattttgtaaaaaaaatactacgtaattgtttggtaatctaggtgtaattgatggacatgaaagtcgttcacatatacacactttactataaaaagaaaagttgaaacttgaaagaaattagatatgttgtgtactacttttatgtcactaacaagaaaatagaagattatcacgattagaaaagaaaaaaaaaacatcttgcaattttagtccaaaattttgttacttccaaagtttttctttgataatatatgtgaaaattttaaatttttatctttcatgcacaatgctacattgaaatacctaataataataatgaccaccagatttttttctttacgacaatggttacattttttggatcctaactatttagaaatgttttattacatttacatattttaaaagctattttcattggattagcactaagttggtaaaactaaaaaccaaaatttttagtttaaagatttgtattagtgtcgtacatgtgtcacaccctgattcaaatttgatataatgaatattattggaaaaagaaaatcaactagcagaactaaatctatttaaattatcacaactttgaaattacaattcatatactatagataaaagacaaaccaccacactttctataacttaaaaaatgggtctaccgtctactacacgactcaatctaaatggtaaaaatagagcacaccaaacgtgtttagtttgctaggcgataccatttgacaccaatattatcgtcaaaactgttaaactatggataagactaacaagtaagggtaagttttgtagccgcagcctttgcttgtcagcattcagacgccgagctgattcatccacattgatcaagaacccaagatttttagtgcataggctttaaaatagatatagaaagcgactataaacaatacgaaaacacatgtggcatatacacccactaatacccatatctttcttttcttttcttaaatggatttcattttaatttctctttcaaaaagcactttattgagccatgaatttaatatacattacttcattaatctcctttgccgagaggtaatgtatatcactattattttgtataaaacccgttcattaattctcaatatattcatatttaaagttttaaactaattaaccttctcaggcttatacgatatatgtactaagtcttaggtaacgacttattaattaaataccgtaagtcggcaatgcgaaacgatcaaaattatgcaatttttaactaatagaaacacatgaaaaattacaagttgtatattaaattactgatacgttaaaattaaattttaggagtaacgaataatgagaattcttattttattttttattttattaaaacgaggaaagtatcagccaaagcaaacgtggtgggtgaatgataagtataaaagatgtctaaagcttcccactcattttcttgtcttcgtatagaatcaaaaaaaaagtaacgacgatgcaaatatactatatattacataggcttcaccagatcatctcgaatcttaatcacattattaatacaattacatagaaggagcaattaaatctctatatataaaaggaagcgtgtgtttcgccttctcttttcaccattttcagttactttctctctttcatcttttaccattctcttcttcttttttttctctcattctgatcatg

SEQ ID NO: 9866 - DNA, 3000 bp, Unknown
  misc_feature (1)..( 3000): cDNA_ID_4266697_gDNA_ID_1974092_Annot_ID_180645 3000 nt of promoter + ATG
aacatgaaataaataaaaaagaagaagactggatcagacattatgcttattgtggtgtctaatctaacatacacatgtgtcgtgttacattcttttagttcccttttcaaatagaaaaacttttgtttaaagggacagccaagtgggtgagtttaaaccttttattcctcaaaataattagatcctgacaaattatgtcttaatccacaactaatctactttcatatatggcattgatcaatatctttatacactttcaggatgtaatggtctctaactctctctatatataagatatgctcgaatatgtagcaacaattgtaaacgagtatcatataatcaataagactttaaaaaataatcagaatcagattcttactaaccaattactgatgcgtaagaagagaaaaggtgaaaagatcataattatatctgatcttgctatgaacatattcatgtgaaaatagacagactttgatacgaagaaaactaaaacagagggaaattgatcttgtcagtttgtactataacttttgaattcttgctagatattttactctagcctctaaatgaaaacgtaaattttgaaggtaaacataagacgatcctaattataatttgtaagctaagattctcatataaataatatcagattagttcactcaaatctataataggcatagggatattggatgtctccacagattttaatcttgaaagagttccacaatttgtcgaagaaacgttttccttttggaattgacgaatgagtcaacttaattaggttagtctaaatacaagaaaattatcgagtgcccattcgaatttttttattatttttcaggaaatgaccaaagacttattagaagtcaagcacgaaattactcaccaaaatcccttaatctctgcattagtttatttctccctaaatttatattttctccatctaaatgattacggatccacctgccaaggaaaaaaaaataactgtgttacgaaaaaattaaaaatcaatacttggttggaaaactaaaactaaaaccgaacaaaaatccaaatatgacattcctattctaattcaacaatagaattaattattagcgttggaacaatctatatatagatattaaagctttgtgtgtgtaagatagaagagttcttaaaagtctatttgtgtgggtaagccattgatcgtttagtgactaaatgatacaacttctaatcccctttatcaaactttatccagtctttgtttagctgtacttttcactgatatattttctcttcttatgttacgtgaaaataaaataatactattgaaaagtaatttgattgatcaattccaccatgcaattaattaccagaactttctgctttcaattatatcttcttaattaattggttattatttcaacttcataactgaatagaatcccttatcgacaaaatgattactcttgtattgttacattattgtcattgtttccttaataattatcaatgatctagtatcataaatgttaccttctatagttaatagttcatgtactaagtactaaaacatgtgtagtatgaaaaaatacaacatccatgttgtaattaatttatagatagattcaagtatacgtacaacaataaattcttttgcagccgtaacgatttttttattttttattttttattgaataccagtaaattctgggccgaagcccgtaatcccctcaggttcgaaaccacagcatgtaatattagtttcgtcccaagcgtcattcgaactggcgacctctaagattcgcctaaggtctttactaattgagctacaatggataataaaagaatctaaccttccaacaaaaagaaatagtattactaaagtcaataagaacaatctatagccaaagaaaaggtctatgggtgttgtggttataagaactaaacaaaagtcggtcaaataacattattgtcttctctattcgttcaccggtcccgtaactgaactttgacgttggcagcctagttacttgattgatttctcatcatactaataaaaataataaaatgttgatacaacccttacataaatgtatacaacatctcgaccagcacgccaatatccctttctatataattaaaattcatcttctaaaatcattttcaagtaccattgcctatccaaactctatacgctatactacatgtaatatattaatgaccataactcgttttcatgacgtatacgtcgtcattgctcggtattattcgtattgctttttttttctgatgatatagaaaaacaaaaaaaaagacctactattgtcaatttttatatacacacacataatgcgagaattgcttcgtcactcctatcatctgatataagaaaaataaactagttgaatgcaaattttcatatctttttgtgttgattatatatacataatacatgaataaagaagttggttttttattaatttcgtggtaagtccgccgatttggcctttctatacgcattcaaacttcacaatactataagaaattaactcctcagttttattgccttcttgataagtggcaactggcaagtaagggtaattagtagtaacggtagaggctaacgaattcacacgagtcactgtcaaaataaaaaattgaattcaaatgacatgagtaaggatagattaacaaaaagaaagttgtaatggatagacgcacattgccaaattccacattatagctttaaaaaaaaaagtctgaacgaagaaagagttgcaattatttagtaatttcaatgatatggaacttgcaaattgtggaaattcttaagaacgtccccaaccaaaaaccaaaaaaaaaaaaaccaaaagcatgcaacatggaaccacatataagagtacccttctttacgtcaattatctttaaagcaagtcttcgctcttcaatttatattttaccaaatcatcttctctctttctctatctctcaaaacaaaaagtaaccatg

SEQ ID NO: 9867 - DNA, 3000 bp, Unknown
  misc_feature (1)..( 3000): cDNA_ID_3034296_gDNA_ID_1974092_Annot_ID_180643 3000 nt of promoter + ATG
attggttattcaacatataggattctgaatgaccgaaatatattttttctaatataattgtattggctgatagaaacttatacaaaccttttaaaagtttttaaattaacatcaatatatacaaaacatgattacacttacgacatcatgtgtgctgcataattacgtccacctttgttacaacattgctttgtttgtactgtaattcgaatcaaaattaccctcgttatttcttctgtctacagcatcatatatatacaacattttctattcttacaaaccattgataattatgaagtaatgaactaagcgcatcatgttcatgccttttgcggttgattattgaaatataaacaaaataaaatgatatggttgtttcgcactgcatgatgatcttacaagtcaatttcacccaaaaagctacaaacatagcaaaagtaggagtttcacgtcttcttgccatcacacagaatcaatatgttgaaacgtatcaaaagtttcttacattatatggtgcatacggaattaacatctggacctatatcatgcatgtttaatatgatgtcgtgttctaggaacgctagtggcaacgaatatatgatgatggttcatgcatatcaccgataaatgaacaaattatccattctgtattatattgatatatatagagtaagttgttatctgattgtggttggtccaaaaaatacatgaatgtttatttcgatcacactactacctctaccatcttggttttttccaattttttagcatgattttttatttacgattagatatatttctttaaaaaaacatgaacatgcatatgagtgaaagtaaattgacttgttagaatcgtcaatatttagttctaataattatatccattgctttaatcactttctatgttgatattattgtttgatcaaaaccatcagtataacctattatacaatagtttgatcaaaaccatcagtataacctattatacaatagttttgattcgttttgatctcttaggtttctttttagctattagaaacaaattcatagagactatagacattagacaatgataatgtagaacaacaattaatgttcctcaaatatcccataaaacctattgaatcaactggtccaaaaccaatacaacgagaacttattgtctacgtttatatgacccaaagacactaatcaatcggcctcaattagaggcggatttaaagacatcacggtatcatcatatccatgttactttttctgttctcttttttacttacccgtccatttctttcttttggcaaaataattttgctaaattacgtggcaaaataattttgctaaattacagcgaagaggatcacatgcatcagcactatttacaacaatcctttagggtatatgttagtcaaccccgtaacaccattcgtacccattaatcatgaacatttcgcaaagttttcccaccaaaaacggcgtcggataaggtttttggcattttgtgtttctttttttgtgtgcatagcataatttcattttaaccgtactattcgaagatttttaaattggataaagatgattcattcattacatagtcgctttgttgttactagtgataaattcatgttaatgattctatgattttcggccagctatctcattaattattaagacgtttaagtggagctattagcaatcgtgtatgacataatgattagcattttcatgtgccatgcccatgcatgaggcttttttttgtttaaaattttattctattatatccgaattttgttatatactaaatgaacatttgtctctgatttggtctactagttaattaacctttagcttcactaataaaaaatctcatgattttgatacttaaacccaaaacatattaaaaacaattagcagtcttttaaatcgataatgtgcttagatgattatacgttcgtaggaaactcttttgtttccaatgcatgttaagaactaagaactcgtatccttaagcaccaatgctttatgcttaatgcctcattagagatataaactgagattgactgtgttctgaatcatcataatataaggcacacaaagaacagaacaggaaatacttagcaatataataggtttccaataaaagtgaagaagaatacaataaacttttataaaaaaaaaagtatataataatttcacactcgaatcaaccaaatgtaagatgtcttgtccatttacacatcacatgagtaagtggattacagattgcaattgatgaaatctggatcttagctaaaaatttattacgttactatatacatcgagttttaagatgttcataatcacaaccacaaccacaagtttgaagaaataagaaacagagtaataatatatcaaataaaatttcatggctgatggaatcttttttctaattgtaggtccaaaaaagcctaaattaatggggaaacaaaaaccaaaattcaatagtaattttactaattatgtcttggttaaatagagtaaaaagaaaattaatcacaaacctccaaaaatcaactaattgagatcaaaacacgtgtcgcatgccaatagggcggtggatcacatggtaaaaaaattcactttaatttttgtctttcttcataattcatctcacagatttcaacttctcttttggattctctcaccgtacaccgtcggcgtaccactccccttccacaccgtcggcattaaaaatctcaaaccctaaaacccgtatccaataacccacccggtccaaccggttattcaaacccggtcaatccaaaattcgcctcggaatccaaacctccatacccaatctaacatggaaaaacctccaatcacaaacctccacgtggtgatcactcattggctcttattctggaatccaagaggacctttttagtataaagagccccttcgttggtcctatcaccttctctctctcacacactaacagaaagcacaaaaaacagagacaaaaga

SEQ ID NO: 9868 - DNA, 3000 bp, Unknown
  misc_feature (1)..( 3000): cDNA_ID_3034308_gDNA_ID_1974092_Annot_ID_180640 3000 nt of promoter + ATG
ataaactcgacccaaaaagttcaaagaagtctaaacatattgctgttcacgtgaaaaagacaacgacttaagaatatgacatttggtaaatgttacttgaagtcttgaagactactctttaatactttatcatcatcatattcgacaaataagcgtgtgcctgatttggtgtgatattgtatgtaccgtacgactctttcaaagtgtctccaacaagtatcattggatatactacgcggcaattaaacaaaataatgaaaaagctttaatttggttgaaatttttgccaaatgacgtaacctttctttattttacggcatagcaaaactataagtcgcaaatcgtacgtactatttcgattgtataaagattcaatgattctacaatttttctaaatcaaaaagttgttgaaagattcaatgattctaccatttttctaaatcaaaagttgttgtcgaacctccgtccgagtaaagattgagtttaatattattagttttatctaaatttctttttgtgaatttccaatagtcttcaccttaatttggacatctctctgatcatgctgactattaaattttttaacattccagcataaaaattgatcattttcagggattagtataactacaaccgttttttgtcaatcaattatataagatttattaaaccgaatacaaacgaaaacaaaacattgactctgatcgatatcacgcgttatggcggaataacgtttgtaatgcgattatgcagaaattttacttattagaaaaattttcatagtgtttagttgtttaccataacgtaaaaatatagaaattgcattttcgcctaaaaattataaataaatcattatgcaaataagtgaatatctatatagtagtttatatcattatgcagtattttattttgggatttattgcaaattttattgtgagacacatttgtattttattgtatacatttgtattttaaattttattgggatttattgcgaattttattgtgcgattatgcgacttatatcataatagaattatgtgatgttaccactcaaagtcattatcttatcacttatgaatataagttatgttatatatttatgtgaaatacatttgtacgtgaagttgttattagttatggttacgtatacattggtttgacacaggacagaaacatctaaaataaatgcagcgtaatttgcaagtactatttaatggtttcattgacatttgttgcaagtttctttcggtggatactgagtgatcaacaccctagaaagtaaaagacttcaaaagatttggtatttttattttgtttttttcattgacccatttatttatcactgtagagatataaacacgattgcaaaatatttatctaaatatacaataatgttttaatccgagtatataacaaattggcaagtgaatcagtgaattgattaaccgaatagtatgactcgtatctaaactaatacttaaaaagatcgatgttagagtatctccattgcaaatatttcatatggattatacaaaaataataaaaagtagaataataataaaacattttagctttctcaaatagtagtagaaacccacataaaaaaagtttctattttttctctataaaaaattttctttggattttttccgtactgaaaacttcttatattttattatttttaatatatatatttttattaactcatgtgagattttttcattttgcaatgaaaatgttcttattaaaagaaaaaaaaaattggaaaggtgaccaagcttgaccgatcgagctaagtcaaaagaacgcgtcttgcttgggtcatgttttggttgttccaagtggtatcgttttttttctccttttgaacgtcatcctcagtgatgtcatattttagttttaatttttgtttcaaatgatctcatatatatatatttttttgggcacacaaatgatctcatatagattgattttttttgtcacccatattagaaattagaaaacactacactaaatgcatgctccaaccacatagggttaaaagtctatgtcattgactacgaacgatgactccaagaaactaaatgaatatgatgcaaacaaaatctttattcgtcataagattgcgattatgtataaatactataaggtttaccggatatttcatttagtttgtcttaacctgataattgctctactagtggatctgccattgaaacaaaaaggctttccactcaaattctctgaggttgcacttgcacatgcatacaaacaaatattcttctaattgtttgcgcgtaagaaaaagaaaaaaaaaactatatccattattgagaaaagtagctgaaaaataaataaattaatagacaaaaatgttaatcaaaatttgcttttgagtaaaaattaaccagttgaatgaataaaatataacttctacagaaggtataagagtttacatgttctaatcctccattaaacaattataaaatacccacaaaatctaaaacttttaggtgaatattcattaatgaataattgaataccactaattaattatgttaaattcatcacaactttttcatgatacatcacacataaaccaccataatataataatgaaagaaatgtgaatttggttgaaaaaaacaaaagaaaaaagtaaaaaggttgaagcaagagactgacttttatccaaaaatgtgcttgaattttaattaaaaaacacgaattcttcttgactttcgtttcaaatctaaatccttcctcgcataaactcttccctgaatcaaaaacccattctaataaaaacaaagacgatctcaaacacgcttcttcttcttcctcattcctcaatcatccctaagacgtcacctcacttaaacccaatccaacgccgccgaaccaaaatcaacttcttcggttcttccccaattcaatactactttctgggtcgtcgttaaatccctaaatctctctctgttgttaccttcccatggg

SEQ ID NO: 9869 - DNA, 3000 bp, Unknown
  misc_feature (1)..( 3000): cDNA_ID_1989710_gDNA_ID_1974092_Annot_ID_180637 3000 nt of promoter + ATG
cagaatttaaaagtgctcatgagaaacatacgtttcagttttcactctcaaaggaacacatttttggtcaactcagttcagttagtttgaagacttgaagttaagaaaactaaattcaatcgaaaggaaaaaaaaactttttcacttttagtttcttttactttttcagacagcttcgtgacaaaacaatataattggttacaactgaaaaacaatcaaaaagaagtttgatgaacatattttgaaaaatgagaaagaagggggttcaaatgttagctttaaaaagattcatatgagacgacaaaaaaaaaaaaaagaaagattcatatgattttaatgtgaatgtgatccgcaaataaataatctaatgtttttttaatagtacaatggtatcttacaaaattaaatgctatttattctatagaaaacttatttttgctaaaaacgtaagatatacatttctaaaaaacataaatttatctaaaaccagattggatttaaaaaaaatagtaacaagtatttgaacctaaaaaaaaaaaaaaaaaactcagataaacagaaatcacctttaaaattacttgatgttttttcttcttctgttaattatacaaatgttgtattactaattatacttaagctgaaattaaacgggattgtggttggagacttggagtgtgtgggaaaccaattcgctttcaacatgcaagcatgtaagtatgaatgctctcattattatcacgttacgttcgccgataataaatgtatttaatttgtaatacaagtataattagtggtaacgaacacattacacatgaacggctatgttacttacttggccattaattccgttgaccttaagagatggcatatttatgagtttctttgactatttgtatatcgacaacttctccaccaccataggcaccactttccattttcttttatgccaaaactatatcagcccacttaaatcaatattttattcacttttatttatggatttatgaatcacacaattctccacaattctaaaattaataaattttgaagaatgaacataaaaatttgttaacatatatcatatattacttgtagatccttctttttggaataaaataaaagtgttgttagcgtcaatatacttcaactttgttaaaaatgagtaaatgaccacaaattgtgaaggaaaaaaaagtagacttgatcttgatttgtcgattgttgtctttcttcggtgtgtttatgattacctaaggtgacaatgaatttgaaggatttccaaaactagagctgcggaacaaaactgtgacggtaggtttctcctagctagtagagaacttggtttagaggagacacgatttctacagatttgctccatctgttgttagtaaactgccaatgctggttttagtgtagtaataacaccgacgtaacgttgttctctttatcaaaaaggaaaaaacaaaacaccaactttattcactattccttccaagagtttgtagatatgcatatatctttcaaagtggagatatttggtggaacatgaagacatttggtgactgagttcattgaaggttttaaggtagggaataacgtatgcttaacatgatgcacggtagcacgtcatctgtccgcaaaatgaggttgtgattattccttgattccaaaagttatttgacactatttgtctattcaatacaaatcgctactcctgatttaataagtgtccctttaaattaattgttctatttttttaaaaattgtcgtttctttataactttgaactatttttcaatttttgtgtcatctctaaatagagagactatactaattttctctgtactatttctattttattggatactccaaagatatgattactgttttacgatttaatatataatttttaacaaaaaaaaattaaatttattcctatttcatattaaagaaaattcaaaatatagtcaatttgttattaggagtataatagaaaatttaatttattttgttaataagtttattgaattgcttgaaaatacaaaatatagtcaatttctgattaagagtatataaaaaaaattagtttattttgttaataagtttattaaattgcttgaaattacaaaatatagtcaatttcttattaagagtataataatagaaaaacattatactattaataattttattaaattgcttgaagttacaaaatatagtcaatttctattaggagtatagtagaaaattttaatttattttgttaacaattttgttaaattgctttttaatccacatgaaaatatccaatctgcaagaagtataaaatcatcattttcaaaatatagaaagaaaataatggttttgaacattgaaaaaaatgatcttattgacaaagaaaggagctttcgacttttggaaacataatccaaattttagataattatgctaatgtatctaaaaatcttaaaacaggataattataatacgttagtgtcatcattatcatacatttcaccaaaataacgaaagaatagactagcaacaaagatttgattttctgagaatatttgttccaatccaaagtaaaaccaatcagaaaaatagaaaatttctatattcacggtaaaaaatatatattttaaaaacagaggctgtgatattttttacccatcatttctagaattttggggaaatgcaaaacactaatccataaaaattaaaaaataattaaactaaaaataaaacaaaacaaaaccaaatcccaaaggattggtccaaaatctgtgtttacaaaatatcaatggcaatttcgtagtaaagataaaaaacaaggatattgtttttaatctttctattaccctattattctcttatatatatatactcttccctccggtcaaatctcgtcgtcttgtttggtctctgtttttcacgccggagatagagagagagaagtaaaaaagcgagaaaaagctagaaactttagaatacccaata
